United States Patent 9,328,346 (POLYCOMB-ASSOCIATED NON-CODING RNAS) - sequence listing, part 56

SEQ ID NO: 12057 - RNA, 219560 nt, Mus musculus
aaugagacuucgaggaggagcgggaggcggcggcggcggcuacagaggacgcggaggaaggcgaggaggagccagaggaaggagcacgggucgugcguagcaucgcagccgcccggagcugcuggccugguguccuuagggacugcccgagucccccgcccgccuugguccccuccucugccuggccagccccgccccggcagccggagcccccgcacucggcagccccacuccagccaaguugggauggggcccugcaaccacugcccggcgcccgagaggccaccugcaugcuagaggcaaacuuuugucuccucgguaaaguugcauuggccuucccacccuuccuuuuuucuuuucuuucuuucuuucuuuuuuuuuuuuuccuccccuuacucuugguggcgaagcacuuccuagccuggccagcuucggcugagaugcuguggcggucuuggagugucucucauccguuuaccggaaucgagaucgugacacugauuuuaggggggccggcuaaagaaggcaacccugauuagugcccugguccagcagcggcagggcuuaaggaggaucuuggggaucagaacucguggccggggucgauuuuauuaccacagcccuccacuugaggggaagugcuucuuguucuuggguugcucggguaggccggucuuugaccggugguaccgcuuggagccuggaacuguuugggggcgacgugggggcuggggugcgccgaagcucccuuagaugggcagcugggagcgcgccugugggacugugcggugugcugcaaccgccgccggccacuuggaaacuugcaacucuacuucuccgcgcugcgaguccgcguccaggagccagucuuuucuuucuuccuucuuucccucucguugaacccuguugccccuucccuccgccgccagucucuggaccucgguucuggcuuccuuaccuuucucucuuauccuaggucuccagauccccuugacuuccagaauggauccacgcguaauccuucgccgagggaucgguucccccuacuccucgcuuucauccuagcccccacuuaacaccccccaagcaaucucucaacaaguauauuugcugaggaauuugaaaaauccacuacugcaacuugaucugugugugauggaugaggagcggcgcggacagaguugggcgccaauccuauuaaggguuuagagagaggggagcguuuuuuuuccuccgggauuggggguggggggagggaccgugugcuugagugaguucgagagggcucccgccgcgccgggagcuggaaguccacccaacugggcuccuuuucagcccggcagcaauugcucucauuuccuaggaaaccugacuuuuagagcuugaggacacuaaggauggagcccuugcgcuucaccucgagugaccuggcuacagagacgcaaggaguuuguggggaucccccagggcgccucuccuuccaggcuuugugugugugucuguguguguaacuguccugugauucccagagccgaucccaguuggagcagggguaggagagacuucucuugguagucucauccuucagagacugggaagggauggguucuguaccucucuguuccccagcuggggcauccuucaucuugcuguucgguggccgcacgauguccugggccccuugccccuccgcccucgcugggcguguaaagguuuaauccccacagcuucagauaaagggaacaguuguaaaacgcucauaugcuguuugcagacgaggcucugggggauguuggagaauuugaaaguaaacguuucccucgcaagcggcauaaaauaguguuuaaacaaauauuguauuggcaugcuccgggggcucggugccaaaaaagaaaaguaaauaaacggugaaauccaaaauauacagcacgggggggauagcgggcagaauaggcgggcuugucacaagucucccugauguuaucuguuuguucuagccaccucuccuucgagcccccuccccgcccauuuccucaccuuggcugcgguuucccuuuuugaguaggcuuccgugugucugggggacuagccccuucaauggcucaguuggucuggaauuggggagggaauacauuguguuccuaccuggauuggucucccccaaguaggaggaaacauuccugaugcuuacucgcuuugaguuuugaggcucuugcuuucucccagcuucuguucuauccugggcacuaaucccagaaugucuaaucuaaaccacgcagaccccuccugcuaaaggcuucacuccuagagucucuacaucuugcuuucccuuucuccaaccagcuccuucucucuagaggguuccaagaguuggguauggccucuucaggauacaguuucuacucagacgcugccugcuguauggaaagcucaccugaugaguuuuaacauuaauuauguuuagggagacuuaggaugcccccaaaugucaugagguauuuccugauucuagggggcuuagagucacaacacacagaagaagguucuguguacugugcccuguaggagaucugcucuugucuuuguccuguaucugugggagaggccgaugggaagcaaguaucuucccacccagggcuggacuccuccaugaacgaacugggacugggauugauagaucuguuucugugcuuaggugggaacugagaugguggaaauaugcacagaauucagacucacugaggucuucucccaaauucaagccgggcuugcuuggaaggaggaccaccuugaaguguauauggaguuagcuucacuuucucaggauguuccuugggccuugcaggcuuggaagaacauugagcacugagcaaucaaagagggugugcuuuugaguugcauaauuguaagaggguguguuugugugugugugugugugugugugugugugugugugugugguuacuggucacaggcucauuuccuagcugcugugggggucucaggggcuguguucuguagcuggcuuguuugcacugcagccugaaaaauacacaaauacuucacucuuuuuuuguacuucuacaagagcccuguacacagugcagccccuggggcuggauuagugaauccgggacagucugcaagcaggcagacaaaauuggauauuugccuacacuaaguacucuucuucccucagcauuccacucccggaaaacuucagugcccagacacuagcaguucccuuuaaaugagaccaugagguuguuguaugcacugugaaugcggcugugaccccucacacccagcuggcuuguuaaagcucaaaaacagaguccuaaaaccuugugggugcagcuggccuucgcuggugcaaaccgcagggaacaagguggggcugcuuucccugugucuuuaggcgggggucuugggugggaggucuaccuguagccuguuaacuggcacaucaggggccagaggccagguggacuucacuguggacagcugcagcugcugggccagggcccauugaaagggaaccccagggaagcaacucccuccuuucuucuuuucacuaagcaucagaggcauggacaugugaggaaugccaacuaaagacuguguucucagauucuagaacaccaggagggguagagucggugacugggucggcagccaggcuacccagauacuuagugcccagcgugcucucauuuuuaaagaacuuaggggaagagaauaaguacucugguguccuuugcugauagguauggacugagguuagcagcaguggcugucagcugaccgauaggaucuuagaguaaagaagaccaccuucucuaugauucuguggcuuucaaguaaacacagcuccauccauacucagcacuugucuuuuuuuuuuuuuuuuccaaaucugaaggcuuguggaaaauguaaaggacuuagaaaaugaaaacuuuggccauuguuuuuagauuuuugagggugacaaaagugucacuuuuaaaacacacauuuuaaauccugggaaaacccagggagaugaccucucucucggagaggcuuacuguccugaauccuuccaacaacugaagaagucuuguuucuacuuagguuuuccuucuggcuuguuacguaucauacaugagcugggaaauaacucuuucaagaugugaccagacaggacccauuaauuuuuuuuuucuuuuuucgggacuuggguuuaaauagaacgaaucaacguggguuucuuucuuucuuucuuucuuucuuucuuccuuucuuucguguguguuucacaugugugucuuuuaaaaaggcagguuguuucuggacaguguguuuuaacugagugcuggguuucaacauuagcauaagaaaaccacuuuuagugcuuuggcuuuuguguugaaugaggaguugguacuaacgggaggcacgcugagaagggugauggcccauugagauucuugcggcagucccugcuccuuugcugccugcggaucugggaucagauaacacuuuuaucuugccuuuucccaauucucugcccuuuuugguucgggcacuuuuguccgaguuuauugacugcuuucgucucugcgaaucuguggaaaauuuaaugaaccucaaaccagcaaaugaaauaaagagaacuuuuuaauuuaucagcccggggcuaggauugaaucgccucuuugggugcagagggucccaguccuccagugagagaacucaggaaggccagaggguggucccuauacagacuggauucccacucaagggaacguaaaacccggggucucagaggccgguggccagucuugcugcagccccccagccuuuuccuccaggauccaggcucugagggguuggcauggguggaggagagacaguugcacagccugucucugcccucugcuuucccugggacacaguuaaguaucucccuaccucuagaccuggcuuucacccuguaauuaggcaaagccccgggugugauuaaagcugcugacuuggcagggcuuggaguccuuuuucuguaugagggugaacucuugcucuuuccucgucuuacucggcccucauacuucuggguugcugggugucucacuuauucuuucuucccgguuuaucccucucucucccucccucccucccucccucccucccucccucccucccucccuccuuucaaucucuucuguccuuuucuccccuuccuaacuuccucucucuuuuccccaucguuccuuuucuucuucuugucuccacuuucuucuccccugccccccuucccauacccucuucaucccuccuuuccuccccugcuccucuuugucucucccuccuccgccccacccccgcccgucugccccgccccaucccuucccgccccgccccuccgagguuccgccgucccgguggggccgcgcaggccgcguguccgggcggcgccaagcgcgcccggucccgggaacauuccgugcccgagcgcccgcggccucccaccugcgcgcccgcccgcuccgcgcgcgcaaacaauggccacauuguugcggcggauggcgggagccgcccgggacccugcucguggcccugcucguggcugggaaggaagaaggccagagggccaaguccuggcgcccgccuggggcauagugcccaccugagcccggggccgacacggugucccuaaccuuggucuccuuccucaugccuuccgcagaugcucaaguuuagagaaucggagccuuugaugagggaggggggagagagagagauccgguugcuaaacuuucagggguguuugaaacuuuccuuaagacaucuguaguguguagcucgcaaggccccaaagcuaggaagaaacgggcucuucuccuggccaugcccauucguccugaccucucagcuugcauaaaaagaucuuugaacacuuaggacagaauguuuaaaagaacaucgugcagggccucgcauaggccccuuucagccccugcuuaacgcccugucuuugugccuuggacaaugaaauaagucaggccgacguuggagccucauuuauaagaaacuguaagggccgcucaaguacacuugugcuaaguugaauugauugaaguuuaauggcgguuaguggcgaugaaugguaaugauuuuccagcguaucuuuggcauacuugacauuaauaacuggagggagggagggagggagggagggagagagagagagagagagagagagagagagagagagagagaggaggcuaagucugccuggagccugccacacacacacaggaggcagcugcauuaugcaucuuacuacaugucaguccauuccucagauccuuucccuuccugcuagauugcaguugcuugaaugauuuacacacaaacacacgcgcgcgcacacauacacacacaccaaaaaaugguagaaaggaggaaagaaaaaucuuucgccauugacuguguacaucaugucagcauaaauuugaguucgggauucuuuuuucuucaauucuuacauaaaucagcuucuaauauacagaaugugaugaguuuguuuuagauggcaucaugaauuaaugguaugcaaaucgaagcuuugcagguggaaugauuuacuuaauaauuucaauuucuaauauuuaggcuuauucauuaugcugggaguuuuuuaaaagguccauauauuuuaaaccgaagauggggagauuaguaugcaaguguuugcaguguaggcagagauggaggacuggaaacagggccuuaacuuguuacuuuuuuuuuuuuuuuuugagaaucuguaauugaucaagcauuagccaggggagcuagggaccgacccaguguggucuaggggaaagacacagaaacucacugguguaauaugaaguguggaguccaggagugcggcuacggugaugcugggcagagggagcaggguugugguguggguggguucagaugccucugcggggcuuucacuucaaacugaagaguugcucauuaaguacuugauuaugaaguggccgugcuguggaaccuggggcugaggaccacccaggcaauucauggaauuucuuuuuuuacacaggguguuuuucucggggacaagcggagacagagagaaaagugguagauggauggacuuuguagagagaucagguccaacuguuuguguugcucucaggaagaggagcuccagccgcacuaccacuguuuggugacugugcacaugcuccuuuccuccuuguuuccaccccauacaagcaacugaaggaagggggcuuuguuugguccacaguccauccaggcagagaaaucacggugaccgggugggugcgguaacucagcacguggcacccacguguaggaagcagagagcaaugagugcugguacuaagcuugggguguuuuucuuuagucuagaacuccaccccguggaaaugaugucucccgcguuuaggaugggcuuuccuaccucagcuacccuaaucuagaaaauacuucacugacagguccaaaggcuugucucuagggugauuuuagaucuuguggauaaucggugucaaccaucauauggugaagggggaagguguuggcgaaugcagccuguuuuccccaguagccaacauguccugggcaguagggucaggacccagaaucagagggagacaggguuguggugggaguaaccagcgucugggaaccucuggggucuguggcaagggauuugcuuucccaucauugaucucuccugcuaggcagcuucagaauucaguguagcuauaaggcauaagguucucacccuuccuaaggcugugacccuuugauacaguuucucagcccccaaccauaacauuauacuguuaugaacucuaaacaucugauaucccccuggggaaaguguugauuaacccucaaaggggucaagacccacagguugagaaccucugcacuaagguauagugacuggucaaagggguagguagaguggucauggguauccugauggccacuuagucagagauggcccuuuuacacuccccugaaagcugaaggcaguuuaggaagggcugacacauaaauaugucucagaucuuuaaagaugaaggcagcauuuugauuuaaaaaaaaaaucgaggucgcaaacaugcaaugacggguugaaggcccaccgcuuagacacuuccacagacagcccugggcugugccuuugugaugcaugguguguguccaggcagggacagaauauuuagggcugucccuccuuaucuucaagagaucaaggagaggggacagcucugaugagguuugagggcaagguauaugcuccacgucuuguuuaugcccagagagaggaagucagcagauccaccaaggccucuuagguaugcagaucaggaauggaggggaggggagaaagugagguggauguuugucuagagaagaugaaguguguaauagacauaauauaguagguuacacugggaauagagucuguuccugggcucuuuguacugguaaaugugaggagagacgugugaucuguguauuuaugcagaaacccguuuauaucaguaaagccguaagugucggcucucugugaaucggauuguuuucugguuuuaagauaaacaagagauaggaguggggcuggggaacguggcucaguuggugaaguauuugcaacaugaggucuugcgcuuaaaaccccaguacccacagaaaagccaggcuugcccaggugugucugugaucucaggucuggggaggcagagacuuggagcuuaucggccugccugccucaccaaguugaugagcucgauguuucaaaaacuaagguggaggcgauggcucaguggguaaaagugccugcugccacuccugaugaccugaguuugauccaggagacccacguaguugaagaaggaacugacuccugaaagcuguccucugaccucugcauuccugcccacauguacauacuuaguauauauauauauacacacacagagagacacacacagacagacacacacacacagacacacacgccaaauacauucaucaucaucaucaccauaaaauugaggaagucacuugccauugagcucuggccuuuucuuguauaugugcaauguacacuuacaugagcuuguacauaacacacacacaugcacacacacacacacacacacacacacacaccucacaaaguaagugaguagcagcagagcugaggcugacugucauagauugucuucaaguggggcuccugggccacucaggugcgguucaggugggaaccauuaaauaugcagauucucagccgggggcgggggggaggggaauccacugcaugagguuugccucagugggugccuuuauuaggguggaugauggaagaccaaacuuuguuuuaagacagggucucauauaucucaggcuguccucaaacuaaaaacauagcuaagauaaccuugaacuuuucugaugccucagcauuaccuuccaagagcugagaauuaucggggugugcugcauugccugauuuaugcagugcuagagaaggaacccaggacuuuggguaacuuaguauucuaccaacuggggcuuuauuccugguuauugucacuuauuuauuuaagauuaugauggcccuuagauucaggacaguccaggacuccuuuaucaggagauuggaagacuuucaccugcuuuguccacuguugcuggacuggguguaauggucaagcagauuaagugaggacugaguuguuucuggaccaaaauagcacagagaaaugaucucuagggcuugcaggauaaaggcaagacuggaagaucagucugguacucagcaugguccaucugaggguuaggauccuuagaaugguggccuuauuggucacugcagucccgauggcuguagagaggggguguucucauaacuucauuuccguugcugcaaauauucugaugaaagucgacucgggaaaaaaugucuaucuauuuggauuauaauuuugaguuccagcccauuacuguggggaggucaaggagguggggaacuugaaacaguuugucacaucacauuacagucaagaggugagagaaauaaaugcauagaaggugcuugcuugcacacuuaucuguuacccagucacagaguuccuaccuaaggaaugguaucauccacagugggccucauccucuuacaacaaguaacaaucaaaacaauucccaacagacaugcccuccggccacccgaucugcauaauucaucaauuaagacuuucucuccaagugcuuauauguaugucaaacugacagcuaaagacugaccaucacagaguuuuaaauaccugagggucugcccaugugagcuagcuuuugguucucugacacauaacauagcuguguguaugcguauguguguuccugagauuagccuuagcugcuucucucagauacuguccaauucacuuuuugugaugggcuuccucaucucauagccuguagcuuuucaaguaugcaagacuggcuagccagcaaaucccaaggacccaccugucucauuuccuuaucacugggacuguaagcuuguaucacccauacauggcuuuagauuuucauuauauuuaucuauuuauuuuguauguguuggggguaggaugccauaaaugccacuguaaggauguggaggucagaggacuacuugugggaguugguuaucgucuuucaccauuuugggaguggggaugucucaggaaucaaacucaguuuggcaggcuuggcuacagugccuuuccuaaugagccaucuugcuuucuccacacccagauauuuaugugggauccggagaaggaauucagguccucaugcuuauaaagugaguacuuuauugccugaguuaccuccucaacccaaggaaaaacuauuuauuugauaggcugaauuugugauguacaggccaguccucauccuuggucaggggguggccauggggagggccuagugcaucugagagcaggauucucaccugacugcguuuauggacuauuuauggaguuaggcucccccaaggguagauuuuuaaaggaggcagagaaacagacaggagguacaagcguuuaaggucauccuuuucucuaaagggaguuugaagccagccugggcuaaugagacccugccuuaaaacaacaacaaaaagggcagagguuuguauacauauuucuccaucuauucacccucccuccacccauuuaccccuuaucuucuccauuuauauauacgaugugaauuaaagcuccaaggcaaggccugaaugguucacucaaagcaaauggucggaaggcuggagccaggucugcuggacgugucucaggaggcauuuuggcacagccggcuagguugaugguaucaaauggucagagaccaugacaagagacuauccagccugaaugucacuaugucaaagugcugcuaauggggaaucucuaugggugauggucacaagcagagccugccgugggugucccugaugacugacauccaagaugcugcugugagguagguaucuaggggucccuagugacagcagguacagcuuuuuacauacucuguccucaccuguaagccgugucuuuucugugcccuguguuugaaaugguguggccaaugccaucaaaaggaguuccuugugucauccaucaggcaaucagcugauacuggaacaucuguuaggugcccugugcugauuaaacuucagcaccacaaacaucccuugcuagccugcuuuagcauccagaagcugaaaucccaggcuucucuaagucuagcaggggagcugagcuauggugggaaagcuagagguaucuagggucauugugaaaggugacuuuaggagacauugcucaguagggaauccccuacacuguugucccagggaagcagaaugggguuauuuuacuggcgacagacuggcaaagucccuagaacauaacagauuugggauggguggucccugggagcucuuagguagggaaagcaagaccugagccuuagccaguggcuccuuuuugcaaauauuuuuaaaaauaucauuacuacuauguauguauauauguaugaaugcaugcaugcaugcaugcaugcaugcauagugugugugcuuguacucaugccuugaagugaugaugugaucagaggacugcuuauaggagcuaguucucuccucauacuaugucggucccuaggauggaauucaagucagucaggguaguagacaagcaccuuuacccacugaaccaucuuacccgcagccuuauccuuugguuuuuguuuguuuguuuguuucuaccaucucacgauguagcccuagcuggucugagaccacuauauagaccagauaggccuagagauuuucuugccucugccaaccaugugcugggaugauguguauaugccauugugcuuagcuggcaaaugcuucuuuaccuaauucaacaguggugcugagcagcuucuucccacagagcaccaaccuggggcuguccaguagaguggaagagaacaaggauagccugggcagaacaguccucagggacagaagccgaacaggaaguagccuucuggggcaugugugugugcgugugugugugugugugguagugguggugguggggauuugcaacuugugaugcacagggcauugcagaugugugauagcuaggugguagaguagcaauguccugcaaaucucugagaguagaccccuggcaauauucaugugcaauaauuguuuuuccuucaaaacaagguuucucuggauaacccuggcuguccuggaauucacucuguagaccaaguugaccucgaacucacuuagauccaccugcuucugccucccgaaugcugguauuaaagucaugugccaacacaucuggcuugauaugugacuaaauuuaaauuaagcuccccaugaccuuuuuauucucccuaccuugaguuugggcuggcagaguuuggguggguggugguuuugauauauuuauuagaggcggugucucauguagccuaggauggccucauacuugcggaggaugacccugaacuucucaucuuccugccucgaucuucagagugcugugguuccagguugauguggugcugggguucaagcccaggcuuuugugcuugcuggggaagcacauucccuacugggcuaacagucccagccucgaggugcuucaguucccccuuuuucuucugagcgggucccuuacaacuguagaaaagagggaauuccuagcaaauguguaugccaaacccuguguguagguggggcugaggggagguagggagggguugccccuaccuguuccugcgccuuccuggggagagcucuccaugauaaucuguuggaccaguuggagggaauggcugguggggaaauggggugaaguugguucuucaggaauggugucaguguuuuuagaacagugguaguugccuauacaucaucuguccaucuggcacucauccucugccccucccaccuacucauucuuccaucaucaaccucuucguccuuugcccagccucuaucuacucuugcaugcauccacugucuacccauccaucuauccuuccauucucccuccaucauccccuauuuuucucccacuugcucaucucccacucaccuuuauguauccauccauuacucauucaucugccuuucuacccauccaccuguccacccaccuguccacccacccaucuaccuguccauccacccaccuauccacccacccaucuaccuguccauccaccuguccauccacccaccuguccauccacccacccacccauccaucuacccauccauccacucauccauccacucaucuaccauccaucuauccaucaucuauccauccauccauccaucauccaccauccauccaucuguccauccacccauccaucuauccauccacccaccuguccauccaucuacccaucuauccaucauccauccauccauccauccauccaucuacccacuaauccauccauccacccacucauccauccacucauccaucauccauccaucaucuaccauccaccuauccaccuaccuauccaccuauccacccaccuguccauccacccaccaguccauccacccccacccauccaucuacccauccauccacucauccauccacucauccaucauccauccaucaucuaccauucaucuauccauccauccauccauccaucuauccauccauccaucauccaccauccauccaucuguccauccacccauccauccaucuaucauccaccauccaucacuuccuccaucuacccauccauucacccauccacucuuccauccuuccauucuccauccagccuuccguaauccacccaucauccuugcuuccauuauccaucuauuuuuuuauuuauccguccuugcauucugccuccauucuuuagucauccacuuuugaugauagggaauggccuuuuguguugaugcucagugugcccucuuuuccccacuaaugaagccaacacucacuucuucuguggaguccuccuauuuuagcccuaggcuuucaagcuccacugagguuuccuuacuuaagagcacgaauuaauguugucuuuuuauaaucuguuuauuuguacuuaguguuugauaagugugugugugugugugugugugugugugugugugugaagagggaauauuuuucaaugagggaaaugguuaugcauuuccuuugguguuugucuuaagaaauccaagcuaaccaggcagaauccagguuggcuuucuugaucugggagagcgagccacuaugacuaaugauugauuuuuaguguuguaauuuucaucaucuaagcaugugcuacaguuuguugggccccccacacagucaguaugggaugggaagcagcuguuuggauuccauugugaugggcagaagaaacuagaguuggagacugguuuugcauuugagccacuaguuacaggcaggccacugucccucuuugauccucuugugguuuguuucauagagcaauuccucucucucucucucucucucucucucucucucucucucucuuucucucucucugccacauguauuuauuuauuuuguuguguaucaguauguaggaacaucuauucuaugaaacaccaugaaggucugggcaucuaacucagauccucagaguuggugccagcaccuuuaccuguugugccaccucuccagcccaucucugucacucuuuaaguugucacauuugaugccuggauuucucugucugugauuagaaaggguugugcucauugaaucucauuuuaccuugccuuugguuaccugauggaaagugccacgcccuuggaugcuaagcacuuccaggauggaagucaccuuggagaucuggcuggucauaggccauguauggaaugcguucuggugccugguugugagccuguggauuuuacacaugccacugggucuuugugguauugauggcuucgcucaaguuccaaaacauaaaaugucagugcauaacucccuccuucucugggguucagcucugccauauucuucuggggaagagguggggcagggggcggagacaagagaguggagggaugaagucaguagaaggguacagcuugaucugggcagggaagauuccagcaauccagaaugugguucuguggucacaguuagucaaguuccuuuacugcuugcuccaagaggaagcccacccacuugucccugcuguggucacuggcucucugaagagaggcuauaagcauuuccuuugagcuuccccugacuguccccccuagacuaggcuacaacauggucaagucuaugaguacccucucguccagugacuucaccgaaagggauuguccagauaggacgggugcuucagcugggacaugccacuguggguggguuuggcucagagcaggcccugcagacagauuaugaagcaaaacaagggcaccuggagggcuggcauugucauuuuguugguggaacgcuugcuuaucaugcagaaagcccuagguucagucccaagcuccacauaagccaguggaggugacucacacuuggaggcagaggcaggaggaucagaaauuugagaucaagcuggggagaucacuugcaaguaugaggaccugaguucaaauccccaguauccaaaaaguugggcauggccaugugcacacaucccauacuuauacaccccacaucuccccuccccacacaaggaagcuuuucguuggugaugagacagucucucuauuauguaguucuggcugccugaaacuugauacguagaccaggcuggccucaaacucacagagauccacuugccucgaugucccuaguucugggacuaaaggcgugugccaucaugccugguccacaaaagaaccuuaguaccauuuuuuuuuuuaauuuuagaguucaccauuuuucucagcuauauagaaguuugaggucagugcgggcuaccaugagacccugucuuagccuuucucaaacgagacgaacaaacagggaugaguguggcuccgucucacagaggguaugaaagaguuaauaugugucaagugcccggugcauaguaaaccuauacaucuuggugauuguuauuuagaaggcagccugaguaggccuggggccucuggcagccguaucauauggguggcgcacuuaaacuacacuuaguuaagggcaauccucacucuccagggcuugagcugcuagugcacaccaugcuuccugccuuccugggccuucagagcucaguugcugcuaaaaguuaucuuggcagugaguggagccgcccuuaccgcaccuacaccagaaugcugugugccuuucuuucucuccaggagagggucaagccuuggcaggcaggauuucuucuuuccccgauuuacuuucuuuccuaccugcuuccccucuuuugagacaagguaucuaaggauuucucuugcugugauaaaaacaccaugaccguaagcaaccuggggagaaaaggguuuuuaguucaucuuacagcucgcaguccaccauccagggaagucaggauaggaacucaaagcaggaacccggaggcaggaacugaugcagaggccauggaggagagcuguuuacuggcuuauaagccaggaccaccaaccagcccagggauguucccacccacaaugggcuagacccucccacaucaaucacuaaacaagaagaugucuacuggacuugcccauggggccaaucuguuuguaacacuuucucaauuaagguucuuucuuccaaaaugacucuuacguugugucaauacgaccuaaaacuagucagcacacaagcucucauguggcccaggcuggccucaaacuaauacgaaacagacaauggccuuuagcuggagauccucgccugccuccgccuuuugagagcagggcucgcaggcaugugacacugccugauuucugcugugcuggagcugcgacucagggccucgugcauggucagcaggcucacucucuguugagccacccccauggccuccuuuacuguucaugcuccaauuguuuuuucaauacuuuacguuggucuguuuugugugugugcaugugaguacauacuugccguagcaugcacgggaagaaggucagaggacaacuuggggaagucaguucucuucugccaugugggucucuguggucaaacucaucuuggugacaagugccuuuacgugcugagccaucucuccagacccugggcugcuuugaagauuuucuguguuucuaguuuucaaacugauuuugugggggaggggcaaaaguggcaauuauucucccuaguucuuccuucuccccuccugcugugcuggggacucaguuacguguguguuggagagugucccaucucuuucauaguagacgggcagaagcuccugucaucccuaagcguucacauccaccacaggucaccccggguccagcucugaaagucugacaggucuucuuacgucuccugaguucccucuuaaguucuggaacaugugguuugcaugugguuagcacagcuucacauucuugucagcucccguuaacagcugugucuucucuggcucagggaugguuuacguauuucuuuauucaguauagauuacauuuuccugccgccuuuuggugaggagcccaugccggagaaucuugguagauucuugaugcuguaauuuucugcuauuaauugguuaacuuuuuuuuugcuuuccugaaaauuuuauguuuucucugagaugugguuaauuugcuggggagggaagguuaaucuuuuuuuuuggggggggggauaggggagagcagggucucuuguggcccaggccgauccuuagcuauguagccgaggaucaccgaggaucaucuuuaacgugugaucccugccaagugccgguaugacaagugugagucgccaugccugauuuauguggcgcugaggauugaacccagggcuuccugagugugaggcaggcccccuaccuccuaccuguaccuccagcucaaaaguuucaucucugaaguuguguuaauugggaugggggugggagcugcuuacagguauugauucuuugcauccaggcauacugcuucugagcucugugcuuucugaggccuggcuggugggucuaagcacccguccuuaagugugugucaagcaccauucucuggcagccuucagccugcuuccuucucgguacccugggaagaauagaaccuaauugaguauauucuacagggucucaagacccucacaucuccucugugauaccagcuugaaucuccccucucugaaguugucaugcaaacucuggcauccgugggacucuuuaggugcuuacugucuccuccacccagcaaucugcugaucugcuuggucugcacuagaacugcaaacucuuuccagacaguaagcugggccuccucguagggcucaccucccuucacugccuggcgugcuuuaaauguuuugucugguuuuuuggugguuucgggugggagccuaaaucuggucccuguuauuccaucucggccagcagcgggacauuuaauuugcauuuuuucucacgaggagagcuguucccauuuuaaacaguggaaaguauuccacgguccugcgguccucaccccugaguguaucuguggagggugugaggugcuuacagcugggagggccagggacaccucaccuccgucccugaagcagaggccucagagaacaugugugggcuggagauucguguuuugccccgaguaccacaggcaaccucagcagcuuguccaagggcugugugcacagcugagcgugggagccuccucagaacuacaaaaccccagagugcuugggcuugccagugaaggcacugguucaagauguugucauggggagaaaggggaaagaggaagugggaagggccuggugugaauggugcuggcugggaggccuggcuugcucccccugacugggccucucaggccuggcugcaagacccugggcuuugucucuuccuucccugugacagagagcuggggccuaggcacagauguugugcuugagacccucgccugccuagaagcucaggagagaggaagcagugcucucuggaaugucugcauucagcuguggagauggaaaauaucugcucagccuguggccuugagauggauggcugaagagacuguaaaucaucuguagucugggagagcugccuguggcccucuguggccugaagagagggcugugggugggcccuggggagcccacuguccaaaugccaggcuaggagccggaaacucagagagccagagugagggucagugggcucuggggaccugcaucuccagagcucugguuggcugcaagggaaauggaguugggauaauuugucuggagauguccaggcugacccaagacugaaggccagcuggccugcccuccucacccagagaaaaggagaggcaaggagaggcuggggacugagccagcacuacucugcuuaauuguguguaugugugcgagccugcaugugcguguguauauguguauaugugugagugguguguguguguguguguguguguguauacagguacauggguacaagauguguuguguauggcagauggcagccucgggcaaggaguuuugccuucuauuuuaaacacacucuugugugccccugugugugugugugcaggcauggagagacacagcauaccuguggaggucagaggcucacuuguaggagucuaguuagccugugggcuuuggggcauucucccaucucacccccacucuguaggagcauggggauuacagagcaaggcuacuucaccugaaauccuaacauacaggucagcauacuugugcuguaaggccuuuacccacugaugccucucccagccccuccaagccccaagguuuugucaucaagaggucugguuuuuuucuucccauacucucugacugucucuuuuccaagguuauccuaagggaugauugcauacucaugcauuugaacgaaagaggugugugugugugugugugugugugugugugugugugugugugcgugcacauguauguguggugugcucucugggugggugaggagagcaucagguguccugugcugucacucucagccuauuccuuugacacagucucucacugaaucuggagcaggcaagucccagcaauccaucuggacucccuguaccacacacacacacacacacacacacacacacacacacacugggguuacaggcaaaccugcuuguuuugauagauucuggggacucacgcuuguagcgagcacacuuaaccacugagccaucucccuagaccuuccuaugucuaauacugcaugaauuuucucaguguccuacuacauauagcugguaguuuucucucugcuuguagaagcauguguaugaggucaugugauccuaaggacagcccagagcuggacaguccagucuauguccccaguugagagacccugaagaacauuacauguuccagggacuuuagucagaggcuucuguaguuagacaccguacagagagcaaagggcugugccugagcagguguuguccccggcucuggcacuuggggcagcaccuguugcagcagagaugguuuagcugugcgaccuugggcaaggucuuuguuaucucuguccuaugaaaggggcgugccaccugguacuagaaccugucccaaccuuagaccuucuuagagguucguucacucugggauugaguccuucuugggugccaauuccaagaugcagugagugagaugcagacagugagcacugaaaugucugagccuacccacugggcaucggacuguuuuuagggugugccuggagaucaggucaucucugauuuccugaggcuguguuaagagucugaggugacuuuccuuuacuugugcaugaaggucuaguugcaggguuaugcaggaguggugaccacauuuuaauugucaccugaugauguagcuggagauagggcuuagcugguguuugccgagcaugcaugaagcccuggguuccauccccagaacugaauguacaguucagugguggggcucaccaguaacaccagcaggaugguagaugcaggaggagcaggaauccaacauucucuguggcuacauagagaagcugaggccagccugggcuacuggagacuucuuuuuaauuuuuuuuaaugggucaugccucuuacuuuacugauucuagaguacauggcucuucuuuuuaauuuuuuauuucaaaucauuaucugagcuccuuggguacuagucuccuugagaccccucuaagcagaccagccacagagcaccuucugucugucuagcuccccaauuauuguugcuggaccccuguggucaaccuauuccucaccaagcuccaccaucucuuuuuauuccccccuucuucccaaaguuccgugucuucuuucuugcaaaaaccaaaccaaaacuugcugcuggaauguugccucuucauuccugucuguuaggcaugccuuccccagcucggucuguccugggaagguugucugacccuggaugcccucuugugcaauucugcuggguggcgaauaggcuguggagauggaucugccugcacggggccaggaggcccauggaaaggaagaggggguaaaggcuggcccgggccacaccuugaggucgcugugggaaggugguaccuauuucucuguuccuuccuuacacuuguggggcuuuuccuccugcuucugcacaaccacacccugucccucccuuccccaugcauucuuuccuguauuuguucuuuuauguauccauccaugcaucacacaucauauauccaccuacacacucaugcauccauucauccauccaucuaccugcucacuccucuuccccuuccucuccuucccuccuccccuccccccucuuucuauucauucaucuucccaccugcccaucugucuaucuugucuguccaucucaucuaaaccauccacccuuccaucgguuuaccaucauccggucaauaaacaucuguagagcacccgugagagccagccuuuagcugaaauuaaggcugcgugcuugaacaagagcuuugaugggaggcuggauuccuucuuuaagggguagagucauccugagggagacacgcuuuuccauggugagggugugggugccauggcuaauuuagaaucaucuccaauauccaaaugcccaguacccuguccauuaaaugacagccugugaaauggggucuuugguggcuuuucuaccuuuagugauacuggagagacaccccgaggacucuuggcucuggcacaacucuuaaauggggaggauggcuccuuccacugaggacugggcagggcaucgaggacaaaauuaauguuugguaagacagagggcaugaagcauuccagaagggaacugcagguucuggggccuggcaugcuauaccugaagguauaacucuucaucuuucuagccaugaccugguaucaccuuuugugagguagguugucauuacauugacugacuugugggguccuacaucuauauaugcuguguuugccagaaagagucauugguguacaucggcuaaucucagauuuuaaugaaugagugaaugagugagugaaugaaugauacucuuucgggugagggggucucaugaaggccuugaacgacugggcuguagauagggaagucuuggagugggaaaaggaugacaauuuguuggccuuggcaugcuuguucugcugggcaagcuuuuugguaaugaucauggccuaaugcccagguugggucuuuggcccugggagugcuccaagacacccugggcuguggguuagccuuccaccccagcagguagggagacuuugucuagguaugaccuucuugucagagcgagacaguaugaauacuccgucaugucagcuguggggcuugcacuaccuuguuccccccaugaaauucagugggcucuggggacacugugcuaaagaguggaacuagguuucucaugucaguaacauggcuccagggcggggcuguggaaggcaagcugggcuaaggccccaagccuuuuguuggugugcguuugugugugugugugugugugugugugugugugugugugugugugugugugcccgcgcaugcgcgaaugugcauaugauguguucguggaggucagauggcagccucaggcgaggaguuuugccuucuauuuuaaacacacuuuugucugccccugugugugugugugugugugugugugugugugugcaggcauggaaagacacagcaugccuguggaggucagaggcucacuuguaggagucuaguuagccugugggcuuuggggcauucucccauuucacacccacucuauaggaacacagggauuacagaugcaggcuaauucaccuggaauccuaacacacucagcaugcuugugcuguaaggccuuuacccacugacgccucucccagccccuccaagccccucuguguaaaguuggggucagguucuauaucaggaguagguuuuaucaucaagggaucuggcuuuacuuuuccaggcucucugacuaucugggcuuuuccaggacuguccuucuguuccuaagcgaugaugucugcacagcucugggaggaucauucuaagaacguuugcacacaagugccauucuaagggcuugaugucucuaggauuuucacacuggguagaaccucuggguuuucuuguauuguucccugucccugccuacuguucuuagaacucuaaggaguauggccuccacugcagauguugggugcauaaagggacauacacagagucagcaccuaaaugaccuugggcuuugguguagucacagguccucaggccacuggccaagggccucagggggaagcucccagaacuuugaaaguaugagcuaggugcaguuguccuggugacgggaacccagcuuuugccuccuacgauguccagugugggguucuuacuuuugacaaaccuauucuaaauaauuuuguuaauguuggaacauuacugagugcuagcucaaaucucucuuucucuuuuucuuuauauuuuaccuuuuuuaagcuaaaaaauauauuauguguacaaauguuuuguucuuguauauaugucuguauauacaugcauuucugcuguccaaggaagccauaaggggguuuuagauggcugugggagccaccaugugaguacugggaauuccacuugcauccucugugugaaaauccaguguccuuaauuacugagccaucccuuuuacuugccuuuuaaaggaacuggcagcuuuuaggaauacaguuuuucauauuuacguauugguguguguauaugugcaagcaugagcgugccaugacauaccuaaggaggccagaggacaccuuguaggaaucaguuuuuucuucuacggugugggaugggggcuugaacucagguuaugagguuugguaggaagugccuuuauguucugugcaaucuugcuggcgucuguguuguuuuccgagauaggcucucuuguggcccaggcugguuucagacuuccuauguagcaaagaauaaccuugaacgucugauccuccugccucuaccucuugagugcuacgaucuaggcauggaccuagccacuggcuuuuacugugcuggggaucaaaccuaggccuugagcguucgaggcaagcacuccaccaauugagcuaaauugcuauccuucauuaguguguuaguaagaagggcucugaugccaggucugguaguguaugacuuuaaucccagcccuugggaggcagaggcaggcagaucucuaugaguucaaggccagcuuggucuacaaauggaguuccaggacauccaggaguccacagagcagggcuucauacuaugugacaccuccaacagaggcucucucuggcaagcaugcuccggcuuccugccccuagagucaugggucaaauaugucucauucuucacagaccucuugguugcagguguccgucccauccucgugccuaagacaucuauuagucaccuuuuuauuacugugauaaagcaucauaaugaaggcuacuucuaagagaaauuguuuaauugggcuuacaguuucagaggguuagagucugcuauggcagagggaaggcaugguggcuggaacagcugagaguucacaucaucaucaugagcguaagcaggaaggagaggugcggggagagaacgcacuugaaauaguacaagucucuugaaaccucaaagccuguuccuaauaacguacuuccuccagcaaggccauaccuaauccucccaacagccaccaacuggggaccaaguguucagaucucacuuaaagcacugcaacccaccccugcccaccuccacccccgucuaucaacucuacuauuucuagggacaucucugggaccauaaacacucuuugggguuguuaggggcuggcagaggggaccucaggaugcucuggggucacagcugcacugugauucugguaccugcuuguggugguaucuucuucuaacuuugagggaggccagccuuugggugcucagauaaauggcuaacaggagcaucagccaucaaaguggaacuguuaagcacauuggcagagacaaagcaguuauuggugggaguggcuagagguggauggaggguccacgugccgaugcucugauaauguaacccugaccaaaaacaaguguaacugccaggcaugguagcacguagguaacaucuacucaaaagauagagcagguggaucuuuaugaauuaugaguucaaggccagccuggucuacagagcuagcucucuaggccauccaaggcuacagaacgggacccugucucaaaaacaauaaaggaagcaaaacacaccugacaggagaaaggguuuauuuggcuugcaguucacuccuagcugaugauagcacucuccccugaagcccauccuuucucuugcuaucagugugcagcuggagaugccucccaccaucauggccuguucacacucgucugggguacagguuugagggugacaggagacucagagcaggaugguccccuugaacuuacugaagucaggagggagguaggaguuugcagccugcugucaaccugaguuuuagaagucugcagcccucugcaucugcacuuagcuggcacugacccaggagaugcacaggggaguguguucugggcuguggaugggggagaaggcugggagggggaugggaugccuuaguggguaaauggaaguccaaggacuaaagcuuggauccccagcgccucugagaaaagcugcugcaccguuaaucccagcacaggagaggcacaguugggucuugcuggccacccaguuugccugaauuuucaagcuccagguucaaugagagaccugucucaaaaaaaaaaaauaauagugugaagagcuauugaggaagacaccuaauuccaaccucuggcuguuacaguuacacacaccugcucacacaaauacacaugagggcaagcauggacacacgcacacgaacacacaaaacaagaacaaacugguuagugugaguuuuggaagccugccaccugauuuccuuugggccugugcucaguacuggugcaggagacacacagggguguguaacagagcugggaagucuguugaagugaggacagagucuggaaaugaaagugcagcagaaaacuucccucuggucucagacagccugcuuucccaaacaaaagucccuucuguugaucagaucucagggcugucugggucccuggccugaacccacccucucucgcucgcguggcuggguucagggguucgugccagcgggaggggagggaggguugaucuaccccugcugucccuaggcuugucuggagcuggcugacccucugugaccucauagccuuuggcccagcuguggcgccucagcauagauggauguauuaaccuguccaggaagcauggcuucaguacaucccuugucccuccaggcagugugaagagaagccagugugccuucaugauggacagacgugcgcuuguccaacuggcugcaggaggacucagaguucugcuguucugcuccuaagucccccagcuguggaggaaaggagcugcccccagaucuuucucauuggucuuggagggauguagguggagccuuggguuggaagaagggggcacuguacuguacugggcaaagaagaaagcaugguguucaggaggucucagcagugggagaaaucagucccucuguggcucaagauucuguguucccuggaaugaggagagguuuggcaagguugugagggcagcgagcaacagcagggacauguccaggacgguuggagucugcuggcucugcuguuagguuuaucuuugcucuguuucuauauugguaaaaugguaccauaauguaugcuugcaggggguggggagagagggggagguacugugagugugcaggugugugcaggugaaaaccaaaggccaaucucaacaaguaucaucucccgaaaugcuguccacuuccuucgagaccggguuucucacuggccuggaauucacccguuuggcaugauugguguuuguucucacauggguucugaggauugggcucagauccuugugcuugcaagacaaguacuuuccugaucaaacccugacccucaagauugauuuuuuuuuuauggucaaugagagaaaauguggugugauagaugagcugacaucugaccaauuggaacuucaucauuguuauuauaugaacugaguucaaaaaguucuagcacaguucuuggggcaauccuggggacacuggcuauguagagccuguccccuggccugggaugucaccaggcagcccugauaaaggauggaucucugugaaaagauggaaagaaguuggggaaaugaugcccuuucuagaguggaauggcuucagggcguuuggacacuuggccuucaauuccccagccucugggugugguuuugugagcucaagguacaaaaccacccaguugaggauggaauccuuccuuaagaggacuuccucucuuucucucaaagacaggauggguuugccugucuccagagcaaggaaagggcccuguaaagccaugcccuugccucagaggggccaagcugguucagggaugacauuuuccuaagggcuacugccggggucuucugaagccacaacuggaucaccagcucagagcacagaugacucuuacccccuuucuccucccaccccucuccucucccuguuucaucuucccuucuucucucauccccuccccuccccucugucuucucuccugcuuuuuccucucucuuccuuccuuccuuccuuccuuccuuccuuccuuccuuccuuccuuccuuccuuccuuccaucuuuccucuuccacuucaccccccacaucuuucuuuacacauaugcuguggaggucagagaacaccugugaugucauuccuuugccacacuccaccuuuuguuugagucagggucucucauugacuugggacuucucccaguggguuaggcuagcugaccaaugagcuuccaaggauccugcuugucuccucccuccucaucucaccacaaugggccuuuuaugggggugcugagguuugcacucauccccgccacccaggcuuggaaggcaaguguuuuaccuacagagacaucccccaccccucccucauggcuuuuucaaggacaggacagagcauaaggaaggucuuuugggcuuacugaguggggugccagggcucagggugagacugucaggugccugggggcaggcacgugcaacagagauguucuuauucacgccuagucucuggagagccaacccccgcccccuccucagugagaaggucaaacaauuacagggcuccuaauuuucaagccaauugggaaauuaaaucgugucuccgucagagugcuauuaggaauuuucaagaaagagguaauugaaaagaaacuuuuuaauacacucaccaaauuggcaagggggcacaggagugcuggagccucucccagcuucuccuucccacuggcucaaguggccaugucugcuugcccuaacccuacucccucauggggccccuguccuggcagugaaggccaauauggauacaccuccuggauuucgaauguggaacccuguuuaaguucuucuccaugcuguguuucuugguugucaccuaggaaaggacacuugggagaauaacauggggucuggggcccacugggccaccaucgaucacuguggcugaaacucaaguaguaaccauugcugucacuacuauagccagcacuguguagaacauucuucaccucucucuggagccuugccucugcaucuagaagccuuguacuuggcauggugugacaucugcuuuguggcaugaugguacgaccaugagcacuucugaucauaggcccucgacuguccccagucacauucugugccaggcucugcaugccaugcaaccugugugugcaauguuuuauugaggugcacucucauuuuauagggcaggagauagaugcagacagguaaaggaaccccagauccaggauucaaguggagcuugcagggauucauggggguaggauggagcugugggugggcguguuuaagugcagauggcaagacauguuucuguccagcuggcaugcagacuggucaauggccuagggcagagauuauaacacugcuguugcugugaacacagggugugcacugucaggaacuauggugucugauuuacuguaacuaagccugacuuaguguaacuucaugugucucagacucuuccccucuccuuauccccauguucugcugccugauacagcuggcguggagucccagcagccuucuguuagcaccuccaccuucuuccuuccagaagguccccgggcugucugaaaggagaggggaagccagccuacaugugacugcuuuugcucucucuccucucuugugucccuggaagucucucgaggagccggccacaugucugacagacgaugcacauauuugaugccucuggagcuuggguuuuuacacuuguagccugaugggaccucuuugcugccaggcugcccucauuuccagagggauccuuuccagaaggaucugugucaaacugugugguccugccacucccugacacagacuuccgguuaccucccacauagauggagauuaaugcaggagacuuuuuuuauaucuguguuaggagugucuguuuggugcagacuauugcaucucuaagagagaagacacaaggauagcuggaggaaagggcuguggcugauuagugauugugagucccaagccaaccugaggcuaggagccaaauucuugggugucauggaaaguuuuucucacucuccuggccucugcuacacucagaguccucaucuauaaaucauuacuggccuuacugaguuugguuuugcuuggccaaaccuccugaagguacaaagugcagucauuuugcuauccaaugagaugggguugggcuugauacucagggagaacucuauaagugauagaguaacugguucuuucuaauuaaguuuauuuauggauuucuauguguaugagugguuugccugcaugugugucugugcacuaugugcaugcaguuuccauagaggccagaggagggcgucauaucccagggacuacaguuacagauagcugugagcuucuguacggggaucugaggaaccgaagccaggucugcugcaggagcagccaguucaccaggccuuccaguggacacuuggugcuugcugggucggggauuuaguauccuuuacuauaggcagauguuuuaggaucuguuguguguguggauguguguucauguuugugagugcaagguggacauuuuagugcagguagacauucauuguguguaggcauggcuuuggaggccagugggcagcuagccuggaacucacuacguagacugaccucaaacucagagacccaccugccuccaccuguaugguucuggaauuaaaggcauggaccaccaugccuaaacacacuauccacuuuuuaaagaauuauuauuuguguguguaugugcgcauggauggggugggguguguguguguguguguguguguguguguguguguguguguguuugcauguaccagagcgugccuguggagguaagaagacaacuuugugaaacugguucucucuuacgaugacauagguucuggggauggaggucaggugaacagacuugcauaggaagcacuuuccccccccuucuggaccagguguccaggacauacuuuguuuuuggaacagucucuguugcucaccugcuguguccaccagguuagccagguuguccuuuaucccccucccauggcuucacaggcgcacugguucuaaggagggcuuuuacaugcauucuggagauuugagcuuagguccucaugauugcauggcaaucucuuccacccaauaggccaucuccccagcacccacccccuuaacagucuuuuuagucuguuaggcuucccugugacaaauagcccugcugugauggcuuuugaggucucucuguggggucucuugccccaacuggaauacaaagggcagagcuaaggcuuacagaaaguguuucaaggcacuucagguuauugugggacaaaacuuuuccuggggaaaugcaauguacagaucuacucacccagauaggaacccaucacagucuaaaguauggauacaacugaaguccaacuuggugaaccaauaagguuuauugggauugcuuacaggaauaugggugagggguuauuuacaugaucaugggugagaaauuacucagaggaucaaaaaugacucaaagacagcagcaucaccaagguccacucuaggaugggugacagcucacaaggcugggaagcuggggcacacuggauagcugcaggcagcucaacaacuaagagaguguucuuuccaagggacuccagucuaaaccucuuccagguagcucaguuugucucugcuucuuccaggcagcuggucugacauagucuucuuugcaacucaccuucccuucuucugagguggguucucaguuuuuaugauauucucuggcagggagggcccuagugaaucuggucaguuucaggaacuuccugaagcuguuuuggaguuguuuaccuuccugcuuaaggagguucucuacaagauggaauuuguuucaaucuuggagaaauuaauauauaacaggugaccaggauaagaauuuggaacugcucucacauugucuauagagccaugacaggguuaagacccuggugugugaaugguggugacauucugggacugccuuucuaaggagucuucucuuucaggcucaagaacagacuccuuaggaaggacuccugccuaugugucaccuauaugcuugagugggcgggaggacuggaaggcuguugguagauccuccuuuaggcugcuuaauauccucccagacaugcugccaagcccauaguauuccugaugguacuaggccauguguuaguuggcacuaaagagcuaugacagaugccacuugccuguuguggguccccugagaauugcccacgccaaccacaguggcaguuugcagcuuggcauugccuucaagcagcuagcucccuccuagccaagaugauagagguauuggagagaguguugggugaggcauggcuuuagggcuccuaaagauuagggugagcaagucauuuggccaggggcucugcagggagggaagaaaagaugaacuuagacaguguugaguguuccuuuuuccuuaccccucccaucaucacuacccaccacucauagccucucuuuuuuaagauuuuugguuugugugcauguguguguguguucaugugcacgggugcaggugugcaggugugcaugcauguacaugggugcacacaugugugugcacugugugcaugcauguacacauccauauguacaugcauguauguaugcaugcauaugaguacauacauguggguccaugugugcauacauguguaugugugugugcgcgcaugugcaagugugugcauguguguaugugugugcgcacaugcgcauguguuuuuuuguggagggcagaggccacuguugauaucuucuucuauuguuuuccaucuuguuuuuugagacaaguguuucucucugagcuaucaagccucagggaccugccuacuccugcuuccccagugcugggguuaugggcagugcuguuguuuguuucuuuuguuuuuaaguagcauuugugggauccaugcaaacacaucuaucuauugccuacacaaauggauagcucagggcucagagaucuauccucuguucaggcaacuuaaauuaacuucagagucugauuggggcuuaucuggucuuggaagacuacaacuuuuccugggucuggcaacucuuuuacugugacccucacugggcccuguugcuuccaacccaacucucugacucuguagacuuggacuggagaguucuuguucuaggccuuuguccccuuuccugguggcucauugccagcugguucugaccucugugccucagcuacuaguccuuuuuguuguccacccacugucacuuuggcuuccuacccaccucuugucuagcuuugaaccucuguuccaaagggugguucuacaaggccaggacaguaaccacauauaauuccaacucuguuaacuucuucccuuguuagggugggaugugugugugugugugugugugugugugugugugugugugugugugugcuggaauucgcucuccugcuugcuucccuggcuaccccuucccaucuaugacaccuccuguacucuagagaaauuuaaguuuuguauggcuaugaguuugaccggcacuacaaacaguuuagccugcugugguugaggcuguggcaauuacauuuuaauugagacauggacugcuuaagcagacacaagacagccacagugacugcuaauuaauuuucuuccaaauugacaacauuuaauaauuauucuccaugacgguguguuauguguauauagccuuccuggcccugguuccugccagugguacccauucaggugaaguuaguuggugguaccugccuugcugccaagugagaaauuccuuuggacguuugaaggagccugcuggcauugcauuggaagguggaggaagggcauugcuuguuuuuagauaguucuaaacagagagccaagggcuuugcacucgauuccugccuccaagguaguuggaggaaccugguuccuuuagcuaggaaaugagcuuuucacuuaaaagaucuguucuguauagguaggagaguccauugaaggaaacucugggaucuggaacauucuguggacuuggcuuugugugcauaccuggauguauggugugugcaugcgugcauaugaguguguaugguuaugugugugugaugucgaugugucauauguguggggccugcagauauaugugguaugugaguauguguguauauggaaauguaugugcaugugugugauguagauguggguguguuacauguguguggcauauagauaugugugcaugugaguauguaugugagucugccuauuuaucuuaacagaggccagaggaggacagugaggucccagcuccacuauucuccacuauucucuugagacagggucucucaaugaacuuggcaguaggcugagagcagcaagcuccagcaauccucugccggcucucuccaggcacgugugugagcgugggcuauguuucacaugggugcuggauauccaaaugcggguacucaugccugggcagcaagugccagccugcacuuuuaggugugagcacaggcuucaccacucuaguuuuuccugugagauggaaggagccauuccucccucaaggguguuugaugugagggaaccacugguguacugcuggcacacacugccugucagaggccuccaguuguggagucaguccuuucccuguguccagucacuuuggguucuauguccuugguugcugggguuccuagucagcccuuuccuggcuaggcucaguacugucuggugccgaggcaaguguuggcacauccucugaauacccauuuuucuccaguggcggcccuuggaaucaguuaugcccagccggaaauuggcagaagagaggugaguucuaggucccgcgaagcccauguuuaauuuuuuuaauugauggucauguaauuuucccuuccagauaggaaccugagguucauggcuuaaaagagguacugcuagcuuugggucaugcuuuguccaggucucaccugcccccuuccagcucucagauuucaagaggagcccugagcgaucuugggaggcuacagaaacugaggacugaguugaggggcuaguauccgggcagcugaacccucuagggagggcaaaagagggaggggagugagggacagguccagcucagguuuggaccauuucugggccaaccugugugcggagggauggaguggacauggggacuucacgggggagugagacagccaggacuucuggagcugcaaaccuuccccucccagaugggcacuccugagggacccuguugugucacuguccucauagugagccguggaggguaugugucuacaggagagcacaagccagugugacuguauuauuuuuguugcugugacaaaaugcuuggcagaaacagcuuccgggaggaguuuauuuuggcucacaguuggagaguguagcuuguugugcaggagaaggcauggcagaggcggugugaagcagcugcccccacugugucugcacucaaaucugagagagagagagagagagagagagagagagagagagagagagagagagagagagagagagagaggcuggugcucagcucucucuauuucccaagucugggacccagcuccauaaugaugcugucuauguguaggagucuucccaccucacuuaauccagucuagagacucccucacaggcaggcauaggcguuuguucucuaaugaguguagggaacucgcaaacuugccaguuuuaaccaucacagugaccuugagcauggauuguguuugcuuuggugagugugagugaauccaugaugugagcagccgugugaacagagauguacauguaaguaugagccagugcaugccagcaugcguguauguggguguguaugagggaaccuuagugagucugacugaaacaggccaagggguugcaugagagauggauggaugggagcuguagccggcauccauguugccugggccgggcauggauguagggaauggcaugaagacccacuagguguucucacaucucugccugcauuucccuuuccuauuuguguguuuguauguaauguauauguauguaugaauguuuuguaugugauguggguggaggccaagguugauguuggaaaucauccucuauugaucuucuguuuuacucaaaauuuuaggcaaacccagagcuugcccauauggccagucuuguuaggcaacuuguucuguagaaucccugaucuuccgugcuuuggggcuagaauucuagguaagccacgugcaaccaacauuuauguagauucugaagauguuuacugagguccccacucuugugcagcaagcacuuuaaccacuagaccaucuccccuacaccuuucuacuggccuucucguacuuuccuugaaugaggcuaagguugguuuaggggccaggaggccauacagguacacccacgugugccagaucaucccggggcucagugcagcugggagcagaaucaggugcuaagauacaaugguggagucuugcccgacauuuccucuaagauauccaguuuggggagacaaugguucguggcccaugggugucuaauacccaagaccugaccagugaagcugugcauuuggaguauaggcuaugagaacccaagucagggugggguauaguacaaagcccaggguggagaagacagagaaccuauggagugugacaguugcuggggucugcaucccaagcugguagauguagggcccaguuauaguggcauugaacuuagaugggcagacuggcaguugggaggggcagggcuuguugguaguaagguagaaaguacuaaaugcaaaagagccacugccacccccuuggugggccuccuguggccuuauaaccuccagagcuaauggccacaagagccagggguagccuggccugggauagcuggggcugugccuugcccuccucuguuugcugagaggaacagcugauuguuucucuggcagcccagagcuggcagcuaagacuccuuauagauucuuccucaccugcgacucaaaacuccccuccuccccuccuaauucaguccccgaggcccaugccaucacccacacagccagagaagguaauuaggggagcugagagggcgaccugccagguucccagggcaggugacgcagggcugagccaagcucugcauucugugacagacauguaaacagcaugcucuggcuggcucagggcugucugugggacaggugggugacgcuucggagucugcugggagcuccucuguaggauggugaagucaccucaggagccaucuuccuuguuuaguggauggacagcagggugagggguguguccagguagccaggcaggugguuggcuggagagccuagugcugcucacuguaggcccucggggucucuucugcuugcaugagcugugacagggaugucaccugguuggcuugggaagauggaaguuuugugaaugucaaagugauuuaaaaguuauuuuuaauuacauugugugugugugugcacacucgcaugccacgauacauauguuguagucagaagagaaccuccuggagucaguucguuccuuccaccaggugaauccuggagauuggacuuaggcuuucaggccugagccacuuccccgggcaugcuccugaguuugccacuggaagugcugggugaagccgcagauauuucaggcuggguucagccuacaaguguucuugucugguggacucagguggaaauguguaaggggaggggagaaggcauguuagaggcuucagaagccaggcuguugaaucuccaguagcccaggcuggcuucaaacuuacuuuguaauugaggagagucuugaucaguagauccuucugccucuaccuccccaugcuaggaucacaggcacaagccauccugucugguuuaugccgugcuggggauuggauucagggcuuugugcacgcuaggccagugcucuguuaauggagccacaccccuagccccugaugcucccgaagacugucugagcacugccaaggcugaacagugggacuguaccaccugugguuugcuccuggcuucucugcuucagcccuagaaaccacagggguugaaccaagaggaaaaaaguucucuguggagaaagaacuggugugaaucagugugcaacagaagcugggaaauggcagccauugccaguggggucugugccuaaugugucuucauuuucucugcccuacaagaggacucuccugguuggauaaugaucacaagugacauucauagugggcuuugucuacgaggcauacuguauccauuguucaggguacucuuuacagagggaagcugaggcacaccaaucccuaguuuggguuagagauguaauaauagcuugggcuggggauguauucagaguugguagagugcuugucuaucaugcaggaaguccuggguuuuauccucaguauggcauaaacuggauguggcgaugcacaccuguuaucauagcacuuuugauguggaggcaggagggucagaaguccaaggucuuucuuggcuauguacgaguuugaggacccuuucucaaagggagguaggggaaaggaagaaaaacaacuugccuuagagcauacagcagauucaaaagaggagcacagguagccuugaucagggagccugggcgucuaagccuggcuccucacuggugccuguuuggacuauuuacccuggcuggccuacuuucuuuuucaaaccuagggaggaggagguuggaacugucucggcacgcgcuccagugugcgugugcgugcgcgugcgcgugcgugugcgugugcgugugcauguguguguguguguguguguaugugcauguacucauucauguauguguauaugugucauugguguuuauguuuguguaacugggaaagaaagcagcuugcucauccuucugcaucgcagacaucacucauggugaaggaaugugaguuuccugcagguugguucuugguaaacaucccucaucucuguuuccagaaggcauggauccuucagcucuuacuuaacaggucuuucuggaaaggaaagcauaacgugaguacacagaaacacacgcgcgcgcacagaaacacacgcgcgcgaacgcgcgcgcgcgcgcgcgcgcacacacacacacacacacacacacacacacacacacuuuguauuuugaugcuagaaagugacucugaguacguauggaggccaggaagguaugugauggcugauccuagcgugggauggcuccucucuuucuuccuggggaguacacagcuaccucccagaggaagugcuagccuagcacuggcuaagaagcaggaaagagagagggaaagauggacaguaaugagaaagagacagagacaggaagagacgaagaggaagggaaacaccagcagcagucuguuugggggaccccucccuacucacccauaaaaacuugcaugccuuuaaaaacaagcaaacaaacaaaauccccaguaguucagagacuuaaaucuauuaucagugccccuugcuaaguggcaagaccagguccaggccucucggccuggcccuggguaagcuguccuucacugucccaggaguuggacgcccuuccccugguccaggcuucuauuaucuuacccuguccgugagccauuucgcuccaucacaucuacuaccuucucaggguuuagaaacugcagucaggagucuacuuggccagcuagaggaaaaucaaggucuugcacaggucuguaaacuccuaaagagcagccguacaacagugcaaguucacauuguguaaacuacauguugagugcauuauuucugguuugauauucuucuacggucccuaggaccuucagccagaguguaggcauguacauguacgacacauacaagcagguucccauugagaccagaagaggaugcuggauuccccugguacaggagguuguaagccucaugaaauggaugcugggaaccgaacccagguccucugcaagaaguuggguacucuuaaggacugggcugucucuccagcccugcugucccuaaucacacccccuccagggccuucagaauccagucuagacucuggcucucuucucauagcuccccaguuuucuccucuggaucaugcaggccucuugucauagcauuguuacagccgaggaccagggucccagggucaucugaugggcuuuucuggcucuugugccccacaacaaagaauuggaccaggaacacauggguagugguagaaauagaggugauuuacugggagagagagcucuuccaggcaaggcaguaguccagggagcuaugaaagguuagaggcuuacuggugccagucguuaugguguggaucuguaaggaucgcuuacacagcccucaccuucuccucagcuuguauaccaugcaugcugucucuugcuuacagcccuggcuaauggggaggagggucuagucuuuuucugggucacugauuuuuuuucuuuucuuuucuuuucuuucuuucuuucuuucuuucuuucuuucuuuccuuucuuucuuuuuuuuuacugauaugagugugugucagagacagagaggucauuuucugguguuacuauuaccugagacaucucuaucuuguguguguguguuguuuguuuuguuuuguuuuguuuuugccagucucucaguggcagggaacuugauuuggcuaggcuggcugcccaguccaucccaggcauucucguguacaccuccaggccugccugucuuuacaguagguuuugggacuugaacucacguccucaugguuggaaagcaagagcuuuacuaauuugagccaucccccaggggaaggggcuuaaggccagaggaucaaggcacccagaggcaccaagugagaaugcagugaagauaugcagccuggauaggaggugacaugaccuguacuuuuuuucaaauuggugccauggugggauagguguucggacaaggguugugagcaaagaggcgagaguucgugcuuggcucugccuuugugguucucaguuggccugaccugcucuuucuugacauugucuauuaagggccuuuuccucccaaggcuucucugccuagccuucagccuuccuccuccagaucaauacuggccugccguucuuugccuccccucauggaggcaggggcugaaugcccugacauagcugcagguguugcacaguaggaucccggaaucuuguguuauucugagucuugaagcagauagaccuuucuuuccuuacccucuuguuugggcagguaggugccaggcugcaacugagcugugggcuggaguagacaucggaacuccaggcaggagccuggacgugauguguggauuuagggagcgaggguugagagggaggccagugggguccugaacauagaggaagccuggauugggcaggguccaggcucaccuggaacugaauggcaggcuggccuggggucauagucacagccuccuggagggagagccuagccagugagauccugcuaguuuuauuauaauaaaaagauacucuuggugaaggcagugcccguucagaggcacacgcugguggugccugugagguguggggaggccuccagcuuggcaagucagagcagcagccgaauuuggagaugccagggccacacacggacugagauugggucucucuagagcccugaggggggagagccccacccuacaccugcagucagagaucucccagcccugcccucuucccugugaccucaggccuagaagccucgauggugggacccucccuuucacauagaguagcugguucacaacuccgguggcuuggauccugucugcacccugccaugugcccaguuccuuuuuccaccuaacuguggccucguacauacucccuggggcuccagccugcuggucucacauugggccuaggaguugggaguggcacccacccugucagucugguuugggagaugauguggcugacagcuggcuaugcuguaaaugagaacuaucugugauaguuccuuuagcaugagcuacuggggagaagggggugggggauaagauuggaggccauugucaacaccugucucuaggguuggagggagaaggacaagaggaauugggucuagggauggcuccgucccaggcagccucaaauuuugcccagcugugcaguaguaugcuacugagaugcuagacaaaacacuuacugguguaacagcagugugauuguuacggggauaacaaacugauuuuuuuaaaaaaaauuggauuugagucugaaggaaagaacacaugugugguacuggaaaccuggucagaagccuguaaauuugcccugggucuacaccuccccaagcccugcagccucucgccuccacccacuguaagaaccugggucuuguucugugguuugaaauuugcuccuuaagcgcacagggaggcuuugcuugucccugacucuaaagugccauccucaguaugcguuucacuggagagaauugcuuuaauaguuuaaaaccucuugguugguugguugguuugcuuguuuugguuuuuuuuuuaaaaacagggucucuucacauagcccuggcuauccuggaaaucacuauauagaccaggcuggccccuaguucccagagaucugccucucaagugcugagauuaaagaugugugccaccaugccccgcaagcuucuugcuuuuuaauugauaaagucacuuuauuauacaucacaagaacuacugugugccccagaacacaguaggugcuccgcagauaugaaguuucugcacuaagcucuuugcauagugaagucuuacuucaucacuaugugaguuaggauuaagggaagguaagcauucuuuuuauuauuauuauuaauuuaauucuuuuuuacuuauucacuuuuuacaucccacucauugccccccugcucuuuucaggucaccucuucccacaauccuucccucaucccccccucccuuucuccucugauuaggucccccacccccacuggcuaucccccccuacucuggcacuucaagucuccgcaaggcuaggugcuuccucucucacugaggucagacaaggcagcccagcuagaagaacauauuucaccugcaggcaggcaacagcuuuugggauuaccaccauuccaauuguuagggacccacaugaagacuuuauguaagcugguuuccccuuguuaaccuagugucaauagcacuagccacaacaggcauuacuaguuaaauacugcaucuuccauggcagacauuguaaguuaaugauuacaucaacuuguauaaggccuagcauaauaguuugaugcugcccucaacccagcacuccucagaggguugucagugggucacagaagcugagaccugcuggcugcucuguucuuguuagaacuaaaucuugaggugauacuaggaggagaaaggugugcuuggugagugcccugagaacauuccuguguuuaguuacacucugugucagucaucaaauguugacucagccugugcccaggcggacagaaagaguaacagauaaacaagcagagcaggggagccaucauuuuaggggucauaggaacaagccagaaacccuagccuagccuagccuggcauccuagccuagcaucuuagccuggcauccuagccuggcauccuagcauagcauccuagccuagcauccuagccuagcauccuagccuggcauccuagccuagcauccuagccuagcaucuuagccuggcauccuagccuagccuggcauccuagccuagcauccuagccuggcauccuagccuggcauccuagccuagcguuccaauagaggaacgagcaugaccacucacaauagugacaagcucaagcuuaggaugggaugggacaacgagcuuggucuaagucuggaaguggggccuuggugcugccaagggaugcaaacucuguucucagaacgcaccgugguacucugauggccuuugguccuugcugcuuagcuuguucucagaggaaguagccuuggucugucccuggcaucuuugcagccuauuccccugcuaaggacugcccuaaggauucuguuuucucuucccagggcagaggccagcuuuguuuucccuuccagcuucagaaauacacaaugcugcgguagcccaucagcccguguaggucuggcaggcagguaacacagugcauccuuguuugcuugccaauguggcuucauagugugguccaguccugcuggaagggguaccagggagagacuguggcccucugggcaucaagccccuggagagaaaggggaccugacagugggguaggggugggagguugggaccuaggaagagucuaucuuauaaaaugcugcuauacuguguuguauucucaggaucuaacaggggagacugaggcugguccauugucagaaggagccucaguagaacucugcuauccagucccagacagcugggacucugccugcccagcuugagagaaagacucugccccucuguuuuacagauggggaaacugagacgugggcuuuguccaaaugcaugcuccaucucugguguccacagucacuguccuuccuguaauggugucacuugcuugccugggcuucugggacuguggauaaggucccuugguguaggguucugggucuuaaaguccacgguguuagugggacagaaagucugaaugaucagguaaagaagccaagacaggaaguggaaucagccuguguuuccagagaauagaucggaguacaagacagugggggcugggaugcuuucuggagcuugagccagaaguccuaccugcgccuuuaggaagaaggaagccuuucugauacucaucucaggaaggaggccuacccaucaugcccuuggggcccaaccccugcccagccagucagugaauuaggguuaauuaccacuuuuccuaacaccagcucucuagcucaggggccuugcaaaucccggagcuuuuguacuuggagaaagaaauucaaggggcuagaaaaggggcaggugcauugccuuggggcugcuuuuugcaugauguggcugugaccugcugcaaugggucauuuuguaaccuguagguuucugggagaagcuugagccgaggggaccagaagccagacuggccaaggcgggcuguagaagugacacccaagggagucacaggucugcuuaugcuucugaaaugucugucuucuccagagcccugcuugcucugacacuuucagccucggcacugugugauuauuuccaaccugcucacuaugcugcauugcuaagcccccuucuacuccagcaacguucauggauaauaaaaucaaguagggaugggcaugcgugcacaaagcccuaggguggauccccagcaccgcacagugcugaggcguggugcugcccuugggaggugaaggaaggaggauuagaaguucaagaucauccuggguugcauagugacuuccaggccagccugagcuacaugcagagauguccugcugauaagauggcucauuagagaaaagcacuugccaccaaggcugaugaucugaguucaauuccuggagccuauaauggucagagagaacugaccccauaaguuguccucggacuuccacagaugugcaugugugugcacauacauuaaauaaaugcaugaaaaaaaugucugcaaucaaggcaggguagguuuucacuagcucuugcuugaaauaugugccuaucugaucuguauguguuuuugcacaugcguuguggaugcaugagugcaugugcguguaauuccuucugacaacauauaugugacagguguaugcaguagcacuguuuguguuaaaugagaccaugagugcaugaacauguauguauguauggcuguguacuugcacacacagacaccuucguacacuaagagugcagcguauguuccauuugcugugcccaugcauucccaugugcucauguauguaagacgggacaggcaugcugccuggcugagaucagaaaggaugcgagugugccagggccugugguagguggcuauguuggcugggaggccagcuccugccucccuccuggagguugauuucaccccaggaagugcuuaugugugugacucacucacaaaggaguucaaagcagccaggugguggugggucuccaggaguucagaguuccucauucugaguaucaguguauucacgccacuccuggaaggcuccuuacccuggccugugcuguggaccccguaacaccugcugugauuaucauucaccgucaugcugaaaugauagaaauagaaaguguggcucacaaaagaccccacuuuccaucaagugcaacggcuguacaggcaccaugcuuaugauaggguaacacuugggcuuucucacugcaggccaagugcagggucggagguaggaagccaccaugcgcagagcugguauucagugccauggaggaugagggucccgaguaucaaacucagguccucgggcuucauggcgaaggcuuuccccacagauucacucccccccccccccccccggcucuagugaaauauuuaguccauaaagucuuguuuuaagcguugcuuagaaauuacuuggagacaaacaacagggagcgauagacacuucccucgccguccugugcaugcucgcaggacacaacuguugaagagcuuucucguucugaucuguaugaaacaggaucuuugcauaugccccaggcugacugugaaugcuuggaccucuuaacuuccaagcuuugguuccaugccuagguuuauagacauguucugcuaaguccugaacucaugaagugucuuuaaaaugcggagagcuggggagauggcuuaguuggcaaacugcuugccacacaaaugugagggucucgguuuggauuugguuugccugaaaccaggcaggggaucccuggcgcuuacacaccaacagucaguuuauccaaaucuaugagccccagguucaccaagagacccuacuucaaagucaucaucuuuaucaaaccauagagugacugaagggaucaauguugacauagggccuccacaugcuuugcccucccccaauaccugugaauacacaccaacacaugcacagugcuuucuuugcacauuuuguggguucuccagccauaugucuggaugagaggucucauggaaaagccccagagggccugagaccuggggaaaaucucuaauggaaaggggcuccuccccagggcaggcccaggcuccccuugguguagcagauuccuguggaaugugcgggcauuuccagagcuguaaaagaaagugggguguugacucuccuccccuggaguguccuggggcucucagacccuucuuugaagaagcuuuuguguugccugugggaaucaacccacauagacacucacucacccagccaguacccaugaagccgugcacagaccccucccugcuguccccagguggugggggaugggguccgcacaaggacgcagguacaguggugacuggcuguccccaggagugaauguaucugcuugggacccagggugcuugguguuuacccagaaauugagcuaaucccacuaauuccugugaauuaugaagacucuuggcucugucuccugccuuccucuccuguggcagagguaaggggggagggggagcgugguggcacugacuugcacaguggggaggggugcccccugaaucccuggugcuucugugugcagcuguuccuuuuuacucagaaucugcugccacagccugagugcugaggcuccugacaauuuugugcucaagcccucaggaugcucuucauuggguggcuguuccccccagggcuucuaaguaacaugucaguagacuaccaaacuguucaccuugcucugcugccucugugggaaguggccuccggcagcucauucccagcagaauccugaggucaucagugaauuggggguuaccagguugcugccacuuguuaggguaggacagagggggaugagcugccacugccaagucagugccugggaguaagggaacaaaagagguucauuucucacugcucucuucuacccccuccucccuacucuuuagaccuccagacccuugucaacaggagccugguccuccugccaggaagauaagggaugcacagggagccagccucucccucugcuagaggcuuaaguggaccaggacccagcaggaggagcuccagaugauucagugguuuaagaauguuugcugcucugcuguucuuucaaaggaguucaguucccagccacuguggcuaugugggcagccuguaacuccagcuccacggggucuuacaccucuggccucugaggacaccuacacucauucuaugcagacaccugugcauaagcauaauuuaacauauucaaaguaaagagcuaaaaaggacccagcaggacacuagaggagcucuagccuggggagaggagcaggccaguugcauuuguuuguuuauugauagggucucucuguguagggaguauaccaauuacaucuaucuaucugucugucugucugucugucugucugucuaucugucaucuaucugucugucuaucuaucuaccuaucuagagacagggccucucuguguagucgcccuggaccuuaacuauguagauuguggccucagauucacagagaccgcccugccucugccucccgaggguugggguuaaagacaggugccaccauuccagauaauucuacugguuaaucuugaucaaaaacccagugggauuuaaaaucaccuaggagacaaugggcauagcugugagaacaugcugguguggagugucagguagacucauaaucuggcagauguaggguuccaaccguggacuguccagagcaggggacuuccuggggaagguggcaucuuaaugggguuuuucaggcaaaggugaaguguauucuuggagaggcaccacuggcugcugggcuacuugcuucuggugcagccaugacagucacagcccuaauaagagcagcugauagggugaugccaggcuaagggacaguguaagaaaaggaggcuuuagcagguggcuggugacuauucucaugacagaaccccauaguagcagaugcuaucaucauuauuauuauuauuauuauuauuauuauuauuauuauuauaugcacguggcuugcauguagugacaugcacgugcugucugacucccugaagucaguucucuccucccaccuuuauaggggguuucuuugaauaaacucaagcugucacccuggugcagcaagauaccuuuaccugcugagccauaccgcuggaucuaaagcgacagauuuuaaagauagcuuaaaccaggcuuacugcuauauacuuacaauacaagcauugaggagucggagauaggagacucaggggcucaggggcucaggggcucaaggucauccuuggaugagcuuuaggcuagccugggcuaugugagcccugauagccgccgugcuuguggugacccucaaccauaaaauuguuuucauugcuacuucacaacuguaauuuugcuacuguugugaauuguaauguaaauaugcuuucaaauggucuuaggugaccugugaaaguguccuuccacccccaaagggguccacaaaacgaugacaguuagugauaugaauauugacugacugacugaaugaaugaaugaaugaaugaacauccacaugagucagccaaugaaggaagcgcagaggcaaagugguuugggaaagcauucuuggagaagucuguuguauuucuguuuuuuuccuagacuucgggcucucuguucgguuuuguuucuccgggucaggugguucucugcuccuguauguuuucaucauuaagaacuuguugcuguuuuguuuuguuuuuuaaauucagguuaaacaauaaacaaacuaaaauguucaguuccuguccuuauggccauucagcaagcagacccgucguuucucaggaugacuaugucaaaauuaucuaggccuucccuccuggggucagaagacugagugugaacuuuggugcuguaggccccgugugguguggaccuggguugguauuuccuagauggguucggggugcaaugucguggcugaaugucuguguccuuuccuccaggguccgccaccaaagaguaugagccucugagauggagacuucugccccagccccugcacuggagaagaaagaagccaagaguggucucuuggaggacagcagcuuccccgacccagggaaaaaggccuguccucuggcgguggccgcagcuguagccgcccacggagguacacuuucuguuuugcacgcccagagagcggcagggguguuuuucacgaggucauuaggauuuaaugagugcgcuggccccugucaucugggaggcacgcuggguuuauggagggcagugccucugcccuaggaaucccaguccccaagaagguggcuugcagcuuucuuuggagagcuggcucucccagucugguggcugaggcuugagcagggaguggggggugggggaggagagucuuacugggcagcugccuggccacccugggguguguucagcuggcaccaggaagaugaauccugagagcuucuugccucuugcccgcugcggacuauuucagaaagcaaucgucugccaaugccugcuggcuguaauuagagggucagguauggaauuuacuaucuuagguggauuucuggccaacuuaauuacaacagaagggacuccacgagccacagucucucauuucacugucccuaagagagauguucuccaguuuccacgguccgugccagcauccuaguuggauaguuuggcgggaaggugagaccucccuugucacugggcuguccaucuggaggccacacagcuauucugucucagagcaaagaaacagauuuauuuucuaccccuuuuaauucaaacacauuuaguugugcucugaugcuuucuuguccaggccaaauacccgaggggccaugcacaagggaagggcucaguuuguuucuuuccaccccugagcgaggcuguguauauggucuguggucugugcuuggaguagcaucagggguuugaacucgugacauggagccacccuugagucacacagguuguugacacugcauugguuuucuucucuccccacgauucuaaguugaagguaauugucaagucacaagugggagaugcgagugaggucagccuugagcaccucuggggacaggcucugaguuugugggccugguguggaggcuuaacucuuaggucuagaaagaggagccauagcccaauaggucauccagccagggaggcauaaauggaggcacagcacaguggagugaauuccugggcaguggugguccuuagauuccccccugccccauucucugaggcugagagaguucccaggagcucucuuccaccuguccugagggaaacgcccugauuuggccuuccucucucaaacaaacagagccauucccugcccugucacaacaacagagaguagacuuaggcaguaauuagacaguaauuaggacauaauugaggggagaggggcccuguggcaucagaccaguugucacuguugaggccagugacagcaaaugcuugagggguuaucuacugggaaagggggcaaagcguggagcacagccacugcagaggagcaccagccccacauguuauguggagcacagccacugcagaggagcaccagccccacauguuguguggagcacagccacugcagaggagcaccagccccacauguuguguggagcacagccacugcagaggagcaccagccccacauguuguguggagcacagccacuguagaggagcaccagccccacauguucuguggagcacagccacugcagaggagcaccagccccacauguucuguggagcacagccacugcagaggagcaccagccccacacguugcccacuccgugcucucucaggugcccuucguuagggaguuuggcugaugaggguuucacaaaucagacauuugucacauaagcagguaguuuauggccuguggaagucucaggccaggcgcaugcacucaggagccagggggacccaggaaugucuuccacugaaaugugcuccuguggggcugguaagcucccuaaacagcuaaucuggaaggguguccaggagucugggaagaguggcuaugccuguguuaaaggggacacaugugaucugucucuacugaagaugggcuaaagggcaggggcaaggaagcccaguggugcaacccaaaggauauugcugggacuugacuucuauguuagcugcgguccuuaagaucuuaaaaccaaguuggcacgaugccucuccagguggaggugcuugcugcuaacucagauuccaucacugggagccaugugaugugguggaaaaugagaaccagccccugcagguagccaucugacucucauacaugcaugcauguguccccuuaaauaaguguaauucaaacuuaagaaaauauuuuaagaugccacuccugcuuaaacucuccguggcagagcaaagguuccacgaaaaacaccucuuguacucagacccccaaugccccagaccagugguucucaaucuguaggucauggcccuuugccggggcaggggggcggcguugaauaacccuuccacagggucacauaucagauaucccacauaucaguuauuuacauuauaauucauaacaguagcaaaauuacaguuaugaaauagcaauaaaaauaauuuuaugguggggggaugucacagcacugggaagguugagagccacugcucuguagcgucagauaugggcuaacuaacuucccaggagugugcucuaugugaggagaugaauguaagaagcaggagccagucauuggaagcugccaugggcuuccuugguguaaagaucucugggaucaucucuaggccuggucgagguucagcaugggggcccagcaggaggguggaaaggauaucuucaaacauaagcagugaagggagacauguaugaucaauaaagaguccagccacagaggcuggcugcugggaaccagccacauuugcuuagccucugaggcauuucgcucuugcggcucucagcuugcaaccauaugugcguaucugucgugagaaugcaugggacacagaggccuggcggauggaaaaugcugcagguguggguggugcuggagcccauauguggacugaagaagugugugcuaugugucuguagggcuucagguacaugaugagcugcagguauauguggggccacaggugugugcuggacugcggguguauguagggcggugcaggaauaugcuagaaagugugugugugugugugugugugcgugugcuuaccugcaggugcaugccgggcuacaggugucugacuguuaguguguggacugcaggugugggcuaggcugcagguguagggauguagcugcagaugcaugcuaggcuucagguuagaggccugcaggugcaguacauccagggaggccuacacuaaucacugaaggcccccuuugcaaaguuguuucuagauauccugauaugagacagcuagggcaggagaguugcagagcugauucccagagcuagacagucagguaaucgcuuauuccuucagagcaugagacaugguucacauggucugugccaggaccuguagucaucuggcaggaagaggugguuuacaugggccugggauguccugccuuauacacaucuguggagggcugggguagugggucuugccugcucauggcagggggcacaauggcaagauaggggcaguuaugaccaaaagacuuaguccuacauccugucaaugacuguguugcugggugcaucuuggauucuggaugaugucacacguggcaggcucuaaauucaaucucauuaucagaaaaaaaaauuccauacauguucagaacacucaacucuccaaauauuuugugucuuugguaaauuauaucugccaggcagagagcccucauauacagagagcugaacucuuguuugcuucuagaucauugcuuuagauugcuuggguaugacuagagccauaauuuugcccauacuauaaucugagugucagccuuggaaaggccuccuguguguccguccccgggucucaucauccuccucugccccaaggcuggcagcucuugaucucuugcagagggcuggaugcauggggucucuuguuugcuucuaaaggaguccacaaggcuaagggcuggggguccuaaaguaugugucagagcaccuucucggggcuggggagaaggcuccguugguaaaaugcacgagccugaaaaucugaguuccaucccgugugaaaaagcuggguguccuggugccugcuuguaaucccauagcuagagaugggacagcuggagcccuggagcuugaugccagacagcaucaucagugagcuccagguaaaagagagagaccaugucucaugagaauaaucaacgaagcaccugggaauagccucugaugcugacuuuucaccucugaguaugugcgcgcacauacacacacacacacacacacacacacacacacacacacacacacacacacacagugggaaaagagagaggggagagagagggagaggggaagagagggagagagagaggcauguguguagguaugcacacaaacguuuccagacugggcagagcagggccugguggguuaggugggcgaguugcacagcagacaagcuaacgaagccuggcuucaggaucaagcaggaagcuucccaaaagcccaagcagaagccuggguggcucuuucacagccucuucggcuguugagcuaacacucuggaggccauaaaucuuuaaaaauacauuuuggcccaggguccccccacccucuaauuuuuaaaaugguguaauuugcaaagcaauuuaagucagauguuucucagugcuuuccacugagucuguccaaaugcuguuguauuuuccugucugccacggguucuuuuccaaaaauauuucugagcugucucaugugcuuccauggguaccagaccauucuagaagccuuggggacagccuugaaacuuagagcugggguugagucucaugggcuggaaucaagcaccgagucccauuucaggaccuggagguccaaugcccaacucuugacagugauguucucucugugagacaaagccagguggcuagccgucaugguccuuccucucccguagcaucagcacccccuuaagagcuggaagugaacggaacuguuagccucuugcaugcuaaguuaucagucuacacugagcuguuucuaagagacuuaaaaucaggaguucaguuuaaacaaagcaucuggagaucucugauacaacgucucuucucccucccugcauccuugucuguuucucucagguucauucauucauuuucucucucucccucucucucccucucucucucucucucucucucucucuuucucucgcucucucgcucucucucgcucucucucgcucucucucgcucucgcucucacucuuccucccucccagugcccucccccucccuccucucuucccccuuccugucuaucucccuuuuucuuuucucucuucccucucuucucccuccuguugagcuuggaacccaagggcucuuguuuuaggcuuuccuagugucauggagccacaccccagcccugagacucucuuaugccugugccucuuacacucuggcuuccuggggggaaggggaguccuuccuuuaugcuaggcaguggcuguucccaagcagcugccaguggcucucaccugucccauggugcuucauuggcacuggcaacagugcacagacaguagaguugggcucucugaacuaguaguuuaugcccccuugaucucaggaagccugugccucaguuuucucaucuguaaaauggaugcaauaaugguagauguucugcagugcuguugaaugcuaucugaguuagacacagggcaugcuuagcacagaggggcacagucaguuuguaugggucacaggggauguuuuuccuauuuauuauuacuguuuuuguuagaguucuuuccucaauguuugaugagucagccugaccuagacaaugucccuuccauuggccacucuugccuacagccuccugucccccagaggcauagcagcuucuacaggaagccuugcuuucugauauucuuauucuccagggcagcauggacagaccccuguccugaugugcugggcuguccuaagcaggccccuugcuucugacucagucaucgccccuguacacugaagagugcagccagaccaaggucacccaagauugaaaguggagcuccaggucagggcuucauaaucgauuccaguagaccuuucuaguuucucaguguaguugcccaaaagggagaacagcuggggauguagcugaucagccgacugcuuccuaacaugccagaagucuuggguccugcucccagcacugcagaaaccuaaccugguagcccauguguguaagcccagcacuccagagguggagucaggacagugagaaguucaagaucacagccaguuugaggccagccugggcuacgugagucuugagaggaucaggcuagcuucauauggccaggaaaaagauucugugccaccuucccauuguaacccccuugucuuauucacuggccugguuggcuuucuggaaagcaucuuugaaacaguuuggcuuggaguauguggauacaucucuucuguguuggaaugcugcauaauacuaggagaccuucccucuagugucugucccugugugugucugucugucuaucugucuaucugucucucuaucuaucugucccucuaucuauaguccaggcuggccucaaacacaauagauuauguagcugaggauggccuugaacuucuaaucuuccuaccuaccucccuaguaccuggauuacaggagugugccuacuuuaugcuuggcucuuguggugcuagggauggaaccaaagcuugaugcaaagguaagcacucuauccccagcccaccaggaagaauauuuaagccacucagaccuacagucucucucucugcaucugcagugcuuccauuuuacuaccuugucguagucagggaucugugagacauccuuccgcccgucuacugcucagagucccucugucuguccucugucuuuaugccuuccccuugccucugggacgccuaguguccuuacgguguuuuaucauuacuguccaccccugucaccaguacaacaaccauuccuccaacaauugucugccaagcaaccccaucacuucaggugugugccaagagggcuguaguggacagcugcuccugcuggccugagcuuccaggcugugacagucaguugaugcugguccuguccugugcuauccuacaucccucgguccccaggccuuguggacagcagggaacuugcgcagcauccagccuucccuccuuaccugccuuucucuguggggccacacacaggcugggaugcacucaggugugacuaagugggcaauuauucuuacuuaagcgauguucaggauugcugcugaaacugcacagaggcuguuuuauggcccagccacauggaacagcuuguucccaucagacucuuuccagggaguguaaugcuacugucccuagcagcuuggcuugccagaaaacuggagauagugccccccccacccccacacacacaaccagagguauugcgaauggguucugaacguucugggguauuggggugcccgauauggggaagaggugauggagguucuucccuguccaaagcagugucuguugguuaggacaaggcugguuugggggucacuuaggcuggguuucaaacagacagccaacccuauggaugauaugauuuagccuauccacaccuauccaugagcuuaauuaauuaauuuaggaaacacagccaguguuaguuacuacacucacugcuccgccaagguauccgaccaaagcaacuuaagaaggaagaguauuacaguuugagaggcuccugcaaucuuuugguucccugggccuugaugaugcugaguagacacacauccaucauccuucuguccguccuuccuucccuccuucuuuccuuccucccucccacccccauucucuucuguccucccuccuccuccuccuuuuuaucuuaggguuucuguugcugugauguagagagagccaagauucuugcuacuuccuaaccuuaguguaaacacacagcuguuugcuggcugagucacagcaugcucgcugugguaaaugaccacagacaacccacagcucauaaucuaucacugagggaagucagggcaggaacucaaggcaggacucugcaggcaggaacggacacagaagccguggagaaauguggcuuacugacuuguucccuguggcuuucucagccugcuuucuuaccucccaagaccacgugucuaggagggacaccauccacagugagccgagcucucccguacaugaaagugcuguccagcacuguuuguggagccaugguucucaacguuuucaaugccaugacccuguaauacagcuccucguguuguggugacccccaaccauaaaauuauuuucauugcuacuucaaaauuguaauuuagcuaauguugggaguuguaaugcaaacacguguguuuucugauaguuuuaagugaaaccugugaaagguccuuugaccugccccccaaaggggucucaacugacaggcugagaacugcugcucuagagcguguucuucauuaagauacccucuucucagauaggucuacguuuguuucaaguugacaaagccagccagcacaauugacuccuuaucagcccgacauacaaaaugucacuuauuaaaccacaaccuuuucuuuuuugcuuaaccccaaguucucauuauuaauacacuauaacuuuuaaaauaccacaauuuuaaaaaagauaauuuaaaagcccaaguuuucuuuaaaaaucaaacaucucuuuagaagaucucucuacugcaaauuaaaaaaauaaguuauauacuuucuaaccccacgagggaaggagccccaggcacaguuacauuuaaaucagagcaacaccgaagucugcaucagagcucugggacccacgaucucuuggacucuugaagaccucucuggcucugccauccacagcacacauaacaugucucacaggcuuaggccgcuccacucuacagugguuaucccaugguacccucaucuccaagaugcuagcuaggucuccuuggcucucuucuggaacucuaaaccucuaaaccaggaugccaagccucaacuccucuccaugaccccuucaauccugggguuuaucaacuucagccgaagugggacauucgucaauggucucuccuggccucucccagggccaagucucagcugcucuccguaacgccuuagugcuuucaaaaaccugagaacccuguagaaucacacggcagaggauuuggccugaaugacucuggucucuucauaaucacagcugacgcgucagcccuagcugaccaguauuuccgcagcaaagcaaaguuuuaauuuuagugguucucauccuuuguuaaucacggaugauucuugagccccaguugaccaggaacacagauuauuaauucaaaauaucaaaauaauaauccaaaaagagucuuugagggacugucaaacuuccuccuggaccaucacaagcccagccuccuccauugccuucacugcuuucagcuuuaucaagugucccccacaguucguuaagcucugaacauccaaugccuuuucugcccccaaggaucucccacaauccuccccaaacaacauggcaucaggccugucucagcauaacccaggaaccugguaccaaucuugcuuuaggguuucuguuccugugauaaaacacugugacugagggaagucaggggagggaccuuggcagaggcaggggcaggggcaggggcaggggcaggggcaggggcaggggcaggggcaggggcaggggcaggggcaggggcaggggcaggggcagaggcagaggcagaaagaggcagaggcagaaagaggcagaggcagaaagaggcagagacagagguagaggcagaggcagaggcagaggcagaggcagaggcagaggcagaggcagaggcagaggcagaggcagaggcagaggcagaggcagaggcagaggcagaggcaaaguggaucucugugaguuagaguccagcuuggucuacaaggacaaccaggacuguauacugaggccuugucacagccaagcaagcaaacaaacaaacauuuccucuucgaagaaauguguagguuugagucagguugacaaaaaccagccaucacaauacuccuucuccucugcccccuuuguccaguuuaaaaugcuuggcaauuucauaagauaugccuguauauaauauaucuugacuguauccacuuucucaccccucccucucccacugaaccccuucuuuccagcaagcuccccacuacuugcaugucuuuuugcacguuugauuuguugaguuaaguuagggucgcuugcugaacacgggugggguuagucacugaugcacacaugccuccucccaggcagcccccaccugccaguagcuccauucuuguaucuuacuguggauauuaaauggacuugggaguugugcauguuugaagucauuucugguuacagaaugaguaaaaaaaccacaaaaccucccaagaucaaacaguucaaacugcucaugauacagauuuggaagcugagguccugagaacaggcaugcuaguggccacauggucauaucauuaguccuggaaaagggcauacuagaaagucucauuggguuggggacaacugucccucagccugggacccaaaccucacuuccccaaauugacaguguuuauguggugaacaauuuucugacauuugguucugucaggacuaauuuuagcauuucuaaagcuugguggaaauacagccucauuacuccggugccaguguguaguuuacuauucguauauucugagguuuaucauuuuagucauguuuaacacggcugcaccaggcaugcucuauuaaauccugcuucuuuuacauuccuguccggaauuauuuauucggaacaauuuccacccuaucaaaagacacagcuaaugcuguguuuuaauguguuauuuacacacaaaauaaccuauuuacaacucagugugcgccagagggagaauggaugggcccguucccugcauucuguucuaucgggcuuuaacaaucuggaaagcuaauagaaccauuuaucauggguggggaggggucggauaauuuacucugugcuuguggccaggucccacugccucugaucuggggaacauuuggaggauaaugaagucgagccuggcaucugaauggguguaagggaggcuugugugaguuugugggguauggccuggauguggugauggggugacccugcuuccacccucuaagagguuucccauuggaggugacucccagggcauggugaugaaucccauauggggugccagggguggggucucgacaggaggggcagugucugggcuggguguccccagcuggaaagaaagaggggugacgccccccagagcagcuucuugagagcucauggacuugacaguaaccaguggacucacauaacuccuuggucagggugugaccuagagaacaagcccuaaacagaguuaagcauaugacccucaauuaucuguauuuaguuaguuauuuauuuauuuaauauuauguauucauucauuuauuuaauuuuguauguguagcacauguagauauuugugugugguguauauguauacacauuuguguaugugcaucuguguggugauguuuugugcauguauguauaugugcacacauguuugcaugugugugugcauguguaugugcaucuguguggugauguuuugugcauguauguauaugugcacacauguuugcauguguguguggagggacggggggggggugcacaugcuuguggacgccaaagguugacacuagguguuuuccucuauugcuuuccucuuuaguuuugugacacuaggugucuuccucuauugcuuuccucuuuaguuuugugacacuaggugucuuccucuauugcuuuccucuuuaguuuugucagauuuguuuucucacugaguuuggagcucacuaacucgggaagaccagcugaccauccagcccugggaucguccugccucugccuccucaguacugugauuaaggcacaugcugcuaugccuaauuuuuauguguuuggugaacauagaaccuggguccccauacuuguggggcgaaugcuuuucugucgcuccaucucuccagccccuggguggucgucgaauggacgcugauagaugaauugaaaaauuaguccaucaaugucuguacgugaggaccagagugcagaagggggauccaggaagcagagucccugguuucuguccccaagaacuuacaguagccaccaagaaaggcaagacuccccuucgucuggcagaugugggcgucacccacugcaguguggccuuggaaaacagcaaugaggcuugggggacacugucaccugcuguccccuacccuuguuguaggaggccuacacacucugaccaauuugaggagcaauggggucacuguggugauuaaucuugauggucagcuugacaggaucuagaagcaucuaggagacaaaucucuggacgugucugugaaagagugucuguauugagugaacugaggugggaagacccgccccgauuguggaucuccccauuucacagcuggagugaguuccugagcaccugugugcacugauuuccacuuccugacuucggaugcaaugugaccagccaccuccugcucccaccaccucgccuucccccacugccgcugugaugguuucuacaccggggaugugggccaaagugcacccugccucccuuuuugacauuaccuucauucaguauuugucagagacacaaguacaguaggguuuaugaaguguggcuggcaugugcucccugagggacaguggagcugggagccuaggcuugaaccuucucccagaccuucuaccuuggggaccugccaucauuaucucagacaccugcuaccauuggagggcuaggauuuauacauaaggagcauaaugugucugggcagcccccggcacaugguggauguacgauggacagccguugcugcucaaagugcugccguucucacuggccugugguuauuaauucaagaacuguuuccucagaguaacguguguuacugauaaauauuugagagagaaugaagcugagucuucguugugaguagcaguucacacgugguguauugugacacggaacccaaggaacggcgugggcaaauguccuggggucugcauguguuccagggugucugaguccaaagagcccaggaaagacuacuagcgaagaagcugguuuacaguccuauugcaaggguucucuuugcugcugacccuggcccaagcucacgucagaggccgugucuagugguccuuucuuggauacaucuuccagcuggggccagcuggcccccucugccucccaggcugaggaguccugucuuagagcgcuguccuuggcugguuuccugugaacaaggaugcuggcaggcccucccugcuuguaggugauaaagaagcuguugugucuggggggaggggcugggaagucugugacccuggcaguuaguguguguuccucugccaccugacccccacccccaucaccguuucacagucaacguuugagcuaagcacauccagcccucaaccuuuugggccacagguaccccugaauagcugugaauaugaucugauacugaagauaucacaagguuuuuggguuuuuuuucuuuaugauuucauuuguguggcucgauugagcagugugaacuuuguaggugacagugaagugggugcuugggauuugaacucaggaccucauacauaugcagcaagcacuuuugcuccaagagccauuuuccuagcuugucccuuuccccacugggccuuuuagaacgaaugagaccccagauacccugguccuggggauaagccugauuuauaagcagucacagaaaauauacauggggagacagacaugcaauguggauguuguaaagauaaguaacggcaguuuccaagccacuuaaacccuucccuuugggguacgaaggggucucugcagacgguaagucuuuaucgagaaauguuuacucauaaacagacaccgagaagccagggaaagaaagcagucagccuuuuauggaccaacagcggccucucuguagugggagcugcaaaucaccugccuggcauccauccauccugucccaaagcuggggguggauggagcaucaagccagacugcagacagugaugugcuuccacuuccccuuccuccacccaugcagggaucuuguugcccugucuaucucagccaucugcuguggcucgaagguaucugaguucuuuagucccaugugucaccagccuaugacuucaagccuccuauuguaccuccaacaggauuucuuuguuggugcgcgcgcgcgugugugugugugugugugugugugugugugugugugugugugacaggugcgugaaggugcacgugugcaaucacccauuuggaagauaaaagauugauggugggugucuucccccgacccucucucuuucacugaacuuggagcucacucgucuggugaggcuagcuggucagugagccccaaggaucccggucccgcugugccaggacggggauugcuggugugugccagcaugccuggauuuuucugugagcacuuggaacugaaguggggucuuccugcuugcccaucaggccuuguauccauagagccaucgccuugguuccccgcguggcccucuuguuaccuccgcacuuuucgcaguguuccccaaguguccuuuguuccucugcucccgggagagcuguccagacacccucuccauguuacuguuacuguacuugccauuguggggugcagacuuuacacccccucccaacguggccacccuggguaagucuccuuuuucugcuuuugauuauuaauuuggcaauuuuaauggguuucuccaggacagauggcagacuugccuucagggauaagcuggagccuucgaagacacuuggagguugugucagucgcccugagggucuucacaguacuucccaguggcuccccuggagaacugcuucucaacccgugggucauagccccuuuggggaugaacgacccuuucacaggagucaccuaagacuaucagaaaacacagauacguaauuaugauucauaacaguagcaaaaucacaguuaugaagaagcagcaaauauaauuuuaugguuggggccaccacacgauguauuaaaggguaacagcaccagcauguuugagaaccacugcccaagagccuuuccuggaucucucggugccucccuggggucucuugcuaugcucucuauacucugacuuuacauugcuggaaguggcuguuugaguuucuugucaccccacccacaccuuauaggccauaacuaacccaaaugacuccuucaggucccugagggccauugaaauggccugucauccuuacauuuucaucagccauuuccuaccuaacacggcaccccucccccucuucagcccacucuuccucuacugagucuuugggcucuguccccaggacucuguucugggccucugccacagaucuuugauucacaccuacucuucuggacaccuaggcccucucgccugucugacaccccuuugcucuuggccuggauggaccuguagcuagauacuaaaugcuucguuuccauccuaaggaguggggccaccagucacuugucagucuguauagagcaaacugaagaguccugugcaccagccaggcccaggucuaucagagcccccucuuaccuccugaagacucauccucugauugucuggacggcugauguaggagaaggaaugggagccgggucugauggggucuccuccugaaucucguguucuuccacuuccacccuaccacgacccugugccccgcuagucucauaugugccacuacccuucagaauugcccaaacuccagugccugaccucuuacagaggaaucuugagaaaagcuaaaacuucaaggaaccccagauccauccuuugggguaguaaugucucuguaagcucagguuuaugcgugucugaauuagucaaguucucuaaaggaauggauggguaaaguuguccaaccuuaguugucuccugcuggaaaggccaaggguccaucaguuguucaguccacaagacuggaugucucagcagccccagucuggugcucgggucccagggaaguccuggagagcuucuuugaauucugaagaaguaggaucuagcaccaaggaaggacaggacagacgaacuuggcuucaggagcaagggcaagcaggcaaaaggcagaaguuuucuuuuugcacggccuuuuauaugggcugcaggcagaagguguggcccagauguagggugggucuucugaccucaaaugaucugaauuuagggugggucuuccaucccaaaugauccgacugagaaaaaucccacacaggugugcccagcugccugaguuuuaguuaaucucagauggugucaagacuagcuaucacagagcuggggacucugcccuggaagugaugagcuaaaucugacucugcgauggauuuagggaaguugguucuucauccaagaaagagagucauuucugccacucuaaggggcuggcaaggaguguagagauggcaggggucugugugccuguucucucugcucucuguccaaaggaggcucugaugcuacauucagugggccagaccaggcuuuggcauccuaacaauguaggguugauggcacaggcagacagggagaaaguugggccucuggauguaggaccugcaacuccccucuuacuucucaaaccuaccugacacuuuaccuugagcuucuaaccauccuagaaagaaugaagauauuccaaagaaagagaucccuguauucuuggcuaucagacuauucaaacaauggaccccaagcaauuggaauucuccacagaguuucauggcaggagaaggaaaaggccaagugccugccggguagaaaccucgucucccaggaugagauuucauacaguucugauaccuuaugcaaccacuuugcaggggagaagggagcugaggcagagaagucagaggacagccuuccauucucugcuucucacuaugacugguuugucuaauuggccuacugaggacuuguuagcguugggagggcccagccuuauaaggagcuugcucagucccagcagaucugagcugaaaggauccucugccuucagugucucccggcagacacucugccucuucccauccccugguuccuuccaggccagaucugauuugucaacugugcuuaauucaaaaggcguuuggauguuuguggaaggcugcugguuagcauugcugccaaggccacccggucacuaagugcuuuagucaggacuugaacuugagucagccuggacccucuagggaaugccuucuuccuucaggucccacugccauccuacuuccuauggcaaacugauucuguagaauggcugugagcccugcccucugucacuuuucauuccccuguauguuggggacacaugcagcuggguuacugcugagugacgugcccugagugagggcuaggacauucaucuauuauucaaggcccuuggggcauggaguuuaggguccuuagggucccaggaugcuuuuaaaaaugugcuuuaacuaauuaauuagcuaaugaauggaggguuaugcagugugcucaucauguacguguggugcauguacaugugugugagugugugagugugugugugcgcgugugcgcuucugugcuugugugcuugugugcuuguguggcuagcuggcuggccugucagugaacccagcucuggggaugcaggcauccccugccauacuuggcuuuuuacuuuuauacaugaugaugagcuccagguccuaaugcuugaccaacugaucuguaaccccagccccaguuuguccuuugagauaaggucucuuacauugccuuggcuguuuggaacucaguauguagaugaagccuucuagaagggugguucuucugccccuccucccuggaaugcuaagacuaucagcacuccuggcucuaagguuguuuuguuguuucucccucuacccccauguguuuggagccccccagauagaaaguuguucucuagagcugagugaccuucugggagugcuuucuccuugagaucuauaagguucugucugccuaucuucucucuuugccauuuuuaccagcagcugaaucccagugccagggacagaggagcccaugcugugaccuuugcucccuguccuaagcaaccugaggcagucacaucagacuuucauuaucgcccccucccccccaucuccaccucucagugagccugucagguuggaagacagacuuggaagcacagggagagggcuuuggugugguuagugcuaggagaagagagaaggcauuucuagcugcugcuuuuccugcuucuggaaagagaggccgggaagucuucuggacuaggugggccugucugagcugagucuggaggaugaagaggcgauuaggauuucuguuucggagauaaaaugccaugaccagaagcaaccuggucaggaacagguuacagcccucaggccacaugucaucacugaggaagacagagcagggacagaaggagaggccucagaacacuucguauuggcuugcucuucauggccugcucguuagcuuucuuaaacauccuaggaccucccacccacgacugacaucgccugcugugagcugggcccucccacaucagucauuaaucaagaaagcaucccacugguuugccuaaggccgacccuauggagggauuuucuccacugugcuuccugcuucucagauagcucuagcuugugucaaguugacaaaaaacccaaccaggacgaguucauuaggcuggaaaguggggcauauggaacuguaugugggcagaggcagagagcuugggggcacuugggacuguuggcuauuuugcuggaguggcagacaagaaaaggccuuucaauccucuacauuugucuuaguguguccugagcucucuuuggcucuccuuggcuccuuuaggauccaguggagugaguguggauuugggucaguuccugcccccaucucaacccccagacuguacauuaccgcuucagccaagccuucagcugcuguuugcagugagccauucacugggggccccuguuagggagacugcgcgcgcuuucagccugguuggcugccaaacucccuggaagcugagaggguuaaagcaccaagccagcuggugaacauuaguuccccucugcgucacgucacuggcugauggagaggcagagagugagcugguggccagcacuggagggaacugccccuccucggcucuccaguuggggggcacguggccuggugcccagacugaaaccccagguaggcuggcuguggaugcaggacccugagguaaaugugauaucacaugguguguguguguguguguguguguguguguguguguguguccacgcaugcuugucuuuugaaagaguucugugcuggccagaacuucauggaaaaagaaagggcgugggggccggagagaggagagggggaagagagggaguggcucuccccagagaguugggaaaggcugacuuuuucuuaaaccuucaagugucccaacaacuuccuagggacagcuuucucuaaggugguaccccaucccccucuucccaggacauacaagucccgagaggccagggaacaauuugcugagguggcuuaaguacaugguuucuccaucuguuuuugugaccaagaggcguuucaaagggguugccaugugccgagucaguagcuaguguguggccgcccugugguuucagauggcucgccaagaccagggcuuccccuccccagagaaaugcagcaagagcuuuucaggggccugagcaccacguuagagugaccugccccugugagacuggcaggcuguuuuacuaugccucacugaugucuuggccaccagcgugugauggagacaguguuguggggaggacuucugagcagagguuacaaaaguacagaugugcacggaagguuucauugucccccgggcuucauggauggcgcuaggaagccuagcuugagauguguguuuuccuaguuugcuuggaggucaggagggggaaaaauguccaaauuaggaaugggcuuguggcuuagcugagcagagugaagaggagagugucugacuguagacucugaggucucagggacacuucuggccaaagaggcaggggagaggggaccaucucacucuggccugggcagccaaccaguguccgaugcuucaugucugagacugcuguagggggucucuacacuuuaaggggacaccuggacaauucuccuccuagcccuauuuuucccugccuccauuuuucaacucuuugaguucagguuguccuggaacuugcuguguagccaaggaugagcuucaugccucuacccccugggcucugggauugcacccggguaacaccaggcuguuuaugugucgcucuggauccgaccuacgauggcuguaacucgagcucuggcacacgagacaggcaaaugagcuuauaccagaccuuuacguuuuuucuaacuaauggaggaguaggaggccuacuuagagaccuuaggccaucgccuugggcacaaucucuuucugcuuugccccagccagcccuuugugagguugucugagccaacacugacuccccuaagcaagugcaguguccuuauuacagaugggaaagcugagaugaccgguuuggcccacccaagugggugguucugguguugggagucacaguucccaacuucauuucacuccauugccucaaccugggcugggcuaccuucugugguaugcaguagguguuccuguaagccuuuaacuccacagggucagagcaccguggccugggcagccguugcuucuucguggucuuuugcugggucccacgucucugacuuggagaugaggcuuugaugguuaaggccugggcagugagccaaguucauguucucacugugccagcgaugccuggacaaaaacaucaguguccugucccagaguagggugaaaggauuaucgcagggacagacugagcuguuggcaaugggacacuucucgaggugcucagagggccacaaagucacaguuauggugacugugaugguuaacagggucuggaaucucccaggagacaaauuuugggcaugucugugagugaacugagauuagcuuaauugguaugggaagacacaaccugcuugugggcagcaccauccccuggacuggaguccuggaccgaauaaaacaaagaaagugagcuagaacacacacucaacccucugcucucaacuguggaugccauacaaccagcagcugccucucgcuccugcugccgugcccuccccgccaugauggccugaguccucagacugugagccagcacaaaccuuuccucucucagccucagauagcugcaggccuucuauagaugcucugcccagcacagcggaugcucagggcagcccacuggaggggucuuaguuaugacagaaagcaaaaggacaggauuguccuuggugcugcagaaggcaugcgaauccagaugccugaccuuccugcgggcuccuugugggaagucgucaugguaaauaccuucaguccuaagcagaagcucaucagggcagcauccucaaaccacacuuucuguucacugaaguauuaagaaguugaugcggaccgguauauagacgacuugcccagcuuguaagaaaccuuggguuccaccaacccagcaacccauaagucagguacgauggcacgugucucuaauucuaguacugacaggguagacacaggaggaucuugaggacauccuuggcuucauagcaaguuugaggcuagccuaggcuguaugacaccuuguaccaccaccaccaccaccaccaccaccaccaccaccaccaacaacaacaacaacaauaacaacaacaauggaugaaugcuaaagagcacaggccacccucagagugaccucucuucuugucuuccaaggguagguaggcuucguaagccagagcacauuucuuuccuuccuuccuuucccaccucgcuuccucccucccuuuugccuacuuccuuucccucuccuaguuacuucccuuuuuccuuccuccccucccuucuuucaucucuccaguccagguugcccuguugaucucucuguguuagaggaugaccuugaguuucucauccuccugccuccgucuuuucuuucuauucaggacuuaacuuugccaggauaguucugaaauugacaacaaaaauacacacacacacacacacacacacacacacacacacacacacacacaguuaauuccuaaagcaugggauuccuguuuucauccacaaugcagucugaggucauccagaucucuuaccuugccuuuccuccuuccccaguggagauuuccaaugcacagcccggguaugguggaccccagaagcucucaucugagaugcugagcagguugaguucaugaugagagacaggcuuaggggugaugaggugagccccccacuuugcucugcuccuuuaucuugcuucuagagccaaggauguaagaagggcaguggcuacaccccuccucuggucccgauuauagcaagcucugcagggaugcuaucucauagccaaagaucauuuauuugaaucucuuuuuaauuucugucgugggaaccgccccuggucuugcauaauauaacaaccuacagcagugcuaaaccuauaaacccaacugcucuguuggggugaaggggcuggagucaggaacagauagggagacccccguuagcauuucuagggacagugcccgcguacucaauaggcaugaaagagaaggaggucagcagauacugaaaccuguuucugugcuuccgugggaagagucagaugcacacggcagaucccucugauuggccacuuguagugguuuguggcgacuaugaaugagcauggguggccuggggacaugcacagaauaccucauauguagguaagguucagaggguuuuuuggagugucucuuuuuuggggggggguucgagacaggguuucucuguacagcccuggcuguccuggaacucacuuuguagagcaggcuggccucgaacucagaaauccgccugccucugccucccaagugcugggauuaaaggugugcgccaccacugcccggcucuugcuggagucucuuguagagaacgcugauuucccugacuuuggcugaaagaggagagcugccuugcuuaggacucagaggaugaggcuagguagagggagagaugcuugugggauucugacaggcugagaccacagggacaguggcaaucauucagucugagaggagcugccuuuucuguccccauagaaggauuuacguacguggcagcccuuggccccauuccuauaaaacuaggcacagaucaaaacuauuuaugcuuuaugggccaaaagcaguguguuggccugggguguagcuucguuccuauggugguuguugagggagcucgaggcccugggugccauccccagcccugcagaaacugggcauagagaugugugccuguaauuccuguguugggagaagguaaggcuuaucccccccugcauacaguuugaaguucucuagaccacaugagacccugucuccaaaacaaacaaaccacaaauccgagauucauuaauuaauggaguucuguagcaaguuaacuuuauuugauacaggagaaaaagacuuuucugacuuguuggcucuggaagucaaagcggccaguacuggcuggguuuuuguuggggugccuucuuaaaacacacacacgugcacauauaauuagugagcgugagcaccuauguguggggcucagagagaacauuugggagucaguucuccugccuuguugaggcaggucucacuucuccugguugugaaguagacuccaggcuagcuggccugugagcguccgcagauugauucucuggauuacagauguguacagcugcaucuuacuuccuauguggguucgugggauugaacucagguccuuaggcuuaugcuucaggugccucuacucacugaaccauaugccuggccuugagcuaucuucuaagcaguggaaacagcaguaaaaacuaaguucagagagguuaagccauuuguucuuggucacacagcaugugugaaggagacagaacaagcaaacaagccugugaggucugucggguggggaaggugauuaggucuacagugaggaaauagacuaugucuuuccccugaccuggguauagugaggguaacguuaacuucuuaccgucuuuaucauuuaguuccuaggguacuugccuaguguacuugaggcccugggucccauccucagcccugcauaaacugggugugguuguugcaugccugugauuccaggugucaugagaaccuggauguuccuuguucacaccauccccuccagacagaaucauccauuucagguguagcccagcaguauccuauguccugcaaaguguguggagccucugccucacucaggagcagugcccaccucucuaggaaccugcugguccugcugcccccagcuccagaaugcugagauuccaaguguguuccauacgccuggcuuaugcugggugaacaggcccagggcucugugcuugugaagcaagaaccccagcccccuguagucagcuccgaugacuugucuccccauccagcuugcugccuucugcccuccaggcccauccucccugccaccagcagucggauguuuggauaaacugggcauagcugggcgggugaucacagggacccugcuuccgcccgugucugcugguugacagaugucucuacgugagccugagcuguuuagagccuugugugucagcugugguccagcagcgucccagugugggacagaacaccaggagugaggcucccccaagcccucacagcuggacacacugggagacuaucccgugaugacucugcugugagggagcagggccuuggguggcagccagguccugucuggaggcagcuagguugcuuguagcacacaucgcacugagugagucagagagaggagaccgugauggguucugggaagcugccagcagaggcaaaccaugcuagucagccuccauuacuucacauucauggucaccgucaaguaagcuuucuuuagccacacggugggccuuucugacuagcauuuccaugcauccuguuucuggguuuccauccacacagucuguguguaccagacucagugcacacuuuccauugcccuuggcuagggagguaguggggaugcccuacaguacagagacuccucagcuaggccuacuuucucuugacugggccucacuugaggauuucaacagaucucuaguaggaacuuccaaaggcaggguuccucuguguucuuuccuguuuuccagauuagggaccugugaucugaguacuccuggucacauagguggggaguggauuuggagcuaagaccaugaucagcaaagccguugcuuguuuuuugguuuuugguuuuguuuuauuuuuguuuuguuuuguuuuucuguguaguccuggcuguccuggaauucacucuguagaccaagcuggccuugaacucagaaauccacccaaguacugggauuaaaggcgugcaccaccacugccuggcugcuuuuuguuaaucuaaaccacccugggcaaugacaaaagaaggaguggcucaucucuuggugguguugcccagggauaacugaggacccauugggaaucaaucugaguguccacugaugggcaagugggugucuucguuaggauuuuacugcuaugaacagacaccgugaccaaggcaacaauauaaagacaauauuuaauuggggcugguucagagguucaguccauuaccaucaaggcaggagcauggcagcacccaggcaggcacggugcaggaggagcagagagcucugcaucuucuucugaaggcugcuaguggaagacugacuuccaggcagcuaggacuaggaagcccacacccacauugacacaacuacuccaacaagauuauaccuccaaauagugccacucccuggcccaagcauauacaaaccaucacagugagugagcaaaguguagucuguagauuggguggacuaucagucagcuuugaagagggaggaacccugacucaugcuauaaccucaaaccauggagauauggugccgagugcaauacgccaguuacaaggagauauguaguguuugauuauuuucuuuucuuuuuaaugugugcgaguguuuugugugcauauguauaugugcauaacaugcaugccugguacccacagauaugagaagagguucuaugauccccuagaacuguaguuauggauaguugugaaccccuguguggguguuaggaacugaaccuauguccgcuucaagagcaacagauucucuuaacugcugagccauccugcaccccacaugugauucuugagcagugcccugugccuucccaacuguagucagucuacucauagaggaagaaaguaagcagaggcgaaugacaggaagagauggguacgucauggaugauggcaaagaagcucagccugcaaguggaggugggauggcaaagaagguucuggagguggugcugagaucacgcaggauaaaccacaccccugggcuggugguaaagauggcuauaguggaggccggcauaaccaacacgacucagccaacacaacucagugggcaccaaaccugauaaccggagcugucccugggccucacguggcagaagaugagaaccugcuucuagagguuguccucuguccuccaugugcucaguugcaugggugccuccuucccaaugagaaaauaaauacaaguuaaacaauguauaaaaagauuauaaugggaaauuuaacuuuuuuuuauaguuuacuagcauuuuuuuguagacagggucucauguagcccagguuggccucaaaguaauuaugaugccaaugaugagcuugaagugcugguccuguggccucuacugcccaggugucagcauuacagaugugcacugucacaccuggcucaggcagugcuggggauagaaccuggagcccugugcauacaagguaaauguucugcuaacugagauucagccccagcccuuucaacacauuuaaaaaaaaaaaaaagaaaaagaaauacuuuaaaagaaucuguauagagcuuguucaaagacucauggauuuuuaaagcuuucagaccuuauacccugguuugaccccaugucguuuuauuugugaggaaggccugcuggggucgggagcccugggccagcuggcucuucugaggaaaugcugcuguagaugaagauggaguaacugugaagccagccucuuacuggagucuggucucccuugccuggagaugucuaugucauuagagcugucaaccccaaagacaugcuaaggcuuccgggugaggaacacaaagacuuuagacauuuaagugaucccuguuucuguuugugaagggagcuaggaacccaggguuacaguagcugaggugauuuggggaagcagcaauuaaaggugaguucgccucuuuccugcccuggcuguguguccagcccccaggguuauugugccuucgccagaccauuucuuuuaacccugcccucugucuucuccaggucuggacccuggaaagaaaugaaaguuaaauucccauucaucacagccccaggcgcacagagaacacuugguggugguauuggccaugaaggugaaagugugcuucuaaacaaauuguggacgaagcagaagccaggguguauuugguuggaugcuggaguuuacugaaucauuccauuuuccuccugcaaauuacacaucugugcagcgggggaggguggcugcaugccgcacuguaugugcggaguccuuucuccuuccugccaugucaguccugcugauagaacucacgcugucguggggcuuggcagcgagcagccuugccccugagcccccuugacagccucacuccauuucuccugauguuaaaagggauccuacacugcucuucucugugacaaccagcuuccuuaaaugauugcccguagucauuguuccuuacaaccauuccaaagguguccccagcucaccaggcugggcuggaccacacacuucauguguuugcaugcuccacaccagagacaugcacagccuucucacagaccuacuugucaaacacaaucugcaugcauacauuccccauccuuagccaaaaccuauguacguauguaccacacauacauguacacuugugcaccaacuauuaucacacacaugcauccccugaauccuucacacacauuggcagccacaugugcaugcacaugugugcaaccuugucauccauauccgcacauacuuguaccuucacaccuguacacaccccucacacaucggaacaugugcauacacacgguccuuacguuucucacacacuuaacacacaugcacucauguguccagagagccacaucagcucugccagaugaacagcacccaguugccaaagaguuuaccacaguaguccauguguagcugccaccucugccuauagcugugucucuggggagccaucuuugucccaauuugggaaucaggguuguguuagcuacuuuacucggugcuaugacaagauacccagcaaagcaacuuaaggagagguuuguuuuggcucacagucuaaggguacacagugcgcgguggcagagaagacaugguggcaggaacuuggcacggcuggugaucuugccucuguagucacagagaaauaaguguucgugcucaguuuguuccccaccccgucuuuuauguauuuuaggacccagccuagaaaacauaaccacccauaguaagggugggccuucccaccucagucagcccaaucuagaaaggcccucacagacuagggggcuugucuccuagauaggcucuugacccuaccaaguugacaguuagcguuaagcauugcagccugcuagggugugcuugacuccuaaauaagaugaacauugaugccucucugagaaucuuacccucauuggcccacauuagcaucccauaauagggugccucaccacuuucccaagugucugcuagguagggaagugugggcaagcuugguaggagauccuaggucuuuagugugggguaggggggucuguaugagcucuccaggccucuugcuucugucacuuccacuucuggcucacuaagagcauuucuugaggucuuugggugcucagagaccagaguggggugacauuuguaaaccuauaugcagguuucacagcaggguuccaccccuguuagcuaguugugggcaggguauacaugcuugcgugugucugacuaugcaugcacuguguguaagacugcuuacaggucacugaugggugaaggagcuuugccugacagccuggguuguuggggguauaguguucacugcugacuagguuguaguugagcugugcuggacgauggacuuucuauuuaugcacugguccuuaggugugagccuauaccuugcuucuaguccgagcauguacuacccagacugaaccugagugugcagugcuacugcuggaugcaucauguguccuucauugccuccugaggucauuucaacagcucagcuccuucugcccucagaggguuccuaucuccucccugccuuccgcacggucucugagccccagcagcacucaggcacuuaggagccgucagccagggugaggaggaaugagaaugagcuccggccucccugguggaccuggauagauggauacagcacagaugugcacaggugugugccaagccccaccuggauagauggacacagcacagaugugcacagguaugugccaagccccauguaugacuguaggcugggcugcaggguccugggaacgugguccccauaggaguggcccuuggaggcccgggagagacacuaagcauaaggaaaagguaaugggggcucuuccuugggggcucuggcagggaagcucuuagcaugaugaagggggcuggagagauggcucacuggccaagagcauugcugcucauccagaggauauguauguauauauguguguguauacuauaacuccaguuccaggggaccugacaucuaccaucuaugggcaucaggagcacagguggugcacaaacauaaauacuggcaaaacacccccacacauaaaauaauacaauaauuuuuaagaugaugaagaaggggauguggaugcacaggccaucauaggggaacagagcagggccccucuguauagaaucucuuuccuuuuugccugaccccaucuuacccccuuugcucucuaugcuggcucuauuugcugucuuuccuucugucugucuccuugucugucugucugucugucugucugucugucccuuucacucugccuugguguccauauccucucuguuccuuggcugauuucugcuccccacaccccuucaacucccuuuccgcccugucuuuucaucccucuccuuuucuuucugccucucugccucuccuuuuuuccuccuuccugucucucugucccuuugucugucugucugaaccuugagcccauaccaucucgaugccugauguucaguccaccuuccccaaggaacugucaucccagcauugaugcagaacaggacguuggcuagcacuccucccauggaaaaaaacuucacagcccaaaggcccaggccacagcuacuggaccucccuggagacgggcagugccugugguguggggacagguguccugggacagccgagugcccacaaggacacugacgucagacagggaggcaccuguguuuucuggaggguuaagccacaggcauuuaagucaggggaguaagagccaagccugagguguucagguucguuuucuugguugggaguggucaguuaagugcagucagccaccgucucccuggguucuuugccugaggacugagccaggaguguguguguuuaugcauguguuugcugagcagguacaggcccacaguauucaugcugucuuagguaccagaggcaaucuuugaugauuuaaguauaaggauaugcacaggcaacacggaaauucccucucucucuuccucucucugucucucucauucauuccuuucuuucccccuccuccuuucuucaugugcaugugguguaugugugcgugaccauguacauacguggugugggguguguguguguguguguguguguguguguguguguguguguguguguguagacaugcucagggaagccagagaccgagaucaggcaucuuccucccuugccuuacaccuuaaucuuucuaaggauuuauuucuguuuaguuaugugccugugcacaugagugcaggugccuguggggaccaguagagggcacuggauccccugcaucuggagucacuggugacugugagcugcacagugugggugcugggacucaaaucccaucccugcaagaaagcaagagcuuuaacugaugcgcuaccucuuuagccccucuaucuugguuuuuucuuuguuugcuugcuuuuguuuuuuuguuuugguuguggugggguuugucuuugguuuuguuuuuguuuuuugagauaggagcucuucacuaacuccagagcucacugagcuaagcuagcuggccagggggccaccagcauccuccuggcuucaccucccuggugcuaggauugaacuuucaugccucuaggaccagccuuucgugaguuuucuggggauggagcucaguuacuggaacuugacaaggcaagcaugucacugacugagcuggcuccccagguuuuuauugucaagcaggacagugggaaugugugccucauuccuugcggcagaaucacaguggcuugguucucagucuggcucugccugcuccaggcuguggcggcaaugucccuggagggcguuggagaccacggcucuugcacaugacgucugugaaccucgagagcaugugagucgugcauuugugcccugggcaccucugccaaguggcgagacugacaucaaguacagaagauuaaaucucccucuuggauccaggaugacaggaaguggcugcuggagacuggguggucugggcaggcccuguggccaugagggcuaggcugaaccccucucgugaagccugaggcuggugccagggcagauggguggugaguacugaguagcuugcgucucaguuaccuucuucaugaucguuccucugggagacauccccacaccuucccgggugcccugaagaacaguggcucuucugguuccagccagcccugagcugcagcccucacuggcugcugcuuuucuguucccagugugaagcuagcucuccacugggcagguuggggccucugaaggggaugacuuuuccuuccuccuugcugaucugugaccagaucacuuuauccccaaaccccuagacugcugagcuccuggggcggggggucacaugggcuguauuagacaagccaggccggggagagggggaccugggggcuguacuugccucuugucucucagcaauccuucucugcaggggaccauguugguggccacuucugucacccuuggaugugcugguuggggacacugcacaggcuuguuucccuggaauggugaugucauggugugugcacagugcugaugagggagauugagguugggagcccugugagcgggcuaccugcucuguccuuccaaccugcauggugcggggcuccuccucccccagccucgccugaaaccuccacaguccccuuccccuuugucucucucuguucgcacugucccugugaacuuccccuuuuuccauuucuucuuguuccuccauggcuaggaggucucucccucccucccucccucccucccuccuucccuccuccuccuccuccuccuccuccuccuccuccuccuucuucuucuucuucuucuucuucuucuucucucucucucucucucucucucucucucucucucucucucucucucucucucucucuccuggaauggaguuccaaaucuauagaggcagcauggcuggagccccaggcccagagaagaccuuaagugcuaauggcucacccgugccagcucugugcauucauagucggagaauaccucccauaucuguuccucggcugugugaccuuagacaagucacugucccuuucugagaccugcuuucccaccuagaccagccagagaaacagagcuuaauaugaggguggauuggaaguuucaaccccuaaccuuggaugagcagaccccuccacgcucugaugagugcugccacuucccacugugccccaccccugugguaacaaacagagcugagaagugccaagaguccugggccuagauaucccuuuagcuccccaaaccuccucccuggcagcuggaacacaggcgggccauuuagggacacuuggccuuuggauuuaagauucucuuucauaagaauccacaaaccaaaguuuaaaauucaacuggaagucaaugccaggccuuccaaaggcagcugagggcaguccuuaaauacccagguagcuagcugcuuaguggauauggaguagacgcuacuagccagaggucagccugacuuggaacuuaucaucaucaccaccaccaccaccaccaccaccaucaccaucaucaucaucaucaucauuguagucaauguaugugcauguauguauaccuggcuauacaugcacacaugaccagugggcacugguguccuguguaauucucaccaaauagacuagaccuuacuggucauugagucccaggaaucucuuuacccccaccuuccuggugcuacuguuaugacacaccgcacacccauccuuuuauaugauuccagcacagguucucaugacaagcacuuuccugacagacauaucuucaccucauggaaagcgucuuucccagacauuuauucagucuguagaucuugugaacuugaaucuguggacgaagaccucugcagacagggaugcuucauccacaguuagacuugacuggauaaauuuaaauauuuaauacuucaagcacacagaagaagacuaaacuggguuuccuaaguugcucaccaguguuuauuguugcacaugugguugccguggauggagagccucccccacguccacagagaaggagcuuuugaggacaggagguugugaaaucaguuuugggcuuaguggacuuugugugugugugugugugugugugugugugugugugugugugugugugugugagagagagagagagagagagagagagagagagagugcagaagccagaaauugacauuggggguuuucauaaauugaucucugauuuauuuuugagaaaacgucucucccugaaccugaaggauuugacugagcuugguuggccugcaagcucagggcuccuucugucucugccucccuagcacagcacuggaauggcagacacugucccuggggauccaagcagagcucugggugcucaugcuugaauggcaagcacuuugccaacugaacuaagccccugucccucauccaucguugcuccuccuguaaauggcauauguuuaaaagucacaguuccaaaucucuuagugcuggcauuuaguaguuuuaugugcccccugccagucaccaacaaggcuucaaagaguuaaagugacaaucucacuccaccccaucucuaacaccaaaccucagaaaggcuuuaaaacugaucccauauuugcauggcuccugaagaccuggcuauuaaaauuccauugauuucauagauauuuuguucaauuauguugcuuguaagguaaaaccuuuccuuuccuucucaauuuuaaguccuauuuccuuuuugaaucuuucuguguucuauagacucuccaauagaaauugaaugcaugccauguuuaauuaaaguguucuagcaacuguauuuuaaaagauagaaauaggugaggucagcuuuaguaauauggggcuaacaagguggcucacugggcaaaguccacuuguugccaagugugaugaccuaaguuugaugccaggguucacaugguagaaguaaagaacucucaaaaauuguggcacagcaugcagaauaguacauguguguguacgugcacacacacacacacacagagucuaugcucaaauauacacaagaaacuuuccucuuucaauaugcaaauguuuguauguguuaaugauuaucuuuggguaaauguagguugauagacuuguauaugguaaggauuggauuccauguuugcauaugcccaggauuacccaguccuccaggguuugguaaaauccaaacuguaaacaugcuacagccuagaucaguuggguagaguuagugucucuucccucucuuucacucccccuuccuccuucuccucuucccucucucuccccaccucuauuucauuccuauuccuuuuccuuuuccugccccacccccuuuucccagcuuccuuuuccugcccuacccccuuuucccagcuuccuuuuccugcccccacccccuuuuuucugcuuuuugagggauuggggaucagcuccacuuucuacuucuuuuugaguuguuugcagcucacuccaucucucuccaggaauacauucuugucucauuuguuaucagcaauuuauuugcaauauccauauuugucauuucucacauacccuuucugcuucuugauugauggcugcuucgugugccuuaaggagcuggggacaguaccuacauuuuucugagcacuccgguauugagccggaguuuuguaaucuguagugugaggagccauggaguuuccuccagcucuuucauaagucauacaagucuuggaucccaaguaccugccaaccacuaccuccucccuuugaaucaugccucucgucuguucucuugccuuucuccuucugugaugucccccuccgagucagaccccuucaccucaucucucuguuacccaucacuuuucgcuuagacccuuuuaauccuuuuuaaagcugacucaauaggcucuuucugcucucugcugacucuugcccaugagugcgcuugcauguacuuuguaauuugggguaaugaguagagauuuagcuguaggaaauuugccugaccugagugauccuuccaaaguggucuucgggaugcuugccagguguuucaaguuuaaaaaaaaaaaauaaaaaccaacaacaacaauaaaaaaaccaacccacccacacuuauuuauuuguugguauguaugcaugaaacgugugugugugugugugugugugugugugugugugugugugugugcauguacucaaaugccauagaguggguguggaggucagaggacaguuugcaggguuuggguccuggggcucgaacucagguggguauacuaggcagcaagcaccuuuacccacuuaggcaucucaaaagcccgguuaccagaucuuugggggcagcacagaugugggaucaguuuuaaauccuuucugagacuugguguuaaaggugggaugagauugucagucugacucuuuacccagugaggcccaaaccugugacugccacccuucuggagggaccucauuaaccuccacccauuucccaagaagagggagagacaucacagcguugaugguacaccagugcuacugggcauggaagagcagccacugacguucugggcucucuuaguucgggugccaguugcugugauaaacaccacgaccaugagucacuuggggaauagaagguuucuuucuucucacagucuucaagucacacuccguuaccaaaggaagucagagcagggacucaaggcaggaaccuggaagcaggaacugaugauggagugcugcuuacuggccugcuccuccucacuugcucaaccugcuuucucacaccacccaggaccaccguuccaggggugacacugcccaggguggacugggcuucccugcagauagaauuaaccaagaaaaugcacacuaucgacuguguacaagcaaucggguggaggcaacaucucaaccaugguuccuuaucccagguaacgccagcugugucaaguugacaauaaucaacaggacagugagagacccuguuccaaggguggagagggauagaccaggacaccccauaucuccuuugaccgucacagguaugugugugugugugaacacccacagacacauaugcacucccacccacacccaccuccaugacacuggggcuuauugugaccccugagacaccagcuccaucucaggguguccugcugacccuggcccucugucuuccaccuacagguggccgcuuuacucacuaacccugugcacguuugggcagguguuccacaucuucugucuggaaggcuuucagucuccccauaagugaacagucauucuuuucucucccaaggcagauuaaagguagaggauaagagagagauagaaccccguguuuuggugaagaaugguaauuauuauccacucuuaagccaaaguccuaugaagugguugguguucuggggaggaagucuuuagccucugucuucaucuaaaacccaugcuucagucacucuuugccugcaggauggggaccaaggcuuuuacagccucaguaaagguguaggucaccagaggccggcuccuucucacugaagugcuagucuaaccuguguccuucuuacaggucauaugacuaucuuauggauaaacugacaccuuugcaagggcaguccccucucccccaccuuccuacuuaguacagagauuuauacauguauguguauguauguauauauguauaauauauauacauauguauacauacauacauacauacacaccaucucuucucucucucucucucucucucucucucucucucucucucucucucucuguguguguguguguguguguguguguguguguguguauccggucuccugcaguuuaaggugaucucaaacucacuauguagaugaaaaugcccuugaauuucugguccaccuccugagugcugaaguuauaggccguaccugauuuaugcagugcaagggauggaacccagggccucaugcuugcuagaugagcacuccaccaacuggaucugagggauuucuguuuguauuguuuagagacagccacuugucuccugggcuaggcuggaacuuagagacauuuuccuuuuagcuccucuucucuaguucugggguuacgguuguaagugaucaugucgggaucugacuucuucacuugaucuuagccaaaaggcugagaagcgaugggcucugacuucuuaaccuuccuggauuuuccaucuccucaguuggccugcacuguuuuaauuauuuugguguaucauguguuagaaaguuaaaggaaaacuagucuccuucagucuggcccggcuauguguauguaggauagagggucaucccagcacuccacucccagugcagacccaaacauggggucagguagauuacauaagucccacaugggagugguccauggcauauucagucuggaaagugugggcgggguguguauguguauacauuugugugcaugaguuugcugcugcagucuuaaaacucuaaguauuggcauagaguauuugguuucuuauuaauuuuuuuaauuuugguauuuuauuucauugucuguauauaugugcauguguauguacgugugugugugugugugugugugugugugugugugugugcgcgcgcgcgcgugcacgugaguauggaggccggaauacaaccuugcaugcugcacuuagguaccaucuaccuucuugaucuggaacucaacaaguaggccagaugucuggccagugagacccagagacuagcugucuuuguccccccaguucuggaauaacaaacauaggcugccauaccuaccuucuuuauauggguucugagacuugaacuccaguccuuaagcacucuacugacagagacaucucuucacugcuaucuaaccuuuaaauagaguagcuuacgugacucauuauucaguugacacagaguauuccucauacaaaauacuggagaguaugaaucuuuuuugaguaggaacaggacaccacccaugaagaauuauauauucugaggcuuugcuucaagcacuacaguugaaggcuucaacauauaggcuauauguugaaucugaaucguaugcuuugguugagucucaagaccuguguacauacaaauauuccaaaauucaaaacaguccaaaucccauaauguguagagcauuaucucagacacuuuuagguaaagggcauucaacuguagggagcgauuguuggggacugggaagauggcuugguugagaaaacauuuccuguacaagugugaggaccugaguuaguuuucccagaaccuguguaaaaacucaaacacacgcagcacaugucuguaacuccagcacauggaaggcagugauagguggcaggacugcccagucaguccagcuaaacuagugagcuucagguucagugagagaugcugucucacaaacaagguagagaugaccgaggaaaacacugggacuaaccucuggcuucugaacuacauguccacauguggacacacucaccccuccccuacacaugcaaagcuacuuauuuaaugaagguuugcaauggcagaaaaugaauucaacaguggcaaaaggcugccggcugagagcccugccucccaggcucagcucccaagcagacaacuggcuucccucccuagaggcaccaguguuaccuguuaaccacacauccguggugagauauucuggaugugcacguguaacccauacauaauuuugcaauauuuaugugugugugcuuaucuauaaauuguauacauacaugcauauauacacauauauauuuccuaaugcaauugucggcgucucucucgcuuucccugucaaugcaucuugcaaauuguuccacaccagaaagaaaugcuucuucauucuuuuuauggcugacugcuauuccguuauacagacaggauguaauuuauuuaacaaggccccuuucugaugaguguuuagauuaccgaguucugccauuuccauacugugccguaugaaggcacccugugccugaguuacucaccuauuagagaguuuauguggagaacucagggcagagcucaugaggaacuccagcuuugcugcagagauaaucagcacuucauggccaagguugccuggcuagugagggcugcccuuggccuuugggcuucuugcccaccacuccuguaguccuaggaauuugccuacuaucuuuaccuacaaauguacagcuggaguuucugucuuugacuuuucucuucucuucucuucccuucucuucucuucucuucucuucucuucucuucucuucucuucucuucucuucucuucucuucucuucucuucucuuccuuccuuccuuccuuccuuuccuuuucuuuuuaauuuuaggcacuauguagcucuggcuugccugguuguacuugaccagguuguauauagaccagguuggacuugaacuuacaguggucugccugucucugccuccugagugcugggaaauaaggcauaugcuaccacaccugaccuccaguauagucucugaaggaaugacacuagguagacuucagagacucugucuguuaaccaaauacacaggaaguaaauguauugguccauuuauagguuguuugggagucaacucaaagaaguguuaaaaaguguguguguuuguguguguguguguguguacacuugcucaugccugcgugcaugcauguacgcagguacauguguacucgugcacaccuguaugcuacagcaugauugugaagaucagaggacaacuuguaagagucuccucuccuuaauucugugggccucagagaucagacucagaguaagcaccucucccugcuaagucaucuuguugacccuaacauuaaaacagaaguucauacaaguauaucuuguucuaguaaguauaguuuccccuguccucucugccuguuguaagaaaauaacccgaaaaaaucacuaaggcaggagguuaauuuuggcccacaguuugagguuauaggcuaucuggcaggggaguaggggagucacaguagugggagcuuaggucaggugcuuacauugcauuccagauucaaaagccuugccucagucagcuuucugcuuucuguaaaguccagggaauggugccacccucagugggcaggauucuucuccuucauuaaccacaauaaucucucccaggcaugcuggggcaucacucagaugguuuucucuguuauuaguugacaauugagauuaaccaccauacccccuacccucucuuucuuaacccuucuuuauccuauuugucuccucuguccauagaugguuccacauauucuuuuauaucuuauaugucacacuggcuaguuuaugucaacuugacccaggcuagagucauuuuagaaaagggaaccucaauagagaaaaugcuccaccagacuggccuguuggcaagccugcagugcauauucuucauugauauuugacgaggaagggcccagauuacuaagggcagugcuacccacuggcuaguggcccugcauuguauaagaaaguaggcugaacaagaaacuauagagagcaagccaguaaacaauguuccuccaucagccccugccuccacgauccugucuugaauucaugccccgacuucccucagugauggagugugaccuaguaacuauaaaccaaauuaaaucucucuuccucaucugcuuuuggccauggugucuuaucauaaugauagaaugccuaacuuaagacacacacacacacacacacacacacacacacacacacacacacgauuuuguguaucuauauaaaaucuagaaaucacaaaagagagauauuucucaaaaacugaaaauaggucuaccaaaugaccucgcuauacugcuccagguaucuccccaaaggacuccacguggacaccuuaaaggaauacuugcacacccuguuguuguaguacaaaccacuacagcuauguuacggaaccagcauagguguccaacaguggacuggauaagagcacuuggcuuacauggaauauuuuggcugcagagaacaaaguuagguuguuugcaggaagauggaugcugagacucguacuaaguuguucaaaccagucucgcacagaaggguuuuuacuagauuuugaaacauaaacaacugagauccgucuguugauucacaugaacaucugguuagaugcuuaaauuagggucaaggggagauucuaccacacuaauguaccaagagaggcacguuugggguggggaguggagcuuaguugguagagcacuuaucuagcacaugcugaggucuagguucagcccccagcacuacauaaauagaauguggugguucaaguguuaccucugcacucuggagguggaggcaggaguuuaagggcauccuuagccacacaaagaccucaaggccagucugugcuguaggagauccugugucucaaagaaaaagaaaccauuuugguucaacaugauaagguguuaucuucuaaguggcugugugucuuaggacucuuaucuggguaaaguccuguuuguccagcuuguguuuagggauguauaaacagcgccuuggcagccaucuuuuacugaguuuuguacuguuggauagccugguuccucucguccuucuggaaaccuccagacaccuaugauucaggcugggugugucgugcccaaggucacucaccuggauuccugcccagguccuuguuccaggcguaacuauccaggcaccuuggaacuuagacacacggucgagcaguaagcccagggcagcagguuuuaauagggaucguuguauauggaccacaccagcugcucaugauaguuuaguugacccauucauucauaggagagagugccucuaucuuauuuuugagacagggugucucguugaccuagaacuaauugauuaggcuaggcugcuugggccccaggaauucaacugucuccgucucuccagcauuaggauuacaagcguguaucaccaugcauggugcuuucacauguagggguagaacuugggucucacauuuggguggccagcacuuuacugacugagccaacucccuggcuucuugcguuuucugcuuaacuuagauuuucagcugacaauggguuuacagagaauguaaaugauguaaguauugcgcccagaggguuuucagccccaguccuaaguccauaacaaucaaaccacaguggugagaggcagaugaagacaccgcaucuuucccagcucugccagagaauuuuagaggacagccgcuacucauacucauuuuccuuuuacauuuuauuuuuucguuuuuaaguauauaagugaucugucuucacacacaccagaagcaggaaucaggucccauuacagccaccauguugacucacauguugcuggaaauugaacucaggaucucuggaagagcagccagugcucuaaaccgcugagccaucucuccagcccccauucauacucuuucugguuacagcuccauacaagaagguuacuuucgcaucaucuuagacugucaaaggcuuuugacuagagagguguuggggguggucugugccagaccucuccuucuucuggccaaucucauuuccuuuuuauuuagcacauggcauaaggucuucucuggugcuccagagcauccugguuucuuugugcauauacuauaucuguguguucauguagguguguugauuuguccacacauguagaauccaaaggucagugcugcaugcagucauucagcaccuugccuuuugaguguggaucucuuacuugaacuugggguuccccauuugucaauggcucacugaccagggggcuccagaaauccccuuguuucuguucccauccuuauuccccacccacuucugugguuuuuaggacuguggccugauuggugauggggugauggggacccacacucaggucaccaugucaucuagcaguugccuuacagauugagaugccuccucuggucuagccccagguuugguagcaugugcuggacagucccuguguccacagcagcagucuguguccugcucugaagaaggccauaggcaggucuuucuccuucgaggccacacacacagggucuuagccauagcugcuugcuauggagagugacacagaaaguauguggugauccaguaggaccgcgugacauuaaugcaagcagggggcagauguggcucugaguuuuaguuugcuaguuuuucuucuagcugacuaagggcuuuaagcugaaucugcuuaaggaugaacgacucuagccucacuuggguauaaacuucauuuccugggucugaggagauagguuagucauuguagugcuugcuaggacgacccaagcugguuuccagaaucuaugagaaaaaagccaagcaaagaggcacgugcuuguaguccuuucuccagggggaaugaagacaguagaucccuggguccugauggacagcuagccuagccuccuuggugagcugagccccagaccauuggaaccugcuuguaaaaacuaggugaggaccaacaccccaaguuguccuuggccuuuacacuccuacacacacacagacacacacacacacaccuuuuuauguuuauuggugagugagguucagagagucucugcuccaugcuuccaggugucauuaccaaguauaguggcaaagcccugacuagagacccuggagacuaccugcuccccuuuucggauauccccaaagucuucuguagccagggccuggugggguggcuccugggagagccagaaagcaaugugcauagcauccaggcaccucagguuuguucugguuuggccuauucugucacuagggaacuuagggccuuuauugacuuucuggggccuugguuuccugauggaaucuggccaguggguggguucacgggugugcagaucuucccugguguacagucugcuuuccguggcagauccuucacccucgauauucuuugcugguuagguuccaggcagaguccuuggacuacguagcucaugugacagguuguuuucuggauuuuuccuuauuguuagaguucaggcugagugauucaguguggucccugacaugguucuguaauccucucuguguuaccgggggaaaucagaggcuuagggagacuaucugagaccagauggucagagauacaccaggaauccagguagacacagggucuccagcccuguagcccugcuguuuccucauggugcuuuggcuucucugaaggugugugugugugugugugugugugugugugugugugugugugugcgcgcgcgcgcgcguuauguacaugcgcaugcacaugcacacaagccuaccugccggucugcauguguaggcuggugaugguaauuugauuuugacuguucuaagcauagaugggaagaccgguggagguggcuagcugauccaguuugcugagcacagagggcauuccuggggcagucuugugcacaccuggcugagucagccacucaggcucaggcuggcccuggggauccugcaagcaaaacagugucugcacuguuaggcucgguaggcuuacccagaagcaaaugagaagccagcacagaagcuugucacucaccuuuguagacuauagucuguguguguguguguguauguguuguggauguacaugcacaugugugcacuugugcauggagaccagaggacaacuuugugccauuccuugggcauugucacucuuucuccagggagcaucucuugcugaccugaugcucaccuaggcuuuugccauugaguuccaggggcugccugucuacagcccucagcucuugggaguuuaagccccacacuauuguaccugcuucgccaugugguuucuggggcucagacucggguccuccuucuugaaaagcaagcacuauacccacugagcuaucuccuuagccuguaaaaugucauuuuuaaugugucuguggaggaagggacacacaggaauacaaacuccgggaucagcucugaggaagauaugcagagcugaccauucagggaacugggaagaagagaugggucacuggcuacccaaggagaggguggugggcccagagcuggaggaggcagaguacccucccagcauccaguaagaggagggaggcagagccuuggcaguuccugagccuggcaagcccuaagaauuccagugagggugaugacaagcugaugggcucucagcgugggaagcccuguaccacucugauggcccuccgggagugagcugggagacccugccucucagaugugccuacugggccacgugggggcaagaaauggcagugguguguuccuguucuaagccagguggcugauuuaauccagcugaggccagggccucuucauggaggcuuagaagacagcugggucucugccaaguccuccucccuaccacauggggcuacaaagcccagaaaggggggagaucugcuuggggggggggguuguagcagaugucaccauggugaacgcuucuuguuuaucuuuuauuaauggcaggcgcuuaggcucaugcaggggcagugcucagagcagcccuuuggagcaagcaagcagaccgcucuaccaaggcggccucccucagaagcuggggaggaaagagcaggcauggauaauacaggcuguaucuugacggagcuugcuggacugcugugcacaccugagccagagcuauggaugcuuuuggauccugaacucgagaaugguuuucucaccuccugggauggggugggaugggacagaauggguguggccagcugaaacccugcucuggccugggcuuuaccaguagccuggacucuacacuccccuguucagaacuguguugcaccauucucugucucauuagaccuguagaugugcacccagagagggaggacgcaguagcuguguagguuaucuguaaggaagugcuggccuccugaguggcucugcucuuucccaugccucccucaugugugugugugugugugugugugugugugugugugugugugugaauguucaggucagaggacaaccucagguacuagucauucuacacuauuguucaaaacugagugugccaggcuaagcuggcucacaaacugauggguauucuccugucuccaaguuccauuuggcauugcagacaccugcuaucguaucuggcuuuauauagguuccaacgaucuggacuugggucaucugcccugccacaccuuucucaguccuuggguagagguagaguauccagacaagaacaugaacacuggaaccuguuucccaucucuuguucuguccugaaaaaggaucuugcagcaagagcugcuggggagggaaugggcagagaaaguuaucuccuugcuuuuuuggccuuuuccugcuacaaauggugaugacuuuaaguuccuauggagaauagcuagucguuggccaagaaggccaccugugccaauggagauaagugugcuguaacccugggaacaagugacaggaagagagaaggaaggaaaggaagagggagcccgggugucaccucugagcugcugauuggccaucugccuugucagagcagugaugggaguacaggacugccggguguuguucucaaucacuuugagguggaaugagcgaugugggagggaauaagcagcggccaccgugugacugaguaguggaauaucacucagcccgaaaaaugaggcgaccccacacugcaacaugaaggguguacagugaaacaaaccagucucaaaagcacaggcacagaaugaccugacccucaacuauucauaucccgaaaguaggaagagcaugauuguuggcaagaguuggagaaagaaggagaucggggucucugagaagcccagacaaaugggcugucuguggcuuugucucaaaacaaacaaacaaacccaaacaacaacagggaaauuaaaucauuagcauugauaucccccaggagauacuagaagcauuacgugucugaaauaagaacagggugcuacuaaguaagaguguauacaacaacaacuuuuaaauaaaaggaugaugauugaaauuaaaagcucauuaaacaaguggaaggugagauuucauggagagccugcagcagaagaacaaaaagacagaggaagaucugaaaggaguguugggaaaggcagaacuugaaagcaagucaugaaucccgugacucauaggagucugaguuacugaaacacaaaacagacgggagaagauuaugaaagaauuuuuacaagagaauugaccauaacagaaugauaaaaaucucugcauugaaauagcucugacucuacccaggauuuuaaaaggaacagcgaaagagucugauuuaagcaauuuaauugugaaauuucaauaaccaagaauaaaacaauauuuugaaaaacuucuaaaggaagggagaacaaacagaagacagaaguugucuauaggggcggaaggcucagcugggaaguagcacuggacagaucaggcuguggacuuggggcuggggaccugaguuuggucuucagaauucacauaaaaagccaagggcagcaccauauaccuguaaucucagaacuguaguggcagaggcaggaagauccuuggggcucgcccaccaccacucuuccuaaacucaugagcaacaaauucggugaguaacccugccucagaaaauaggauggagauugauagagaaagacacucaaggccagccuuugaucuacacacacacacacacacacacacacacacacacgggggggggggaggugcacacacauuacaagggagcaguaucccagccuggagaacuugggguaggggacggugaccaggccuaaccuccagacaguacaaagaccaccagaugugagggaguccagggcuagcuuggggaaagcaccagcuguaauccuguaagugugggaugcagggaggagccaggacaaugucgagcucaagaaggaaaacauaaagcuauuaaacaguauuccuuacacagaucagaugcugcgggaggaauuaagugcggggaaaucuguaagaagugguugccuugagggugcuggggagggacuauugcuuucauuuauaaauccugcugugcuguuugauuucuuuuaaaucauaugugggauggauaagauuuauuuuuaaagcccaaaaacauuacgaaaauucaaaggaagcaacuugaaaagcccuaguuugcaaccacuuguugggggcugggcugaaggcuccaucagugaagggcuugcugagcaagcacaaggacccgaguuugaaucuguagcagcccuacagacagcacagcgggcuuagcagggcuucucuggagucccagaccugaagagguagagacuggaggauuccaggcaguuccuggucagucaugcccagucuauggacuccagguucaacuugagaccuugucucaaaaguaaggugauuggggaagaugguguaugucaaacucagaccugggcaugcacauccuccuuugcaugggcagacuccacacaugcgcaugauuguacaugccugcccccggaccacgcacuucagagacgugggugaggaagcacuuauuggaguggucuugagaacaccugagggcucugagguuuaacuggcuccugguguucuuggcaccacagccaucuucaggaagcucagccgggccagacuguuggauggccucucaagugagaguacucaaugcuguucuuuugcuuucuuagguuuuauuuauuuuauauuugaacgaccagaugaaccuucuccagagccuaggggugcauaggcacuguuggugcugagaugucucgaagacugugacuuagaucugacaacugcccuugaaaucugucgucuugucuguuccaucuuaugacccacggugaaggaaaaggccuguauaggguccccaagcaaggggaggacagcaaaguaccagcuggacauuggacacuggacuauaccacugcugucucugcuuucagaauaaucaucuguauugaccugaugcucacaguggauguguuuuuagugaaagguguguggaggggaacuaacagagccaggugugggagagcugucaggaacacugcugaaguguggaagccucaugggcuggcacggagguuuucugaggaagugugguauuuuaccuggcaccuugacacaauauaaaaucaauacuuugaagagagccuuaguuggggauugucuggauccacuuggccucugugcgugucauccugguugugguaaccgaugugagaagacccagcccccuguggguggcaccacucugaguuuggguccuaaauuguaugacuagagagaugagcugagcgguagaugugcaugccugccuuucucuccacuccugacugaagcagauuuggcuagccaccuuauccguuugcugccuggguggacuauaacuugggaguuuugagcuaaaaugaacccuaucuccccuagguuguuuuuuuguaaggacauccuaucacagcaacagaaaugcuaugaggguaaucgggaauucuagagucaccaagcuuguccagucggagggggaggggccauccacuauggucacaucuuaggaaaguacuguggucaguaaaggugauccaacuguggcaagauaucuacaggggauggaaacuuuuaacucccugcucaggggaguagcugaggccuagagggauuggguccauucugugagacuguuugcaaggcuugggcuuagagugcaauugucuuggagccuugagggaaucugcugcauagagggaacuuggaggcagguccugagcuuggguuucuguagggaguccagagagaaggaggaacuggagcuuggagaauuucuguucagaccuuggaaaaucacagagauacuugaaagcuggacuccuugccuccuaagucuucuuggugagaucgaaccagggugaggccaagucagacuagaaaaggugcugguacauguacaaccuccuccucagguccucagacucccaugacacuugugagaccagcagacuuaggcaggacggagggaugagugcuuaugagguaccacucagaaccagggccagcagcaagcuguccacgcuuggacagagcaggcaggucuuccugccacuggcuugagcaaggcuucucugcccacagguaccucuuuugccuccucagcccauuuggaggcaaagccuagaacuccacuauaugugcacauuccuuuggcuuggaauaccagugacaccauuauagccaccaaauaccucugauuuaaacuguagauacccccgugaguuugaguuguuaccaguucuaaguguucucuaugccuugauaggucaacaggaccaucuuccauuaacugaacagccagucagcauucacucauugugcccuauguccuggagguuguccuagcucuuggaggcaaugauggucuauauccugcccacuacuuucuugggggugaagggaauuagaaaagaugauaugaugguagagucugugaaacugccaagggaagaaacacagggacacggguagugucauguguccuugggcaagcuacucuuagcaaagacugugcaggucuaaugccagcucucagaggugcuugguacaggcuuccccaaguggaaacggggacuggcuggggcuaaaaagaugcugguuagaaagcaugagagugagcucaggcuaccaagagcagggcaaccugaccaggccagauccuggagacaugagcauggaaaaugaaugcuuucuggcugcagugacuaagaccugggaaagacagagaagaagaggugagaucucagaaggacaacuccaugucuccaucccgcucuggcucuugguguguauugguuucacucugcucuugacuguggaugggcuaugaccagcucccuugauuuccugcagugauggacuggaaccuggaauuguaagcuaaguuaaacccugaguugcauguggaggccaaacugggugucuuccuugguuacuuuucaccuugauuuucaagcuaguaucuuucacuggacccagagcuccuuuauuaugcuaguguggaugguuagcaagccacagguaucugucuccacuagggauuaaaaaugugcaccaccaugucugauuuuuuugcauggguucuggggaucaaaagacaaagccucaugcuuuagggugugcuguuuaguuuuaacuggaggguuucaguugagcaauucucuagaacauguuagccuaugggcaugucugugggggauuaucuugcuugcuaauugauguaagaagacccagccaauugugggcgguaccauucccuguuuaggggccucguacuguguaagagcagagagggcugacugaguaguaagcaggcagcaugcguguauugguuucgcucugcucuucacuguggaugggcuaugacucgcucccuugauuuccugcagugacagacuggaaccuggaauuguaagcuuaguugcuuuuggucaggauguuuuaucacaggagcaugaaggaagcuaguacacauggcaagugcuuucccgauccagcuuucaucccaacccaaggcuuagugaacacaaggcuugugcugcauccugacucaggaccaggaccaggaccaggcaaguuuguguuuucugccaacuuuagaugcugcugauacugcuugacauuguugguccuugaccaguugagaaaagccugagauucaguggggagagugugggccaggcagggcuagcuuggggccagauuguuucauaagcuggguggagcaaugcugcucacucacacagaacaagauccccaugaggccaucuggggaagaccuacagucccucaaauaucaucugagaggccauccaugccagaaucuuugguaacccagccgacgagcagagacacacaaccuacaagguaugccagcucaccagaaaagcugacagcucucacuggagugacugacagcguaaaggugcccagggaugcucuaacagggaagaugcaguguagaugguucucuuagaagagugaaggccucucagcugugggcugauccuggaggugccagaggcugugcauugcuugcuugguuuuuuuuuccuguuucuuuucuuuuugaaacaggguaucacuaugaaacucuuggucucucucucuuucucuuuguaaaauuacauuauucauucaugggggcagcugugugugcacauaaaggcagcaggcagggaagguguggagucuccuagauguggaaaugguaggaaaacugggagaagugaugagggggaugcagcuaagugauagagugaucucccagcaugcacaaacccccuggaguauuccaccccaacaccacauaaaccuggugugguagccuaugcgucuuauccccucacugagaaaguagaggcaggaggaucagggguucaaggucuauauagggaguuugagaccaccuuaaucuacaugaaacccugccucaaaaaaaccaaaggaauaauggaaguuggucuuucgucuaucuuucugguaggucuagaaaacaaucccauggugccucacuggacagauuggaaaagggaagcuagagagguuauaugaccaccuucagguuccacugauaccgagcugaagaaucauuacccucgccauggcugucugccccuagauggcuguccucagcuacugucugaaccacucguuaaggcacaugcaggaccuaaaauguguucaggaaaggcaaguguauuguuuaaacgcuggcagauaccacuugcauagugccugcuuugagccaggcagcugagguuucucccggccguuugcuaauagcauggccauugugcuugccugcuugcaaaggggaugucaagaggcggggaguguagcucaguggguagugcccauugagaaugaaugaugccuuggguuugauucacagcauugcauauaaaccagguacaguggugcauguggaaauucuagcacucaggagacaaaagaaucaguucaaggucacccugggcuuuguaguagugacuucuaggcuacccugggauacuuaaccuggagaccugucugaagggauugggagagggggcagaucaaggcucagagaggcaugcuaccugugcaggcuggugucacuggagcuugaccuaggccacucaccccagagcccguguccuuccugacuucuuugcugcuuugcggacccgccagaggcgcuggaggucuuuaaccaucuuguucccuguggccugugggcuuccugcagucaaagccuggaaugcucuuaacucacucuccacuggagauccaaccagagcucauaugcaggggcccaggcuggaggauagguugggcugaaagcuucuugggguaggcaguacagcuuacauagagagaucaugauggaggcuggagcugugggcugcuuucuacuguaguccauccauguuccagcuuucacaugccugucgauggggcugggcccagauuggccuaggaccauguacuugugucaaggaacaagcucagaugcccgugacaucucuagagcccccagaacccucaggaauccagaguccuauggauugcccuucugagcacguguccuaagcaccugccugacacucccaaccccaaucccgcuucaagaucacccugcuuucuagugggaaacugaaaugcaagugcauggaccacugauggauugugggugcauuuggcucacacucaggccuggagggagcaggcaugcucugauagaacugggcccagaggcccuuugauuucuaucaagguaagugcugccugaacaggcagggcuaauaacggcguaggcugggggccuggaaaagccagaaccacaaguuauccuucuaggccccaacucugccagucuagagcccagggggauuccauggcauacuccagugugaagacacuguggaccagcgucuuccaagccauuuucccuccucucagugcuccuacaggagaccagggaggccuuaggugaaagggcuaugcaagaggaaagagggcugaggugggaacaagguagagauacaaggaugaugcuacacuagagaguucugucuaucugucugucugucuauccacacccagccagucauccaucauagguacaaagcucugucugucuaucugucugucuaucugucugucugucuaucuacacucagccagucauccaucacacauacacccaucuccuuacucauuuacccaucagcucccccauacucaccugcccacucauccacuaauccaccauuucuccauccuuuuaccacccacugauccauccauccacccacucacccaucuacccauuuuuccaaccauccucugacccacacacacauuugcccauuuucaauccauccacucaccaacccuuccacccgcucaucuacccacccacucacugaucuaaugcauuuuguuguuguuguuguuaacgaccuucuuuguuauugccauuuucauccagguuguauugcaggguaguuucuagcaugcuggccaccccuccuuccuucccuugcucuuucccugaaugcuaggauugcaggugagggccaccaugccugacaucuacucauuuuuuucugaucucuguucucuuccccucucccucccugucuuucucgcacacacacauguguacacacacacacacacacacacgcugauacuggcuccuagcccuucagacuacuuucuugugauucuucuugucccucguugugacccaccuaagacugagagcucguuuacugugaucacagcugcuucuaacuccccaugucuuucugaaagcuugacuugaagaagucacuccggacaucuuucuccggucaguggaaaaguuaguagugaaugucugacaugagucuacgguggggaaaacaggggugcaugugauacagccaagcaaggguaggauugacuccuggggcugaugccaucuguguggguugggaacaaucaccugaccugaaccucggugccucuguuggucaugaaacagcacacaaaccucucugcacggugcagugcccugguggaugcuccugugguaccuggcgugcgguuggucaguacuugauggucuccccuccccucugcucauacccauuggugugaaggugcaucagggccaccguguuuaggagaacucagcagagccacacaauucuugcugaggccaaggucacccaagccaggaucaagcaggugagcagcaaaaaaauucuucugguuucuggcucccguucucccauagcucaccucaugggucacugggccccacguccccaggaaaagacaacauaaaagacaagcuauugaguuacagguaggcagcgugcuaggugccuugcuguggcccuauuggcuugguucuguagccuagugaccagguagcuugauuuuaguacacaaggcuugugacagucagcugagcacaaggaguuaccaggaggugggcaacagcaggguggaauccagggagugugcacggugcuaggggccacaggcauuuagucaacugaauucucacugccaucuccccaacugcguuuauuaccuauuaaauaauuaucucauuuggaaaguguuucuuaaucuagggcagacuccaccccuggggcccagguuuugcaaugugcugucuccugccugagccaaccagacuucggcaggaccguggugugcuugcccuggccaggggccuaacccuaaaccaggccuucuggaagccccccggggcugggcaugccucucugcaccugagaaauccuggcuaaggcacaucacuaagauuuuaucuucuccucuccucuuccuucccccaccuccucucuucuccucucgucuccccuucuucccuccuacuccccuccucucauugugucuuagagccuagaguggacucaaaauguagccaaggaugaccuugaacuucucauucucuugauucuacuucccaagugguagaauuauauucauuaacaagauuauugucucauguagccaaggcuggcuccaaauucuuuacuuaacuaagcacgaacuucugauccuccucccccaagccuuucaguguugagaauacaagcaugcgugauuaugcccgguuucuaaggcugaacuuaggcagacacgacacacugagcuacuucccagcucaggacuuucugagguagucuucugaaggaaacuguccagggcucggcuucugguuagucuugucuggaacuugaccacagaauuucccaaaugcccaaguaggggcgagugauggcaggggcuuuggcucaggcuggggcucugcauugagaucugccuacugcuucauuucugucuugugacaucaaagguauccacacuggcucuuucccuugcagaagggauuccaaaacaagaaagcuguguugaaugaguacagcucagccuuacagugcucccaccuacaggugaguccuccucugucacuagaaaguuuuaggagcuggcuuuuuagguaaaggcacuuggugccaagcccaagcaccugaaugagggucccaggauccauaugguaggaggagggaaccugcaaguguccucugaccuccguauuccuccauggcauucauaccccuuccaaauaaauaacugugauaaaacucccuuuaguaaagcacuuaucugucauccaagcacuugggcggugaggcaggagaaggggauugcugaauguuugaggccauguaguccaggucagccaggacuaugagaugagaccuuguguuuaauaagagcuggaccagccacauggcucagcagggaaaacggagacaacacaucacagcaggaaaaacacauccaguaaggcaauggccugaguucuguucccagaaccaccugaagguuagaaagaaaacuccaaagaccuguccugugaccuccacggugcaugucacaugcccaucccaucaaacagugaacauaaacaagaguaaacuuaaaaguaauuucaaguguuucgccuuuguaccacucaugcaaauaguaccgaacucgcagagauacucuuugccccaucuugucuguuccuguugguccaccaguuccuaauguaccuaacacggggccuuuccucugcaucuccagaugcccuuucucugugucauugucacuucugaaauaagcucaauccaggcuccaaagcugccugcacucaagcuggcucccaguccccauuucagaagcuccaagagucacuagaacagugguucuugcucucugggcugugacccccuuggggucgugucguguaucagauauccugcauaccagauguuuacguuacgauucauaacaguagaaaaguuacaaaguagcaaugaaauaauuuuaugguuggugggucaccacaccaugagggacuguauuaaagggcugcagcauuaggaagguugaggaccacugcccuaggcuauuagcaucuugagagucagucuucaucaguagccaaaguggcuuggcuacccucagggacuacugaagaagcccccuguguggaauagcacuacguaagcagggcuuauuagggcagccugguccuggcuucccuggcaauagggagcuguaaaaggcuguggggcagcacagauggacuuaaugaggugggaaugagccuggcucagcuacccgggucacccuucuucaccugugcuaggaguuagccuacugcccaugagauugagacgcucagguagcgcaccacggcuuccucugcaacaccugcggacaacugcgaggguggugauggacuagaucaaagagcguguugaugagacugaggcauuaccaccagaccuuuaaaggagcaagucuuaucacaaguguccguuauugugcaaucacaagguuagggcuucuccauuagggaggccuccauauccauuuacaagaguccagaaaggcagagggaaacgccgaaaguccaucaagggcugucuguccucuugcaaugcgguacugaacaaguugggcaaggcagugcagugucuguugggugaaaccugacaggcuccuuguggcuccguggaggugccuguugggacauugcuauuggccaggccuuccuuccccagguacuggugagcagaagauaggucuuaaggcuggccucucacguguagaagucagagggcagccucugguguccaagagaccgggucucuuguccauggcuguggaugccagcacaguggcuucugugggcucucuuguuucugcuucccauccugcuuuaggaacacugggaaacagaugugcaauaucacaucuggcuuacuuugguucuugggauccgaauucugguccuuauacuuucauggcagggcaagcgauuuauccaccaucuccucagccgccuuugcucauucuuucaaacaaaaaggaaauacugaagugagucuagucugcgcuuggcccuccuuggguguuuggacguagugguucucgcuggcugacugucacagcaagaaugaguuucucaaagcugggaccuuccuccugccuuccugaccuccccaggccuaggccugcugagccaagcuccuuuguuaaaacagaugaaaaaggccucucucucugcuagaccugcaggccaggggccacccgcugaggaaagguggcuucccaccugcucaguaagcacugggcuuugcgcucucuggcucuucuccuggauucauuaccaccugaccaagggggaacugcagagcugagcagggauguaucugcaggcgcucgcucggcagauuucaaugaagacgauagcuugucauuuuuuauuaaugagcaagugccugauucauuauacaucugaggggugagucaccccagauggggaggagggacacagaagugugcagccgccaaggaaggggugacgcugucuccaugugggagucuuuaauuccucuugcuuuccauugggaacagacaagcugaagaaggcaccugggcgagacaggcaggguuccggugaccugcugcaggggcauggaaccuuuggacaucgagacaccgacccugacaucuacagaguucauguuugagagcugcccaauugaguuuuaaaauaauuuagggcuagagacaugauucaguggguaaagagccugcuauucaaguggagaggccugaauuuggauccccugcauccacgugagaagccaggugugauggugcaugccuguaaccucacagcuagagggcagagagggcagagacaagaggacuggccucagccuagccaaugggagagcuccaggcucaaugagagauacugucuaaaaacauaagguggagaagaagcuggugaaagaagacaccugauagcaaauucucaucgccacaugcaugcagacagacagacagacagacagacacacaugugauuccaaucaucccuguauccuaaucuguacacuaugcagguuccugugcaccauucugccuucucuguacuuaauacacagguggaauugugucugucugucugucugucugucugucucucucucugugugugugugugugugugugugugugagacacaugugagggaaaggggaaagagagacagagagcucucuccuucuaccacguggguccugggauccagcucaagucaugaggcuuggcaacaaaugccaccuugccagcccaaggaacuuuuuucaacaguccaguggagcagaaggcuggcucaguucagagaagguugcugucuggccaagcagauaccccgcuuaagccgagaaagccugcuguaaacuguuuuuauuguaaacuguuucuggcucuuugguaacaugaagguaccuuuugucucgccucugaucccauauggagggaagcagccccccuccccccaacuccuugucagcaccuacccgauguuaagcugggagaguggccugaggcagcccuguggcugcuguuggcucugccuuuuuuuuuuuuuuuuuaaacugagaaaauuugagucuuggacuuccaacuauguuaaaaucaucugcuuuguaggcuaguccuagauuagaacauuggucuauuggaggaugcagcuuaggccacuuauaacuuguccuuauuaaaaaugagggguucuucuugccuugggcaguuaggagauggugcuucuguugaugguuuugugaagccugugagagcccuggagguaaagacuuucacugaguucccugcaguacagguucugaauauuucucuggcauaaccgacugcuuccagagccugcagcccaccuuguucuagagagugccugcaucggcucuagccaaggacugucugacccaaucagugccuccuccuuccuggcaguguccucaccuggccccuuaggucacauuuuucauuauggucauuuuguaccuggacacggcuugaacaaagucuggcuuuuugggguacacccaaauacucaagcguguccugucugcauaauaacugguacuauauuauuugugugacuauguauauaguacauagacaugugaguguguucacaugggagggagaggcugagaaggggagccaagagaagguauggccugggggaggguagaacccagcgaugggcagggccaggcugggagggaugagagaggaagccaguuugguggugaaguggccugguauggggcagcuggggaggcagauaggccucaacugcagcagucuguagcccuggauguuauuccuugggcuuugguggcagcagagaggguuuuagguguaagaggagacccugugagagcugguaugggaaugcuguuggcuacaggucuccugggagacuaauuuuguuccauagcauguuuccaggaccaaagucgauacgagacccauucaccagcuucaggcugaagaguucugucaggaacaugggugucuuggggcccagugaugggacucaaacagacauccuggaggguaguugccacguugcuuaccaggaugggccuuggaucugguuuggcuuuuuuucaaaccuguccaaagacagcuagcucagagucggugcugugcgcaggggucuggccuggcuguaaauguuuugagaaggcacaucccugagauugacagggggcucaacugagagcccuugcuguggaacguuauuuccugagguggggugggucuggggaaccuaccuuacuuuuaaaccauuacauuuauuuguuauuuaugugguagagcacacauguaccaggguggacauguggaggccggaagacagcuuguaggagucauuucucuccuuccaucagguggguccuggggauggaacucagaugcccagguuuaguggccucuauccucugagccaucucaguggccucuugccauucgguaaaaccuucugacccugguguuucccaaggaacucuauaaaaguauuauagggggugugcaccagauacgugagagucggacuucuggucaccgggcaccuugcauggagcuggguuucccuggggaagcugcugaguggauguuugcugggccuauacauacaugucugugugcaccucccccaaugccacaugcucguucccaagggaagggguugaagcccccugaccugucagccuccgucccagagggaccucacucucccugugagguugcaggguuugcuugccaucucuuguuuucuuucugcggcucugccaugccauucuaagcugaaccacccaagaagggaucugcucuuuugauuugcugagcuggguacuuuggaguugagguuuuccuguaacagaccaaagcagaccccuugaccccuuugcaaccccacagcccuacagccgugucuggcuuggcugucccuccgccugauuuggccugggagccacugugagucacucaggcccuagcugcugcugugugauagccaggagcccugcccagguucuagggcugaguauuucucuagguccuguaugugccguuccuacuaugucagggaucagacuccacucuggagcccagauguccuugucaaagaaggcacaaaaugguggccaagcaggcuauuucuagcccaaagccuugugccuccggcaguguacccugaacgaugcuggagauguauuuggcguugauagagcagcuucucugcuccuuuugagagauggccaccagucuccucuuacuaugugugugucugagugccuaugugugucucugugugucuguaucuguguguguguauccauauguaugcauguguuugugucugugugucuguguguauccauguguauauuugcauguaucaguguguauccauaugcacauguguguguguaucugugcaucugugugucuguguguguccauguauauauguauguccaugugugucauuguguguguccauaugcauguaugugugucuguuuguucauguguuuguccauguuuguguguguuacagguuacauguggguauaugcaugugugcaaagaaaucagagguuaauauugaacgcuuuucuucauagcuuuccaccauguuuuuguuugcuuguuuguuuuuaagacagggucuuucacuuuccuugaacucagugauuccaguaagcuggcuggccagggagccucaggaacaaucugucuccacuuccccagaacugagaugucacgagugugccaccauaccugaguucuuacacccagauccucaugccggcaaggcauggcacuuuacugaccgagccaucuucccagaguccuagcuacuguuguagcuuuugaaggggcucugcucacuuugcaggaagugugucuuguuauauagaaccuggaggagugugugcuagaguguuccacaugguagggcucagagggcuucacacgaggacauggagucaagggucucuaaagaaggcuugggcaggacaguaugguucaggacuuagggauagccuugaauuccuaguccggagaagauaagggcagaaagaucucuggucagccacucuagccaaaaugccaugucccagguuuaaugugagacccugccucaagaauaaagagaagggcuagggagguggcucagaggucagaaguuauguauuccucuuacaaaacaccuggagucucagcaccagcacugggcagcucacaacugcugggauugauucaagggaucacaaguuguccaugaguaccugcaucucuguguguaucucacacacagauauacauaaaaauuaaauaaauauuuuuuuuuguuuugguuuugguuuuuuguuuuuccacuugccucugccuccugagugcagggauuaaaggcaugcgccaccacguccggcuaaauaaauauuuuuuaaaaccaaaaaucaagguagaaggcuacugaagaagauaccuggcaugaaccugugcucuccaugugcacguacacacaugucuacaucauacguacacaaguuggggcagugaccuuggccuguccuguaucuucuacaaccuugcuaugcauaagucacuuucucuucuugggucucaauuuccccuuauccaguagguuuucugugucuaauaucaccuacagucucucucucucucucucucucucucucucucucucucucucucucucucagugcagagucaagaauuugagccucucuuccuaccuccuauuucuugacccuuguguuggccucagccucugucucaggaagcuuuuccccugcuggaagcuagccugcagaggcucacacagugggaggaaugccggcugucccaucagugcugagacccagguccugccugcagaguguccucugaugugaccugggaaugcuucaagcucuccaccucccucccaggccuguggaagucacugcugcagaguggcuaugucugcuuagugucccuugcuggcucuuugccaacccccccccccccuggccauaucccaaccgugcuggguaagcaggagggggacagcuuuucuugagaccauucaaguauaagcaaggaggcagucgcuguguuuguacaggcuuggcgugcaacucagucucugccuccuugucugggccuggugcacuccaaguuugaagccaguuacugaggcaggaagaacuguguagacuagccagccucugaggcagggggagcugugugggccagguacaccggaguuagggaugggagcuacagaggagggaaaaaucccagcagacagaucuggaggaaggauaugagacuccaaagaaaaaccugaaacaagaaauuuauguggcucuggccaaaggugucagggagagcugaggagggcaauagacaggguuccaacccccccccccccccgcaucccccauggaugcuggggagaacuuugaaccuucugagccccagaagagccuggcuucuaagcacugcgacuucaccaccucaauccccugguggccugagcagccaggagggcuugcagacaggaaucuuuauugucugcagcaagccaaggcuccaaguuccuuagaaaaaaugugugcguuaaaaccaagcaaguuuccccagggacgggguugucugcgcaugaggaaugaauugggaggaaaguucaauuucagagagaagggaacagagucacauuggcaaaggaauguucuagagacucagaaaaaaugaggagauucuuuuuaacauccuuuugaguuuccucuuugggcuuucggaaagcaccacccagcacugccugcagggccccgaggggacuaagaguggggauugucuuguuccuuugggaagguaauauacucguaaguucuuuugaguuguucccuggugcagugggaaccccacauguugugggguggacaagcagagguggugaggucgcuuauccacccuccccacccccaccuugauugugcaggcccugugacauucagaaauagaucuagguauggagguuagaccuuucuggugucagauaaaccaagucagauuaugucugcgagaaggaaaaagguuggggaaggcugucuggaagcccagguagcagcaggugagggaaguggggaugagagccggaauggucaccuauaaaguuuacaccucucuaugcaagggagaugcuaacuccaagaggaggacguggucacuguccccagucccuggcagggagcauuaggcaugccauuagaaacaucaggguugggaucuuuauccuuaagggaaggaugugugggugacagggcuagagagccaagccaggaagaugggaggcugcaaagguaccacauccaagcccagaacugaggagagacacugggcugcuguggagccugggaggggucuagaucuuggggugacuggagaggucuguggucagggacucaucccuggggccacaguugggcacaaacugcuacuugguaucaugaacauagcucuaucuuggcaguuugugguuuuuaaacaaaucauggugguacaccuucuaaacaauuuagcuuuuuuuuuuuuagucccucuccccuuagccggucccaucacaaacuuuugaagcaugaaaugaauuuugcugggcccugccaauaggauccuuccucuagauaauggauuugaugaaauggcuauaaucuuccuagguaaugagugaaaguuacgcccuccaguugggcccagcaucccucuucuugauuuaugauagauggguuaaaauaguaaacugauagcaguugcaaaaaucuccaucaaucacugagguguguugcuuaaacuguagaaaggcuucuagacaggagcugcugggagccagugaagaaacaauuggcagcccuggagccauaaagcagcaguaaaagaaaauuucuguauuuguauucuggacacagagguguggaauagcucaggcuacuuaagaaagaaggacuauaccagcaaacccaugcccuaaggacaagacaugucccccucccagggcucuggacuacagagucucacagcuguuucuuggucccauaguauuucgugacucuuucuagacaguguugggaaguuuuucagauucuaucauguguaaagauguugagcuaggggcucagauugcaugcugcucuugcaggggaccuacuuuggguggcucacaacugccuguaauucagcuccaggggguucuguguccuuuucaggucucuguggguaccugcacucgugugcacacacccacacacagacguacuaauaaacacaugauuuugaaaauuguuguugagcuaaccacguggcaauagauaguuauauuuaugugguauuuguggggguugggcuuugauuuuuguguuuaguuuguauugagauaggagcucaccauguaucagggacuggccuagaacauacuuuguuucagaacucacugagacccgcuugccucccccuccugaguggugaaacuaagggugugcaucaccacacacagcuagugauaaauuauaaggcaguuucccaaagauauaaaagaguuggagcccgaaucccucacgucuaagcuacaaaggugcuuacuguguaagaaugacaacccgagcucagauccucaggacccuccaaaaaaggccaacagcuuggaccuguacucccagagccaggcacaugagagugcauuggcugaccagacugccuaaaccugaaccagagcuccagauucaaugagagacccugucucaaaacauaaaaugaagacagccugguccauagccuccauaaaggcacgcaugcaggcacaaaugcagaaaacacuugcacacacacacacaaaugcagaaaacacauacacacacacacaaaugcagaaaacacaugcacacagcucucaaguuuaauuguuucugcauacucuauaguuuuuaauaaaaaaaaauaaugcaaaucccagcauugcuccccuggaauauccaagggugcauggguaccaucuucauguagcauuuguuuaaaaggaaaaacauuucuuucauuggaugaaugaaugagugaugaaugaauggcaagaagcccuuauagaaauccuguuuagcaucuagucaacaaccucauuuugccaauagagaaaguaagucccaugagaacacaguaagcuugcuccagagcuugugggaaacuggaagucuagagaaguccuggcuuugauggugucuacuauacuugagcuucgccugucacauugacucacaucugaaucuguggacauagugcuugucuugggaaugcagguuguagagucaacagccuuugacacuguggugaaaugaguggguguucaagucccuccaggugaucuaagcuguccuaauuccuucaaguagcuauggcaugagccaguccucuuccuuccaggguguauauccugacucucagauggagcccaguaccugaggcauagcugcuguuccccacagucuguguauuuguaauuuuuccacaagccauaaaacugagccccccgggacuucauauuuccugccugugacauaagucacuguagauauagagcccacagacagcaagaagaucugccugcaaccucaaauggucaccuucaguuaagaagagcaccauggcaugccaauucaggaccaaaucccuguauaguaacccaggcaagagacagauggguuggcaguaaccagugaggacaagauuggugucaaaucaauuagagaugacaugggucaaccucagaguccuggcuugaggcaggugaaucccaggacugaaaucaguugaaaaagacccaugggcuugugggucugcaaaacagcaugguaaaaccagaagcugucugcuacucaacacuugcuucucuuggccagggugucgguggucacaggcacugucuucaaacauccacgccaaggcaggacugggcucccagccgaagccauggcuuccucauaaagauugggcaaacggcugcgugguggcuaagcugguaauguguugcuguguguucuagcuuccuuuucuguugcugugauuaaaaacugaauaaaggcaaguuggagaagaaagggucauguuucauuuuacaaauuacagucuauuuuucaaggaggucagggcagaagccagagaggaaugcugcuuauugguaggcucacugccucgugcucagucaguuuuagcccaccugaggcucaccugccuaggaauagcgcugcccacagugggcugggucuucccacaucaacuaucaucaaucaggauacucucucacagacauggccacagacuuaucugauagauuuuuuucaguugagguuccuucuuucuagaugacuguaguguguugaaaauaaaaucuaaucaggauaccaugcaagcaugaggaccuuggucccuguuucuagcauucauaacaaaaaggccaggcagagcagaacgcaccaguaaucccagcacugugagguggagguaggccggucucuguggcuugcugaucagccagucagucuagccaaauuagugagucccugauauauugagagacccugucucaagaugaaugaaugaaugaaugaaugaauggugaggcugaaaagauggcucagauguuaagagcacuugcugcucaugcagaagacgggaguuugguugccagcagcugcgucaggcggcucccaacuguuguaacuccagcucuaggggauucuauagcugcacacauauggcacacgugcacacacauacagaaauaaaaguaaauuuggagaaaauaacguaagacguaagauugagaguguagaggaagacacuugagguuaaccucuggucucuccaugugugcuugcauguagagguaggccguaaguuccugcacacgaguucugcuugcccugacccuguggcuaaugcucuaggcuucucugcucaccaggcaaaacagagaccuucggucuuggaggguggggcuuggaacuugagaacaugcccaggucuccucugguccaugcccuuuacuucucugucccaacaccuugccugccacaccccaccaagaacuuuucuuuccaguggaggcuuuggaccauaugugcuaaucacaggccgaucugugcucucuagguguggguuugcaaaggacgucuuuuguucuuguuagaguagcuaaccucuaaaucuauuuaauaucccuucccagguuguccaucauugugacacaugguuuuucaaaggauuuacuauuaguuagcggcacagggcuuucucccagggguaccagcuacucgcagugaagaaaaugcauguucaauguagcaauuugucuuuuuuuauauauuuauuauaagaguaaaugaguuauuguuggcgacuucaauauuauugcaaauuaggugcuucaaaaggagccuggcccauuuauuauguuucuuaacuccccuagccagcacaccaguuuggaaacaggcuaaggguuccagcccuucgcugaguguggugggggggauccccaaagggucuaccugugaggaugacaacaucacauugugccugagacgagagagaccaggaaucaccugcacaggcuacaggggaacacguguucaaaguuuguuguugugcuacacagucaguggugugugcugauggucgggucugagcuagaggggacagugggcuccugggauguaccaugcauacucuccaccuguuccaggcuuucucagucaugaucucaaaaguugauaugggauguuuuaauuguguccucaaaaguccuauagcuaagaccuuacuuccaggguguuguagcccagccccacagguggagacuugauaaugauuugaguugugccccaugagaggagucugucagcccauaguagacuucuuuagggaguucauccuuaaaggccuucugcuguguaguugugccccuuagccaucuucucagccacagauagacacagagauuggcacagaggcucagcuucauauacuacuugggcccaggacaggugaacucugugcacaacauacaucagcuacacuggaggaccacaagcccccaucuuaguuaggauuacuauugcugugacaaaacaccaugacccaaaauaagcaaguuagggaggacaagcuuauuuggauuauaaauccauauugcuguucaacaccaacagaaggcaggacaggaagucaaacagggcaggaacccagagacaggagcugaugcagaggucguagaagggugcugcuuacuggcuugcucagccugcuuucuuguagaacccaggaccaccagcccgggcaugacuccacccaaauggacugacuagacccucccccaucaaucacugauuaagaaaaugacuuacagcuauauuuuauggaggcauuccucaauuaagauuucccuccuuucagagugcucuaauuuguguguuaagacccuucagcaauacagaguugcucucucaggccacacagaacaccuaguccagauucugggagugcagcuuucuggugauagaaaagggucuugcuucugggucaacuagcugucacaugacuguggaccucagcuucacuguagccugacuccuacuucuaaauggcacugaugaucggagaugaucuagugugauacaggugcugguguccuugauaacagccugcacugcccugguucacaaagcuccucugagugggaugagauaaagagagcagucaucagcccuucgugugacagcgauagucacagguguaagcagcaaagcccaggaaucucccacucauaaaggcccacaaagguuuuagaauaacgccccugcugucuucucuccaugugugucguacacacugugacuggggcucauguccucuucccuuuccagaagggagucagauucuauuacugucuugggaagucuucuacucuugucccucagcaaccucugcuugucaaagcccuccuucaguggcauucccaaacuucaaguucagggcgucuuucucaagggacaguacugggagugucaguggguuuggggaguuugccccuuauuccuuuuuuuuuuuuuuugacagagugucauggcaccugagcucagcuccuuauguagcuaggaugaccuugaauuugugccuccaccuucugagcgcugggauucuagacacgagccacccagugugccuggcuggagccuucauuuugacagugcauguuuguugauauuuuuaccaucugagaaaucaaaaaugagacauuuaaaucuuaaauucaauuuccuguuguugaaugaacugaucuccauggacaguuugcuuuuuauauuuuuauuacauacauauuugugugugugugugugugugugugugugugugcacauggguauaugugggugguacacccaugccacacugcacuugugaagguagaaggcuccuuacaggaguugagucuuuccuucaccaugggggaucaaacucagguugucaguuuugagcaccuucgacugcugaagcauuuugcugacaauugccuggggaccucuggcaggucacuuacuuuguccaguagagaggaugaaaaagacaagaaugcccagguuuuuuuuuuuaagcauuuugaaggcuggggugauacucagccaauaaagugcuugccuugugugucuaaggacccgucuugggugccuagagccaacaugagaaagaccaacacugcggcacacgcuuguccccacacugagaguggaggcaggggcuuccugugacugccuggcuggccagugaacuggcuccagugcagugagagaccccaucucaaaacucugcuagguggcaccuuagcccaacauccaagguuguucucugucuuacacucauucauccaugcacacacacauacacacacacucacacacacagacacacagacacacauacacacacacacacacacacacacacacagaguaaauaagaaaaagugacuucacagacauugagacaccuucagacaccacuaaagacucuuuuauuaagcccacaggauguuuuugacguuccugcucaaggcugggccaggagcaugccucugguaaccacaggcaccuugggccuccucaucugaccacacucacauccauagacacguggcuuccccacccccuugcucagaaaaggccccaauguaacagccaguuguuuacaccauucaguucacagcacugagagcguuucagggucuuucucgugguuggggaggacaaagccccugcgucccuggaguccacagcaggcuuggcucacagcagguacuauugccagauugccacagcaggaacgugcucugggaaagagcucuggucccugaggucugaggucuucucugacgguugaacuuauucuauggagcuuuggccacagggaaccacugucuccugccuuguccucucaagacagcucccagcugcaugcagccuuaggccccaguggcuagagccacuccgcuccacaggaccguguagaugacagagcauggucugugauauuacauggucugcgccagagcgccuguuuauuugucuuggccuuggcuugucuucucaacuggcuggccagcccucugcaaaauguguuugguguguuuugaaacucuauuuuuuucucucauccauucauuuguguguguguguguguguguguguguguguguguguacgugugugugugcauaaguagucucauguauguagguacacaugugugccuggguguacauguguguauguacauguggaagguagacacugacauugaguguuuucuccaguuauucucuaucuacauuguuucuugaaacagggucucucccuucaaccuagcacuugcugauuuggcuagccuggcuaccuaguuuguuccagggaucccaugucucuaucucccaggagcuagguuacaggugugcuaccauuccugccuggcauuuaugugcaugcugaaggccagucuucuaguuaugcuucaagcacuuugcccacugacccaucuccccacgcccuaaauuugauuuuccaaagagaaaguuuccuggaccuguuuggaguauuagaaagucaucacaaaacacugccaaaugcccaccaggagaaagguuccuggagcuuggguggggagcccagguugugcagacuucucccugugucagcauuugggaaagacagaugugcccagcggcaggccuugcuccuguaaccugcauugagccacccauggcaucuaucauccaugaccugcaacaguccuacuuguuuauagccucugggcaugcauuguuuucucgggacugaaauacggcaugcuaaugagccaucucugcuuuggaggaugcaggcaguuuugaaagaugcuucagcggugcacuggcuauaguuugucgacagcuggaugcgguggcagcuguuguccugaggaagaaauggcaugagagauguugauggcgaagcagcugguggugucuggguuugcugagaaccuuggcaaggacaaggaucuccccugcaagugacuuggcgccagagauauuugcuucucuagccuucagccugacaccagucacuacugguaggaauguagcccagggugugugagcuaaccuggauuaggguuagauuuuuuucuaccugccuuuuuaucuauaaagugaagaagucaguggcuugggucuugcuggguucuuagugauuaggagcuucuuggcaaugcccaugccugguauggagccacgugugaaccugcugggccagugagccccuuacaccuccccauacacagugccuggaaagaguggaacagggaguagugucuccccauccuuccuuuuuccuucuauugagacggggucucaaguagcacaggcugguuucaagaucauuaugcagucaaggauagucacgacuccugauguuugccuccaaucaaauaucuguuuucugugcuaugggggauccaucccagaguuucauccaugcugagacaaaacuguaccaacugagcuguaucuguagcgccuggagcagcgucucuaguuggcuugcaugauaccaagugugccauguacgcagagcuuggaagaguggaccauaucaagaggggaagcucaaacauagccugagucugagccugagacucauccugggugcaggaagucugaagucaugcuugauggggagggcugaagaagccaaauccuuuuuguuggagaaauaguucugaagcagacagggaaaagaaaggguuuggaagagucuucaggaaaugcuacaguagaugugguguguccuggugaccagguccuugcucauagccauagcaauguggugguaguggugguaguuacccuccaucugcagucuagacuccuguaugcuccaucucuccucuuuugccagaauucauccacgugaggcuggggagaugauggcucagucaauaaacuggucacaguacaagugugaagaccugacgggauccucauuauacacauuagaauaagcugggaguggugauguccucuuguaauucuaucacugggagcagggauggagguggagauggguggacaugcuguguggccagccaggucagucauaugagcuccagguaaagucacagguucuguaucacaaaugaugggcagugccugcagauagacucuaaaggcugaccccacccccacccccgucucugcccccaaccacacccacaugcacacauauacaaauacgccuauacuuguggucacacacaaauauuugugugauuuguauuuguuuuauuuguauuuguauuguauuuguauuauuaccuauagacuucaguauuuugaucacuguauugguuucuuuucuguugcugugauaaauaccgugaccgaaagcuauuuaugaaagaaagcauuuauuuggacuuacgguuccaccagagucuguaacuuuggagaaggccuggcagcaggugguuagaucaagaagcuggccgaucacauuucaucagcacaccaaaaagcagaggcuagugggguaaggcuaacucucaaagccugucccuagggacauccuucccccagcauaacuguaccuccuaaaagcucuauaaccuccccaaacaguguuacugacaggugaccagcugggcagacacaugugacugugggggacaguucucauauaagccaucacaaucaccauauaacucucgggagaauucuuccaaaucuacacaaaauaaccauagagacaaacuauucuuugaugacgguggggauggaaugaccuauggccauuucagaaguuucacucgaugguuucuaagccauggaacaaagucauggugacuaauacaaggaaccgugguagaacagaguccaacaagaugugauagcccauuuggcugguugaucagagucucauguaguccaggccagccucagaccccugagugcugacaugacagguauaugccaccacuccucauuuaugugcugcuggcgagugaacccagggcuucuggcaugccaugccauaucuacugacugagcaacauccccagacccuuugccugucuuuucucaaaaagguuacauuuuuauuuauguguauguguuugugucugugcauguaggugccuguggaggcuagaaaaaggaaucagauccauuggaacugggaguuagggacaguugugagccaucggugugggugcuaggaagugcccuguguccucuggaagagcagcagacacucuuaacuucugagccaucuucccagccccuuaaccuauuugcaauagggauggcuguucugcugcuauuacagaaugccagggacuagguaguuuauacagaaaagcagugagccugggauagagucagucauaguguucaccggcauuuauggagccuguguucaguccuuagcaccccauaagccaagcacaagauacacagcaaacaugaaagacugucucaaaaacaaaaccucucguuuucaaugucuucagacugagauggauagcugaagugcuggcugagccugggucccugaugacaaagggaagaauaaugaauuucagagaagcaggacuagagagggguuggggcuggggacguguuucuaauacaguggcucacucacuuacccagccuuccuucagccacagauauuuacugggugcacacuggaaacaaaugugcgcuaacacgcucaagcacaguagcaauuucuugcugcuggaaauggccguuaacgagaaguccgucgcuuuauacaaauaauuagguccagaggagcugccugugcagaaucauggcuguaguaaaagcacauuaugguguuuaaggacuugguugagucagagugaagguuuaaauaaauuaaugcccagcuuuggaugaagauacuaugaacccgcuaauaagauauuuaucaaaaaucuguauggcauaccacaagacuacaaaggaagaggaccaaauucuguacacaguauaaaguguauuucuaaaacuccugucuuuuagcccaauuucagagccagacuuucagagguuuuaguuuaaauuuucuucugugugcagccugacaagcucaccccuguauguguuccuuggaguccccgaggggcacugagugugggcuaacugguacagcuggcugccugguccuugacuuagcaucgauuuuagagaugggucuguuuccuggcccagagagggcagggccuugauuuucaagcaccaguucccuuccaccuagcuugaaugucccagggcaggcuguggcuuuggggagagcugucagcuaucacugccaggggaaccccauuggcuguggggaacuggguaaagaccuggcaccugagguucugggcaucaggcuggauaucaucagcaucacugagguacagagggugggucacuuuggaucauggaguugaugaguagcuuaggacucagguuggugguugggggagguggguggugggugguguauggugugugugugugugugugugugugugugugugcguguugguagguggguagguagauggguaugugcacacacaccaugaaugugagugugaagcuagacaacacccucagauuuuguuuucuuccuccaacccacccccaaugacucaaucugucuuagaccuagagcucacuaagcagcuuaggccgacugaccagugagccccggucuccgccucucuggggauggaccauagcucagcagugaagaguacuugcuguuuuugcagaagacccaguuuugguucccaguuacauaauggcucauaaccaucuguaacuccaauuugggggauucaauucuccuuucugaccuucauggaugccagauauacucaugacacauacauacauacaggcaaaaacacuuauacacauaaaaaugaauaaguuagaaaaauuaaauuccgugugugugugugugugugugccugugcgugugugcauguguuuacaugccaagccccucauguuguugucagaagacaacuuucaggagucacuucucucacuaucacaaggauuccaaggaucaaauuccaguagucagucuugagggcaggcgccuucaguggcuaagcaagucucacucagggcuuuucauauuagggcuauagggauggagcuggguucuuaugcuugcaaacacuuuauuggcugagguacuuacagagcacuggaggccuggagcagcuacugugaccuacgaggcaacuaagcuucuugccagguugagccacgugacugauccaagguggugacucugcuggugcccgggaacagaugccauuagcaggcccuuguaggugacugacaugcagaaucccagccaggccccacaggcuaaauagauauucacauggugcccagccacucaccugccuuuggcuucagcccagugugaaccuaagcuugcagucacuugacggccgggcugccaucucacgcuaacccauaauuacuauuuagaaguuuguggaugcagaccaguagauucuagcucgucguguuaaacuccauuugcaugauccuguucuaauaauccuuuagcauugcuaaaagagcuucuggccuggggaagugcaccccacagccagugagugcggggaucguuucccuccaccaccagcucuguuucagcauugagagcuuuaagugcugguucaaaggccugugugaagcacuuguacuuuuguauguauuaugcauaaucagggcagacggagggaccucucaagcccuugucucccaccccugugcucacuacugagcuguaacaugcaugggucugacuucucaaccuccauccugcggggaacagcaagguuuuguuugaggaccucaggguuggguggaaaagcagacugccuuucuccugcagcagcugcugcacccccuggcacugucauugguggcugccaucuuugaaugcaccuucuagagacuucuuuccucucuggguuuugcauaaguuuuuagugcccgcuuuggccacuugagcauuuaaguuagggaacugaccaguuuaauuacuuugcaggcauauuuaaaucaggggacuagaaaguccuagugugggcccuaguucauguuuuacacuuccgugguuuugcgugugcuguguguguguugaccagaggacaacuugcaagagcaguuucugucaccgucucauguggaugacacggaucagaucccagguagucagacuuggguggcaggcaccuuuaccugcagagcuggcucgugagcucuauauagccaggauuccucauauuuuacuggaccaggaggcagagacuggguagaaagccaggcccagcuguaaacuucaaacuuccccugcccccaguccuuagucccuucccugacaaagaucucacuggauccucaacaaccagcuggguaccaagcauuucaauuacaugugccugagggggaugguucacauucaagccuuaaucguuaguuaguaggauuaaguaaaucugugugaagcauauaucugugcgugccuauaaaguuagccaagaccuugaauguggaugauuuaagacaggcaacucaagcucaggguucugggcucugcucccaaauacucugaaggugccugugucacacucugaaccauggaggugccugucugccuggacccuaucuguggguccugcugaauaucaggacgcauucauuauuucugugacggaacuuuaccuggccaaagggacuggagauaccgcucugcauuuccuguucuuacagaagucccagguuccuuucccaaucguuacagcagcagcacccaaucaccuguaacucccguucuagaagacccaaugcccucuucugggcacugcccucacauggugcauacauacauucaggcaaaacguucaugugcauuaaagaaaaaaaaaacugacgaaagcaacuaaagaggagaagggcuuuauuuugacuuaguguuuuaggggacagucaaucauagcaggaagucauagauccauaagcacaaggugucugcucacaucacagucaggaagcagagagagaugggugcuggugcucagcccaggacccuggcugcagaaucauaccacccacuuuuagguuaggccuuccuacuucaaacucugucuggagacuucucacagcugugcccaguggucuguuuccuaggugacuguaaaucacaacagguagacaggagccaaggaugcuuugguccuuguuucucaacacuaggauuacaggugcacaccaccacaccucuguguguguacauguguaugugcaugugcaugcaugaguucacaugcuuacacuuaugccugugugugaaugcacauacuaugcuggugugcacauacacauacuauugugugcgucuggaggucaaagggacaaucuuauguaucagcccucaccuuuucccuuguuuaagauaaaggcucuuugcuguuaccacuguguacaccagcauaaccuguguaaccuaccuauacgcuuuugaggacucuccggagucuaccucucaucucucuguaggagcuccaggauuaccgaggaaugcuaccacauuuggcuuugcauggacuccacucugggucuucacacuugcacaauaagcacuuugcccuucgagcuaccaucucagaccaacaccucggcuuuuugucucuuuguuucagcauguguccaagccccaugugugcuagacaaggacuuuacugacugaccuuucuccucaaccccucucuuuuccugcuucuucagugaguuccuuaucuucaccucuggcucagaaagccagccugagcucacaucugguuuucauugagucuaauuuuuuucuuuuuucuuuuuaaaauacuuauuuauuuaaugcaugugaguacaguguaucugauaccagaagggggcauuggaccccauuacagaugguugugagccaccacgugguugcugggaauugaacucaggaccucuggaagaguaaucagugcucuuaaccgcugagccaucucuccagcccccacuuuuuaaguuguaauaauuuacucuaguguggguaugugagucuguaugugcaccuugugcauucagguguccucagauaccagaagagggcagugcauuccucagaacugccguugaacaagcugucagauaugagugcugggaauugaaccccgguccucucuaaguguugagucccuuuuccgacaugucuccccccccccauuuuaaaguuccuuuauuaaagugcaagauuuauucagccaaauauacccuuaagagguguaaaguugugaauaaaccaauuaauagcaaauucugacacaccuacacaagugcagaacccucauuacuggcaagguacagacuacuucccucucuccaaaauguccaccuuguccucugcauguccccacagcccccggcagccuggacugaauucugucccuacccuuugaccuuuuccagaaugucauauaaauagccucauaaagcauguucaacugggacuuuugagggacaaagaucagggucccuccuagcaugagaagggauuagcacucucccugagccugcucugaggaaaguucucucccucucccucucccucucccucccccucccccuccucaucucccucucccucuucuacccacaccccagucccccccaugcgcccugggccuuggggaggugagcugcuguccaggagccaggauauuagcugguguuugcugggcauuuucuucuggacccaacguguucuuacagcagcuucaugaggguaagaccucuguaaucccauugaaccagugagaaaacugggaaucagaguuguucagcaauucacaauguugcacagcuaggaucugaucucugauuuggccauccucucuauucugugggauucuugaguuaaggaagggugguucuugcuggugacuagcaagacucugguuucaaggugagaaguaggaggguggcauagaggaacaaaggcauccuuuaucuaugcuuucagucccugucacuaggggcuguauucuauauuguagguuuuguugcagugaaauacaccaugaucaaaagcaacuuagaggaggagagaguuugcuugguuuacauuucuggcacaauugguggagaaaaucaggauaggaacucaagcaggagcuugaagcagaaaccacagccacagagaaaugcugcuggcuggcucagucccuaauuuucuuucuuauacaacacuagacuuccugccuagggauggcacugcccacagugggcugggcccuccgacgucaagacaguccuucacagccaugccuacaagccaaucucauucaucuaauuccccuacugaggcugcuuucucaucugacucugggcuguguggaguggacaguuaaagcuaacuaggacaggauccuuuuugcaaaaaaaauaguaagcucuucugauucucccuuggagauaucuuggaccauucugcaaaucugucaccugaccugaggacagcccagcacgugggggauaguggcucacacuuagccugugcccacuggguagggacaagagcacccaguucaggaaacagagcuugugaagcuuguaaucccuaucccuggccuggccuucaggaagagugagucugucugagcagauggugaccaggagagaggccaaggggcuccuggaugccauguguguugaccaaggggagagauuagguaaaggacaauauugcagucuuggacccaagugccucuaaaccuguggguaauggguuuuucauccccagaguaauaggagacaccaaagaaugaggacauuacuuagugagucccucaccuccuuggcccuguucggcaaaccagaggaaggacauugcccggcaccgagccgucuguggauuuaauggggcuuccagcugaaccuuccaucaaauuuacgacgcugccugucuccugaccuucccccucucucacauuccucucagaaaugaagcugugugcaggcugugagguguagcuucccccaccucagagauauacagcuugggucuguguugagaugguagauuuaaucagaccaaguccccaaaguucauuuaaccccuaagcccagugacauuaggacacugcugggauccagcuacaauggguggcacaguugccagaugccugcccuguuggccacgcuggccagaacuugccucuacuucccucucacugcuagagaugcugcccccugcccugaugacuuccauucuucucuaugucccuggcuuuccuccuugaagaugcuaaguuguuuucuugaauuccauuuuugcccccaaucaaugucuaacugaaaugguauacagccuucagaaggccuuccuugauucucuucaccccaaaaggagagacaucccaucugguuagccccuaaacagacaacugauccucuaggcccucuagaguaagccuuccuuuacgugugugugugugugugugugugugugugugagagagagagagagagagagagagagagagagagagagagagagagaacgcaaaccauggacucuaaggacuaaguuagcuguuuaggcuugcaaggcaagcacuuuaccaacugagccacacacaccccucgaccccuccccccauccuggaaacucuuuauauguccagucacucuuggacuucuagcgauuagcaggcauuacagggucgcucugccaacuccucacuccagauggugaggauggcugacuucacguccccugcugcaaaugaggcaaugccagucucucacgacugcccccacccugcaaugccagccuuugcacaggugcuggaaacguccaugagacccugucccgccucccaccacaccaugcagguggcuucuguuucccucauuucuccucugaggcagcuguguauucaaggcccuucccuuccugacucuguguuuucucacuggcugccagagcacuguggggaaggcuguggcaauacgcugcuggcagccaacauaugcuggacagacggccuguacaacccucuaggugacggcugacgguacagcgagcaucugggaggugcuggggugagucaggcucaggacacuguacugacugaaaguaaaaucucuucaguucccugaaucugaaggccuugauaccuugagucaaagggggagccagacauggggugaggggggaagaaucuugcaguacuaagcuugguucacaagcuaccacagucauugacauuucucucucuuucugcucuuucuguggcucuaagaagccaagaaagaagaauaaugccugcuguuaacuggaguuaccuccuuguuuauacuaaaugaagcaacaguaacaacaaaggcaggcaagaaggguaggcagccugccacuaagaccggcaaccugaauucaauucccaggucacaugauggaaggagagcacugacuccugcaagcuguccuuuguccucccuguggaacucaggagccuacacacacacacacacacacuuagauacgugcacgcaugcucgcacacaugaacacacauacacaaagugaguuugauaaaaauugagaaauacaaaacuuguacguuuugugugacucuucugaguagggugaggaaauuucacaguaucuuguugguuuaucuaacuuuuaccauucauuuguuuagagcagugccuuguguggcucaggcuagccuuguguggcucaggcuagccuuguguggcucaggcuagcuucugacguggugaguagaugaagaugaccuugaacuucugauucuuucaucucuaccuuccaagucacgggaucacaggcgugccucauccuucccaauucacacagugcuggggcucaaacccaaggcuuccagcaggcuaggcgagaacuccagggccugagcuacagcucuaguuccaaaucucacaugugagcgaccucuugguucauuguauucucacuauggaucuuaccuucccauuaaccacugcuuugcuuucuaguaucccauucuaggaauccuuacuuuaccuaaaaauggcccaaaggcccagaggggcaauacuggcuauucuguuacaauguagaaucacuguuuauccuuacugugccugauuuauaaauugaaccuuauuauaaguaugccaugaauaggaaaauauagcauauacauacacacauacauauacuaaauacauauauauuugcaugucagccucauccugaccagauaagguaagggcaggcauggaagguuuucuuaggagugugagaggacagggauaaagaaugccuaggaugcaggagacauuacugcugcucaugcucagggcugauccugcuguguaacuuuggacaaaacaguggugccuggacggcaggagccucaccaagauaagcgguaucagaggaguaggcaccaggauguggggguugggugugguagaagcugccaguguguaucuguuaaauaggggaugcccagggcacccggagcucuuauaagggauguacaggaauucaguacucuaaauauguaagaugcagaaaagcauaggaaguuguuaucuuccuccaaaccuacaugcuuucucuggagguaccaggaugcuaaaggaagauacccagcaucacaaauagaucuuagcagcugguucuccaugaacaccugcaguuguugagagcagguggucagaugcccuagugaaaaacucccaccugggaagucacagaccuuacaagauacagaggacucucaccacaugcauuuggcccucaccugcaaaggauauagcucaagguuggucucuuagucuccucuuuccuuuucuuagccuagauagauacuuccaauguauccuccaaccugugauuagcacucugugugugugugcauacucacaccugugcaaagguauggacaguuucaacuuuacauuuguuuacacguguaugugaagguccaagguccauauuggagccucccucaguccuucccuaccugucugcccugugccucugccucccaaguacugggauugaauaaugucccuugaugagccugaaacucccugauccuggcuauggggucucuagcacugggauuacaggcaagugccucugugccuguuuuuuugcuuuuguuuuuuuuuuuuuuuaauguggguucuggggaccuuaauucagguccuuguccuuguauagcaagugcuuuacuaacugagccguuuccccuaggacccccaccccucagcauuucuuuucccagggcccaggccuguguuguuucuaaaagaccaagcucaggaaagccacuguuugagguuagccuugagucaacuuguucugagcacuugggagccuuucaaaagaggcgagugugcacacaaaucaugaugaggcuaaucagaaguugggguacuuagcgagauguguacacaacagugccgcacgcgcccuucuccugcgagggccguuauguggagaggggugcuguuugccugguuuuuguccuggacagauuugcaucuacuugauggauugcugggguuugggggggugggucuucucuuugggaagcuguggagugucugcucagugcaguggagaagcgcuguccaguguuugcccagguccuugagaugccaggagccuuacauggagcuagaucaauaugagacguucgggggcagcucucaugagcccuuuucauggugaguguccuucuaggacacagcaaaagaggcaacuuugcucugauagugcuuggagccucuuguuuguuuuaccagccaugguggccucuugaguuugccaaagugauuuggaguggcccuuccuacugcagcccugcaugggcccucuuaagcccuugcccuauaggcugccuucucuccgacuggauggaugcugaaaagaagccucacuaggagcagccagugggcuaaacagggcucucauagggaagggcggcuugcuccuaauaaacauuuucugcugccaaagugcccugcagcuuggccucguggcugucuguuuuggcaggaugggagauguuuuugguuuuauuggggguguuuuucugggacauuugcgacaccuguugauuccguuuguucauuccuuuugaugacugagccugaagauccaagcucaguaguucugaguccucucccguuuugaauggcauccccagugcguuuacacauuuaccuucuuaacuaaagggcuuguuuucuucggcacacacaaaagacccuaugcauguggcucagggaagggguagacaacagcuauaggcaugcagacuggaagugguguguuucccaugaagccugguguugggggauggggggugggguuaggagcacagcucugccaguuuguguuugggauggugaggcauggugagugcucgcgcucucccccccaccgcccauccccgagacaucugugcuuacucuauugugacagguuacagggucuuagaaaugagagugugugcacaugcgcacacacaccaagaaucagcuucagggagcuggagccaggugguggggaggagccaggacaagcaucuucugccugucuuagccacguccacucacuucuuggagauuuuuuuuuuucugaacaguucccaguauugugucugauuucucauucucuguccaguccacuuaucagcaaaauuucuugggcacccacugggcacaaggcaaaugaaaaaguagguuuugggcaccugccaguggggauagagcagaugagaugaacauaagugaugcccagucaggagcugugacaagucacaggugaauuucacccaacagugagugcugaggugaggccaagguggggggaagagaaagccagggagccuuccuggaggaagggccgcuuggcuugccuguggaauagcacacugguauagagcagagaagguguuccuggggagguguaucaaccagaguuguucgggauggucugagcuugaacuccaucuccgcuuaaagaaggggagggcaggggaagggacgggagauuuggugucuuuguucaaguccucuaguugugccccucuugguuuaugaucucaugaagguucucugguuccacagagcgagguuuuucucaggaaagggauuggggucccaggucuggagggagugaggaaccuuaaggucacacaguuagugucccugauggacacacaaguaggaggacaguguccagaccucuguuugcccuugggaacauggguguauaauccacacucuguccguccugcuacacaguugcuguggauccugcugcuugccugucugucaccugagcuaucccccccauuucuggccugcugucagggugucugguacacacaguauggcccaacaggcauguuucccauagauaacagaugucagcugaugcccccuuaccaccccuggccacuuguccccaauguccuggaggugucccacugucuccaaagcaagucacucuuacuaaugucccuaucuuggggucauauuggggacaugaugagguaggcuuccugcagcuuugaaucaguggauuggaaaucuagagggccauagagugcuccucuacaaaacgacuucccugugacauggggccaguggucugcuuaggaguguacaccauuauuccauuauagacugaggugacuuucuaagauauuaaagcaucuuagcaaguccucaagugguuugggagaguggcuagguugccguggguugucagugcuuuuguuucuucuaguuuuuaaauuuuguuuauuauuguaaugugugcauccgugguaugugugugucgggguugggggggggguuauggaugugcuuaaguauauguguagaggucaaaagacagcucuguggagucaguucucaccuucuaccuuuacagggauuggagggauuaaacucuccagucacugggucaugaagcuugugcagaaagcaccuuuaugggcugagccaucuugccagcccacuguuucucauuucuauugggguguguguguguguguguguguguguguguguguacacguacgugcuggcugacaucuaucuaagccuggcggggguuuuuugcucuuaguauuggauggagaagggagggagggcccuagguaagcauucaaacccaacccccaaagaggguucauuuucaaaaguagguggccccaagaucccccucaccuccucccccuccgggccuguguguggcucccugacaauggagauuccugcugggcgccugcagcccagcagcugagccuucuugaaggaucuucugagaacugguucuauucagagcauugcaaagcgguuacuucuggcucagcucccccauagaaaacugggaauuguaagucuugcguacccuaaaaaagaaagugacaggaguuggucugagcccuacaagaacaagugauuccguauucagggcagugucuuagaaggaauuaccaaagggaaaaaagaaaggaaggaugaagaaacucucagaagcaggucacuaaaaagauggacaggccucugagcuccauuccugcagggcagcugaguggugaucucccucggauugcgccuccuuaggccuuugcggagcuggcucuggggaauacugggcaaagcuguuucuucugcauaagccccgguacugaccaagccugcacggagcaagauuguauauggcagacagucuccugauucugggaagagccaccugaccuccuccuccuucccacuggcagaaggaaggcuuuccucucagucgacugcauauuaaucacugccuaggagaggcccguugcggugacugucugggaauugccaggguuuugugguggcuccagcugaguuuaggggcauuugcaauucauguugcuugcugccugacaaucccacuuauugcuuauugugaacacuuuauuuuuuuagugcuuuauuuucagguguguguguguguguguguguguguguguguguagcauaugugugucagugucccuagagaucagaagaggacauuggacccccuuaaagcuagaauuacaagugacuggaugugagcugccugaugugggugcuggaauuugaacucugguccucuagaagagcagcaagugcccuuaccuguugagcugucucuccagcuccacugccaaguuuuaaugugggauguaaucgguuucuccagauguuuacccagucucugagaucucaacaaaacuuauuuacuuuuuaccuuguuuuauuuuauuauucaugucuuuguguguucaugcaggugcgaguucgugcguguguguguguguguguguguguguguguauguguguguguaggccaaaggauacaauggacaucauccucaggaaagcuguccaccucuuuugagacagggucucuuauugaccucaaacccaccaaucagauggccagcuuuuugagccccagguauccuucugucucugccucucuagaguuggaauucuaagcaugugccaccuugcuccacauuuagacacugguuacaggggaucaggcucaggucuucacgacugcuuucccaacugagccguuuccucagcuuggcuuaguuuuaccgugugcuuuuuguaacagaugcauauguugucacaaagaagggcuacuuggagcccucaugccccugguuugacagaauuguggucuguagcucucagcaguccuggucuuguuccuccugugcauucucuuccccucuuguuccuucuagacugcuccuggucaguccuuaugcuaaggucacaccucauacccguuuggugggucuauaucuguguucuggagggggcucaaggggggagaagugugggaugccacaaaugggguggcaucucuugcuucaagcaguuguggacaaaaccaugcuucccaucuugacccuuuacucagaaguggaguacuuucccugccuguaccuguaggaaccucugcugggugugguggauagucauugacuuucaacuugacaggauauagagucaccuaggagacaagcuggaaggcaccugggggcuggauugggcuguagagaaccauguggggugugugacagcucuugagaaaguccccacacacaccgucccagaacuccagcaugguguugucuuccuuccuugggccauugagaaggacagcucccaucuugcuucucacugaggcuccagagggucaugucagguaacagauggaaagcgccuuggaaaugaggucugcccaguuagaacaaaugcggcuguuuccucaagcuggcauccaacccaggugugggucugcaggagaauuuaaaugacuuuaccaguggacaaggguccuuuguaggagccccuccccccagagugagggcucccuucccaaggaccuugcugcuguggggcacgccaacauuucucacucugagguugugaggugcuggucucuuguguuucuugacuugcccacccaaccccagggaacuaggagguuucugacucagggacaauagacaaaguguugugggaaguuuacugggauccagguucugaguccaugccugucuuccaccuuguuugaggcaaggucuuuuauucaccaugagguucugguaagucucccaucucacugcaggagcccugggcucgaccacgcugaauuucgauuuauuacugcaucucuguucguauggguucugggagccugaagccaaaucccucaggcuucugaagcaagugcuuuacccacugagccauuuccccaaccguggcauccgucgucauggaagucucuccaacugacuuggccacgcuagguaggggucauugcggccucaguuuccuugauacaccaagaugacuguguaaacaaacuuaaaugauccuuuuaggauccagcuaaacacaauucacuuuucccugacuguuauuuauggccccugcuccugccccugccccuggauaaaauagucaagugacucauguggccagagcucuauucaagcugcagaaguaugacugucgaauguuuuguugaauggagaagcuggggaugacuccuuggccaccaaguucaagggcagauauuaaggcugagacugaggcgggacaucccccagagagucuucguggugccucacuucacguugaguuuucacagauuggaaaucaucucuuucagguuagagacauggcugugguugugacagcagccacacaagcauaaagaccuaacuuucgguucacagcacccacguaaaaacugggcauaguauacccugucacaccagugcuccggguggggguuagacauaauagaucccucaagcucagucuagccggcuuccugugcugcaggguuagugagaauuccugucucaaaaguaaaguggagagcaguagaggaaaaagccugaaguuaaccauacauaccagcacacaugugaacacauaacacauguguaccuacacaugcacacauauguauacacauguacauauacacacauacaugcucacacaugaacauacaucacacaugcaugcacgcacauauaugcauaugcauacacauauaaacaaauaccaagcacucacacauacaugcucacauguaaauacacgcacaguuaucucucugaguaaaaagaggaaaacggagcccuuuuccugaugaguacaaaucuuagcuucgggguuuguuuacacccacauauguucuuucucacacacccacaagcuuauccucguuccgacucgacucuguaaacaucucugaaauguguauuuucuuucaaacuaaaaccacucaaguuuuacccagacgggccguugacauggaauucacauuuggcaaaccucuauuccguguguuuuacugaguguggacuguuauaaaugaagccaagccacuguggugugguucccccacacuccaacucucuuucuuccaaaugguuauggaaguagagcuguucccaaguaaaagauaaauuauagcaggaucuaaaaaagcaucauuuaaaaagugucaggauacaauuggguucuuacaaaguacacaggcugcuaaauucacaggaaaauugaguggaucagguuggcggggugacaguguccuugccauugauuuauccugucagucuggcugugcuggagaaguagugucugcugcggaggaugauagucgguaggcccuucgacucuucauggcuccaguuauuaucucugggaaggacccugggacucaggagccagcauggacccauucgagaaagaagacagugagcuguccuuuauauaaaauuaaccuguucuaguccauuuucugaagaaagaacaaaauagcuaaggucaauaauuuacuuauuuauuuaguggggaguggggcaguggggcagugguuggguguccccgagcuacaguuggaagugguugugagcugugcuuuuaaccacugagcuaaauuugcagcccccaaggccaguaauuuauaaagaaaagugaucuggggguugguaagauggcucaguuggcaaugcacuuuugugcaagcaugaagacuugaguuuggauccccagcacuuagguaagaagccaggugugguugccuacaucuauaaucucacuauaggaggggcagagacaggggggucccugggggcuugcuagcuagguaguccaaaggaauuggugagguucagguucagugagagaucugauugugugugauugacaaggacaccaguugaagacuuccagccuacauaugcauacacacaccuguacacacauaugcauauaacacacacacacacacacacacacacacacacacacacacacacacacacaugcaugcaaaugugcagcaugcucacgaucugaggcuagacgcccaggguccgaagcugcagcucugugcugccccuugaaagguggagacaaaagggcaaguguacauacagggacaggggacaagacagaaguugcucaguguuucaguaucacggcauuggcaguucauccucuuuugggaaucuauuuauuuuuuguaucguguauauacauggaccugcuuguuugcaugagcaccagccacauaugugcagugaguucugaugccaaaagaagcuguuggagccccugggacauuauucacguagaauucuuaaaggauuggucuaaacgucaccuaaucacuugcccuuggcagaacuuugggguuguauccaguuauuucauuaguuaguucuaauuuccuaacuaggauuaaaaguucuagccaggcaggcguggugcaccacuuuaaucccaccacucaggagacagaggugggcagaucucuugugaguucaagaccagccuggucuacagaucaaguuucaguacaaccagggccacacugagaaacccuuucucaaauaaacacacacacacacacacacacacacacacacacaaauaaauaaaagcucuuacuguauguaaguguuaacuuuucacuccuucauaacccaugagaaguguguguguguguguguguguguguguguagaggguaaagaagaguuugggguacagucucaccuguucuguugagacagggucucaguggccuggagcuuaccacauauguuaagcugacuggccgaugagcuuuaggagccugccuguguccgucuuccagcgggauuacaaacacaccaugcuuagccuuuugcacauguuuuggggaucaagcuccaauccucauguuugcuagggccaucucugccuguacuugccaauucauuucuaacagugugcucuaugguguuuuuuuuuucauaugugcauuggauaugcucaucugaaaaguuaaauuuuuaggcagaaauugucuaaaugaauuuucaaguacucuguuugcaaaggaaagaauggguccuuguucaagagagcacaaguguugccagaaagccgcugcuucgcagccgagcugacucuuagcugcucucaggagugcgcuuuucugucuccaaagccaguggccucucuugaugacuugaaaccugcuacugugccaacacuuagacccugguaaugagcagacaagccuggguuuccacaucccucuuccuacaagagagcuggcugcugacguucaucagcaccccuauggccacuuaacuggcuuagagugcuaaaggaacaacaguuaauaucaaaguccauuggagacaugcaaaugaggcagcugguauuuccagggagcccaugcuaggguguuugagacauccucgugaagggguaaaaaauagggggucuuggagucuggcaugcucguagggcugauucucucccuguugcggucaggacugcgauuaaauuccagauggugcuaaucuuugacaugagccagagccccuggaaaguccaugcugcccgcucagaugcugccuuggccagucccuuccaggccaugagcugccauggcagaaugcucucaccuccaagcuugggcaucugguuccuguugcagucucggggucagaguucacaucgugcccgaguuucaaaggaagugcuucuuugucccucugcacugggcuuguuucaucuccgaggagaaaugaguuguguugccuugauggauggaggagggccagcagagcuuguaaguguguuggggcccuugcuacauuguucauuuuaagacuguaguaaauagauugauuauguugaggcagggagggaaguaaggcucaagaaauuaaugguagagagauguucccugaggucaggucacaguagaaucuagggcuagacugcuaacgggguuuaaauuaagguuuuaaaaagagggagcuucgugggagacagacaagagcuuacaggaaaccauuuaauuagggcuggcuuacaguucaggaguuuaguccauuaucaucacagcagggaauaugguaauaugcaggcagauauggugcuggagagguagcugagaguucuacacccagauggcaggcagcaggaagagagagugauacugggccuggugugagcuuccgaaaccucaaagcccauccccagugacaaaguuccuccuacaagaccucucccuaugggccuaugggggccauuuucauucaaacucuggccccuauaggccacucaaagucagagauccaccuggcucugccuccugaaugccgggauuaaaggcgugcagcaccaccacuuggcuuuuuuaaaaaaaugaugaaaauggaaacauuuuauacacagaaaaugugcguggcacuugaggacugugaugcagauuuaaccacaaaacaaaugguugcuuccccucccuggcccccauaggcuuauagccauaucauaaugcaaaaugcauuuacuuaguccaacuucaaaaguccccguagucuaucacagucucaacaguguuuaaaagcgugaagucucuucacagacccaugcagucuccuaauuguaacccacuguacaaucacaaugaaaaagcagaucacauacuuccgacauacaauggcacaugcauugccauucuaagaggcaggaaagggagccaagugaggaaacacuggaccaaagcaagaccaaacuccaucuggacaaacuccagacugcaucuccaugucugaugucauggugauuuucagaccccaauuccuuucagcuuugcugacugcagcacacuucuuuuucuugggcugguuccauucccucugagcagcucuccucagcagcugccccugacaucuccaccaucucagggucuccaaggcaagcuaggcuucaccuucacagcuucacacgauggucucucuaggccucuaugcagggacaccccugucacaugccugaccucaguggcuuuccucauccaagaggguggggggggggguggacuucagaacucuucuauccucaacucuaaagcccaaaccacguguccgauccgccagguucugcugcuugcuggggcuagaacauggcucccucguuggaauacauucuucaccggcuuugcuuuugauggucuccuucacugccuaagcuugacugcccuggaacugucuuuguagaucaggcuggccuugaccucagagaucugccugccucugccucccaguguguggacgugugacaccacagccagcccuuaacuuuucuguauuuucacagguuggaagcuuggcuggugcgucuggcccugaggucaccacuccccuuauuccccuuggcuucaggcuugucaauaauaauaauaauaauuuuauacuucccugugccccuuuucuccuccaaccguacauuuuguauuuuuucuugcuccuuuucauuauagauucacauaagugugaccacuaauaaccaagcaauacuaggcugucuagaaauuucugcuaauguaguuaauccaaacucuucaauucagccucaggcaguuuguuuguuuguuuuuuaaaaaggaucgaaaacagccacauucuuugacaaaauaucauaagaugaucuccaggccacauacuacuagucuucucuugagccaggccuccacaguucaaaucacccucagcaccgcugucuuccaugcgccuacuaggauggcccauuaagccgcacuuaaaauguccaaucgauuuccuaguccagugucucaaaguguccccauauuccuccaaacaaaaacauggacugcccuaucccagcaaugccccagucccugauaccgaccgacuucugucuuaguuuucauagcaccacacuacgcaagcaugaagaucugaguuggaucugcagaauuucuguuaaagcuaggugcaaguugacauaaaacacccuuauaacuugcaaaaacucagucauaaauaaauguuuuaaucucuuaaaaaauaagguggagagugauugcugaagauagugucaaagcucugccucuacacacauacgugcacacucaugagcaaacacacaugugugcaccuauacagggagcggcaccuugguuucugccgcuggagcugagcugggaaccaguguuuguuaacuccccaguggccuugugcaacagaguugaaggcuccugggguugagaaggcuguacugugccucccucuggcccagcagggagaguggaggagggaagccugcugccugggccaggaggcgggaaggacagagagccucaggcuucccugggccauuaaaguuuaucguuugccacagcagugauugaaaaaggcuuuuugcaggacugaaaugugagcagugaaacccgccaguugauacggaggcuagggugcuuaucccauaaaaauacccucugugucaaaggguuucaguaaaugugccugggaguauuagcagucauuucugccagccuggggcucuugaugggggggggggugugggggggaggcgguaaggagcuauaaaagggagcugcaguuccugccaagagggaggacaaggaggagaggacagaaccaccagcagcuccuggcuagauccuuaugcagcauccaaaaagcucaaauggggcugugccuuggguauccccaccuaccacuugaaugggagaggggcuaacagccuagcuaggcacacgcacaaucuggugaccuuugugugucuucacuguagggucccagggacagucagggaacauggggcagguuccuaggacucagggagguuguggugugcaugggguacuccuuugagcugaucuguaaaauggggguugugauaguaaucaggggaccccagguggcaugaaaggccaauccugaucaauaugaggcugucaugugcuggcagaauagagaggcuuugccacuuccuuucaggagacguuuacagagaggguaucaguaaugcaucaggcaugggcaggaacuacugugaucagugcagguguggucugcccuguucuuggugagagguguggauagcauucgaaaacuuuguguucauacaggacccuguaugccaguuacugaucugcccugugucaugcugggggcagcagagcuguaauaagaaggaugucagguggagguuuuucugucaccugucauccuuuggugccgggggcuauguacuuggcuuggguggcauggggcaaccagggcugcgcaagaccauucagagcauggagcuuguguguugaguguggugggaaagagaauuuuccacugucccucuagccaguagucacgggagacaucuugugggcccuggcuguguccgggcugucauuuucagaggccgugcucugcccccugaaggcauguguccucucugggcacagaaagcagaaaagaagccaagggcucuggguggagaaaagaagcaaugagcccugucgcccaucuagaagguaggagagggcaucguguacccuuccuaggagggauggcucccucgggcauggccccagcauccacugaugggccacacaggcuucuucucuaaagcugugguuuggaggaaaucaauguuauggaauaguucccagcucugcugcugguucugcugggaggaguuuggguggcuggcuugguuugggaaucauauuuuucauagaaaggaaagggggaaaucccccaccuggccugggcagcaggcaggccaagggaggaacuucacuagggcaggucaguggcuagacccacacuucaucccagaacccauuuuacaagaggaguguccucagucauccagggccaccagcugugcccauagucuuggcuacagcagggccuucacaagccuugguaugcauucuuuuuucgcacuuucuuuauuuagcacuuaccaauuacacuuagucaugaguucauacgguacguaauguauuuugaucauguucacuuucuauuacuacccuuugccccuccucaccccacacaccgagaucccuuccuugucccucuuuuguguucaugauguuugggcuuguuuuuuguuuuuguugguuuguggccuaaggaguuccacugaguugcuugaagaagcuuaggugaggggucguguauaagaguguggauuucuuaccagcagcuucaucacaaaaugugugucccuccccaucaccuacuaacugccuauauacccucacgggguauauuuccguauuucuaaguuccugagccugugagagcuuucucacuugugagggcauucuggguugugugcgagccuacuagccacgaucagggcuguugguccucuuucccuguguucccacacuuucccugugcugcgacuucccuccccauguccuguuccaaacuccuuuucccugggguccuggucaccucucccaaugagaguuggugcaucccagaggcuuacaacacccuugugcucuuggagucucccaguagcuaccguauccucaaacuuggccacccuguccccagaucugucugggacuucucacccaaaucaaagucugugugauaauuuaugcaaaugagggagggcuggugguggccagagucacagacauccaucaccccaugucccagcacagucauccuucaucaggcccuuaaaagauaguacaguuuuuguuuaaggcaauuacuuaaucuugacaaacuccuguguuaagcagggcuauuaauggggcccaccauuaaucagugcgaacccaggugggugcuuucucugaaccuccaucacucuuggggacccaaggugggcccuuugccauccucaaugcccuaauuacacaaacagcaugcuaaccacaagcaucccacguggacggcaggggcacccagccauggacaggaaagaggcccauuuuuaaugccaggcagaagguuuucugagccaagcaggaugauccauggagguuauuaguagggaccaggagcacagcuggggagaacagauaacuccucuccugagaaacucuccugcucuuagcacccacuuugucgccuaccuggcggucugcagaaggauugcacaaguaccuuacguuggccaguuacguuuacguuuggaugacuaggaaggaguuuggaaguaccaagccuugcccugugucuguuuggcaucaucaucucugacaccccauaaaggagcuggguaucagagugcuccucuucauccaacuaccacauguggcccugucacacugacaccugcccaauggugucagaggggagcuggccccacaggagaacccguagugaguggaauagagacagagcccagaaccuggaucucccucaaggaguucauuucuguuuggaucagagcagaacaaaacauagaacuacuuaggaaagacggggguucauuucagcuugccaauuacaaguuacagucuaucguuguagggaaguggaggcaggaacugcaaauagcuggucacacccacaguuaagagcagaaauaaauauguacuugcuugcuugugugcugguagauuucuucacucuuauaccauucaaagccaucugccuaaggaaugaugcugcccacaggccaacccaauguuggcaucucucauugagacucuucccaggugguuuuagguuguaccaagaugacaaagcuaaccaucacaacggucaccgaagaaaugucacuaucuuaucccaccagugaggauggaccagaaucagugugggugggugcgaggccagacugugacacuaauuaugcauuacuaggggcaagucaccauguuucuccaugccucuguuuccccuucuguaaaaugggguagaagauaacagauuccuucuugagggcuucagguaucaauauguuaagaaugggacacacucaggagaguccuuccugugacagucucgcugucagaagcccucugugagggaaguacaguucugaucacuccuccaacccccaggccaaguguguggggaguuuuucccuggauguugagcccuguuuauuuuauaggaagucagcuucaucugcuuuuaauucacacacuuagcucaucaaaauguuguuuugcaagaggccuuuugguguccaggaagccuuuggaauggccccucuuuacauagucuuauuccaggaaaaagauucuagaaaccacuuuguuugauagguugacucaugcccuaauguuuuucuuuuucuucuucuuuuuuuugaucacacuuauuuauuuguaugugucuaugagaacauaacgaguuugugugugucacgggucacauauggaggucagaggacaauuuguggaaguugguucucacccugagccgugugaguucuggggaugaaacucaggucaucgagcuuggccacacaucccauuaccuacagucagcuuuccacaucuuaguuucuucaugcagggacgaaggauuuguggaacagccuuuagaguugcugguagaccccacaucauccugcucaagggagccaccauuucugucgguggcggugugaguggguaagaagaaacaugggacagcuccguggaaacaggacauacuagaaguguccuucaauucauaguguggcacagacgggagucaagcuccaacacaugucccccggcuuggcggugcagcugcacaccccugcucccuuccggcucagaauccccuuucugacuuagcauccugaggacccucuuauucaucagaaggcuucgggauggguccacguacccauugacuauuuuugugcacacccccagcuugccggaaagacagcaggugaugauccaggucaggcuggaggcaggcugcacugaccagcacagcucugacccagccaaggggauaggaaguuauaaggagugucacaacaucacucggugaccucacagggaccugggugacccugugaguucagugaacuggaagaugggaggaaggaaggaaagauaucauaacuguuugcuguguuuguuaaguggcauaacuuaacuaagcuaagauguggaagaggggaaggacugaggggugggcgauucucauuuccguguuuuaugugucaggaagccuaugauuagccuaggcuagagcuccaucagugugcaaagacggugacaaugacuacuuaguccagagcuguuggacaugacagccacagcugccugucgccaugcaguugagcaaucgucccaguaagcugcacaaaagggaaggaucuacaccagauuuugaagacuucauggaacaaagaacacaaaauguuuuauuaacaguuuuuauacugcguccaugcugaaguuuuaauuauguguauauaugugugcuuguucauaugugugugaguacauguacguguaggcaugugaacucaucugucuggaggucagaagacagucuuggguauggguccucaggaucuguccaugguuuugucuuguuugcuuuugcuuuugcuuuuguuuguuuguuuguuuguuuguuuguuuguuuuuacaguuucucauugaugagccuggguugucuggucagcuagugagcuccaggugucucccugucuccuucucucagccuccucccaugggagcugagcaucgauugcaaacacuguggcccauagggaccugauaguggagugucacagaugucccucugaaaggagccaguaccucugagacucugaccacacagccuggaagcugccagauggugggguggcaggggagucagucagaggggcaagggaaccuaucaaaagaaaacacgguuuggggaccucaucuuccccaagguaguucaucuagcuccaucccuacaaugggugcaaggagcaugggggcccagguacuaauugcuggcugcucuuaucgccaaguccaugaacuuggccuagauuuguucuuuucccuucccuccuucucuuucucccuccuuauauguguguguguauguguguucucuucaugugcaucuguguaugcccauguuguaugcauguauguagaagucagaggacaccuucaagugucauuucucaggagcugugucugucuuccauuuuggaagacaaggucuuucacuagcuuggaauucaccagcugggcuagacuggcaggucagcaagcccugggcaucugccugacuuugccuccccagcuacaggauuccaaacacaccacugugccuggcuuuucuuauguggguucuauucuacggaucaaacucugguccuuguguuuauaaaauaggcacuucagcaacagggccccuagauucacacuuuuugcaagaucuccgagucccuagaacuaaaauccucuguguuucaaauccuuugauuguuuugggggccaucccacaacuuucuagaaaacagauuuugugaccuagacgauugcccccuuuagucuggauugaccuuccuaauguuucuucugacccuaagauccccuaaccuggggcugaggagacaggucuauuggcaaagagcugguccacuagaacuggugagcagccccugcuguuccccacaguggguagugggggcuuccuugggauccuguaaaacuccccucugcguccccaccccugcugaagagaagggagcccagcagagcuggcaguagagacagccacacugguucuccugcucucuguauugucucacacacucugugucccuuggcccugucacugcccucauuucacagaugggaaaacugaggcacagaauaacucauugagacagccacuucagcacuaccugucacaucccaagccucugggguggucccagucugucccuguggccugucccauguuauuccagguacaucauuuaaagggacagauugccuggcccagucuccccgaggcuucaguuggccucuuccauggcguuuucuggaauacucuuggaguguucuuuucucuucucucuugccuucccaacccugagcucagucucagggcgcuguccauacggaguggcucacacuggcuccagcccagcccugugcacucuuccaacaacuguuuugucaguaguuccuugacugggauaggccaggggaagguccagcugcucuuucagccugcuagacaacagucagcuuaugcuguuugaauguugggccugauuuuaagccccgccuccaacugagacuguaacacuucucaaucacauguugugaaguaaccacucuggauaucauaguuauuaaaaagcauccuugugaggcagucgcucccacaggggccuccaaagucagcuuguccugcggcugguuacuggaaacacaugccauuugugcagggcccugaagacaggcaggcucagucuggaggacugagguguuuuggcuucuaggcuguuuuagugccagcuacucuagcucugaggcacgggcaucgggcacuugguuuccugacuccaccugacugacaggcuagucuuggaagaugucccagcucccaagugggcugaggacaagcccagcucagugagggcucccuagcucugguccacuccuucaucuuuacaccaguggaaagucagcuuuacaucaguggaaaggcuaggugaccuaauaauuccaagagcaccuguuuagacaucuugcacguucccuuguucuguguguccuguauaccggaagcucauguggaguagccaggcugggcuuccuggggauuguaccuggggaugugaugagaagccaucagaaucuauuugucaaagcccuuuucuacaaagcugugacuccuguccuuugcgucuggguuuguuuuuuguuuguuuguuuguuuguuuguuuguuugaagacacugccucauuaaccugguugauugauucaucuagacuggcuggauacuggcuggauaguagagccgcaggaauccacagaacucugaacuucagccagcugcucauccuuggccuggucacccugaagguugcacuuauauaugcuugagccuuagcacaacacccuguugucuaacuuaauuuucuuguggcugggacaaaauacugacgagugaaaaugaccuaaguaaucuuccaaggaaggaaggaccugguucacgcccgucauggugggagggcacagaugcaggaagucuggucauuuugcuucuguacuuggaaagcagaaagaggugaauucugacacucagcuugccuucucuguauucauucagaacuccaaccuaccugugguguuuaaaugagaugucauccccccucccccacaacuccugcauaguuugagcauuugaguacuugguccccaguuggugguucagggcaauuugggaguuuggggaagguguggccuuguuaggagaaucaugucacaggaagugaagauuaaagacucacaccaguuggaguuugcucucccuacuuuguguuuucuguuuuaagaugugagcccucagcuucugcuccagcuguggugcaugccaccugcugccaugucucacuaucacaauaaccuauuccuauggaacuggaaaccaaaccaacccuuccuucaauagaugguauugcucauagugucuaucauagcaacagaaaagaaacuaauacaccauucuacacucagggcgggucuuccccgcucaguaaaccuuuccagaaacaccuugguacacucaggaguauauuccaugguggcuauaaaucccaucccauuggcaauuaaauuaacagcaaccagcacaccaccugcacuguacaaaaucucuuguccuggagucgcuuguccccgcuggcuauuguuaaauaccugggcagcagggcuucucaaagaaagccacuucucuggucccacucacaaaggacacauguccuccaagcugauuccaucuuguaguuauaauugaaaaggcgggaagcucuagagaaccacauucuccagagacuggacauccuagaaggcuguggugucuccacaaugucccauaugagggucaugaccacugagaagucuguugagcaccucucuaggcagugucuaggauauggccacaucucagaacacucugucagcugaugugacuucgagacauguuuucaugacccggauguucugcauucuuccuguaagaagcccucuucauucgccacuguggucaugauggggcuuuaacuugagcucagccuccaaggaaagcccgucccuuaucuccuuucaacgucuuccucacacacagcaaaaugguuaccucaggacccugucacacaaauggcuccucaccagacccuaccagccagggaacauuugggguuucaguuagcacacaaaaauucuggacuuuucaugacaucucccuccucuucacuuccucagggacuuucugugcaagaucaaaaacaaaugugcaaaaugugcauuuuucuagggacagggcgugguugccaagccuucuccacuuugagcuucucccucagaaacuuaaaaagggagacauuucuuugaaauggcauauggugugugugugugugugugugugugugugugugcccuuucugcuggaggacaugauuuaauuuagauuuccuuaaaaaaauaauaaaacccacaaugaaaacauuguguggaaugaucaaauucaauaugucggcugagguggcuguuuuuguaugugggucugagugugugugagaaguauauauggguaaagagguguguguguguguguguguaugucuggugcacuugcgugugugcgcgcgggugcacaugcagucguaaagaccagagcagggcaucgcugucuuccuuuaucacuugccuuauuccucugggcaggguuucccacugaaucuggagcuagguuggcagcuagcaggcccucagugacuuucugugcuuguccagcugugugcauaggugccggggauuagaacucagcuccucgugcacacacagcaagcgcacuuacccacugagcugucuacuagccaaagguagcucuugcuugcucuguuucucuuugcauucuucagcugcugcuggggccucuguaugggagguuauuucucucagaagcuaaaaucuccucacugagagcuuugagcaagcacuuauuucugggagccccuacugagcugaaaugucugacuucagaugagcugguuccagccugcaucccuucacuuaccuguaugaaaacuuggucugggaugauuguguggugaaucugugagugggagagugagugggagugagugagugugugcuauccuguuacagcgggacucccgucacugggcugaaugguucagcagcuuaguauagguugugcuccugcaggggaccugaguucagcucucauaucgugcagcucacaacugccugauguggcuccagcucuggggcaucugaugucuauuucuaguuucuaaggucccagaacuuuuuauuuuuuaaagcugggguugggggacuuuuuuuagaaaagauuuuuuuuuuaaagcuugcaaguggcucagucgguaagaacacugccuucuuuagcagaggacauacaaaugcagcauacguucacacaugcacacacacacacacacacacacacacacacacacacacacauacacauguauggaggccagaggcuauuucugcucauucuucaagugccgccugccuuguuuuuugagacauggucuuucacuaggaccugauucccaacaaucgcuuuaagcugucuggucagaaagcugcagggauccuccugccuccaccuccucacgucuggguuuaugagugugcaccaccuugacugucuuuucauguggguucugggcuuugaauuugaguccacuaagcuaucuccgcagccccggcucuccacucuugauauuaacuaccagcccuuuggugcugguggugccuccagaacugaaaacaccaacacgugugugucaguucggagcugagucagccccugucugugcuuggccugugcucaacaaaucaucaugguaauugcaggaugcucuuugcuuauugaaagaaaaugccugggugccccagaggcaaacauaauuauaggcuuuaggaaaacagggccuuuuaacaaguaggcugggaaaaggcuaagggcuggggcauuccucauuccucuguggacucuucccuuagucagaaggccacuggccuagggaaguagggccuagucuaucugccucgucugccauaucaucagggcugcugacagcuuaggugugccuugaucaauucaccgaaauaaggcuauucuuuguaaacagaaacuucucuucuauggcacuguggugaaauaguuaaauuuaccaugguugggggcuggggugguaguaacucuugcugcacaagcaugagagccaagucaccaccauaaaugucagaagccugguguggggacacgugccuucuaccccggcauugggaaggcagagacaggaggaucacugggacuugcuagccagccagccuagcugaaucagagacugugaaaucccagugagagauccugccuuauaaaacaguguggcuaguuggauaguaccugaagaugaacaccugagguuguccuauggucuucacaugcuugugaacauaugugcacacauaccacacaugggugcucaugcacacauguguacucaagcacacgcaugcacgcacacaccugugcaggcaugcaugcaggcaugcgcacacauacacauagagcagggaauuagcuaccuaagcagauucccccaagcugcgccuggccuugcuucacagaugguucuagguaaauaugugcagccugugugcacagcggaucugaggcugguaccugaugauacugaagccacacgcagccaagccggggugggcagaagcuugugccagucagagucugucagcacugucagcccugauuugcggccaagcuggguuccccaaguucaaagagcauggagcugcuugucuuugucaagagcacggcuggggaucuuuuauguggaagauguaggauucucagacuggcuuugauuauuuauucaucccccuucgugggugugugauagcacaggcaucauggagccccuuguccuggccacucuugcucaggaauucacggagcuuaaagccuuuugaaaauuguuuuuccagggagggggaaaguguuugaaguccucucucucucucucucucccucccucuccacaguuccucagcagcuccugccggcuuuccacgcgccuuugccgauugacaugagacaccaggagggaagguaccauuaugacccucacucuguccacaguguacacggguaaguguuggcuuccauacacugcuccugcugugcagcugccugccucuguccuuuuaggucacaaaagugcugugacugugaacccaugagcaggugacagugcacacuagccccaaguagcaggcuuggaucaugugucaucaccaugguucaccgugguccacagcucuaggcuuccuuauuggucccuacaauguaaucuuaaguacggguugcccugggguagugguuuggaguccccuccccgcuuuuacaacuagcucagagugagccuuuaggucucuuucugcuucccaccuugagguccccaaggagaacggugacaccuugauaugauucagcauuucccgggguggggguggggggggggaccuccagcccuggcugauguucauucucuuggcauuugcuccuuucugagccccgcccccuccuauaccaccugguccccuccagaggagagaccaguuauuuucaucauugcaaugauaaaguagcugaccaaagcaacaaaggaaggaacguuuauuuugguucaugguuugaggguccauuguggugaagucaugacagcugaucacauggcauccacauucagggcgcugagagagauggaugcucgguugccccaccucucuuucucuuucagugugggaccccagcccagguaauagugccacccacagcuaggguaguucuuccccagauaaccuaaucuaguaagcacuuacagggauauaauaugucuccuaugagguucuagauugucagauugaaugacagaauuaaccaucacagaggucugggccguggcuguucauucagcccuccaugcaugggaagugagucccucugucuguccgcuuccccucccacucuucucagaccuccucaccuguccacaucaaauugcugucugcggugcugaaucauaguccccgucacuugucgggaugacuggcaccuguugccugcccagucugaacccccucagcuucagaucuagcucccgaggagaaugggaugccccacccugagugggacccagcucucaauuccaacaccauugccagaucagagcaagggcacauaacucugagauuuccuuaggcugcuguaccuacagugacagaugcauaguagguacgcagagagugcugagcagagaguccccaccuaugagauucuaacucccacuagaauaaaauuagucagcauagcugagugcccagauguucaaagcauugugccucugcugugugccagccagcuguccagugacaccuguuucaggacaccuccugccuacuagacagccagccugggacuuuggcuuucuuuuaagacaaauuuuaaguuuaacauugggauaaugacaagaugguuccgugaguaaaaguguuugcagugcaaaccugguagccugaggucaaucccuagaacccuguauaaaaguagaagaaaagcaacccccaaaguuguccucugaucuccacaugugucucauggcacacauaacaccaauaugcaaagguaauacacaaggugcauacacaauaaccuucaaauaaauuaauuaaauuuugaaauaaauucaggcaugcaagagcuauaauaauugagcaagauaaaccacaugcccuccacccagcuauucagacauuaacauccuguaucaucuaguaccaauauagugaacuaauccacauaucugauauuaauguggauaguuuucucauaagccuuuauuuccuuguucaggauccuguguguuugcauguguguguguguguguguguguguguguguguguguguguaagccagaggaggacaucugauguccuucuccaucauuucccuuacucccuagagacagguuugucacugaaccugaagccuggcuggcagccaguaagcucuguaauccucuugucucuguucucccacaguggacuuugagauccacaagucaugcccauugcuaagugggugcuggggauuagaacacagguccacaucuugcccagcaagugcuguucuccacugagcccucucccuagcuccuuaggcacgagaauuaccaugcucuucacugacuuccaugcccuuugcacugaauaccuugaggaauguguggucauuuccuguggcuaucacaaauagucaacucuguggcuuaaggcaguacaaguguauuuucagacaguucuggaggccagagaccagaaguaagucuuacguaguguggacaggacuuacuucuggaaggaacgugcauuuguccuuccccauuucuggaagccuccugcaucuuuugacuuacaaccccaaccucacaccauugcaccccuggaccugaccccacgucagucuccucuccugcuucaauguucucucugacuauuucaucaaagacaguugcuauugcuuuuuaagacaauccagcuggguccagaaucaucucuacaucccaacaucuucucccaguccccuacuaugaugcagaugagauuaauaugcaugccuccuuagaagcuauaucauuugauaucacuaagcuccgguguaaagccugggagauggucccacaugcuucugugaggucuaggggaccagacuguggggcauagccuaggagggugcuguuugucaucaccacugccaggaagcagcuucuaggaccugcugaggcaggccuugacaagcucaggauaguaugucuccaccaagaagaucaagaagggacaugauaagagcuucggggcugagaggcauaacuccucguccccauacuccccuuaucccaggugagagcuagacaaacccuggaagaaaaauggccccauaguuccggcuucagugauuaauguggucugagccugguggaguccccaauccaucaaaccuauguuguagacugccugcuaccaccaaugugucuaauuacacacguggcaugcagcaaaugaggcaccgugccaucucuugucagaagagucuaggccacugccugcccccuuggaaccacaaggcccucugcuugcugcuggaugcaccugcugcucuuaccccacacuaccagaacacucagaccccugcccguggcucuuagauccugauaagucccaggaguggaggaucccagagugcaggcucuaagucuagugaccccuguugugcucacaggacuccuuccgucuuacccaaagaucugcuguugucucggacccuccaggggguagggggacugccacaugucugccagugcacaauagaugucuugugaacgggcaagccucaucuuuucaucuaugaagcaagcauaucuacugaguguuagguuucagaccagaggcuagugaagccgugcugaccuccagucaccucuucuagcugcugugacaggaauggcaagccccccaccaauagcuugucugcagaucuucagucucauuccucacagaucccuuuaagugcuggaaagugcuccaggagagugacaggugccauucucagguccuccaggaaguuuacaggccucagguugcagacucugggaccugagaacggcagcacuauggguauaacuggcacacuucaccuagaugcaccgcuccgccccauccuuggagccgcacaccccaucaccaaaugcagauccacacuggaccacccaucagauguggcagaaaaucucccuguuccuccgaggccuagaagaagggaacccccucucugccuuguggucccgagcacuccucagagcuuuugcucuguugucaucugucugucgguccauguugcuaacugauaacucuucucauacaucucuuccaccccucaaaucuaccuuaguauccccuugaaugccaaacucaaaaccuuucgauaaucuuaauagcagaguccaccgaguuguuguuuuguaacagucacgggccuaacaauuguguggcugugugguaugugccaugggugagugcucacaugagcggagccagagaacaaccuccacuguuguuucuugggagcucuuguuuuaccuuguuuuuuaacauagugucucucacuggccaggaauacccccaguagacuauuacggcuagccaaugaggccugcggcucugcugugugucuuuccagcacugggauuaaaaaugcaugcuauggauuuuccuccuguauggcucugcauguuaucaucauuaucaccaucaccaucaccaucgccaucaccaucaccaucaccaucaccaucaccaucaccaucgccaucaccaucaccaucaucaccaucaccaucaucaucaaucauucuuuugagacaaggucucuaacugaaccagaguuuaccaauacagcuaggcugacuggucagccaguuucuaggaucugccuguuucuguccccaacauuggacuuacagacacuugccaccacauccuaauuuuaugugggcaucagggaaaucuaaauucaagugcuugggcuugcucaauaagcacucccuggccccucagcucuuuuuuagggguggugcugggggaauuaagacugagucuuacuguguugcucugccuugaacucagagaccugccugccucugccuuccaagugcugagacuauaggugugcaccaccaccaccacccccuuuuuugcuuaacauugguucuggggcucaggcuggguccuuaugcuugaaggggacaacacuuuccuggcaaagccaucucgccagccccuucguugcucugagaaugagaucggauggagcagggaagaguguagaaaaguuuaggacauccugcuaaaguuuauuguugcuguggcucucccgguuaccuguuccagaagaggcuucaucacaggccagacgacaaauauggcuugccauuagaagaggaugggggcugggguguagaucagaggagcauaaggaaggagggagacuuucucucaguggaggaguuuggacgucaguuucucuaaagccccagagucagagaugaugggcagauuuaucaggggaccuagggaggauggaaacauggugaggacugccugggucuuugcuggcuaguuuuaugucagcuuaacacagcuaaaguuaucugagagagggaacuucaauugagaaaacaucucuauaugaucuggcuguagacaagccuguaaggcaucaauuagugaucaauguggaaggggccagcucguuguaggugguaccauuccugggcuggaggucuuggguucuagaagaaacccagguugaacaagccaugaugagcaagccaguaaacagcaccuccuccauggccucugcaucagcuccugccucuggguuccugcccugcuugaguuccuguccuuugaugaugaacugugguauggaagcacaaaccagauaaacccuuuucauacuaacuugccuuugcucauaguguuucaucaaagcaacagcaacccuaaaaagacgguguccuaacagccuuacgugggacugaacacccuguccccaacgagcugcugggcacagcuuucagcaugggaauaucuugcugcccagccaauuagaugacuuccccaaaacacccucuucccacccccuugcagggagauuauuucuugaugauuucagcaucaaaacaagauucacacugaaaacuagggcuuuaguuuagcgguagcgggcucgccuccaguacaugaguucauaguacugcaaagaagaaaaucacguugcuuccugaugcucaagugucaguguugcucacagugcuaaugugcaauggugcugucccugaacuugaagugcaacgucuugguucuauggaaaaugaaggaagcacaucggucagggguucucucugaccccugugagggcacgcuccugagaucccaaaggaagaagaaaaagccagcugagaguggaaacagcccgaccugcagugucugucugggaggagaggagcaccuugcuuuccgcugggcuucugcucuuaaaagagucuggcagggugcuagagggaguguggcagagugugguggggcagccccccagaaaagaaccaggaccuuggugcacauuggaccaagaguacuuugugucccugaguggaagcuauggaguccaugccacugguucaggaggcucugccuucagucuguguuguuuguggacuccagcuuugaucuguucuguccuggcauuucggaggcgguuagaacuaccucuggcugagaagaacugagagaaacuccuuaguauagcagauccccgucuggacagucuggcaguucuguuuuuugagacaaggucucauguagcucaggcuagccucaaacucgcucuguggcugagagcuucuuucuagucuuccugcuucuaccuccagagugcugaaguaacagaugugcaccaccacaccuggcuuauaucacguuagggauuaaacccaggacgguguaucuaccaagcaccacacaacaaacugggauccaucuccagccccuuucacccuacacccaugucuuaaagaugcuugcuccuaacaccuagcuccaaauauucugauuucuccaaguccaggaugaggccuggggaucuccuuaauucuaagcuuacacagaccaguuuuuagcgaccuuccuauuucuuugacaaccaggaaagaagcgcagaguauuagcuuucuggaaucauggagucagcuacacucucaacaacagcaaugcuaccucagaaaugggggcauauuaaaguccccugugcuucuuguccucccacuaagagcugagguucuccugguuggccuaaacccauccauaucugagcuugcagguggcauggagcauguacuggggagagaccgugaacucucagccacagagaccaguguccugcuguccuuucuugucuggcaccaggccugaccaccaugauuuccacacagcccaccuucugugucugacuacagcuaauggcucccagaagaucacuugguccuggguugcacuuaguuaguauuuauggcaaggucacacucuccacagagggcagaaaggcucuguggggacagauggcucugggguaucucucucagcucauggaaagccaacacacuggacugggguguuaaggaaggaaaagggauaccagguggugggcacaccuuacccaaagucccccaagggaaccauuuuacacauauaagucucugccuguccccagcaggaguguacaaauggagaugucagcccguaaauuggcacacugucacuuaagauggucguuucguugcugugacugugcucagguagcuaacuuucuagucugugggauuugaagauagcuuuuccaaggucaugguuguugacaaacaugccaccugguaacuuacuagcaugauucuggggccugugacagucuucaaccauuccccaagggcugcagcugggcagacaaaaguguggcugguuucuucugaauucuuggcucuauaccccaguuuuagcuuuguuuguacaucuuaaagaauugucuucuuccucagcaagugugugugugugugugugugugugugugugugugugugugugugugcuccuuuucaaagccuggugaguggagacuugggaagggcaugucugccugcuuccuaggcugaggugcuagauggacucaggccaccuaccagaagccuugucccuucuccugacaugacuucauccccaccauguuguucucugucauugggucucucucucucucucucucucucucucucucucucucucucuguaaaaccugccaugacugacaacuuacuaccucugauggacuggucagcagacggagagcacacagccuggagcaggcugcccacacagccugcccuugauggagggacccucagaugaggugacuccugcuucccuagaggccagcccagccguugagcagucgagacugcugcccugcaaacauggugaugcugucccuccugcucauaagagggaaaccgaggcacuggacagcaaccugccccuuucuuggcauaacuuguguuagacuaucucuuguugggauagguaacggagagaauaacuugagaggagauuuauuugagcucagguuucguggacuucaguccauguccuccggcuccauagucauaagcccauggugaggcagagacgcucaccaugucucuugguggcaggaucuugugacagaggaggcugcucauuacauggcagccaggaaacagagaauuaagagggauccagagguaaaacacaccccuuuagaguugggaagaugccucaguugguccugugccagccaaggaccccuaggaugcacuuuaaaaagccagucaugguggugaacacuuguaagccuggugccaggguggcaggucacuggggcuuacuaggcagcugucugcugaagugagagauacugucccaagaaauaaguagagagcaacuaaggaagccaccugauguggaccucuggcuuucacagguucauggacaugccugaacaacucucccucucccuucucccuucucuguaucccucuuccucucccuccuucccucuuucucucccucucuccuccuuccccucccucuucuucucccucccucuuucucucccucucccccuccucuuuucccuccuccucucucucccucucuuuuccucuccccuuucucccuuccucuguuuuucuuucuaccuuucugucccucucccccucccccucccucccucccucccuuccugucucucucccucccuccccccuucccccaaaggcaugccuguaaugaccuacuuccuccaaccaggcucaguucccaauaauguuaucaauuauguaucuauccauggguugauuccuugaugguucauuaaucugaugaaaaguagaguccuuauaauccagucacuucccaggacgcugcccuccagcugucaggcaggccuuuaaggacacuucagaguuaaacuauaacacauucccagccauggcacagguaggauuugaacuccaggcagcccgauuccugccgcaucucccccugcucugagaacauaagauucucagcucagacacgugcucaguggcauggggcagacagcucauuuauaauggagccuggcccauaaaaguuuaaugaggagcuugucugauaagaugccuaguguuugaucuuugugaaugccagcugcucauguaagaggcgcuuccuggccgugacucuggggagcauugauggggucagcugggggcagcagucaguggggagugaagauguaguuaguccuguugagaagggcugcauggggagcccuguguucucagaagcugcaggggcaggcuucuggccaggauuuccuacaacaccaggaagugacccucugauuccucuccugucccuugggguucuguuggacguucgcccccucugcacucuaaggaugaaggcagagcuggguagggcuaggaugugaaucuuacuauauauucucaguacauacaggggcuggcugauuaaccaccacaugccucaguuucuccuucucuaaaauggggguguguuuguauccuuguaaugguugauacugucaacuugacaguauauagagucaccuaggagagaaaccucuaguccugcuguggggaaggacuuagauuagguuaagaugagaagacccacucccaucaugaguggcguccuucaguggacuggguccuggacuuaaaggcaaagcuuucagagcaccaacauucaucucucugcuuccugacuggaugugaugugaccagccaccacauagaccaccccggccauuacggacuguaccauuaaaaacugugggccacaauaaaccuuccuuccuuaaguggcuuuuugucaggcauuuugccacagucuugagaaaaggagccaacacagcauggaaaagguuaaugugaggauaagaugaguuguuauauaucauuacauaccaugugugcugucgugggagccuggauuagaaguccccucaaaagccccuguccacggauucgugggaggaaguuaagucauggggguguugcucuuggaagagauacugggaccuuggccuccugugagauagagaagcuggcccgaccaccuucccuuguccucccuguaauguucucugccaccccaggucaaaucccaccccagcauccaaggacuuggugccugugacuuucagaacugagagccaaaacaaaccauuugugugugugugugugugugugugugugugugugugcacgcgcgcgugcgugugcgcaugcauuguauguauaugcaugugcacauggagaccugaggucaauuccucuaucacccucgacguugauuuuugaaacaggaucucucacaugcuuagaacucacugauggcugagcugcccuggguauccuauuucuuccaaguacugggauuacaaggguacaccaccucacccuguuuuuaucuuauuaaauuaguucagagagucaaacucuggucuucauucuugacugguaaacgcuucgcaguugggcugucuucccagccccagccguccuucuuucugaguugauuuaucucacauauuugcaaagcucagugacaccgugugugcagaagcauggcagucccacagcauccugagcacacaccccacacacagagaaaagaaagauagaagaggaggagggaggggggagcagauuguagggugacaggcuuaaaggauugugggcuaacaggcuggaaggaaggagauguggaaccucacacaugaaaggggggaccaguguuuaucagcagaagggccugccucuucucuguaggccagcccacagagacugucuggauacagugcugcugaggagagaaccuuccccaggcacgcacuagccaguacugccuuugagaguuuauuugcgccccaggauuaaccugucuagcuuugaugggcgagcaggacauuccacacaguucuuggcaaggcuaagcugucaaguccgccacguuugucugccaucccuacagacucuucuuuccugaaagcacccuccucuuccuccuccucuucaucccccucuaccucugagaccaguaccagccuauucccauccagggcuucaaggcauugacuuucuagaagauuccauucaguugugcucagccaaggguggguuauacuauagaccaagacuucacauucccagugguaaccaguguccaggucccccagagaggaucucauuuugacaaguugcuccuggccuuuccccuggcccagcuguguuccuggccuuacuucuuaccuggagcaaguccaaggcuaucucaagccuguaucccagcaccuauucgccugaacgacaagcacucugcuagcucuuaucguugaacuuuuuuuuuuccucauguagcccaggccagcaucuaauucaucauguagccaaggaugguuuuggaugccugguccuccuacguccacuuccgcagugcuagaauuguaggcauguacuaccacgccugcuuuauuuauuccgugcuaaggauagagccagguuuucgugcaugcuaagcaagcccucuaccaacugagcuguguccccaggcccuuccuauguucuugaacacaucuggaacuaggcgugugaaauagcagugccuuccugcccuucuggcucucagggagcugagaucaagaaggagugugugggcgugaccaaaccucuguuaacugcugcagcuggggcuuuuagaaccacucuguauggccuuuguggccuccguuuuaugaccucauuucccuacgcaaacaucaguguuuacuuagugagauaucuccaaauccaaauacugauuacucuucaagaacucuguugagggaugagggcaaaaacucagagcucagcugggucuggugaacacaggcucuguagcaggccuggggaucugcagggcccaauguagauucaagugcaucugucaaaaugaauccaccagauaggacuagggcuggccaguagggauacagagcagcagaugucauccacagcucugauggaacaccagagugacagagggacaugccugaaaugcuuucuaguagcuuccauaauuucuucacuacaggcuccauucuccauuccagggaccucacccauucagccaaccucaccagaggccuggaucccugcagccauccuuucucuaaaaucugggucugcuaaauaucaaaaacaaguggcucagugaagccucacagagacagaucagccagcaugaccaaggcacucucgugcugugcccagccugaguguuaugggagagggucugagucccagggaauccacugaagcaucuaaguucuuguauuccagguuagacugggggcuagaaauacaaauagaguuuuuugagaaaguaaaggcauccuagagaaugagaauggguaagguucucaugccuguuacuaagauaaaguaguaugauggaagcaacuuggggggacaaaggauuuaucaggcuccagguuauaauucaucauugggggucagggaaagucaaggaguuaggaacuuaaagccacuggucauguuacaucugcagucagaagaagagaccaacaaaugcauccagacaggucaagaucccuugccuagggaaugaugccacccacaauagguggguguugacaaucagauacugcaaucaagacagguuccccaaagacaugaccacugaguggcucaaucuugauaauccuucacugaaaaauuucccaagugauucuagauugugucaaguugacaauuaaaaccaaccaccacaacuaguccuuagagauaagcccucaaagcacuggccaggagccacaugacccuuuguaggucauuuauguagcaccuaacucacacacauuuacauacugugagcuuuucuuguucuguguguuguaugaaguccaggcaaccaaguguuucuagucuuuuccuaccacuggcuuauuuuauauauuauuauugauguggauuuuuuuucuagucccauguacuucuuacuuccaguguagucgagugaccuuguacugaguccaaaaauggcacuggggaugagccaggacuuugggagccccaugucaccaucuuccugcccuaggucucucacuucucuguuaucuacaauuaugaauucuucauccccaauuuccaugccaauuucucuuugacacauaucccuaauaguguuauuggccuagaugagcauuuuauauauuauggcuacccguuucccuaaugguguauugcuuaguuuugcuuuguggcucuuucuauaaauaaugcaauugcagguauuuucuuggggaacuuggaucucaugcuuuauagucaguguuuuaucuucucugccuuuauuccuuccuucaucuguucauuguuauuagcucauucuuuccugcugcucuacagcaaucugaaucuccaggcaucuggggugcacuugugcccuucaucaugggggacuccuauguccuguccucugagcuccuugugugugguggguucuguaauucaccccaggggguugaaauuuccaauucacagggguuucacauucuugucauccaguaugcugagauuuuugcuccgugacuuugccaacggaagaucccacccauaggguugagcagcugagccacagcaggacagcacuggcuggggagauagcucagucaguaaguaugauucccagaacacacauauugaaaaggagaggaggaaacgcugggugugguagcacacccugguaaucccaggacuggagagguaaacacuaauggauccagcucccuggcgaaccugcugcccagucugugaguuccauaccagagagagacacugucucaaaacaucaagcuggaugaugccugaagaauaauaacugaggucauccucugguguacgcgcgcacacacaugcacacacgugcacacacauacacacacacacacacacacaugcacgcacaaacacacaugcacaugcacacuuuugauuuugagacaggaucucaaauuauagcucugacuggccuagaacucacuuuguuaacaggcuggucucagacucagggaucuuccugucucuaccucugccuccugagugcuguaauuaaaggaaugcaccaccaccauccuuagcaauauacacauuuaaaaaaaauguuucauucuuuucugggccaggaauauaguccagagaugaggaauugcuuagggcccaugaagagauggguccaguaucacccaaaacaaauaacaaaccugcugacuuucucaaaguacaauugcccugaguacauguuuuuuuuuaaauaugauuuuuggaauuuuccaauuagauguguagagaacauaaugaacaagcuugccaauaucgaguuuccuauacagaacaaagcaaagaaacccaacaaagccccgagcaacaaagggccaucaggaaggagguggaguuccugaugagccugcagggaaccuucugggugcugagauggccugccugcucuacaagaacagacacaggccugcccaccucagccgaggggaaaagagagagcccaagcuacaaggucugugaauacaguucccucccuggcaggucggugggcccagccuggggcagaaggagaacagaaaacuccauggagcuaguaaccacugacucccagcagcuuagccacggcacgggggcacggguuccccaguucugucauugcauugugauccugguggguggcaggcaucuuggggcugaagcaugcgguccagccuuccccagagccuaagggcuuggugugucaugccaagugguuucugcuauggggaaucagggaccguguaaucccgguggcggcagaaaaucacaaucuggagcccuguaagagcacaggauggaacauggaggguggcaccucccgccccucaagggcugaccccaccccuagacaggaucuuuaccaaccaaaaagugggggcuuaaaccaguggaaauguauucuuuccugauucuggcgauaggaagucacaggacagccucaccaggccuauggcaagacaagacugugcccuaguggcucacagagacgcuucucucucccucuucuagcuucugcugguggcuagcauuccucagcuuaggacugccucagugugaucucugccucgaggucacauggcccucucuguuugagccccguguuccuuuaggaccuuugaggacccugugaugacacuuagaccuggguacuuggaucauugcaaacgucacgcuuguccugucugccauguccuuuguugccuagauucaguugaccauagauuucaggaauuuaggcaaugucaccagcuuccuucauguauucuacaagcguuuuucuucacacccgauccacagaaucacugcugugguugcuuuuugcucaugaagagacaggcacaaagagggcacacaguuuucuuccaaccacacagcucagaguaaacugaacugagcugaaguggaacccaggucuuuugcuauuaugccugcuauucucacuggguguucaucauccaucuauccaucuauccaucaaacauucuucauccauccauccauccauccuucauccauccauccaucuuccauucauuugacauacuagaaugcucaaaccucuuagugggcauaggcuuagaacuuggcaagcagaccuagucgauaccugcuccugggccugucuacccaguggggagauaggagcauaucacuacuuguaguuccucccaagagagcccagucaucugcuaaacucaaacugaggaaggcuccgucuuccacggcagugccucacgagauaucugaccuugaccugggacugggggaggaaggacacuucuuuggcaaggggcuucugaugacagucuuaggagaggaagagagauagcugagaggauacagaugggaaggcaggagcuggggucagaguuguagccacaggucaccccagaagccagcccaggagauguguaagcugacagucaaaaaugucuggucuaaccuuucccaucuucagaggccccuaaaccaggcuagggaccaucaacucauaguguuacaacuuauugccauggcagugucucuuugggucucaguaauucugucugugagaugggacacaggcugcugccugacucuggccucaugguccugucucagcugcucaggucuggucuuucuacucucucccuucccugguuggagaucagggcccacccuggugcucaggccgagucugggugagucagcacgcuguucacuuucccagacaggcauugcuggguggggcucaggggccucaacccucccucccccugcuuucuuucccuccucucacuccauuaggaaggaacauguccauuccugccccagggcuguuccaugcuacaaagcccacgcccucccuucauguccccaucugugagagccuugcucauacucccagccggcaucacccucauagcuccccuccaggaagacauggcuccugucauucuagcuccccagggacccauuaccaaggcucugggcgugcuagcucaggcccggucuuggugcuagagugcacgugggauucucaucaccucaaccucuccuuuugucuccugccagaacuccugugcugacaugugagaagggggcaugaguuggggugucaggagggugagcggggugugcuccccugcugagcucuucaguucuccuguuguuauaugagaagggggagcgcuggcugagcaccuacuaaggacccaguacaguuacuccacacacuucucguacauccuucugucuacaccuguucauccaucuacucucucaccagccagcaggugaaggaugcguggcucuaccaggucacacacgagucccaacacugagacuuagucucagucuaccccaucugucuaacuucaaaguucaaacuccaccuacaauauguagggugagcuggagaccaacugagugaugccccagagggaccaccaggccgaguuucuggggagggcaccagugaggauuugucgaggggaaguuuguaccuuagugaacugaaaauaucagcauguccaauuugaccucuugagagcagaggcuggcuuucuuucauucuggcucuuggguaaggcccgugacauucuuauacauauuugagggaaggugugcauggguacauguuugagugugugcaaaugucuaugcauguguguacacagacauauggaggccagagaaucacucuuccuuacuuuuugaaccuggagucccccauucagcuagcccaugagcccuccucucucugccucuccacugcuaggacuuuaggugcacacuguuaugccuagcauuuuucauggaugcugucaaccuaaacuccuccucaugccugcacagucagcgcugcccaccaagauauccugucuucagcccacuucuccacuuucaacucuaucccacuucauccuuggcgucuuuuucaauuccccaaccucccacagcacaggugcacaugagcauacucucauacucccaggcuaugaucaaguagcugacauagcuggcccuucuuguugucuucuuccccugguccaacccaaagcucuucugagcuugauccucuaagaguuuagaaguggauagauagcaugugucuugauuugacucccagggccagauccagccccguacccacaaucuaguacccucccaaauugaguucuaauuucagcauucccagaaaaaucuucagggcuacucauugcccccauggcuccagggcccagauacuacuguugugggcccaaucugccaacuaucuggcaugagggaagaguaaagacuuguuccccaggcuuuuggucaaaucuguuaucagggaauggccaaucaccccacuguacccugguaaaccuguuuggagaagcugucauagcuucucugugugccuuacucauggccaccagcagacugaaaguccucaaggucuguucucuaauagaguugagcagccccagagacuggaacaccauccagugugcaagcucugguucggcacacucccaguuaccucccagcugugggcaugaggcaagaaagcauucccccaccccuucucuggacccuuggggcuacuuguuguacaggaguugguagcaaugcaucuuccuugaugaccaccauaacaagguguccagggcccugcagggagcuucuguguguuccacagagcuuggggcugagagaaggaaggcagugccugggcagaaaccccuguucccuguuuccuuggugauggaggcagucucuggggaagggaagcagcaugccucuuccccuacagggcaucaccuacucucugaaaacagccucuuccucugugugggacacagacaccacccugagcacucuccuucccuuacagaguggcccuauuuuugagugcaugucaaaauaccucaacaauauguacuccugacuccugccccagaguccagagggaucuggguuacaucagacagccuaccugggacugcuggguggucucagccuggugguagacaucuucaugucaucacugacugucuugggguccuagcuaagcuagaccacacugccagcucaaugccaaggaggccccauuccuggguuuggggccacuuacagccaccaguuucuguauucuugucauuucugucgcugugauaaaauacacugacaaaaggcaccuuggagaaggguacagcaaccaaaagcagcugguuacaucacagcuacagucaagagcacagagagaauaaauucaugcaugcaugcuuucuugcaucuagccuggucucuauauuaugucaaaauacagccagaaauucucacuugaagaaugguccugcucacaguggguuagguauuuucacaucaacuagcaaccaagguaugcccacagaccagccuggacuagauggccccucacugagauuuuucuccugaaugaugcuagcuugugucaaauuaacaaugaaaacuaagagucuucaaaccccagccugcugcccaucacacaccaaccuuccccugcagggcacucagcuuccaaacacuccauuagccucucaggcucugccugagucuccucuucccaaaaaugccugugugcagcaggaacaugaauguccauccugucauagucacagcgagagccacuuggccugacauccaucagccagcccugcuucuccucccuugggacacacagcaaccucuucacagcaaggccacaaucaagccucaaaguagugcaguuccccauggguggauccccuccguagcuggcuugagcaugacagcaguucaaagugacuugugacaucugccauaggcgcuccucugcccaugaacuuguaguccacuggggaaaaugccucgguacaccuucagaacucucuuccugggcagcuaugcauguucaaaggugccuggauaugcaaugcuacugggcagaaccgggucucuaagauaccaaccuaagacccuacuggaauucuuugguaggggugcaaaauacauuugugaaggagcuucaggaagggaguuaccccgggggcccgggggucccucaguguccagguuucagauacaagaagggauuugcaugagauagaaaaugcaggaaggaaggcaucucgggcuguggaaaaaccacaagggcugcuugaggcuagauaagcucauugggcuugcaagaccaaggcuccaacaucacagaugguaaagagugauauaguugaaagcuuccuucuggaucaauggauugauauuuguaaagcucagaugugagucaccugccugucacaccuugugcuauguugugaagcaggcuaguuuucaugcacaguuggacaccgaaucaucacgucugauuuucucaguaaccacacuguccacuguaguagccgaucagaauggaaccccacacagcuucaccaaucuggggcgcugcuguggugccucuccaggcuucacacucuacuucuaacuuauacuguggcucaugcauacuuuggaugagggucauuguccuaguuucauuuccuauugcugugaugauacuucaacaaaaagcaauaagggagaaggaguugauuuuaacucauagauuccagguuacuguccauuguugugaagaagucaugacacaaacuugaaauagucccaucauaccaucacucccagacucaaaagcauagagaaauaaaugcacauaugcuuacuugaauggcuuuuuuucuucucuugcucagcucaauuugaccacauucacacaguuuaggacugccuagggaauggugccacccagagcagacuuuuuuuuuucuacaccaauuaagacaaucaguccccccaaagaguugcccauaggucagccuacuguagacaauaccucauuaagacucucuucccagcugauucuaaguuauaccaaauugacaauuaaaaugaaucacaguuggugaggauggauuuuggaguaggugucuccaaaaccuggaggcccuaggucagguggccaaggguucuaaaagacucauuaaauguugaguagagucauagccuccaaugcauauagaugauugcagucaucccaagcaaugaaaaccaagccaagugcccacgugacuggugaggguauucaagacaggggacugugaauggaaagcaucaccacacagagagcuagaacaauauucuguauuuuaguucagcucaccagcuugaacaccauucuugggcaguugcaguaacucaguugguaaaguuuuugcuuuccaaggcaguaagacucacccucagaacccacauaaaagaucugagcauggugccaugguaugugcuuacaaucccaaaccuauggagacagagacagguggaucacaggcucacuagcuagcuagccuagccucuuuggguuccacgucggugacagacaugauauuuaaaauagaauucaaaaagccaacaagggagauggaucgcaucugagaaccaacagcugagauugaccuucggucucuaacguauauguauguguacacaugcuacaccucacaaagaaagauuuaucuugaaucuugaacuuuuccuucagcugcuuccgaauccuaguggucugacugaagccgaacaucuacccuuuucuucagcuuuucacucagucugauagcaaugagcucuuaggaccuuauuccuggauuuaguguggccaacguccuauguacuguccauguucugguauucaugcaugugcccaugcauuaaccuguauaggcacacgggagcagggcugcaacccaaacauguggucagcugagcucaggcccagcaaaccugaaggagguauccagaguuucaauacaaggauucuugugauacagguucacuacgcagccuucuuucugugggugugaacaaauaauggaggccagagcacagcuucuaagugucacuccucaggugccguccaguuuuuguugucucuauuguccuugaacuuugccaagcagcuagacuagcuagccagugugcucugccugucucuuucuccaucucaauguggcuggaguuacacgcccauagcaaccucucccuguucuuaccgucaccuccggggguggaacucagauccucgggcuuccgaggcagacacuuuacccacuaagccaucucucaaaccccuuggagcuuccagucuggguccacugacugauucuuucaaggucugacucuaagcuagagcugacaaggaguuuggcauagaaaauuaaaauggcaagcuucugaaugaagucugugggugccugcacacgucaauggcuacucgugguuugggguucuuagugagguauuugugccccgugggucuucucucugagaaugucaccuuuugccuccacaggccucccacccuaaguggcagcccugucaucucagauaucuccuugauacgacuuucuccacacccugcuggcccuggagagucacccuucagcgcccaccaccccuacgugaacccccauauggagcacuaccuccggucugugcacagcagccccacacucucaaugaucucugccgccaggggccucagcccugcugaugguaaguagugcuggagcagaggcagcggggacauuggggguggugcuaggggugacucaguccucacagccacuuucaucaucuuccaauuacacgucaaauuaaauuuucaucaauagauauaucuguugguuaggucaaagcccucaugauccagucaguuccccagagcaccaccucuguacauugcaucggggacccaagcuuuuaacacaugagccacugagagauguuucauauccagaccauagcagccacaucauagggacagacugcugcuugcaacacgccaaaggcugcggaagccaguguuaaguaagagauugugugggaauaucuccuugaagucagcaucaaaagggaggcagagcagagcuggcugcugccugagucuguuuucugucccugugauggucaacacagauggccucucaagucccaggaauccccuggagguggaguuacaggcagcuggcaccccaucccccagagauagaccaauaacuuugaguaggcucagaugcuugagaaagaguggaccagcccacuggagcagguugauuugaaccagaagugaguagaaucacauaacauaguuacuuucucagaucuaaauuuuuccuaggggcugaagagacaggucaguugguagguauaaaaucaguccuccagaacccaggauuuuuaaaaagaaaguaaucaauaaacagggcccaguggcaagcagucggaaucccagcauugaggaggcagggccugagguucacuugucagccagucugguggaaucagugaggucccuguucaaggagaggcccugucucaaagacaguggggagcaacugaagaaggcacccaggguugaucucuggucuccacgugagcauaggaggugacggaugggcuaggaggucaagcguugagaccccagaccaaagauaaauuauuuuuccuuccuuaaacaguaauuuuuuuacaagauucuauuuauauauuuucauuuuaugugggugugcaugcauauuuacauagguuccccuagaagccagaaacaaguauuggacccacuggagcuggaguuaggggugguagggagccacccagcaugggagcugggaagugaacacgggcucucuacaguagugguaugugcucuuagcugcugagccaccccuuggacaguagauucugauggcuccuuucucuugccuccugugacaguggcccacgaacaucugaaagagaggggacucuuuagccucgcagccccaggcaccaacccuucagacuauuaccaccagaugacccucauggcaagccaccccaccccuuauggggaccuucuaaugcagagcgggggugcugcuagcgcaccccaucuccaugacuaccucaacccuguggauggugaguaccagagggugcaacauggggugaggggcagggaugaugugaaugagggugacugacugccggucauagaaaacaggucugcccucccuuuggaggugagagacacaaacagaagucugcacuucgucccaguacugucuauacuaccagacauggggacugagcccaaguacuaggauggguggccaagagaccuguggucaucacaaaggaugggaugcacucacuuaacuuuugggaaggaucuauagugggagguacagacaccacccaccacuggggguugguaagcuaagagggaaugggguaagcaaaauagggauggagacgcauacuaggguagcgggaugcaguuuugagacauagagagucaagguaucccucacuaaggugugguggaugcuauuccugcacagaacugaagggccaacccaccaacuggcuuggugaagagcagucccagcagaggaccugcaggugcaaaggaccuguguuccuacugggagcccaguaugaucugagcuugagagaccagugugaucagcaguaaucaggugaaagacaggaguccuaacuggggucaguguuccaggccgggcugugccaacaaguugggacuugacuaaggcuuugcacguugcuggagugagaugaggcuguggaaccauuuuggggaggaugugcagagaaggaaagagcucugauguuccauuugaaaguaucuuguucaugcuggucugagaacccagucggagcggcgagcagcaguagaccccauuggugagcuguagauuaauccaguuaagggggaugccuggguagagauguaugacacguucccagcacagguguggugugcacgaaaggaggaggccauuacuuagugugcucuuggcuaugaccaaguaucuaaccucucacuggcccccguaaacaaauccugaugaaagcagcuuaggcaggcuuguuggguguggcucacacuuuaaggagauccuguccaucaucguggagaugauggccggagugugugacauccauagucacgaagcagagacaggccaugcucuccuuuguauucagucugggaccccagcacauagaauagcccacguucagggugggucuuuucaccucagucagcacauucuagaaaauccuccacacaugugucuccuagauaaugaucucuccaaguuaacaauuguuauaaaccaucauaaagagucaagggcaaagccaggaucgaggguccaagugauagggugggcuucacugaucaaggcggugcaugugcuagacugcuuugcagaauaggagguugggagucuuggaucgaggagguccuaagugcccaucagaugccaagcccuaucuucucacuagaauccaugcugcuuucacggggugucuuagcccccugacuaugagauccugggucagcauacaaccccugucaugagaaggaaacugaagcucggugcuguugcccgccccccuccaacuagauuccacucuaccuggcaacccuagagcuguccaaggaugccugguaugugggcugaguagaggcguggggaaccaccaccaaacucuaggcuggugccgccuccuggcugcugucuucuaguccugccgggagcagcaucuucaugccacaguggugggaggagacagaccugcagagaggccaucugguccugcaggguagcagguuggaaacgggcuguggcagcuguuaagaggccgccgagggugcaagauucagggugggcccauaucauccaggcuucgucucacaucauaggccccauuccuggguuuccugccacaaccgccacugcagcuccccucaggggccuugcuccaguugagcuaucucuccacagaggcagaaccaagagugcuccuucuccaggaacucugucuagaugcuuccugccuccucugguugcuccugccucucugaguuuuaaagaaccaccccaccacaaacgcaaggucaaguugcucugcucaucccugccauucccugauaggaggcuucugagugacaaagcaguguccccaacacucagcugagugucucucccucccuaggaggaugcuggguccaggauucggcacagcaugguauuaagucccauccuugccucugacacagugagaugagggacuagggagggugcauccuggacacgguguuucccagcgucguaaacccagucacaacuacacagcaggagaggaauaacgagauccagagcagagucacgcccacaugccagcuucugccauucugggaagcccuccuccaaggcucagaaccagaugguggacaucacuggcaaguagacagacuuguugaugccauggcuaggggaccaaguugagcagguggcccacacaucaggagaagcagaacugggcagacaggaguuauccugugacagccauccugagugccugacuggguaugcaucuccaugcagugccaugcaugugacagagagaggaaugacagugagcauuucuccuauggcuggaguuaggacgagcaaacaaguccccaggccucuaggcgggguuccaaaccuuacucuagcaaggccauaccauccauugccaguaccugagcucuacccuccagaaggcggcuaggcugcugggucuggauccggcagagagcagcagggcaggaugcaaagggggccaguaugaaaacuagugaggggacaccagagaggacagugagugggacacagggaaugugaagcugacugaaggagaauguaguaaagguagaaugaagguaaauguugucuacuuaauguauagacugggugcucaauuagugcuggugugaccucucacugccaguauccgucucagauccgcccugaucacuggggauccauaucuuaguuguaucaccucaugcuuccucccaggccauggaccacucugggcaucauguccucuucguguucccauccauugucccugggcaugcuguguguggcuuguccccucucucccucgcacuguuguuaccaguauggcagcaauaacaaaccaggcucagcagcccauccucagugggccaguuaaauggagcagaaguagugaaaagugugugugugugugggggggggggggggugccuauucauuguggccacacaggaaagaggaacagagagcuuuauguuuacguuuacauggagagcaagaggcacacauggcuaagcaggccugaucaagguguggucuagccaucaaaugcucccugcaaaguggucuggcaaguuaucacaacugugggaaaucucuuuggaagacaagcucccccucccccuccagcagcaccagguuucaucccuguccuucucccagcaugagucuacugggggaaguuccauuucauuuauuuauuuauuuauuuauuuauuuauuuauuuauuuauuuauuuauuuauuuauuuauaguccgucgucaguuaaccaaugggauggacacagguguuucuguagaaugucuucuucucggcagccucauugcuggcucccagagcagauccccugaugcuuccugcucugccugucugcugcucugccaugccugagggcuugagggcugugcagcaccaaaggcaucauggacaucaaggccugggcaccugaggcaccaugggaauuccaggcacccaauucuagccgaccgggauuucuuucaccuaagacagucaguucugcugcuacagcagguggcucacagccuguaagaccugaugugucaggaguggccaacacagaagaccagggagagaaaggugcagcacaaaacagaaaccacuggaauggacaagggagcugcuggcagcuacgaguggccuagaagggacuggggacagcuccguuccccagaacauucaacauugacugcaccugucuaagaaacaggaaggccccgggcaagaggaguccaugggucgguggauaacuuaacacagccaccuccucucuccacuucuauauucagaucagcagauucccacacaccugagcagcacugggauggcaggcagugacgggggacggcugggggcugguuuuauaaacccaagaaacccauaccaauccauagcagucuucuauuucuccuguuggugcuucucagcagaacuuuuccaggcagacucgcuguucgguuucucucucagguuggaaccuagagucucucacacgcuaugugugauuacuuaaccacugagcuaggcccagacuuuucuuucuuuuuucuuaaauucuacauuuuauuuauuuauugugcuuguguaagcugcaugccacagugcucguaugggaauugguuuucuccuuacaccaugugggacuggggaauggaacucaggucaucacacuuggcagcaccaccaucaccaccaucaccaccaucaccaccaucaccaccaucaccaccaucaccaccaucagccaucucagaucuagcccagcucuuuucaaaccaguggaaggcagagcuucagacuuggcuucagauuuuuuuuuguauuaaauuuuccauuuauuguucaucauaucauugucuuucuuguauuuuugucuaguagcugugccaguuuuccuaauagaacuauuauuggacaugugguuucuuacuguuuuucaaaggcuuacuauuuuuuggccucagauuuuuaaaaguauuugggggcauuuccacccaauuuagguaccugugcagauaccccaucugcuguguuucugcaaaagaugcuaaaugcuaaauaaggcugggcccugcccaaucugccuccagggcauugccccuuccuccuucugcacuuacguugagcacgugagccagggaagccccugccaacugcugcauuuucugcagcccacucccauaggaugauucaguccccucauggaaaacuuagauuuuuuuuuuuuuuaccacguucccuuuugcucaauacucugacagaagaaauggugcacacucauucacuaccugcuugcucagcaugcgucccaguuaggcuucacuguugcugugauaaagcgcugaucaaaaccaacuuguuggagacgggauuuauuucacguuacaauguccaggggacaguccaucacugaaggaagccaggguuggagccaaggcaggauccugguggcaagaacugaagcagaggccacggggacacugcaggcugacuugcuccccauggcuuacucaguuggcuuuuuuguacaacccaggaccaccugccaaggguugccaccacccacagugauccaggccuucccccgcaucaaccaucaaucaagaaaaugcugccacagacuugccuacagccaagcuggugaagacaaucgcacaauugaggugucuucuucccacaucuucccagaugagucuaguuugugucaaguucacaacacaaacacacacacacacacacacacacacacacacacacacacacacacaaguaaacauuccaagccaauucuaggcacuaagcaagaggcugaacaccacaucaaguucucagucugucuggccaggcaccaggcaucuuuuugguaagcaccccgaugcagguccugaccugaccucugacugccuucuuucucagcaccuaccuucaugucuugagacagggacacccagcagagaugagaauguuucaaagucuuuguguguccaauagaggcacagagguaggaucuuucaaaugggagguggccugagcagaaggcuggugggcaaggcccucguauccuucuccaacucaaugacaucguuuuacgugagucaaggacccagugcacaauagugcauguaguauucauaacuggcuucacuuugaggauuaaaagaauacuucuuaaaaggugucuaaggguuuuacuaccguugaagagacaccaugaccaaggcaacucuuuuuuuuuuuuuuuuuuuuuuuuugguuuuuugguuuuuugggacaggguuucucuguguagcccuggcuguccuagaacucacuuugaagaccaggcuggcuucgaacucagaaaucugccugccucugccucugccucccaaguguugggauuaaaggcaugcgccaccacgcucagacgaccaaggcagcucuuauaaggacauuuaauuggggcuggcuuacagguucagaguauacuccauuaaccucaaugugggaguguucaggcaggcaugguauaggaggaguugagaguucuaccuccucaucugaaggcugcuaggagaagaccacuuccaggcagcuaggacgagggucucaaagccuaugcccacagugucacaccuauuccaacaaggccacaccuccuaauaguaccacucccugggccacgcacauaaaaaccaucacaaaauggaacuuuuuuaaagauagggacucauguaauuaaggcuagacuugaacuuacuauguagcugaggaugaccuuggauuucugauccuucugacucuacuucucaagugcuaaaauuauaggccugcaccguuauggagacuuauguguugcuggguuuggaggccagggcuucauacaugauagacucuaccaaguggcuauauccccaucccuagaacuuuccuuuuucuucccaaaggggcaaacuuaaccguaacagaaggggaugucucugagaaccacaagaauaucucgugaacuuuguguacaccccacaugugggacacauuagaugggucagaaagacagcaaggccucugacagguccauacaccaaugccaccauccacccugguccaaaaggaggcugaccugaggcucugauacaggcucaccucucccuccauguccuuucuucuucucuugacugauuuuucaucaggaagaccagaagcugagccaugaaaaagaaaacagaaccagucagaaacccaaggucauccacuccucugcugguggcucuguggagagcgaggaguucacugcucgucaccagucccuagcaagggacauucucgagcuaggcuguugacgcuggcaguguaacugcagggcccaagcacagccuacccccaccccccaucccuccugagaagauugaaauguccugauugaaguacugucugcucacagcccuauaacuccucccagcuguguguuuuauugucauauugacacuaaugugccucggaugucaccuccauccugaugcucauucuuuaugcagggcggggaggcucagaaaccgauggcauugaucucacaggggagaggcagacauugcuggggucucaggggacugcuucaggcaggaauccaggcccagccuggcacagaggggagacugaggcugaggagaacaaccgugggucccacagacugcugagcacaggcugggaaugagcuggggaagagaggcccuuuggugaauuugaguugaccaggauacgauucuacuuacucaguuggggaacucaaagcccaggccuuggcuuucucugcccucgggacaugacugaaaaauggggccacuagccucuaaguccccagcuccguggccucgccauggaggcuccguggaguuuagauggguaaaauacuugggcugaauuccucagaacacaucuugagagugaguguagaaaagaccugggccaacugcaguggauuauaccuguaaucucagcacugggaagguguuaaguggaagagucaggaguucaaggccacccuucgcuauaccacguccugucucaaaaaaguaaaagaaaaaacaguggggugagaugaggaagauuuggccaguuccuaaagggcuugaccuggaaagcaugaggauaggaguucaaauccccagaauccacguggaaagcagcaggguggcccgcaccugucaucccagugguggaaggauggaaggcagauacaccaggaucccuguaagcuuggaggcuagccagccuagcugaaucagugugcccaggccagagaggccugggaggacggaggggaaggguggggggaggggaggggaggggaggggaggggaggggaggggaggggaggagaaagagaacuaauagaugagacagagucagagauauguaggaggaacaggccacaucaggcauccucugagggacgauaggcaaguggcuggucacucgcuggccaguguuaggacaggcagcaaccacagauggauggcggcugugaaugcucgaguccccaaacauaaaucacaggaaaagcacaggaaaugagugccaggcuuuucuuccuauuuagugauuuaucaagggaagaggcgcguuaauaaacacauuucccucgagggccaggaauaacggagaugaauacuacugucaguuugagccugcuuccucuuguuaggggcacccgagagggugggagucagaauguuagcagcagaaucucuuucugaaaaauauaugacgaugggcuguggugauagcucacucaagaaagugcuugccuugcaagccuggggcccuggguucccuaggaucgcuggggaaaaaauggugugcuagggcacccacugaggagguggagacucgugaauccccaagacucagcggccacccagccuagcuuccuuggugaguucuaucugaguaagagacccugucuaaacaagaagguggacgguuccugaggaacggcaccugagaaugucuucuggccucuacgugggcaugcaugcacacaaacagacacauaaacacacauacccaaagaaaauauguauacggaaggcauggauaagucauacuuuaguggaugcuagagucuucgugucccccucauuucauaacacggagucuguaggaggaccccaugagauaaggauuaucuagacaugaaauugaggugucagagagcgcccagauggaggccuguugggcaaagugcuguaggucacuauucuaggaucagucaucuuuucuagacuuugggccuuuccuuuucccuaaacuucagguccacucugcccauccguaucccucaaagaagcccugggaauuagacagcucacacagacauguggacaaggucauaggcaccacccucagaacucuguaugacuucacagcaagugugcacaauacggcauguugccuagauuggagggaagcuggggaugucuguaugauguccugcucagcauuugggcaggaccaggacuucuuacaggcagcaucugcagccaacacauaauauaugaaggcccggagguuccagagggaggccagaaagucagggcaaccauugcuccuuguagauuucuagaaggcaaagacacaucucagcauucaccuuaauuugcuacgguucaggccacucgucaucuaacuuuacaccuuauggcagcccugaagggugcugcuaccauaagaccccugcuguaaagugugagcugaggcagugaagaagcaauagggacuacagucaucuagugaugucagaccacuucuaggacacuuugucuaaaggagagauccagaauuccugggaggguggggggugaugaugauggggaaaagaacagugugugugugugugugugugugugugugugugugugugugugugugugugaauuaggguuuucuagagucacagaacuuaugggaugucucuauauugagagauugagggaauuuauugugaugacuuacagucuguaguccaacuaacccagcaaugggcagcugugguugggaaguucaaggaucucguaguggcucaggccuaugaggcuaauuguuugagcuggucuucuguagaaguagguuccaacagaugugcuggcaaguaagugcaagcagucgaagagugaaucuuccuucuuccaaugaccuuaccuuccagcagaagguguggcccaaauuaaaaguguauuucaccaugccuggauuugggauuugcuuugucccaggcugaccuugaacgcagagaucuccuugccuuagucuccugggauuaaagggcguguacuaccuugccugggccuaaacucucuauggccacugugccuugagaucuccaugccaagauccaggucagaaaccuguguccuccagccucaagaucuggaucacaggugagcccuccaauucuggauuguaguucauuccagauauagucaaguugacaaccaugaauagccauuauaguacauaugugcgugugccuacaugcagggcuauaugcaugcauauccaugagguguacacauuuaagacaacacauuuccaccauucaguagcccagaacuuagggucuccaagcgugagcacaucugugugucacauggccucucccugcugcuccucuuuugccucccuggucucucaugguagacuucucaguagggucugcggagcagccagucuacaauguggaauaggagggcucaccugugauccagaucuugaggcugggagacacaaguuucugaucuggaucuugccauggagaucucaaggcacaguggccauggagaguuuaggcccaggcaagguaguacacaccuuuaaucccaggagacuaagaagucucagccaggagcccagcaucacacaaagcucugcuuaguaaguuucuaucaggggguucagaugugaaccccccuggggggguguuucuggugugaccaccguugcaacaaagcucaugguccugugacuuguaacccuguucagucugcuccucgugagauucucuucaauuauggaaagggcccaucaccaccaccaccaccaccaccaccacgccauggcauggagaaaucaugaauauucaugauguguagaggguggagaaucugugauacuaacaagccuuccguuggcugucucccagcaucacgauucucuaguccacgugugaccccacgacugagccgcaagcgggcucuguccaucuccccgcucucagaugccagccucgaccuacaacgcaugauucggaccucucccaacucgcugguagcuuacaucaacaacuccaggagcagcucagcagccaguggcucuuauggacaucugucugcuggugcccucaggugagccccaauaguaagcagugggcugagaacggggagccgggucuggggccauguugcaggguggaacuuuacacuggagaauacagaacuuaauacuagugucucaacaugcuagcaacuguauugguaguucaaaagcaauaaugaggguggggauguggcucuuugguacaguccuugacugggaugcacagaguucugugauccauucccagcauuguauaaaaucaggcauggugacaaauuccagucaucauagcaccuagugagucugaggacagccugggauacaugagagucguucuguaaagaacaacaacaaagccaucgugacacagggaguucacacucacaccaacaccagaguacauccuuauguaguaagucugccaccaggggcuccgucaugaugucagagguaaccaaggucaaaaguggccuccuuggaagcuggggagacaaugugguagguagaaacacuaggcaugugaguagaaagaccugaguuugaauccucagaacuccugucaauggccaggcauagcacaaguauccagagcccagcacuucuuugggcagaaggagguggagacaggagaguccugcaagcucaagguugcauucaaggagcuagguaugaucagcaaggcuaaggacauccguuugcaaggcauguuuaccaucuugaaccucagaauacaguccucucugccaaggauauuggcuuggcagugaacccacuccuuccccuauccucuccuguucuccauugcagcccagccuucacuuuuccccaccccaucaauccuguggccuaccagcagauccugagccagcagcggggccugggcucagccuuuggacacacaccaccccugauccagccuucacccaccuucuuggcccagcagcccaugacucucaccuccaucagcaccaugccuacccaacucagcagcaguagcagcaacugucuaaaugaugccaaccagguaggugggugcaggaaacugggguggguccucacugcucaccccguccccaagggcgguucaugcuaggaacugguagagaucucugcacuuuagccugacugguugguugcuuuuaggacagagaucacaugauggcaagggccuuaaacugggccagaagcccuggccugggcccaugguaagcuccuagucacucaguucugucuucuguccaaauaacuaaaagggauggagaaacccucucaugcaggggugcugcauggagacacacuacauacaucaugggaaacaaggugccuucccuuuccccuaccccucaccccacaucccccaccccccacuccugucuuggcuggcccugguuggaggaccaaucuaagagacucaguuuuugauguuucaaacuacagaagggaggaaaugcuagggagauaauaagucaguggcugacgagcugcuuugcaaacaugagaaccugaguuugacucccagcauccauauucaaaaagccaggcauugccaggcaguggggacacacgccuuuaaucccagcacucaaaaggcagaggcaggcccaauuucugagugcaaggccagccuggucuacauaguaaguuccagagcagccagggcuacacagaaagacccugucucagaaauaaggaaguaaaaaaagaaagaaaauccaggcguguuggugcaugcuuguaauaguggcucugaggagguggagacagguggaucucugggcuuacaggucagccagcuuagccuaacuguuagccuaagucccaggucccaguaaaagacccucaaaaagacaaaauggaugcugacuaaggaacacacuugagaggaaccucuuaucucuacguacgugcaugcacauacacacagauauacaguguacuccacacauaugagcauacauguauauguuuacacauacacauaaauggugaucuaugugaguaaacuguagagccacagcccauggaauuuggggguccucugucuugugccuaugugacagacuguccucugccgucucccucagaacaagcagaacagcgagucagcugugagcagcaccgugaaccccaucaccauucauaagcggagcaaggucaagacugaggcugagggccugcguccagcauccccgcuuggacugacacagguaaccugcugcucacugccacuguccuuaggcugggaccaggcuggaucuccugguuuggcuguugagcuccuagugguuaauggaugggggagaaggaagcaguggauggauggaugaauggaugcaugccuucauacaaggauggauagguagauggauggauggauggauggauggauggauggauggaugggugauggauggauggauggaaaauggaauggguaaguggauugauggccaucugcagaacuuagagaguuagugugggggagcucacagauguccugcacaguuccucucgccucagcauauaucauuuuuaucuaauauaaaugaguaaaugaaugaacaaaugaucuacccuuccaucuuacuauauguaugacugaauuaaugaaugaauacuaacguuuucuucccuuccacuuccuucagacuucaacuaucuacacauacagccucagccuugagucugagcuccucacguuccccuaaguggcucugguucucaaggcugcccccucuccuggagcccacugcucacacuagauccuuuagugcuggugcuccuggguaacuuaaaugccggcugcugggucacuucaggugggaaggauaacuccugguagugagggagccagcaugacugggcccagccucuauggaggggcccuuggaaguccuacuacucacucuguuccuaggaggacacacaggccauugcuacccucauugucaugcaggguucuggcauucaaaaggcuuagccgcugcugaccuugacuuuaaaccucugagcccuaugcccucacaguggcauagucuccaucuguuaguccacaaugcacagucaccaaggauacucaagccucccucuggucccuggcucccagcaucugcuggucuauccuuuaucaagacuguaaaccaucaggcaugcucuaggcacuuaauuuucaugaaauauuagguccucuuauugucaggcaaacagagggguugaugacaaauuccucuccccucacugacaccggcacuagucagaacaugaugcauaguuuccacgaggcuggccaucacggggaggggugugugcugaaauugaugaggacagcacauauccaggaagauaaacaugcagaaauguugaggacagggaggggcaccacggugggugcuugcuaaguaccuuggagucucaccauccauggguggggccucauuacugcccuaugcucuaggaaagccacccagaggccuucuucuugccugugcccacagcacuuaggaaggaaaggagggagggaaggaggagagagaaagagagagagagagagagagagagagagagagagagagagagagagagagagaacuuuugcaaggggcugggaagaugauccagucaguaaagugcuugccauacaagugugaggaccugaguucgaaucccuagcaucauguaaaaagcuggauccagggacauguaccuauaaucucagagcuguggcagagacagguggaucccugggccuuguuggucaaccagucuaaccgcgucagcaaguucuggcauuuguacaugccacuaaucccagcacuugggaggcugaggcaggcagauuucugaguucaaggccagccuggucuacagagugaguuccaggacagccagggcuacacagagaaacccugucucaacaaacaaacaaacaaacaaaaacaaaguagguagugaagagugauagcuaaggcuguccucuggcccucaauucauguacaacaguguaccugaaaacacacacacacacacacacacacacacacacacacacacuugcauaagaacaguuucguauaagugcauaaggcauuucaagcauauucuccccauagccuaguucccucuacccucacuaucaccccaccccacccucaccccuagccccucccccacuccccuugauggccuuguuacucucaugucaccugugcagauaggguucuaugcaccuauaaagucaaggucucacaggugagagacagaaugcaguauuugucuuucugagaucgauuaauuaauuuucuuacugugauuaguuugucacauucauccaacaugauacuagaugaaacuauaaucaggaagacaaggguguccgcuuuccccacacuuguucaacacagugcuuaguuucagucagcacaugagauuauggcagggggaacacaugagauacaaauagcaagggaaggagucagaacacccuuauuugcagaugacauggaugagacccuaaagacuccacuggaaaacucucuaaguugaaaaccacuugcagcaaaaugacagaauacagaaugagcacacagaagucagucacguuccuguguaccaguaacaugcagagaaacuaugaaagcaaacugggcauggugguacauuccugggaucccagcccugaaggaggaggcaggaggacuggggacuaaggccagccuuggcagcauaguauugccaggcuggcgcucugugagucccucucucagauaagugagggaugggagcccggggaggcaguccacucacaggcacugcagaaggccuucccucagagucggguccaugucgucccaugugugguucacuugccucccuuuggcagaaaggauagagguaauggugcuuucugcugaagcccucaaauugcagacugggaggauccuugccuuggccuuggggcagcccacugcuaggccagcuggccugcaguguauguguaggggagauaaucccagauguucuucuguugcacugugggcacuaggagaccucucuacauucucaucucaacagccgcuggcugcuggaaacccggaagugagguguuccgacugaccucagugcagagguugcuuacgucgacauaguagcagcauuguucucugcacagccagggcgcuuguucagagggucccugauggugaacccggggucccuuuuggaaaagguuguagcaauaucagagaguuccugugucuguggcccaccaugggaaauguugucguucugagaugagcuugcuguucacgagugaccaugccaguggacacuccgguccuuaaccuggcaaagagccugucccuguuagccagcacuguccuuguuucccugaagcucuuccuugugucuauuuuccuguuuugcagcacaggggauuaaaccugguaucuuauguguguuaggcaaauguucuugaucuaaagccacaacccaggagagucaggauacauuccugcuguuuuuaaaaauaaguugaacauggccagguggcauaugccuuuaaucccagccugauguauacagugaggugcgugauacccaguuauacagagaaacugucucaaaaaacuuaaaaaaaaaaaaaaagcgaggguuggggggggagcugucuuuguaacauugcuucuggccuuacuuugccucccaggaugccugggagaccuguuaaacacuggauugaucucacuagacuucaugggcccucccuggaccuugccucccagccuggagaauguaucccuggucaugacccccauuccagacagguccacugugacaugaggcuguuucucuaaguuucaucuuugaaauagccucauaacacuaauguagucaaacgagugcuccauuuccaugacaucacucugaccaacagcaaguaggaaagaaagggguuuguugccuuacacguccaaguuagguccaucccugaggcaagccaagacaggaacucaaggcagaagccacggagggcauugccugcugguucacgcucagcuagcuuuucuauggggcauggugccacccgcagguccugcugcaucaauuaacaaucaagacaaucccccaaacuggcccacaggccauuccaaucuagacagucccuccguugagggucccuuaauaggaacggagacacaaguccauaucuaagcuacuccaguccccauaucggccauggagaggagaagccacaucuccuugagcuucagauucccuagcugugauacaagagugaagaagggcugaggcagggaagggugccuaagggucuaaggggugugcguuuucucugcagagcacuuggcagaugcuggcacugugcugaugugagccgagugcccauagugcacuugagaaagaagaaacaguaugacaaaaaauauuuagaaggaaaaggacuuggagggggaggcaguucuccaggcaggaaccucacacacuuaauggaguuuccaucuccacaucgccagugauugugggccucaguuaccugcaacagaaaccaaacccacguuccuuucuuccacuugcaaaugagggguggggugggggugggggcagugcugguuagaaucucuucaugaugaccagagagcaggaagggcccaggacaguugccugugacaagggguucccuuaugcugagcugaggaaagaggcuguggcgugugacucugugugccuauguuguauguguacagauguaugcaugcacuguguacauauguguguguguaugcacaaguacauauauuguaugugugcauguguguccacaugugugcagccuugggcccuugguaugaacucuugaguuucaucucagccuagccucaggaccaggcuaccaggcauggcucaugugguuguggucuucccuauccuaggagcagcuggccgaucucaaggaagaccuggacagggaugacuguaagcaggaggccgagguggucaucuacgagaccaacugccacugggcagacugcaccaaggaguaugacacacaggagcagcuggugcauguaagcucuguccccagcucccacccagggaugcagagccccaaccacaauggaccuagagccuuccaaggccugugcuucaaagggguugaagggggacccccaccccuagaaaaugggagguauggugaccaggugccuuggaggcccuucacccuaccccaaacacauauguaguauaugugaagauccaagaaaauacagaagugugagaauaaggggaaggaauaaugaagaacacacacauacacacacacaccacaggaggugcacagcaaaacugggugcucugaacugcaguccgcaugcacaugaaguucauucuagaacuugaaucuauauuuccaaucucuuugcagcaagugaaggcagagguagcaaucagaacugugcauugcagguucaagcacuuagguuggggaaacggggacaaugcuugggcuaggacugggcucaagcaaaaauacagaggugacaauguaaaaagauguguucugugauugagagacugcucaguggacaaagugcuugcaaggccuggcuccaguuccuaagaacccuuuacaaaggggguggggugggguggggggugucagaugccuuuaauccuaguacuggugaggcggccaagaaagaugcaugccaacacccuagccggccugaugaguuacagaccagugagagucucugccucaguacccaguggacaggauccccuaguuagacuccugcugugaccugaggaggacuguuuuagggauaucucuguggcccuaggggaucacuccuaccuggcccuggaaagcaggcugcucuacaaagaggaccugccuuugccuagcacugcuucucugcucucugggaagauggauggcaagccagacuccccguccauuauuaacaauuugucgcuaaguaaaccaauaagaaaaaaaaugaaaggcguagucaggaagcauuuuucucauuugaaaggcuuugugaauggaaagggaggcugauaggagaagauuuuucuagacguucaaagggcugcugucuuacaggcucccaagguggugguaucuaugcugacaguugggaugcugcacagggcaucgggccaguggccuuuccucuucuaggacaugguguuaccagagcauguuacucagcuccuugauagcaguguaaauggcaaauguauuugucugggagagacuacagcucacggguuuacguuuuccaggaguaccuuguaaaaauacagaggcagaagucaggcuguggcuuuguugugaccuuggcugacccaccucacucaucggggcuguuuagccccagugucagccaggcacugggccuagagcccgaagcugagagucaggaucuggcucuagccucccucaaaaacggagcugaggaagcucuauuuuccacugauaggauaaccuccuuuauacaucucacaagccggaggaucaguaugucugcuucacugcacacuuagcuuguacgucagcauccccauagucaccauguccacacaggucaggcccugagcuucaacuggauguguggacuccuuuaaucaucaguaaacuuagaggaggagccagagagauggcucagucgacaagugcuugucauacaagccuaaagaccggaauucggauccccgacagccacauaaaaagccaagugcaguggugcauuucuauaaucccagcaugaggaggcgcagacagaggcucccugaauaccacuggcgaguugaucuugcugaauuaauaaacccaggagaacggagaaaccccgucugaaagaauccagggggaaagugacagggugacaccuuguguugaucucuggccucuaugcacaccuguagacacagcacauacacauacaaacaugcacacacucauauaucacauagaaguauuugggaggggucucaugggugauagacaaguauccuaccauuaagcuacacuccccccaugcccaguuggcccugucccaggggcaggagccaugucauuccucccccaccaaggccaugaggggcucggcagcuguccucagccccauccacgaaugugcugugcacacauaacccccaccccccacccacacacagauacacagucacugcagugcuccucaccaaggcgggugcuacauaggccccaggguagagacuuuggcauaggaugauggucccugagggcaggagguggucugugagaggaggggcucugcacgggauggacccagaugaagagaacgaaccgugcucaccuucccacccugccuugucuuaccgcccuccagcauaucaacaaugaacacauccacggggagaagaaggaguucgugugccgcuggcaggccugcacgagagagcagaagcccuucaaggcccaguacaugcugguuguucacaugcgcagacacacgggugagaagccacacaagugcacggugagccuccucccccugcagagacgcuuggacacggcugggcccugugucccuugaccccuugcucuuccuuauggucccaguuagugcuuucuaaugaccaauaauauugaacuggcuauuuguauacuuaaaaacaucuuaauuacauuuauuuauauggcagaggaggagaaaggggugaaauagaagucggagaagagcuugucaggaccuuuucuccuuccgucaugugagucccagagacacauccaggcaucgggguugacagcaagccccuuuauccacagagccauccccccagccccuauuuguacaacuucuuugggaaucaauacuuguuauuuuguugcuugguuauaagaauuauuuuuguaaccaggcuccagaucauuaucaaucauacaguuuuugcaaauauuuuuucacuuuuguguguugucuucacuuucuugauaguuuccuuugaagcauaaaagcuugauuuagcaaaauccaauuuuuagcugccaaaucuaagaaaugauuaccuaacccauggucacaguggcuuagccgacccuccugcuuugguucuuauaagaguuuggaaggagucagggacaagcauagcucagaugguaagagugcuggccuggcaugugugagcccugauuuccauccccaggccacauacacugagguggugguguaugcuuauaaccccagcgcuugggacauggaggcagaagggcccgacauuuaagaccauccuuagcuacacugaguuugaggccagccugggcgcuaugagauccugucucaaagauaaaaacaaaacaggaacuggagagauggcucagcauuucagagugcucgcuguucuucccaaggauccagguucaauuccuggcaccaacaugguggcuuccaaccagcuguaacuucagcucuuuggaccaggcacacauguaaugugcagacauacauacaaacaaagcuccuguacacauacaauaauaagauaauaagacuauggaguaauccaaacuuucauaugcagguuuauaaaacagguuuauaaaauagugaaggacuggacaucuuauaaaugugugcuuuuguucauguaaauaucacaaauacauacgugcaugcacgcuccuguauuucacaguaaagcucucccaccaaggucuuugaugcguccaaguuacuuuuauacugcaacccuuucaguauuuucuagaaaagaggguaacugucauuacuaaaacacaugcuuuggggugcacaagugggagugugugccaugggggugggagugggagcaggguaggagaugcaggggagccccugagucugucuagcugccugccaugcaucuggaguguccuaucugaccaguccacuucuuuccaguucgaaggcuguuccaaggccuacucucgccuggagaaccugaagacacaccugcguucacacacaggagagaagccauaugugugugaacacgaaggcuguaacaaagccuucuccaaugccucagaccgcgccaagcaccagaaccgcacucacuccaaugagguacgcauggcugcgauaugcagaaaugcaugcagaggcccuggcauguauaaaugcaucacccuugacuaguggauaaccauguucuaguuucauuucuauugcuguggugaaauacccugacaaaaagcaacuuggagagaaagagacucacuucaacuuagacuuccagguuaaggucuauuguggggaagucaggucaggaacuucaguuaaucauauucuucaagagcacaaugaaugcaugcaugcuuacuugcuugauuucuuguacuagauuccauuucuuuuuucauacaguucacaaccuccugccuagggaauggucugcccacagugggcugggucuuccaauaucaauuagcuuaauuaagacaauacccaauaaacuuguccacaggccaguccaaaacaaucucucacugagacucucugcccacaugauucuaauaagguaaagcuaaccaucacaaaccauaugcaggugccccuccccccaccagccacaaguucugcaugccagcaauucucccucuauauaccacagccucuccuccauguagcaggugcuccauaaaguuccuuuagcacacugacacucucuguaccucaguuccuucgugucuguaacaauuaccgaugcccccacaaggacugcagaaacugagauaaaaacagaauggccuuaaugcuggauguaguauugcguccuuuuaauccuggugcuggggagcuggagacaggcagaucccuggggugugcuggucaaccagccuagcuuagcaugauccaggacaaugagaggcccuucucaaaagucaaggugcaugaugccaaaaagagcucuggucucaaggcucugagcauguccuaagacauacucuggacaauaucccacagacaugcccacaugucaguccaagacagacaguccgucacaugauucuaaauagauaaagugaaccagaacaaaccacaugccaggugccccucccccaccugcuucucuggccacugaauggauucugccgcagauaaggaaaccaacacucagaggagacacaaccuucgguggugucacaggccuacuggccacucugaagcuaugaaaccauccuuggccauugcuuuaccuacaaguagguauaugccuacaaaacagcugcccuaguguuauagguacaugacguauguggcgggcaacuccugcugcagaggcuaggcugccugggcuccacuaggccaucaucggucugccuggagcaagcggagccccuagacggcccaagagagagggaacucaacaggacucccuagucccugcucaguuauacaauuucuguaguucaggcagaccaaagauagaacauuuguguguguguguguguguguguguguguguguguguguguaugaaaaugguacauaugucagugcagaugaaagguguucauguauauaacuacuuuaugcucauguagauacaggagcauguauauaugucuggagguauuuacauguguguguugugcauuuacauguguguggugggaugcacauauauaguguauauagggccaaguguggguuuguguggauaugaaugaaggugguuuauauguguaugugcauguguguauguauguuauacaugugugaagauauaugcaggguuagggacauuagguggugguuucugucuguagauuugagugugugcaagccaaggacagaaagaagauguucagaugcucaggugugccccaaguggacagguuacuuaaaguuuccuugguucuaucugcuaaggacuaucugcuaaagucuaaugagacugauauccuugucuuaguucccgggagcacgugggucuuuccuauacucuuucugaucuauguaaccagccucuuuuggcaguucuuuugacacuguaaccccccugcaugcaaggguaguauacaaggcagauggaaggccaggcucuuacggacuugaccuggugcacucaacccacaggccgugaauguguuagagcacuuaccccugcuccaggccugccagggaacacggaaugacuucagaacagcuauagcacccauucagaguuuguccuuggguccucguccauaacccaggccugacucuuuuccuagaaacccuacaucugcaagaucccaggcugcaccaagagguacacagaccccagcucacuccgcaagcaugugaagacuguccaugggccagacgcccaugucaccaagaaacagcguaaugaugugcauguccgugcuccacugcucaaggagaauggggauaaugaggccagcgccgagccagguggccggggaccugaggagaguguggaggccaguagcaccagccacacuguggaggacugccuacauaucaaagccaucaagacagagagcuccgggguaagacagagcuggguggccagcuggcagagcuuggcucugcacgaggcccagaagcccaaccuccucuugaggauccuacuagagcacccccuucuaagaacaaaacgaugucccaucucacugcagcucagcucuccucauuuaucaccuugcacccccucaugaacccugucuuauuuccuucaccuucucugacccagcuccugcugggcaacugaggcugaggcugggagaugcccuuccuccaggccagucugcacaggaugcauuugccucuuuuccaguacccgggugccacuguggguccccagcccucucucccugucugugcccuccccacucuagccugugcuccuucuguucuaaccaccuguucuuugucuccaccucuuuuucccaacuguaccuccccuaaggauagacgcuacugaggugagcagaggaauggggugggagcauccagggagagagggugggcugggugcuguuuagugcuccuggcugggcagagguugaacucgauuuuggagagacagguaucagguggcgcugugggaauagguggagguaggcagcaagaaugaggcuggcagguaugggaaagaagggaggguaggggugagguguggagaucaagggagagcaggggugugucuaaacuagauagagcaaagaacugugaagggcaccaugauuguugggacugucuccccuaaacucagcguguagcacuauugcaucuucccaaggaagagggaaaucaucugacccagagaugagccucaaacuacuacauacagaauuugcuucccagcccagaucucaggcagcacuggaugcugcaggguucugugcuguuccaugucugucugccugcccaagcccagcccagcccagcccagagggagagccaaauagucuaguuucauuuccguugccaugauaaagacccuaagaaaaagcaaagcagggcaagcaugcgaugaggauuugaguuacagcucuacauuccuacccaccauuucuagggaaaucaaggcaggaacucaaguagcuaggcacaucacauccacagucccuagcaaagagaauagaugugucauugucugccugcugcuucgaucagaaaagggacacgguuagacuuaaugaccuuacacaggcacacaagggacagucuucaagugccucuuuaaagcgguucccugcuuccucaugucccugcccaagcauacagagcaugguaggaguguggaaugguuuacaggacugggugacuucucacgcccuccgacccugugucuucuaccuugucccuacagcuuugucaguccagccccggggcccagucauccugcagcagcgagcccucuccccugggcagugcccccaacaaugacaguggcauggagaugccggggacagggccugggagucugggagaccugacagcacuggcugacacguguccaggagcugacaccucagcccuggcugcacccuccacugguggccugcagcugcgcaaacacaugagcaccgugcaucgcuuugagcagcugaagagagagaagcucaagucacugaaggauuccugcucgugggccggcccagcuccacacacccgcaacaccaagcugccuccccuuccagucaauggugagugaggugugacagacccggugggagagagccuggggcuuuuccuccuggcuccuugcgcagugugacuggcugcccacaaugaggcagaucagaugcuuccaagugcuuggugucuuauucaaucagagagcugaagaagcccacaaaaauugcaaaacagagaaaagcuuuauucagaaucgaacaaagcaugagcacaugccgguuuacaagcucaagauuccuggguauugcccuaggcuuccucuaggaagucuaggaaggggaggugcugguugcuaauggcaagguguggaugaugcuuuguguuugauugacaggcuuaggugacauaagccuuacuuguuuggacaugcccuaauuuuaaccauaugcacacucaaucauacacaaguauaacaugaugaaugggggauucucccuaaaaguucauucaaaggauauaguuuacauuacugcauaugcaccccaaacaaguccaagcugggucaaccugguuccuugguuguagguuguaugucuggucuccaaagguuccuaaggguugguagggagggagagaucaaagugacuggguucuuuuguuuggagagggguauggauggagcucaguggcgggcaagcugcaaguguggaggugcucuccuggcaaaggggugugugcacugugauccaagugaugcccaacuacuaagccuuccuuccacgcaugugucuacuucagcccuaccuugugcagcauggaaaggaaacagguucagagagguacagguaccucaaucaaacccagcaguaagugagacuuagcucaggucugugcagcuccaaugugcaugcuguucuucaugcugcugucagccucuaaaaguaggcugugucuccuucauuaucuagccauucagcauuuagggcaucaaggcaaaggcuuaaggaaagaagggcaguaugcuugccgucccaaaggacccagggucagagucacaugcagagcaagccauagagcaccgacgcaccaccgauguacugaggaggugccuuccauggggaacgagcagguggcuucucagaggagguaggcuuguguucagcagguucuuuuaucuccaagagcaucucuggagugccgcugggcacauagacaccaggcugacccccuauggugguguacauugauuggcacaccaccagccccacuguuagaaggauuccugccacaagucugugaacacugcaugucugggaucucuuggauugcagacagcugccugcacucaggucaugacuguucauaaggaaggugaccacccgucucagcccugaagugcuaugagaggccuugauuggccucugcaaucuugggcucacuucaacucugucuacucuaagaucagucuauacagcauagagagacccugccucaaaacaaaccaaauacugcaugcaaagcucaguugguggaguguuagccucauacacacacagcccuaaguaccaacuucaauucucauuaccaacucaacagcguguggugguaacuccagcauucaaaagguagaagcaggaggaucagagguuuaaggucaucuuugguugcaggccaaccugggauaccuaagaccuugagucuucaagccagggcccucaugagcccugcugucuguaaccucauagguacagaugaauuuuauauauagcuaaagaaacuggggugguuucucuguguagcccuggcuguccuggaacucacuuuguagacuaggcugggcucagaaaucugccuaccucugccucccaagugcugggauuaugugugccacuucaccugguuuucagcauccuuucuuacacccagaacucuucuaccaucgagugccugcuguggaccuggccuugugauugggcuccaggaucagucuggucaaggggguugguagaugaacugguuacuaguucuacuaccucuacuagacaagguguagaugauccuuuaguuuugggaaacagaucagggagucuggguucugcggagcacaguccuuggcuuccugugaccccucuguuuuuccccagguucuguccuggaaaacuucaacaauacagggggcgguggaccggcaggacugcugcccagccagcggcuaccagagcugaccgaagugacgaugcugagccagcugcaggaacgaagagacagcuccaccagcaccaugagcucggccuacacugugagccgccgcuccucuggcaucuccccauacuucucuagccgucgcuccagcgaggcuucgccucucgguggccuacgcccgcacaacgccagcucagcagacuccuaugaccccaucuccacagaugccucucggcgcuccagugaagccagccagugcaguggcgguggcccagggcugcucaaccucacaccugcgcagcaguacaaccugcgugccaaguacgcagcggccacagguggaccaccgcccacgccacugccgggccucgaucguguaagccuucguacccgccuggccuugcuggaugcuccugagcgugcacuuccuggugccugcccacauccacuggggccacggcguggcagcgaugggccuaccuauagccauggucauggccauggcuacgcaggugcggcuccagcauucccccacgaggggccaaacagcagcacacggcgggccagcgacccugugcggcgcccugacccccuuauucugccucgagugcaacguuuccacaguacccacaacaugaauccagguucacugccacccugcgcugaucggcguggccugcacguacagagccaccccagcguagacagcaaccugacccgcaacgccuacucucccagacccccuagcaucaaugagaacguggugauggaggccguggcugcugggguagacggcccagggcuagagugcgaccuggggcugguggaggaugagcuggugcugccagaugaugugguacaguacaucaaggcucacaccggugguaccuuggaugacggcauucggcagggguaucccacagaagguacuggcuuccccgagaacucuaagcugcccaguccugggcuacaaggccaccgcaggcuagcagcugccgacuccaacauggguccuucugcuccuggacucgggggcugccagcugagcuacagccccuccuccaaccucaacaagagcaacaugccugugcaguggaaugaggugaguucuggcaccguggaugcccugccuacccaggugaagccaccuccuuucccucacagcaaccuggcugugguccaacagaagccagccuuuggccaguauccaggauauaauccacaauccgugcagagcagcuccggaggucuagacagcacccagccgcaccuacagcuucgaggagcccccucugcaucaagagggagcuacacgcaacagccucgacagccagcugcaggcagucagugccuggguaugagugcggccaugagcccgcaggccagcuacagccaagcccacccccagcugagcccaaacauugucagcggaucucugaaccaguuuucucccuccugcagcaauauggcagccaagcccagccaccugggacucccucagcaaauggaaguuguccccaaugccaccaucaugaauggccaucaacgggagcacgggguccccaauucaucccuggcugcggugucacaaccucacccaguccugagcuauccccagcaggacagcuaccaacagggcuccaaccuucugucaucccaucagccuggcuucauggagucccagcagaacgcgggcuuuggucucaugcagccucggccaccccuggaacccaacacggccagccgucaccguggaguacguucugggcaacagcaguuguaugccaggaccacuggccaagccauggucacaucagccaaccaagagacagcagaagcuaugcccaagggaccagcagggaccaugguaucccuagcuccucagccaucucaggacacagggcgggcacaagaucagaacacgcuauacuacuauggccagauccacauguaugaacagaauggaggcugcccagccgugcagccccagccgccacaaccacaagcuugcucagacaguauccagccugagccuuugccuucaccgggagucaaccaggugucuagcaccguggacucccagcuccuggagcccccccagauugacuuugaugccaucauggaugauggugaucacucgaguuuguuuucuggugcacugagcccaacccuucuccacaaucucucccagaauuccucacgccucaccacaccccggaauuccuugacacugcccuccaucccugcgggcaucagcaacauggccgugggcgacaugaguuccaugcucaccagccuggcugaagagagcaaguuuuuaaacaugaugaccuaaaggcccuggcuccuggcacaggagaccugagcaacacuagccccuuggaauaugagggucuagucuguucucauugucccaaaguguuaacuaggccugagagggguugggcaauggccaacuccaaaugacagcucugggccaugcccaggggucuucuugcagauguuuuaagaaaagauuaaggggcauccucucugcuguuuggccuauuuggggggggaggggacacccaaagucuuauucaaaaagaaacucguucacaugacgcuugccagccucugguguuugugagauucccggguucuggcuccuuugccucuaucauucagcuaaugagagagaacuuuggccaggggcuuuccaaguacacgcccaaagaggggaggggagccacucuggguuugaaucugagaccaugcuggauauucucugcucugagaagaugaguuugccauucugccaccugggaggaaaagggauuacuguuuccccuggauucuuccaugaagcucgucaagguugcucaccacggaggagaaaggcgcaucccccgggauauuguagucuccucaguuacuugcuaacaucuccauuuccuuagguagagugggaccagcagauuuccuaaauggagaagaauuaauaaaacacguauuuuacuauugggggggguacagggucucuccuggccuguuuacaguguucugagguauacagugaagcccucccugggaagaagacuugcgucuacaugccuuggguugcuguggacuaggaauaggcagggccucgagguggaagaggccuuccccaggaaaaggaagucauauguuuacccgcuccuauuucuccagugcacuaucugaccacucucucaugggagaucccagggcuccuccacaccggcugguggccagcagacaacccugagcgaccaccugcagccuccacacuuucugguccccugaccucuacccuccucuccagguuauuuggcauggaccagugaugacaugcaugguuugugguugagcggaagguugaaggcauugauucuuggacuuugaggaacucuuaacugaauuugcuuguucaguauggccuggccccagauaagaaauggcauguggaaacugacuccaaaaagagucagucagagcgcacugcagggugaacccaugccuccaccaccacagacaugugcguaucccaaaccuguuccuuugaguuaacagaaacuuuugccaaccaaaccucaccaaucagagcuuccuucuggccaugaccuuggcuguggugaggagcuucuuaacagagucuggacccucugugucccagggcagcaaacuucucuguuuacaacccagagacaggaccaacuccaaaugacagcucugggccaugccccugggucucuggcucuugugguguggacucauugccugacauagacccuagcuucccauucugucuguaucuauuuuguguagacaucgucuugccugaauagacugugggugaauccaaauuugguccagccaaauuuauauugccaaacauuuuuagcuuuuucuacaugcuauaaauugagaugacaugcucaacuuguaaauaagucuuuuuuguacauuaaaaguaauuuuuucauaauuuaucuuguugaucugcuuuucccuugacaguaguuaaugagaauccaggcaguaaauuuggugcauuuga

SEQ ID NO: 12058 - RNA, 34321 nt, Mus musculus
ggcgauucugguugugcgcauagccagagcggcggugggacggcucccccagguaaggaugcugugccccgcaggggaccgcagacgaggggugcgcccuaggauagggaagugaguacgcucuccgcgcgauugcaggccuccuaguuccacguugggagggagggacacgucucaugaaggacaacgccccggacugcgccccgcuuggcuugaaaggugucuuuugggaaagccggagagacucccagccggaucugggggugcugaggacaugggggaggcgccccaguuucucuucccuugcugccuguccuucccuuuuuccacaaauggccacuuccugccuuuucgggccucccuccugaguugguccacuuccuccgucccuuucagauccauaaaauguugcccaaacuucuuucuuaaagguaggaacuuguacuuugggugaccugggagcuggguucaagaaguuuguagggauuuguugguugugaauuacuuuuugauucugucuuccaguugccuuucagagugugacuagcaucaaaggugguuuuuagaagcaccguggcuugaaggguuuuccugacccgguucucugagccaagucagcucguggcucagacuugcuuguggcccagacuugaguguccccagagggcgcggcacccacagcaggguccuuuuuccuagaguucauuuccaagugaauccuggaaucuagggauugguguuaccaggguguucuggaagagggucuggaauggacugauaguucuuacccucacuugccuucaaucccugaagaacagagauccucucgcucuggcucugcuuucauuuccuaaccaccuuucuuaaguuuggguuuauugaaugaucaaggcuuauccucagaggggcagggagugugcuuuggaugugccaagugaagauaguuuuaaucagagcaagaaucuuacauguuaagucucagaacaugucaaaguggcgccgcuuaagccuggauugagguggugaaauugugagagccauaaagggaggugcugaauauugagaaggaggugugagccaagguugauccugguuuuggaacuuuguguguaugagacaugaucuuuuguagcgcaggcuggccuggaacuugauagauagcuagagugaccuugaacaugugacguuccugccucuaccccuugaguguugugauaacuguauucuaccaugccugguccaugcagugguggggcuggaacucugggcuuccuauaugcccaagaacucuaccagcagagccaaauccccagccugguucuggaauuuucuuagugccguggucuagaggaggcccuuugucuucucugagcucugaaagaguuggcugcccacccccacugucagcuuccaauccaguaggcaguguuuaaggugugggagugggcaugguucuaggauuccaugaaaugccccccugcugaagcugugaugugugugugugugugcaugaguguaugaguauauauguguauguguaugcauucuuguaauuuuauuuacaugugacuaugcaaauaucuguauauauguuuguauuuuuuagauuuauuuuuaugugugcauaugugugggacaggaacccuuggaagccagaagagggcguggcugggauucccuggagcuggaguuacaaacuguugugagcugcccugcaugggcccugggaaccaagcaggccucuggaggaguagcagaugcuccuaauugcugagccgucuccccagcccccaccagguuacuuauggugugugugugugugugugugugugugugugugugugugugugcgcgcgugcgcgcgcgcacgcacgcaugcuaugcacacauguggcagacagaggaugcuuuguagaguuuuucuuuuccuuccucuuuuaauuuucagaaccaaacugguugucaggcuuguguggcaagccccucucuccacuaagcacucucuuggcgugggagcuuuucucuuucuuuuuaaguggggucuuaagucugucccacucacaggaaacuaacguuaggggaaaccagcugcggugugggcccuguaggugcucuguugauucugaccuccucagagucuuuuuauuuuauuuuuuuaagauuuauuuauuuauuucauguauaugaacauauuauagcugucuucagacacaucagaagagggcaucggaucccauuacagaugguuaugagccaccaugugguugcugggaauugaacucaggaccucuggaagagcaaucagugcucuuaaccacugagccaucucucuagcccccuccucagaauuuuuauuuuugugcgcaauguguauguacacaccacacacacacacacacacacacacacacaaacacacuacaauguucuaggaguuggacagugccuugugcacgacuaagcagcccccauccccaggguugcuccccagcuccuccccuuccuuuccaguuacuucccacuggaaacagcacggcugcucuuaucugagaucccagcgagguuuuacugugcccgaggagauguuguuccaggaaagugugggugugaguuacuagauagcuuuuggaaaauaggaccuagacacguaaagauagaaacaugagaauuggaaccuuaaauggagucuggagaguuucucgugaauguuuaaugguggaggaauuagagguguacucggggcugguucuugauguuuugucuguuugguugcuuuggugcuggggauggagauuuuuuaauucuuaggccacggagauggcucugugcuuaaagcaguugccuuacaaguguaaggaaggacuggagcuuggauccccagagcccaaauaaaugccuggugggauggcagccugucuguaacuccagcacacaaagguggagacgggaucucuggagaaagugggcuagcucucgagucuugccauaccagugagccacggguuuucuuaaggaugauucuugacaucagcuucagccucaccgugcaugugcacacgugugcagagcacccacggcacaaacagaugugcaugcacgccugugucgacucagacacaaagaguggaagagaaauaucgucacuguugccuugaaguucuuaggaacuugaaggccuugggaacaaugacuuaaggcuccauaacaaguuugaaccccgggaguuugugcuguguuguuccaucauggcaaaccucucuggagucugugaccaaacuuccccauucaucucauuucugaacgugggaaccauuggagaccuugucugaagcugcaguuggaaacguaauaacaagcagagcuauuccauuggaacuuugugaacugggaaggucuccaguaagacaaaauaaacacaagaacccaugcccuauauuucucacuagcacaggagucccuugugugugugugugugugagagagagagagagagagagagagagagaauuauguguugacaauuacuucuaaucuacugcuguuagaugggcaagaaauuuucuuuuuuugaaauuuaauucuacauguauuuuuauguguauguaugugccugugucuguuuaugugucccaugugugcaggagucagaagaggucagaacccuugcuugagguucccuccaguucccuugaggugagagagguggauuugagucacuguaugggugcugggaaccgaacccaaguccucuggaagagcaaccagcucucuuaccacuaauccauugcucccugcacuccugugagcuucugguccuccuuccucuacgcacucagugcugggauaacaagcgcacaccucuauacgugguuuaggcagugcugaggauugaaccgggacuucaugcgugcuagccucacauuccacaacugagucacauccagacugccacaggccuucuccaagacuagcuuccaacuuuuuuuuuucuuuuaaaagguuuucuguuuguguguuuuuguuuugagaaaggucucucauguagcccuggcuauccugggaacucacuauguagaccaggcugaccucugaguuacagagauccaccugccucugccuuuuaagcauaggauuaacggcguauaccaccuuaccuagcuucuuuauaagcacucuuuagacuagacacuauugaggugguuuuuguuggggugccuuccaaagcauguggguacuguagaggauaaagacacaucuuggguuccugcuguucuagaaacuuccaugguauacuugaaauuucauguucuuucuucugguucuuugucguuagacacuagaauuaaucagccaaauaugcagucgcuuuagaaauuagaaauuuaaaucuuacuguuccccaaaccaaauagaacacagagauucuuuuagaucaacucuaaaacaaguuggugggcaaaaaaaaaaaaaauguugauaaagugaucuuugaucuccauggugagcagcugaaaaugauuaucaguucguguguguggagauuguaugcacacauguguggagcucagaggacaacauggacucucucucuccaaccaugugguucccagagauagaaccugggcugccaggcuuggcgguuucaccuuccucugcugagccgucucaccuguucuuccgccuaauuacuuuuuaaauuuuaauucuauuuuauuuuauuuuauagucuacggaggcuuuucuguuugagcuuugcaccucuagagaaaggaccccaggggucucccuccuguguguuuuggucucgcuucuuuguggucccugaugcuagcugggguugucagcacaaggaaaccaaacugacagcguggacacagauuguucugccauuucucuagguguuugaguugcagaucaaaccuagggcugaucgcgcuacacuugcucaaccugcccgugaggguucacauugauuuucccagcucugugaucaucagugaugcaaacucaccaugugaccgugcuucaucaucacaguuaggaaccgaacgauggcuuugacacauggccugaugaggacccggcguuugccucucuucucagcauuuuuggugcucuugagagcaccugccaggacauucauggugaugaggagucuuuaauuuuauuuuugagacagggucucacuguguaauccccaaucugagguagugcaaacagaggcaucauuauauagagcaggcuggccugccgcucucagagguccuccugccuccgccucucagauacuggauuaaagauguuaaacgcuaugcccggccaccuuccgauuugagauguggucuccaauugaagcugaggcuugcccauucuguuagacaggcuggccagugagucccaaggauuguccugucucugccucuucuguugggauuauagagagaucacuacacuguuuccauggguccuggggaucugaagccagagcuucacaccgcacggccugugcuuuauccacuguaguaucuucccagcccccuucuucuggucuuaccucacacaggcuccgccucucucuacugcaugacuacaaagucagucugcuacuucuguucuuugagacugggugucauguagcuaagacuguccuugaacucuguguguaguugaagacagccuucaaucccugauucucuuguauccccgucccacgggugcgauuacagagguguacguaccaaaccagcuuugugugguucggggaacaaaacccaaggcuuuaagcacacgaggcaagcacucagcuagcuugaccauauuugcagcccugucugcagagucuugacuggaccuugcuuccuuuugcuucaggacuuccuuccucccugcagagagaggcaguagguaggaagugcugagcauagcagcugagagaggcagggccacugggcaaagguuuaugggccuguucagaaaaggggcuagaugguaucagugguaagccauugggcugcuacauuuacugauguagaaaguucacauggacuggggagauggcucaauuggugaggucuuggaaugcaagcacaagugcccaggcuuguucccccggacccaugcuaacacaaagcaaaacagaacuguggcagcuugaguuuguaaucucagugcuggagaggugcacacaggcgcuuccccuggggcuugcucagccgaucuagccugagcagugaacuccaggccagugggagacccugugccugccuagagugccugaagcccugggcuccguccacagcaucacagaaaaucaguuaugaagaugcauacucauaaccccaaaucugagguagagccaaaaggagcaucaggagcugacaguuguccuuagcuguagagagaguucaaggguagccugggcuccaugauacccugucucaggaaaaaauauaaaaggcagaauauaauugaggaauauaacuuauguugaccucuggccuccauguguacacacacacacacacacacacacacacacacacacacacacacacacauacaaacagagugaacaguggcuugaaguggcugaggugccacaaggggucuggcagcuguggcugguuguucuaaccugguuguggcagagaaaauggaagauggguagagggaaaagguccauuagagauaagagccaggagaaagagugaguagagcuggggagaaacaaggggaucugggaugaucaccuggucuggcuugacuagugaugucugcacuccuaggggcuuguguugcuauuguggggguggggcagguagauuaggagugcguucauucugauuucuuuccauuguugugauaaaacaccuagaccacaguagcuuggggaagaaaggguuuguuuagcuuugagggaagcaagggcagggacucuagaaugaacuggaaggcuggcuggcuugccauucugucuuuaagcaaagaaugcacucacugacaaggaaguacagcagaaaccguggagcacacugcuuggugaucacccagggccaacugcacugggaauggagccguccacagugggcuggguccuccuacaucaaauaacaaugcagacaguccucuacagacuuguccgcaggccaaagcccucaauggagacucccuucggagcuguguuaaauugguaguuaaagcuaacuaggauacuacuuauguauuugcuugucuguuugacuuguguguguuugugaguacacacuugcacacucacaggacagcuuucacaaguaggagcuguccuuccuccaugcgcuucccaggaugucaggcuuggcaacaaggaucagacuuuaggguagagggacgaagaguggagagaucuauuuggggacuguugaauuugaaaucccugcaagacagccaguggggugaggaagacagaggggccuggccucuguccuccaguuugaggagacacaggaagccacuuggauagaugugcucagcccagggagacuguggaggagugagaaacgugacagccugagccucagccgggagaaaaccuuagagaagagauaggcccuggggaacaugagcucugcagucuagaaggaugggcauugucaagugggagcagcagggcagcggagccucggaggggagcgauugaugauccugguucgugguuuuaaaugccacaugagacugguuaugugauuuuccuuucucuugaauuccuucuccagccagaaugcuaguacagguaguuggggugagggguagaguuggucuuugcaggaggaacuggcaagaugucaucuaagcgggagugucagaggagaucagaaaaaaugugcugagaucggugcuuaauagguguuugagcgagugauuggaacaauuacagguuugaggcuguggugucugaauauugugcccccccccauagcuguauuugaacaacuguuccugguugguggugcuguuuggggaggucuaagggguacagucuuguuggaggaaguaugucacuggaggagagcuuugcaacccguuugaguuaccaaacacuuaccuauuuacaguuugcucucuuagcuuugugcuuguaguucaagcugugagcuuucagucgcugcugccgucaccaugccuacgauugcugccaugcauaacccccgccacggacucuaaccccuggcaccaugacccuggauaaacucuuccauaaguugccuuaaugccacagauggacagaccagaggcaucauaucaggacccuugggugagaucagguccccauggcagagcgaaggucccuuuuuacacauuuagaggaaggaggcgguucuauaccaugugauugguaguuauagugcaugcuugcugccaggccgucucugauuccuguuaaccuggggucuuauauacagagucagcuguaagggugcaggaagcgccgggcaugguggugcacgccuuuaaucccagcacucaagaggcagaggcaggcggauuucugaguucgaggccagccuggucuacagagugaguuccaggauagccagggcuauacagagaaacccugucucgaaacaaaacaaaacaaaacaaacaaacaaacaaaacaaaacaaaacaaaaaagaauccaaggaagcagguuaaugggagagcuuuacaaaaugcgcuggcccuggcuaacaugagcucaaaggauagagguaggguggagaaccaggaucaggcgagguucaugguauggugggccugaaacuuagugcucuaggaacugcuagagucagagccggggcugaacaggacagugaaacagaccaguuguagugaaacgcagacagagauuuaccuaacagcacuacacugggaagagcaagcaaagaggucugaugacccuuaaagcccgucagggucccggcauaaggcucagguauaaacagaaggcgagagcugugcauagccaagcgguccuggucaaggugugcucuugcccaucacugacccagccuugucucagugccagcucuccugcagggggucuuggcaggcugucagcacugugugaagucucuuccugagaaaggagcuccucucugccuggcaccaaggcuccugucuccuuuucucaguaugauauucccagggaaaggccaguuucauggauccauuguacacaagaaucccuucuggaauauucucauucucgccugggcaguuacaguggggaggauccgcaccugcucgaacagggugguuucugaggacagugaagucggaagcagaauuuguguccucuguccauaaggaaagugaccagggagaucuggcagugacagagcauggcccugggaggcgaggccuuagccaaaugggaauuuugaaacagugaggugagugacuaagaagagcagacaggaagugaccaugaggacagagaaaggacacaagucuggccuggucaccacaggccugcggaggccaacacuguaugcuuaaaauaugaggucuuuuaaggacaagcauagaggaacauucugagaauagaagaaugcuaugguaucccuagugguuggggacggugggucagucucugcggagguggaugaaguguugagcugagagacccaggcaugggcgaguguggagcauccuccugccugucccaggaggagaggcagagcuaugcucagggugugcuggccuggcagagccuguucuagcacugccugccccaggccuugacagaggaagccacucacucuugcuguguauaccgccuuggcagggagagaaaagacauggccauuauagcagucagagcugaccugaaaccaggaccaacccacaugcccauugcuuguuuggagaguaauguucucaguguuaaacacacacacacacacacacacacacacacacacacacacacacacacacacacacacacacaagugaaaguaaccggcaaggaauuucuuuauguuuuaaaaucuugcucauuauuuauuucuauguuuaugguuguuuugccuagguguaugucuauguaccaugugcaugcagugucugcaggagccacaagagggcaugggauccuccuguuacagacaguuguuagcuaccauauggaugaugggaauugaaccuggguccucugaaagagcagucaaugcucuuaacuacugagccccaggcaaugucuguuuuguaaaaaguguguguuaccacccaaaccaggauagcaagccaaauccaaggccaagauggccccugucuuuuaccccuauggaagacaggguggggaguggcuguucuuuuuuggcugagguugaaccucacaguucacucccagggggcuaauguggaaggcagccagcagcaagaaaacgaaggaaagaggucuugagccagcuguucugggccaucacagucugggaaugcagaggguugugggagcugggaggcucuggguaaaguacaaggugggagaugaaaagauuugaauuccuuugcauaaaauuguaggagguagagagauuuaugaauucuuuuguucuuagcaacuagucaccuuugauaggaaaacuaaaacccauuuuucacaagcugaguguggaggugcgcaucugggacucagaaggcugaagugugugugugucaauggcccacugguguuuucuuaugaauucuccuggguggcucaaaacacauccauuuuauauucccuuccuuuaaaacaaaaaagagcucacuuuuaguuuuuaauuagugugugucuguguguguaucugugucuccguguccguauuugucagcguauggguauguagaugugacuacaggugccaaugggguagggagaauggcuuuggaucuccugcaaccggagauacaggcaaccacccaacaugggugcugggaacugagcucucgggcauguguucuuaacugaugagccaccucccuagccagccaacccgcuuuuccuucccccacucuccuucauuacuuugucuuuuccuuuuuguuuggcacaggguccugucauuuccaaggcuagccuggaaccaccgaucucuuugccaccuuaugaguaccacguuuuuaaaauaaugaguuguuuccuucaaggcgauggaugaggucccuuuuaaguuuuauauuuuuacagguaucuaccgugugugugcuuauggugugugucugcgggcgugcaugccugugcaugcgcuugugggggccagaggucagucagcugucuucugucaugcuucaguuuuuugagucagggucucucccugaagcuagcgcucuaaguuuugcuagguuggcucuggggaucugccucugcacccucccagugcagggggcgguggggggauacagauguguguuguuggggcggaguuggcuggggaucugaguucaggaugcuauccauggcaagcacuccuccccagccgcugaauuuuacauuaguuaugcaguauuuucaaacccggggauccaagugcuaguucguauuggagcuguuggaggagagagggacucauuccaggugagagcuucauaauuugguuuuagcaagaaguaguccaauaaacuuuuaaauuugucuuaguuagaguuaacuauuguugugaugaaaauccacggccaaaagcagcuuggggaggaaaggguugugccugugugguuuguacugacugagcuggcucucuucaggccccacauacguacuuuaaaaaauaggcuuauuuuuuuauuuugauguguauguguuugucuguguggggcaguggaccaugccagaaaacuggauaagguugaguggauucagaaaucucccuccucuuacaccugagaacuauggguguuuaaucugcucccaaccagguuccuguccuguaacacaugaccauggcaccccauggagaggacugugacaaucagucaccuagaggcagcaccccagcccuccacaugcagaugaggcaucccuaacaucucagaccaagacaauaggaagcauuuacugucagaccccaacccaccccaaaauguauaaaagacccuauccacaaggaauaaagcaggaguuauuucacuaaggaucgucugagagugucugucauaaagagcuguaacacuuggaggaagagaaguucucucccggagaagcuuucucuacuggaagcuggucaagccuacggaggucacuuccuguuccguggccgcgaccuuggcuccuagccaaugugcugcaccaacucuggagcagagguagcucugcaguagagaccuggcaccuugccuaccugcucgcacuggcccuccacagagcagagcagcacagcauuggccugggacgaucaaccccccacccccaccccuucagagagugcaacccuggcugcuccagcugggccagagcucugcagaucucugcagauaacauccgguacacagcauguaugugugugcguguguguccaggugcccacggaggcccagaagaggguguuggauccccuggaacuagaguuauaaguuggugguggguuccagggaccaagcuccaguccugugaagagcagcaagcacuuuuagcugcuaagccauuucuccagcucugggauuuuuuuuuccuaaaaaacaaacgacaucauaguuuauauuuucugcagcuugauucccacccccaccucuccuuuaguggcaccuccuagacauuuccuaggacaggagauggggcuccucucucucuuuaauagccauauaaucuaaacauuggcucauucauaauuuacaaaacuauuucuaguuaguguauuuuuccagguuauugcauugcauguaaacaccaagaaaaaaauccuugcacacuuacagucucagcauauaggaucuauaucuuugcccacaauauccauuuccccauaccuuugugugugugguacuugcaugugugucagcacacguuuguauacagguucgcauguacccgugugccccugcaugccaagguccuaggucaacuuuggguuucccuccaucauucuuuacauuauucauggaaacagggacucucaggugaacccggagcucgaugauugggcuacuccggcaaacgagcuugcucuaggggaugccuugucucugccuucugaugccuagauuuucagacaggcugccuggcauauauguggauucuggggaucugaacuccuggccucacauuuauaaggcaagugcuuuauaucaacugagccaucucgacagccccuucccacucucuuccuacacucuuuuuaguuuuaugcaagcugguguuuuguuugcauuuucuuaaguagccucgaaguuagguguggcuccauauauuuaguaaccauauuuaccucccucccggugaauuacuucauauucugcuuauuuuagaagguucauguggaagguggaggaucagaaagaaguucaaggucauuguuauagcagguuugagguauuugaaauccugucucaaaaagcuccaaauggggaaaaaaaaaaaaaaggaaaauaaauagaguuuaaaauugaguuguuggccucccgggcaggaccuucauacauuccagaugucauuucgcagaaugcugcacucuuccugagcguggcagucuuccgaaaucccugcccuccguucugccuucacagcuucuccagcugcgcaaguucaguugaccguucuuuccauguuugauuuucugauuuuuccccauuauugcuuucugcugggaacuccugugugaaguagucuggaaguuuaaauggucaucuuccucuuugagcuucagcuuucuauguggaucuggguuuuccuugucaacccugcucuuuaauggccaaguccacagccugcucuaguccuaguccuccaaacagcgcuugcaagauggugcugagcugcaggugacugguaguucgugugugugugugugugugugugugugugugugugugugugugugugcucucaugcccccucccuucaagugggcaaaugccaugguguaugaggagaacauacaaguaucuuuuauuuuuaaauguuauuuacuaauuauucguuuaaaggacuuuauuuacaccugugugaguguaugucccaugugaacagguguccugagaggccagaagaggaugcuggguucccaggagcuggaguuaaaggcagcugugaguugccugaugugagugcugggaacuguucucuggagacagcaaaugcuuuccucuccagccccacgggugucauuuuccuuuucuuccagauccucucuguaggucuagcagccaacaaugccgagucuuaccugaacuagucuuuuuauuuuuuauuuuuuacauuucuuuauuaucaaugcgugugcgugugcaugcaugcuguguaugcugugugugugugcucuaugugugugucuauaugugugugugugugugauugagugcacagugccaggugugaguauguggagaacaacuugcagguauuggcucuguccuuccucuguugcaucuggggcuggaacucagguugucagcuuggguggccagugccuguccccacugagccgucucacccgccucugcaucagucuuuuuaguggugguuguaaacacuggcuuaguaacucaugugcacacugugcguuuaccagcccgccuuggcuuucuguggucgagagcccucccuucucccucuuucuuuaguacuuaccauagguauggcucuauggguuccugaucuccuuugcuauguagaggucaugggugcuguuacucagguaucuguguggagacaggcucucucggaaccaggaacuugucauguagacuggacuagcuggccacugaggccgagcuccaccagucugccucucuaagcccugagauucacaagcaugcaccccccaccccaacuggcuuucuccuuucaaauucagguccuccagcuuacagggcaagcacuuuccugccucagcccccgguucugaauuuugcaaugauguguuuuaaugagcuuuucuuuguuguaacaaaguauuuggcaaaaaucaaacauaaagagggaaggugcagcagccugaggccagccucgaagugaguuccaggauggucagggcuacacagggaaacccuucucuaaaacagcaacaacaacaacaacaauaaacaaacaaacaaacaacaaagaaggaggaggaagaggaggaaagauuaguuuggaucauggacccagaagcucaugguugcuuaggccuuugcuuugagucugaggugagaggcuggacgacauggaggagagugggaagcaagcagagagguccagugccugucagcagggaagcugucucucugucucucucugucucucucucucugacucucucugucucucucucucugacucucucugucucucucucucugacucucucugucucucucucucugacucucucugucucucucucucugacucucucugucucucucucucucugacucucucugucucucucucugacucucucugucucucucucugugucucugucucuuucucucugucucugucucucuaucucuccgucucuuucucucuuucucucucugucucucucucugacucucucugucucucucucucugacucucucugucucucucucugacucucucugucucucucucucucugacucucucugucucucucucugacucucucugucucucucucugacucucucugucucucucucugucucucucugucucugucucuuucucucugucucugucucucuaucucuccgucucuuucucucucugucucucucucucugugcacacgugugcauuccuguguguaugugugugugcacuuuugcaugucuuguuucugucugucuguguucucauuuagauacauucuaagguucucacauucuccagucauuuccuggcucuuuuguacagucagauaauagggugggguguuuucuguuuguuuguuuguuuuguuuuuuguuuguuuguuuguuuuaaggcaaaggcugugucucuggaaugguuaccugcaaaagaaaaagcaaaaugagccacaguaaauggucugugugugacccaaacagggaucagauuucaucuuucgggccagcccagggguggguaugucuggagugacugagugacaguuggcugucuuagguccuucccuaauccuagcaggucagcugcagcuauggccuaagugggaacaucaacuuuccuuacuucugauuugcacuuaaacaacagcaacaacaacuagaucucaugucuggagagaagacagagagguuacauagcauggacucuccgcaccuguauugggggcucccaacugccuguaacuccagcugcaggggaucagaugcacugcgccugugcgcacgcgcgaacacacacacacacacacacacacacacacacacacacacacucccgcguaauuuaaagggggcuggggguggggguaggggaaggccgggucucaugcuucuauuucuggccucaagcucccuaugcagcugaggaaacuucugguuuuacauuugccuccacacaagguuuaugugauggugcaggggaucaaaccuagaaugccgggcuggcgcuguauggacugagccacaucguagucccuguuauuuuugaacuugaaacaaaacaaagguuuuguucuucagugguuaucauuggcaaggaaaucgacuuuauuuaaaaugaaaacagacaaacaacagcaguaaaugguccuaggcuuauucgguaaaugucugccuuacaggcaugaggagcugagcgcagaucuccggaauucaugaaaagccagggagggcugugugcaccugggaccccagcacuagggaaugcagacacaggcagaauucugacguucauuccagguuccucaggaaacccugccucaaaaaaauaaagggggcuccggggagauggcuuccugcugagacuguaccagaguuugauucugcaacccauguggucgaaagagagaaccaucuccuacaggcugcucucucauuuccacacaugugcuaugacauggauguucacacaugcgcacgcgcgcauacacacacacacacacacacacacaggauguaaguuauuggaauuaaaauaaauuaaaaguaaagguggcaaaugacugaggaaagagagccagaguuuacuccuucauggaugugugugugugucugugcgcauccuacacuauaagguacauacagcacaugcacauacaugccaaacgugcauacuaaaaccauauaucuguguagugcauaauuugguugucugcauguguuugaaaggacccugcccccagccuggacaaauguugguuuauuuacaucaaguucacagaaacaggguuggcggugagaaauugugggccuuugugugguguggguuccaaccgcauuccccagccccaucucugcaggaaacaguuagugguuguaaacgaggccaaagguauuuucaaguuccugaaucacagccuuguggggcuccuguaccccccauuccuucuauuucuauccccacuuagaugugcuuaauuaucuaguuaauugcuuagcucacucauuaaaaagcacauaauuagcauagggggaguaggucggauggauggauggaugccuggugugggcagguaccugaggaagugcagggaaggcagaucugugaccuugacuugagcagcccaaggccaugccuggagcucacaccaaugcuaaggggucccaaaucaucaagcaaacgacaaauuauguccagucugccugacugcaaaaacagauaaagugcaugagaaauaguuugcaaaacaaccuaugcccucaaaggauuuaaauacaagaaugucuaagucuaagacacuaagcagagacacacaguuagacacacaguuaacagugaaugcuaggccagguauggcagugcaugcuuguaucccagcacucaggaggcugggaugguaggggagaguccugaguuccaggccagccugggugacacagugaaaccuugucacaaaagaaaacaaaacccaaacauugcuccaaccgaacaaaucaguccccauaaagaaggcagcuagggaguuagcuucaucagucgggaucuccgugcaagggugaagaccagaucucagauccccagaacccaggagaaaagcuaggcguggacuccacaucucugacucuaaugcuugggugacaaagacaggaggcucccugaacuuucuggucagccagcccagcugaaacagugagagacccuaccucaaaagacaaggugggaagccaggugaggggcacaagccuuuaauccuagcacugugggggcaggggcugugauggugugaaugagauguggcuccguugcuugggcauuuaaaugcuuaggauguuguuuggagaggcuuaggagguguguccuugcuggaggacccaaccucugccugcagcugugcuucccugcugaaggacucuccucccccugaaaccugaggcagauaaacccuuccuccuauaagcugccuugcuugcuuucgguguuuuaucacagccauaaaaaaguaacuaagauggaaguacaggcauguggaucucugugaguccaaggcuagucagggcuucagagugagucccugucucagaaauuuuaaaauaauuuuuuaaaagguugaggagccagcgagauggcucggcagguaagagcacucccagggaacccguucaguuaccaguacccauguggggggagcggcaacuucagcucuaggggcucucuuuugaccucugagggcacccacacauuuaugauaugcacaacauagacacacacacauacacauaauuagaaaaaauacaauaguuagugacaaaaauaccugacaucacccucuggccaccacauauguacuauacacacacgcuauacacauacauacagagacaugcuguacauacacuauaacacucacagacacacuauacacauacuaucucucugucuauacauauacauauacacauacuacacauacaugcauacacaugcuauauacacacaaacaugcaaauauacauacacacuauauguacuauauauacacacacccauacaauauacauacacacauauacauacauuuguacucaaacacauauacacauaggcacacacacacuauacauauauauuuuuauacacacacauacuauacacauaugcacacacauacauaugcacauacacacauguucacauauacacuauacauacauauauacacacauagacucacacauacacccaugcacacacucuauacacagacauacacacucuacacacaugcauacuauguauacacacauauacacauauauacagacuauauacauguacacacuguacacacagacauacacuuacacucuagacaugcauguacaguguuuuaggcauucugagugauuuuuuuucgaguccaccugacuuuaauuuuuuuuuuuguaaguuugagacagggucuuuucuauuuaucccaggcuaaccuugaaggcuauauauagcugaagauggcccugaacuuacggucauuuuuccucugcuuucuuuagugcugggaauaaaggucacuucucuugcuucguccauccggucuuucgauaaugucauuuuuucccccagauguuauuuuugccccuguuaaaguugaucaagcccuuucuaacaccagccugcaauguccuuuagggguguguguugacuucuguuccaguuuguauuggaggcugggauggugggugugugcugcccccagugguuagccuuugccuacaucucagagagguuuugugguucucugugucucaggcuggagcuugcuuugccugcuaauugccugacuguggagagaugcuguggcuacagcuuuuuaggggaaacuccccugcuucagggucucugaugaucaaggagccucuugguuguuguuagaauguuuguuccucuaacacauucaaaacaauuuuaaguuguuuuuugcguauggauguuuuugucugcuuacacaccuguguaccacacgcacgccugguaccuguggagcccagggaguguaucagauucccugggacuggaguuacaggcaguucugagccccuacguggguguggggaaucaaacccggguccucugggagagcagccagugcuuuuaauugcugacccaucucuccaguucauuccugucccguguccccaucccgacuccucuaucaucccccccccccccacuuugggagacagacucuggauggccuggaauucacuuugugaggcaucucuggcuugggcuguguugacuuuuauaaugugaccggcuccuugcccccaucccuagcagugcugacuuggaauucugcaacucccauuucugcuucucagcuuuguccuauccugguuccucuugggugacuucagaguugccagacugucaaggcucuuucucuuccagcccuucucucuuugaaugaguuaaguguuucuaaggugcaggggagggcuggagaaagggcuuggugcuaagaugaccacccccaacuccagccccaggggaucugacauccucuucuggccucugaggucaccgcauucaugugcguccacacaugcacacccagccacccccuccacacacacacacaauuuaaaaugaaaaucaaacauuuaaaguauagggaugucugucauaugucauuugcuuucaacuggauaggacacacaccaucuccaagcucuuguuucugucaucugcagcuccucaccugggccaccuguccgugugucaccaccuccgaccagcaggauggcugccaacaagggcaagagccagggcucccugguacuucacaaggucaucaugguuggcaguggaggggucggcaaaucagcccugacgcuucaguucauguaugaugagguaagagaugccagcacagccugcgccugcugugauguugagugugucugcuccagauguguucuaugucccuuuccccgugggguguuugaaaagcugcagggauaggggcucucagcagaagauucugguugccgacacagugguggguuuaguggucacagaaauggagggaguuucucugcacacuguauuuccagcguuauguguccuuucuuugagacaggagcaagggaagagagacaccucuguauaugugcuaauuuuuuauuuuaaauuaugugcaagcugaaaaauguguguguggguggggggggaggggugauauuuagaaaagugcaguugccuucagaggccagaagagggcauugaaugcccuggaguugaacgcaguuggaguugcccaaugugugcucuggggaccaaacuccuagucuccaggagcagcagguacuugucaccacugggccgucucuccaacuccaacauuuuuuuuuuaaagauagaaucuccuguagcucaggcuggccuggaacgcacuauguagccuaggaugaccuugaacuucuaaucuucccaugccuccccuugcugggauuauaggugcaagcuaccuugccuaguuuaugaggcucugaggauggggcuugggccuucacaggaaagaggugugcacucaaccaacugagcuacuccccagcacccggucuugagugucucugaaaggguugaauguuaaagaacagacccucagccuacagcaccuugggaaguugagcucagcaagagagguuaggucaccggaaguguguccuuaaaagagauauuagagucccacucccuuccggccuuccucugcuucuugguugccgggacgugagaaaccguuucugcuguuccucgcaccaccucaccuccucugccucaccucaggcccugaggaccauggagugaaguucugaagcuaucagucaaaaauaaaccuuuucucuuuauuaauuuuggggugcgugucuguguaucuguguauguguguuugugugugugaaugcauguugcaccacacuggaggucagacgacaacagggacaagucaguucucucucucauggacugcacguggguccuggauucgaaugccaacuuuucacgcuuggagacacucacuaagcuuucuugcuaaccccaaaauucacucuuucgucauguacauucuaagcaggugugaucauguauaccuguaaucccaacacuccggaggcugaggcaggaggaucaugaauuagaggccagccugggcuuuguagcuaagcccagugucacaaaaagaaaauauaaaauaaggaauuguugucuuggugggcacuuuccgguugcugugauauuaaaccuugaugaaagcaacucacaggaacaggguuccuggggauaccgucuguuauuggugaaggcauggcugcaggagcagguggcuggcuggucacacuguauccacacucaggaagccaagagugaacaggaaguggggcaggcuauucaacuccaaggccaccuucagugacccacuucuucccagaaggcuccauuuccuaaaaucuccacaaccuucccaaacggugccaccuuuucuaauauugcccuuugauuugucaaaguuuuacaguuucaaaaauguaauuaauuuguuuuauguguauuuguguuaugccuguguggaugccugugcaccacacguguguaguacccacagaggccagaagagggcaucagauucccuggaacuggaguuguauacagaaaguuaagcugccauguggaugcugggaauugaacucaguucuucuggaagagcucaauugcugagccaccuguccagcccugaaagcauuaaguuuuacugaaguccgguuuagaguggugugugugugugugugugugugugugugugugugugugugagacacgugaggugcacaugaagaggucaguggaaacuugcaugacucaguuuucucuuccacugugagccccgggguggaauucaugucagguuuaguggaaagcaccuuuacccccugagccaucccccuggcccccagcucauuucuucuuugcuacuuggacuuuggucucauuccuaagacuuuaugucugguucaggcucacuggugguuguucuguguuuccuucugaguuucugucuuaguucuuaugucuauacuggcgcuguuuucaguuagucacuauguuuuaugugcccugcauaagaaguccaauuuuuuuacgcuuuuuaaaaaaauguauuuacauguguguuccuguguuugaguguguggcaugaaaaaccuugucucaaaaaucaaaaaacaaaacaaaacaaaaaaaacaaaaaaauauccaccuguccuugccgccaaagccuggcaggaaaggcguguuucuccaugcccaccuuccaucccucauuuuuucaaaaguaaauuucaaauuuauccugugacgguuucacgcaugcauauacucuauguggauggcauucauucuccauccuccagccugcccacuucccgcucucacuuccucguccuacagacgcccaucugucuucaugucuguucugugggacccacugaguuccccucagguguucacguggccaucacggagcugguguacuuugaggcacaguauuauuagauugcucaggcuagccccagaucuagccuugccaguguuaggcucagcugagauaguucaguggguaagacaaccaccaugcaugcauggggaccugaaccccuagagcccauguaaaaccugaacguaguagcuagugccuguaacugcaguacuucugugggaggaucagaggugcagcagcagacuccccagaagccagcccagcacaugcauggugucaagggaaaggaagagaccugccucacaagcaagcugggggaugaggggugaugccugagguuauccugugaccuccacguauguacagcacagucucucccacacuccuacccacagacaucacaaacacacauaugcgcgcgcacauacauacauacacacacacguacacauacucacuuauacacaaacacacacuacauacacaaacacauauauacacacaaacacacauaaacacauaaacccacauauacacacacacauacacaaacacauauauacacacauauacacaugcacacauauacacacacucauacacacacaaccacacacacaagcuaaauaaauguaauuaaaaauguuaaaagggauugcauuuuaucaagaguuuacuaaagucucauaaauuaguuaauuuuuaugugugugucuuuauuacaaaaaaaaacauucggggaggcuaauuuacuucuuuuuuuggcaguuuuugaauuuguuuugucuuugaggggagacuacauccuucuauacauagguaauaaucucuacucuacuggcgaccugcugcagaaugacacacuguuauucuagaguugucuacaugcccguauagaguuuccuuccuccuuuuuguguaacagcgaagcacucaguuguauagccaaccuuagcugggcauuuggguggaccuucaucuuuugugaugcccuuuggugccaacagugaccuugauuuuugagccagcguuucuggagauuagauuccuagaagcuagauguggggagagucagaggauaaaguacuucucauuuuaucagauguugacaaaucucuccaugggaugguccuguccccugccccacagggagcaacaggucuuuccccaaagcccaugucucagggcagcucuuccuccucucuccugauugcuuuucucucccucccucucucccuucucccuccucccucucucccuucucccuccuuccuuucuuucgcacuagugaggagagcaugucuccaugcuggcuuuggaugcucccaucagugcguguuaaagaggagugcucaaugcacugugugcagcucagaguucuggcuagcgcuugcaucgugcugcgcugugcugggcuggguugggcugugcugugccucuguuguuuuuucauucuugggaaaucuaacaucaauuuuuuuuacauggcuucuggacuuugagucauaguuuaaaaagcccuucucuacuucaagguaauaaggugcuaccaugucuacuuucagugcuugacuggauuuauuuauuaauuuacaugugugugugcgcauguucauguaugcagaugcauguguggggggugugcaccuacaugugcaugcacaugcuugugugccuauggaggccagagagcauccccaggcaaugguccucagauaugguccaccuuguuucugagacaaggucuuucauuagccuggggcucucugcguaggcuggccuuagcuggucuuagguggucuuaacuggccuuagcuggcaaugucaccuguccucaugucccuggacuaggauuauaagcaugcacuauuaccaugucucacucuuuuuuuagauuauuuuauuauuuuuaguuacauauaccgguguguaaaugugggugugugcguacgagugcaggugcucaugcaugcuggacgcacuggauccccuggagccaccaaggggacuguggucugaacuuagguccccuaggagggccauagauacucuuaacugcugagcccucuccccagccucuggcuuuuguuguuguuguuuguuuguuuguuuguuuguuuguuucuaagagggauguggggggucacacucagcucuucauguuugaugaccagcacuuuguccacucauccaucuccccgacucuccgcuuguuuuacucuacacucugauuccucuugccagauucccuugggaugauuuuuauaguucugcucauuauuaauacaggcucccgagccucaccuuuuccauuguuuguauuauaauuuuaugcucuauugacaaugauaucaucaagaauucuucuuaguguuggccuuucuuaucuguaaaauggggcuaucugccccuguuguugaaagcuuuaaaaaaaagaaauugaacucagagcuauuaaggcaggaaguguucccaagcaugaugggacaugcuugcaauuccaacauuuggaaaguagagacaggagguucaagaccagccugagccacaucgugugacccuguugaaggaaggaaggaaggaguggguuguuugcauucuucagugucuucucuggguguaauagcucuagacucuuagugaauacaaagcugauugcaaagcauucagacguagugauguagucggggugccgacuguacuccuuaauucugacugcuuccccccaguuuguagaagacuaugagcccaccaaagcugacaguuacagaaagaaggugguucucgacggagaagagguccagauagacauccuggacaccgcuggccaggaggacuaugcggccauccgugacaacuacuuccgaagcggagaaggcuuucugcugguguucuccaucacagagcacgagucuuucacagccacagccgaguucaggugugcuugacuggggagagccuggcccugacccuccugcccggcggcugagggcgagggauccggggucgaguggccuagugauggccgggcucugaugaggaagaacucugccguaggguucucugaaucuuguuacacuuuggucuacuauuguuucuguuucuuugggcauccauguuuuaggauuucugcacauaccuuuuuuaaaagguggacuuauuuuuauuuauguguacugguguuuugccuacuguaugucuguguaccaagugugugcaguacauacaagggccaaagaguucugagcgugccaauagaccccaaaguugucugcaagagcagccaguguucccaacuccaaauucuguuauaaagaaauagugagcauugggggguacuucuucuguagcugguucuucaccacaccacacaagcuuucccacuuucuuauauaauugcaaauuuuuucaucgacuccccuuaaggacagaauacccuaguuaguccgcuuaucagaaaagaaguuacugugguuugugguuucugaggcuaccaaccacgaucauguggccuguugcucugggcccagggguagggggcaugcagcaugguggggguuauguuacugaaggcuugugugguacacggcagcuggggugcaaaagagggagucuagagucccagugucccuucccagggcacaccccagagaccuaucuucuucccaccaggcccugccuccuaaaggucucuaaagagcugaagguucuggcuugcuuucugcagcugcgguguguguauggaggagacgcacagcagagaacucagcgugagcucuugcggcugcagauuuuuuuugagcauucaggaaguuucuauguggguaacacuuuugugaucacaacuguguuuccucuucauaaucugauuuugaggccaucccggagauaaaacaggaugucuguacacacugcuuucuucucucccuugugccuguauuggaauuacuaagcauuuuugugagcuguugcuuuggguuugauuggauuuuuuuguuuuguuuguuguuuuaaguagugucucaugaagccuuaaacuuacuauguagcuaagaugaccaugaacuucuggucuuccugucuccuggguuuacaggcguguagcaccaugccugccuguagagugcugagaaggaaccaggggugggggguggggaggggcucuguguauacagugggagcacccugccaucugggccauguccccgagauucacagaggguuucuuccugacuucccucucccuuucucuuugaccccauaaauugggggacuccguugagaugcagacuccugacuuccuaugcagacaucucuuuuguaggaguauggggcagagaaauccguaccugggagagaccagaugaucauaauggacgaaagcuaagggccagccuggaaaagccccugcuaguagacacccauuuugaaaucucccgauggaaugauuucucuuguucuuuaccgagggcuuuagaugcucuguaaaccccgaggcaccuggcagcuacuuguaaagcugacuucauaugccagcuuuuaaacaaaacaaagcaacuuuauuuauuugugcgcugugcgugcaccggcauacauaccauaguucacguggaggaaggaggacaaccugcaggaaccaguuaucaccacucacaguguagaucaaacccagguccucagacugccuuggaggcaagcacucagccgcugagccguccuggugccucucccgccaguuuuggcuuucuuaaccacacuguucuugccgcaccgucccuagggaacagauucuccgagucaagucagaggaggacaagaucccacugcuggucgugggcaacaaguccgaccuggaggagcggaggcaggugccuguggacgaggcccgaggcaaagcggaggaguggggugugcaguacguggagacaucugcaaagacccgcgccaauguggacaagguaggacgaguucuggaggcuucucagaaucuggcuuuugcugucucaagacacagccaucucguuugcuuggcuuuuaauuuuauuucaacucugugugugugugugugucuaucuauguagggguaugugaauguaggugcuuauagaaguaagaaaaauccccuggaauugaaguugcagguagcugugaacugucugauguggguaccgggaacugaauucaggcucucugcaugaguggcacucucuccugaccacucagccacuguggcugcugccucugcuaccacugcccccuucuucuuccuccucuucuccuccuuuuccuccuuucuuccuccucuucuuccuccuucucuuucuuuuuucuccucuuccuucuccuccuccucuuucuccuccaccuuuuuucuuuugacagggucucguaccacccgcagucugaccucaagcuugguuauguaggcagugucacaccugcagucugaccucaagcuugguuauguaggcagugucacacccgcagucugaccucaagcuugguuauguuggcagugucacacccgcagucugaccucaagcuugguuauguaggcagugaugacuuucuaguccuucugccuccaucucccaagugcuagcauucaagcuuugugccaucacaguugacuugucauuuuucuguuuuccuuuuucuuuuuucauccuuuuuuuuuuuguuuuguuugaaagucucacacaggcuagccuagagcuccguaaguagcugaagagacccuugaacuugugaucuuccagccuccagcccucuaccuuccagcacuggaaugacaggcgggcaucauagcacccgguuuaugcagugcugggaauggaacccagggcucuacacaaucacaugaccgcccugugguuuuucuuuuacaucagaguucagaguguuagcacacaguugaaguaggugccuuacagcugaacuucacgccguuuucccaugcugugcugugggcucuuacuucacauccugggcuugugaaaucagugcagagccagggcaggcagaacagaagggcuaugucugcacccaguuaugcucggccacagaucugucuaccucuucuuguucucaguucacacuguagcccaggcuagcgcugugggaugucacucccucucuuuguacccuaccaaggagagcuguuugacuagcugguucuagaagagggcugaguacucucaagggacauucggaggaccuggcuuuaagagcuuggugcucucuguagccuggggcacagugaguuguguuccaucgucagcuagauuuugguuaucaugugggccccagggaauugaguucacguugccagguucuuauccuccaccgcaccaugucccugguucugucugucugccugucuucugucuauguguguaugugugugucuaucuaucuaucuaucuaucuaucuagacagggucucauaugcucuagacugaccuguagaucucguguguguguaaggagugcuagaaacacagguguggaccguugcaccugguuugugggugucaggguggaccccagugcuuggcaagcccucucccagcugccguaucccagcaucuuuguuuucuuuacauuguuaucugaacucucacguugcuucuuaugaugcucagacuucuguuccuagcugagggaaauacagagggcauccagguauagccuuagucuucucuggagaggaggagggugcauguuugagacaagguguagugcuaguuguccucugccucccacacccggacuaaggcuuuauguuuuaaaaccaagaaggcugucuggucaugguagcacaugccuuugaucccgcuacucagaaggcaggagcuggcagaucucugugaguucaaggccagcauagucuacuuaaggagaccuugucuaaacaacaacaaugaaacaaaacacagacuuuuucaguaugaaaaugcugacguuuuugagaaggcuggagucagugcucugggaucucauucuggggcggggugcacaacaucaugucccccuccucucccuggacaaccuuugaccugcaggaaaaacccagcaggaacuuguaacagguaauaaguuuuuuucaguaaacacuucccuucagaaaggccgcggagauagaugcccagcccaggaucagugugggccgcuuuugguugaaugcuccacaggccucccugccuuuuaucacaggaugaaaccaaagucugugguuuggacccagggcugugcuagcaaaacgggguguagacaucagccugagacacuuaggguucccuucccuggggcugggguucauguaagcucacaugagaggcauaacaggaaagcagucuuguuuugcuucauuucugaaacaguaauuuauaugcccagacuaguuucaaauuucaaauuuguuguauagucaaguugaccuugaacuuugaaccuuucuagaccugugacaucacacaugacuucucucucucucucucucucucucucucucucucucucucucucuuucucucuguuaguuuuauuuuuuuuuucuuuauugaaaauaaugacagggucucuucuccgccaggcuaaccucuagcucaguauguagcugaggaggacuugaacucccgaucuuccuaucucugccuccuguguucuaggauuacaggugugcaugccugguuugugcagugcuggggaucccauccaggggcuuguguaugccaggcagcugcucugccaccucagccccagccccagccccagccccagcuuuugcuugcuuuucccuuugguucgucucugagaaucagcgcagagauggcggagauggaaaagcuaguguucuuuguccugcuuccaguucugugggaaaucuccagugugucuuugcagggagcguauuuugucugccaggguuuaaucagucccuuggcaauugcuggucgcagagggugaaacccaaaccucacugacacaugauaacgcccgucuagauaauucgcaguggcucgucuuucuugauaacauucuucuuggcagugggggguggaaauggggguguggggcugagguacgggaggaggaacgcugugauaagacuucacuuucuucuuucucccagcucuccaguucaggaaccugccuuccucacuccugcccccuugcuuuccuagauuugcccuugguggcuuucaaaguaggauuuggggaggggcaaaucauuuauaaugccauuccagccuuuguaguucaacaagguauggugacgugggacaaagcagagauucacccuuuauuucuucucucucucucucucucucucucucucucucucucucucucuguguguguguguguguguguguguguguguguguguguguguguguguguauacacauguucauaccaucaggucauugugcucaguggcaggggacucugccugaugaggcugcccuucaccuuucuuggaaauaggaggcagacacucacaggccauaucccuucaaauguuugaauuucgcacaccauuucaaaaaccaugcuugccaaagcacauuucacccuuaguauauaauuaagaagagauccggcgacggugacaggcucuuccuguccaugacagcuguguggaaaggcagggcucuucugcugggagagaggaggcucucauuaaagcggauucuuacugcugucugucgacgccuugcuguuuauucgugaugcuuuguuuguaacgaaacaggcucauaagcauaagcuugggggcuggagauggacuuauugauagaacucuugccugggaccaucaucagugucacgugaccuagcccugggaugcguaggaaagccaggaugcauggccaugcacagccaguugaggccagcuugggcuacaggagagccugucugaaugaauaaacgaaugaaagaacgaacauuuggacccuguacauaagaguugagugcaccccaccuccuuauucuuuucucucuuccucucacuucuagguauucuuugaucugaugagagaaauccgggcaaaaaagaugucagaaaacaaggacaagaacggcaggaaaagcagcaagagcaagaaaaguuucaaagagcgaugcugcuugcugugagcgggcugcagacugacgcagcagagugggccacacugcagcgcagcgagccggagguggccucccagcuggcuccccauucgcucuccacaacugcauucacuaucacuucuugagaugggacagauauccgugcgucaguggcuggcagaagaaagacgccuuugucuguguaaugccucuguuaacuuugccaggagcuuugagagucugcccucucccacccuuccugaaccaugaccaccaccagcucuagggucguaauguuggagaucaggaauauugguugugaugacaagaaagagcccacuuacuccuccucguucuaggacacggucaucuuuccuuaggaaauuaaaaugcuucauauuaucugggcaugguggugcaccccuguagucucagaacucuagaagguaaggcagggaggguagccugagcccaaggccagccugggcuaccuaacaagacccugucucuaaaagaaaaaagaauuaacaucuuauuuucuuagauuuuaagagagagucucuggcaagaccccccucaucaguucuaaucauuuuagaaguagacagaaaaaaauaucuaagcucagguaauacugaaaaagccaaaauguuuuguuucguuucuuuuuuuuuuuuuuuuuuaaagauaaacuuguguaguuuggaagcagauuuagaaagaugaacuucacuugggccagauaggcugaaccaagcuuccuggcguuuguagagaaagugggacgcuguucucuucauauuuaaaugccagccaggugcuggcugugggcuuucccuccucaacacccuuauuuagaaaggaaacuguguggggggagaugcaggccugagccccauagcgagcuugccuuuucugacugggucuucugguccccccuacaccagccauaggccuguucuuuuucuuccuucugaaaacugugaccaguucaaauuaugacucagaacguagggccagcaccagcuaccucugcagacucccagugacucucucuucacaagcagaugaagggaaggcucagaagggcaucuccuguagcuccuggcagcugguucugguggcacugagaugagugccaccagaggcucacacucacucucuguugagcuucuucccagggaaggggauucugggacagggggcugccacuaagcacacacacuccuccuauuuuccagaagugaacauuucauguuuaggugccgaaugugaaucuggguggggagagcgggagcccuucgaauggauuuuuuuuuucuuuuuuuacagagguuaugggaacuaaggucugaucccuggaaacugaucuugugucacuuccaaagaaucaugggcuuuuucgaauaaaaaaauuuacacuuuuca

SEQ ID NO: 12059 - RNA, 24963 nt, Mus musculus
aggaaguaugauaguuaagagccugggacuggguaccccacugcucucagagaggcaggaaagagaccuucaggcucaagaccaucaccugcuuugccuguggauccuggggggccccauagcuaccaggaucuucuaggcacugcccaggauugacuucaaggccugaaucccugggggugccacccaguuccacaagucugcauugcccugcaacugagauaggagauggggugaguguguagugucuguggaggagggugguguggggaagccaguggggcagcuucaagucaauacucagcugaaugcccgaguccuguguuuuucuugugguugcugggagccugguaguguucugcacucccucugugggaaaacacucucagaacggacugcuuggaggccagugaggggcagggaccaugauggcccugagaagaaccaugauuggccaaaaaaagcuccccuccugggcucugcuucucaacaugcugaugcaaagcugggguucagcuuugggggccucuacuggccucugcuugggaucuuuccccuggggcccaaauaaccaggagagguuuccagaacagcuggaaagaagcuggacaccgcccccccccccccucugcucgcuucaagaacuguagggaaggugacaacaggaacaaguuaaagggcugggacugguggccuuugauggggcugagaaucaaacagcacagcaacagcacgaaggggccucucauccacccacccuucucuuuccgguguagcucagcuccuggacuugccccagacagaaagcaaaacacacacuugccagggagagucuuugccugauucugagccacuuggagugcagguauguguaucugccacagaggagcccccgaggaggauaggagucugugggcaggcuggcguugacucacagaaggcugcugugcugcaccuucuaugcacagagggucuuggggaugggaggguggaugggaggaugauccagagauaauccagaugugccacaaucagagcuucuagguacagaacccagggccaugcugcccaucugggaugcuguucugugcaccucacugcccgccuuccugacugcagcuaugcuuugccccaguagcagggcuugguugaggaccagccuagguagagucaugaaggugacacaaucugcugcccccagcugaaggugacacaaucugcugcacccagcucccaagacugcagccuuggccuccacuucagugcccugucugagccuugcauugggcugacuccucagccauacagagaagcauggacaacucguucauguugccuucagaaggucucaucagcauccuuaccuuugccuaaagcaaacauguguguguugucugaaacuggggugugacuacugaucucuuuaaauggcuucuggcucaaaagcuuacauucuccaaaguuugcauuuucuuuuguuuuuauuuauuuacauuccaaaugcugcccccacuucccagucccuuuacuccaucccccuuccccuuugccucugagagggugcuccuccacccauccccuuacacccacuucacauaccccaaccucccgcaucuccaugcauuuuuaaaucagacuacaagcugggcuauagcucacuugguuuguaaagggcaugcuuagcuaccaugcaugaagccaaggauucagcccccagcaccaaggugauaggggaaagugguacacacucauaacccaugcauuuaggagguagacacacaaguucaagaccauccucaauaccagugcaggugucuaggcuacucugucuuuaaaaaaaaaaaaaaaaaaacaggcagaaagaauggagcugggcauggugcaugccuuuaaucccagcacucgggaggcagaggcaggcagauuucuaaguucgaggccagccuggucuacaaagugaguuccaggacagccagaacuauacagagaaacccugucucgaaaaacaaaacaaagaucucagaauggaaccacuuuugguuugagcaccagugcgguccuagagcucugucugaugggcgcagcuuuauuucaaagcauuuuagggcuggggguccuucuuaugcuccugccucaggcauccccaaagaccggcucugggccuauuuuucagacaggcagucaguguaacuuuugagacuucacuuucuggaaccguuugcuuuagaggaaccagauuuugaagagaacgggaugagcacaaagauggggagcagaguuguggaggguuucagaucuucccuggagcucuagagcccuuggauuugaugguuuuagaucuuuacacucccccacaucaucuacuccucccuuucuuccccucccauccuuccuccuuggcugucucccucuaguaaagcaaugagcaaggccugguggccugauguuaguucucagcaguaggaagucaggggccacaaaagcagagaaggggugagggcuccaggcucauguugcaauccuggagauuugugguagugugacuggaucugccugaccuuugcugacccagggcccuuccucccacacugugucagcuuccugggacaaccccaggccuggaugcaaaaacucugaguccccagugccugaaagaggagacagagaaaggucuguuccuguaaacuggccuaccucugaaggguucugggagggaccuggggcacaggacaaagagaagucaguccccaaggguagaacagaugcaagcuuggggcccagcagaccccccacccugcugcucuuuugcuucuuuggggggaaguuacuuaaccuuccugagccaccgcuuccccagcucccuugccugugcaguggcugcguggagcccuuuaugggauggucuuggcuggcuaucagugucuacugcagguaagacaugggacucuaggaccccccacaugguuguuuguuuuguuuucucaggaagaagauagccaagcccaggagaugcagaguaccacuaacuaccuguggcauacugaugaccugcuagggcagggggccacugccaguguguacaaggcccgaaacaaggugacagcaacucuggccccagacccuuucaugcccuggagcuaggcucuccauuugggcauuaagauucuauggagcuggacagaguccugggacccuuauuucugucaacucugaugagaaaaagacuccauagauuugggcugaggugugggaugcuggaaaaauuccuuggaauggugccucugucagaggcauguugggacuagagaacaaggcaagagaggaggugacagcaagugccaucuaggaacagcagggcugggaguuugggccuguugggguuugucccuauaguggcuguagagcugugucagaaugcacacacggugcucaggaacuggaggcaggggagacugccggggcaguucuuaucuaugacaaaaugagcaagaacacaagucgacccuugagggacaucaggugugucacuuccaagcugcucgagcucccuggguaggggagggggcugcugaugugagcccacccaaccccugcuucccucuggggcuggguugggggagaggcuaacgagaagaaaagauugcagcuccucaauagggguagguucccggcagaggugguccccauugcuuacucucgcccugugcccacgcuagaaauccggggaggugguugcuguaaaggucuucaacucagccagcuaucggcgaccuccugagguucaggugagggaguuugagguccugcggaggcugaaucaccagaacaucgugaagcuauucgcaguggaggaaacggugggucgucugccuggucagagaugaaugaauguucuuaccuugaccuucgaaguccagggagaggcaagccaugcucaucagcaguccagaggcauugauuggggaagggcacgggguggggugggggaggggaguggggggugggggugggggugguggagggaccaagcaccacacucaaggguguggaaccacacugggaaaucacuggaaaaggaaacuggaauaagugcccaaucaaagagggcuucucggaaaagguugucuuggguugguuucugugucugagaugggucugaggcgcgagaagaaggccaagcaagaaaccggaaaugagagcugccagccucuagguaggcaaccuccagacagugggaaguaccuucuuccccaaccccgccccccgccccuugucccugcacagggaggcagccggcagaaggugcuaaucauggaguacugcuccagugggagccugcugagcgugcuggaagacccugagaacacguucgggcuuucugaagaggaguuccuaguggugcugcgcugugugggugagccaugcccugcccccgaggcacaggcccucuccauggccaaaguccaggaugcgugugaucuucugaugggccagaaggauccacgugauucauucaguucaaaguuguaugaagaacguucuuaaaaacgguguauuugccacagcugaaggcagguagcauccuucgcuguaguccacgggugaagcagcccaacaggauacaaccauggugccugcagguggcggcguauagcugcgcagaggagggaaaucuagcacccugggcagugugaaagaaacugaagggcccuaugcugaggaacaagcuagcugcagaaaagcaaagcccauacuuccacuaggauucagccccuaggggagccccaaguugucagaggcacagggagacugcugugcagggcuggacgcacagaguaaggagugcugguuaaucagggcaggaggagaaguuuuuggugagaagcauuggggauguuugcaugauaguguaugaaugugucuaacgcuauugagcugucugcuuaaaaauccacuaaauugaagggccgcguugcuugcuccccacccacucuggggggggggggugcugaggcaggucgaucaggaauuccagggcagccugggcuacauaguaaaacacauucaaagacgauuuuuuaagugauacauuucguuagguauauuuaaccuccccaaagaacccaaaugagucuuauauucugaugucccugggacuccuuccuuguauuuauuuuguguguaugaauauuuugccuauauguacgcauguacacugugugugugccugauaaccucagaggccaaaagguuucagaucccaggaccuggaguuacaauggcuaugagccauggcgugggugcuggaaacugcacucggguccucaggaagaauagcaggugcucucaacaaaaccaucucaccaccaccuuaaaauuuuauuaaauuaugucuacuuuacguauaugaguguuuuugccugcauauguuugugugcugcgugugugacuggagccugcagaggcccgaaaagggugucagaucaccugggucaacuggcuccaguugugagaugaccugggaguggggugagaauuggaccagggucgucaggaaaaauggccagugcaaugguaaugauccaucccucuagcuuggaaugccccuccuuugcccugggggggggggcaucucugaucuccuucuuucucugccccugaguuuccuuguggcaacucuuuauuuggauacuuccccauccuuagcugagccaagccauuagugcucugucuauccccaguggcuggcaugaaccaccugcgggagaauggcauuguccaucgggacaucaaaccugggaacaucaugcgccuggugggcgaggaggggcagagcaucuauaagcugucugacuucggggcugcccgcaagcuggacgaugaugagaaguuuguuucugucuaugguacagaggaauaccugguaagugacauguuggugacccuaugcccucgcugugugccuccuuaagagucccccuaggagugcccaugcugucccuccauagccgcuuucugccuuucuuccauagcacccugacauguaugagcgugcagugcugcgcaaaccccagcaaaaggcauuuggugugacuguggaucucuggaguauuggggugacccuguaccacgcagccacaggcagucugcccuucauccccuucggugggccccggcgcaacaaagagaucauguacggugggcuaugggacagggaaugaagaggacuggcccugagugucuuccagacaccuggcccucccuccacugggcccuaccuucaguguucccucuagcccugcgcccauuccuagcucacugugucuccauuaaggcuuagguuacagagccugcagggguaaagauggagcugguacccagugucucucacugacugcuaggaggaacuuaagacagaaguugccaggauguacuacacagaacaaaagagaugaagaguccagccagugaaaugagggaccugcaauacgagggucuacugagcuguuauugagucuguguaggaaagaggcagcaaaucuugggacaaauucccaagguucuagcuggagggcagcaggaaaaauauccacuggacugaaugccgagagcucauuauaaauaacccuuagggaggaaaagcagaaacguauguuggcuguagauaaugugcaguugagagaagaggguuucaggguggcagggcaguccauaagcacugugucugcaccauuggcaguuaauugucuccagcgguuauugagaggcgggguaugguggccuuggaggucagagguucuggggucuacagcaagcuugcagcauaugcacaggaaugugaaauuguuccugguugagucccucagagcuuacaaugguuagcuucucuuuccuucuuagucuuguaauaaauggaagacaccucaggaagguguuacccguguguccucaggaagguugguguaugcucccucgguccuggggcaagcuguguagagccaaugcuauuagguuuagggauggggucaggaguuggaaugggaugaacugccagggaaggauagaucagaggggcaguuagaaaaguggagaaaacauauggugcugagcuuguaauggcacagauguggagguagcuagaccugguguagccauagcaacagcgagaagggcucugccuaaagcauggagcuugccuaggcagaggugaucucacagguggagcagggugccagcccaccguacaguggcugagugacauggacugugauguuuggaguuuccuguuuaaauaugaugggugggugggggaggggucuagagcccugauucugccccacuacagguacagaaucaccacagagaagccagccggggccauuucagggacucagaagcaggaaaauggucccuuggaguggagcuacagccuccccaucaccuguagacuguccauguaagugggaggggcaggcuagggaucgcuucuuucugcugagucaagagugccaagcuaucucagcagagccccaggggccuccacuuuucgucuguagccuggggaguuccaucuagacgcuugggccccggcucugacaguccucgugucuucugugugcaggggacugcagaaccagcuggugcccauccuggccaacauccuggagguggaagaggauaagugcuggggcuuugaucaguucuucgcggagaccagugacauucugcagcgaacggucauccacgucuuuucccuaccccaggccguuuugcaucaugucuacauccacgcccacaacacgugagugggagcaagagagagggggaauaggagucuucccugucuaagcagugguguggguccaaggggucaucucccaaaacauaucuggggaaaguacuaucuccaucaaguucaaggcaaacagucuuccuuguuuguguuccgaaucccccacucuucccaaugcuagcuggcacugcuugucccagaggcggggugcucaauuuccugggucuguaauuuguuguucauagaacccuuuucucacuaaauucuuggccuuugcuguuuaagacaggaucuugcuggguagccccagcugauaaacucuccauccuccugccucaguauuucgagaugggaugugccccccacaccuggagcacucuaugggauggggagaauuuguugcaguacagcaggguugggcauaaaggcagagguuaggcaucugaacucugggguccucuucccauucuucauggggaguuccugggcuccgccuuucuucugaagccugggaaguuccauuuagaugcuugggcccuagcuaggacaguucuugugucuuguguguguagggggcugcagagccagcuggugcccauccuggccacacccccacacagacccuauuggagaaaagcugagccuucccauggugcccccggacagaauucuccucucacaugugcaggauugccaucuuuuuggaggcuguauaugagcagaccaacgugacccccaaacaccaggaguaccucuucgagggucacccuuguguccuugagccaagccucucagcccagcacaucgcccacacagcugccagcagcccucuaacucuguucagcauguccagcgacacaccuaaggggcuggccuucagggaccgugaguagggccacucaggcugagucuuuuauacucuggacacccucccaaaacacgacuuguuuucuuagugaguguuucucuggcccauagaguagagcauauuuggguuuggauucuauacaugccucuauguggccacgugacuugaguuggugacuagacuuccuuggguuucucccagauccuccaacagagacagggcauuuagagccuuuauaccuucaucaguuucggccacugguaggggugucuuggauauuugaguugaaaggagcaugaguccaggcugcugggaaaaagggcuggaggacagagacauagauuuucuuuccuuaauuucuaggauaaauauuucuucuccuuuggaucaugcucaguccuccuccgaggugagggagugagcuuuaaccucuccagucuuaaggcagggcuuugaacucuggaguguaguucugggauguggccacaagguggcgguaaauaacugcaacuuugaggauccacagggucgacguuuggggaugcuuuaaaugggagaucagcagcgacugugugcuggggacaaggaaagauaaccuaagaguugacccagucuuuaaaagcaggccccucagacagagucuuugucugcagcugcucuggaugucccaaaguucgucccuaagguugaccuacaggccgauuacagcacagcuaaggugaggggccacccccaggaggcagaaggggguuugacacgaggaaggacuaauccugcacaucuguacuuuucagggggugcugggcgcuggcuaccaggcccuguggcuggcgcggguccugcuggauggacaggcguugaugcuucggggguuacauuggguccugugaguaccgugaagcgcuggaggagugcauagcaaacccguccagacuucuccuaccccuuuccgaggucacgccuacaagcgcagggcccugguggaggcgccucugacuugggcugcccucacacagggaggugcuucaggacacgugccagcagacacuggaggucacacggacagcccuccucuaccucagcagcagccugggcacugaaagguggguguuccaccuaggccaacuggggcccuucagcucuccucucugcuccuuaccccugagauguauaagccuucccagccagagcccuccugcucccacucuuccccuucccccaacauuagcacccucaccagguccuucaaaccuuguauucccaaauguauauccaucccuggccuaguccugccuaucacggagaaauccaccggggcccugccucucugggaucgagggcagucggguaagggcagucucacuacccucaaaaggguagauacccuuucaugucccagaacaagcaggcccccuaccccagguaggaccuuaauucaccaggacucugaaugauucgugacacucguucugugugaagccucccagagaauucaggggaagaacccauucccagguucugucccugcacagcagcgauggaaauucagacuguuucagccucuguagcuuuugcucauauuucagcugggucuuccacuuguccuugccuucugagcugaaaagaaggagcccgggaaggaggacgcuaagcuagugaaggguggagagagagagcaagggaggauucgccgcgaucaggagaacaucaccggaauucugaaaggcuguaguguguccgugaugagagaccggaguucugcagcccgaggaaguuuuuccccaucccaauaacuugagccuuucccucggaaguacaggaaguuucccaggguggguuggaugccugugugggcccagggcuugguuaaaacaaauggugagaugaugggggagggaggaaaaagagcaagaacuauuuccagucacgugacaggauuggcgccaauuguggugggagagguuggaagccauugcgagcacuccuguuggauauccucuggccauugcgagcacuccuguuggauauccucuggccaguccucuggccacgacagagaugagaucuguguguacaaugugacuucugcuccacggaagggccugugcuugccaguccuuccuugguacaugagccuggggaaggaagggcccucuagaaacgggagccaagucaccgagguuccgagcccacaaagccuagguugauagggggaugggaggaacgugugaggcacauccuggagggaagcuagggagagggguggguggggaaguguuggaauacuggaggggccaccucuagagagguugguagcaagaaaauaaccauuugugguccuuugugaguucucgaucuggggagagguauauagaggaauguguggggugucugucucucccuugcccuggacugacagccuguaggagacaggcaucaggagcugggguuuccacucugguuccuaggcucugaggccagugggugucgguuguaugaaggaggauagagaacagaggagccugcagggaccagauguagcuugcaggagaccaugggccaucuguaccuucccuugccuggccaauaucuaaagucuccucuguaaucccauucuuucccagacauccucagaccuguagauuucucuaagccuuggagucuaagucaucuacaucgggaugggaacguuuucaugaguggaaugucaccuuuguugcuggaggcaaagugauacuuccuucccgucugaucauccuuucuugcuucagagugcuuccuuagcaaggcgggcuuccuaucuuuuauccagagggucuccagcuggacagaucuggacaucaggccaggucucagcaaucccgaggucuccccacuccucaacccccaauaauauaaauucacucccauaacaagccaauagucacacauaggauaacugcuaugaaccccccagagcuuucuggcggguaaagcaaugcagaguuccugccuucauagaggcucugguggacuccgagacucucuguucaccucuuccauccuucucugauccugcacuuccaagcaaaaagauacaggauucuuucuuuaauuguuaucaugugaagacuaugcugacauaugccuuucauccuaacucucaggagacagaggcaugagcaucuuugagagcagcuuggccugcauagugagcaaguuccaggauauaaggauacauagagagacguaucaaagaaagagagaaagaaaaaagaaaggaaggaagaaagagagagagaggaaggaagaaagaaagaaaauaugguuaugucugcgaggggaaaguggacagcaggcccuaccccuaaacaaaaagcuauuugcaguugauacccucuggcacagagaaaaucaguuccacccagcagaguaccacugggaguaacgaccacucuacagaagaccccauggccaggaggagcugaccaacauaaaaugaaguccaugguuguuggguucuugggggaaaggaggcaagacucucuuuuauuuuguuuugauauuuguccuauugagauuuuuguguguuuguuuuuaaagaaggagaaaacagaaaguuggguggguagggauacagggagggccugggaugggagaggggaaaagcaugaucaaaauauauuguauaaaaauuuaaaauaaaaacagagagggaguaauuaaaaaggcuacaugcugguggagaaagucaggaaguggagaaggaccucccacccagacacgaguagucacauagcauugguccccuucuuugucugucguguguguguguguguguguguguguguguguguguguguguguguguguguaaacugucaccugcauucugucccuaagcauguuauaaccugcuuuccucagcaagugagcucucuucccucaguacaugugugugcauguguucuugugcgugugcuuuguaaacugucacccacauucugucccuuagcguuuuauaaccugcucuucccauuaagcaggugagcucucuucccucaguacguucacaucuccucuguaccaugguuggaaauuuucugucacaaauugucccacaauuccuuuuuauaguuuguuuuguccaaacuggaaaccaguccaagacuacauuuugugugugguaguccuguuccaugaguuuauuaagcuauucccuccgcccucaccccacacaccccuugucuucauuccucuggcuuaggaaagcucccaguccacugccccacccucagguucauagaacauucuguugucacuuggcuucuucuuucccagcagcaucuuugggggcuccucagacuguuggacauuuuguguuagaacacaccaucaaccaugcugaguccuuccuggguacacaccacagguaguggucaugugauuucuguacuguguagguguauuuuuccugcaaaagaaccaggguaguguuaccuugacaccuugaagauauacaccugucaaucauucuugguugaguugccaaucauuucacggggcaguggaauguucaugguccaaguccuggacuauuaugggcugguacccucccaucagugugcuacugguugucaggaaauauaguuucuacugaaaagaacuucauucugcuuaguucuagaacuuucuagcaagguguuuucuaauagcuaccuugcauuguaggcuuguauauuuucaugaauuccgguguuucaaccuacuucaacuuucauucuuuacaaugcucaacaauaucacgaccuugguguguaaggcccaugucaaguugguucuucugucucaaacccucagaaagccaacaagauugucacaaagaagcuguguguggguacagaauccucuaccuauucaucugccuccugaacccccaaacauagccuuauccuuauuuccucccacacccagguucagcaguggagcggggaugccugacguccaggaacgaaaggaggccacagagcuaagaaccaggcugcagacugugagugaagcaggagggcagagcuuuacaggaacaagggguagggagagugggccugcggacugcacagccuagccuugagucaaggacccuacaggauucucucuuuuggccccacagcucucagagauccugucuaaauguucccacaaugucacagaaacccaaaggagccugagcugucugggugaagagcuuuuaaagaaccgggaccagauucaugaggauaacaaaaggucugugagauccccacugucugugugaugaugcuguggaggacgggucacuuggggggugcacaguggucccaaaggcucagcagcuuucucugagucagucugauugcucucuucagggacagggggcuaaggugugggagaggaguccaaggaagagccaggcacucuccugagaccagcucugggaagaggaccugaguccugcccuaacuggggacuugacucacagggagggagucacagcagaugcuguagcucugcagggaaauccggcuccuuuucucugggugugucuguaaagaggccucgcacuuagagcaucucgcugaaucugacaaacaccagugcugcugguuagcagaugagagaaggcucauucugagagaggaucacuuucucugagucacaaucaauacaugaugggugagcuucagguuagaucuaccccuccccccaaccccccuccccccaagaguuuacagcaaacagggauuuuaaauuuaucuuauuuucccugggcuguaucacagugguggagcacuugccuagcaugugcuaggcuccagguccaauucccaguaccacaugaugguauggauggacggacagauggauggacagacggacagacagacagauauagauaaauguagagagacugauagauggauagauagauuaauugauugauaaaugaugaauggauagauggauaggcaggcaggcuggccacauacguuuaaaaucucuggaaaaaaaugggugugguauuacuugcuuuuagucucagcccaugaggaaggagaggcaggcagaucucugugaguucaaguccagccuggucuacacgguaaguuucaggacauccagggccacccagagaaaccccgccucaaaacacaaagaaacacauuuauuuuauuuuauuauuuuauguguauggguguuuuucauguauuuacuucugucggccacauacaugcaguggcaccagaggacagaggagggcaucagaucacauggaauugguccuaugugaguaaaccaccauuugggugcugggaauuaaaccuggaucuccuacaagaacaaguacuguaaaccacggagucaucucuccggcucauggcuuguagcuucugaagaacccuguuacuguuuucacagacccaugaucuaucaagugcagagccaccgacgcccuugucccauggagaccauggccauugaggucucugcagaucuaaugucccauguccucaguucuuaauucaaauaccucacagaacagucuuguguacucugucucaucuacgguaauuuuuuuugcuuguuuuuuugagaauuuuuuuuuauuuuaaucuuuauuuuuauauuuacauuuuuauaaauuuuuuauuuauuuuuauaagaccucacuauguaacagaggcugaccuagaacucgucacguagacuucgagaggcuucacgagugcuugagaugagcgguguacauaccacacccagcucuucuggcagagucugagcuuguuggguuagccgccccucccccacuccgcuagugugcuccgcaaacccucugugugcacugaggugccuuucuggacucacaaggcaauucugacuucacacacgugaaacuguggcucuacacucaucucaggcgaucucaggcgaucucauccucacggcaaccucucaguaggacagcagaggggcuggcugaguccccaggaacaagcuugcacuuagcccaaacccaggaacaccugaggguaccuagaaaucucugggauggaguggagccaaauaguccugagggugaggaagaauaacggagugcccuaagggaagaaggacaccccagugcccuaagggacacaguuguguccagugugaaaaacaagaugaagagcaguaaugacuuuaaacccugggcugacaaggcccucgagaggccaucuuucaccucaccccacccugccuuacuguuuuagguaggguugcuggauccuucuauggagcagguauuauauauauauauauauauauauauauauauauauauauauauauauggcucuuuuacccaguccagacccucugucucaccugcugggggagaggggaggaagggaaggugagaucuauaauagagacagaaggcuuggucuauauuaucuaaauaaguuuagagacgggccaguuuccccacucccagaucacaugcuaacuuacccuguggcugcugugguguuugaguugucugcuuucugcccacaguauccagaagauucaguguuguuuggacaagaugcacuucaucuacaaacaguucaagaaauccaggaugaggccaggugagcuuugaaaagagccaacaacuagaaaccuuccuucucuuuucccuuccaucuccuuggcuuugcuggagggaggcuuuguuuguugggguucuguuggucuaaggcaggaagagucucugccugcacauugucuguaggccacugagagacauuguacccgagugucaugauagaagcucaggagauguggauacaggauacagugagcuggaguaauguggaaaggggccugaaaagaaacccuuuaguuucauuugguuugguuuuggcgcgcgcgagugcgugugugcguguguguguguguguguguguguguguguguguguguguguguacaugugugugcauguguguguacaugugugugugcauguguguguacaugugugugugcaugugugcacauguguuuugugugugcguguguacaugugugugugcacguguguguguguguguguguguuuugugugugcaugaaugcauguguguuuacauguuguggaggccacagacugaugcuuggcuucuucuucaauugcucugcacuuuauaucuugaggcagagucuucauacuugaacccagaguucaccauucugacuaauguagcuagccagcuuguuuuggggaucuccugucuuuaccucucuagcacugggcucauggguggccacaacaccugcccaacauuccaugggugagcucuaguguccacacauugcaguaacacugcacuuacugagccaucuucccagccccucuaguaugucuguagaccaccaaaagagccaguucaucugggaaugaggaucagaaggaauccccauuagaguuccuggacuaggagauuucuuauguuauugcuaauguccacaaagaccuucugggcaagggcaacccuucauaggcuuaggaaggaaaccagcuugucugaguuggaugaggguggaguagucaggguaaggauugaaugugggaagggguggggacaaaguuggagaagccugggaauaaaagccccaguuagcuagcgagcugacauauuagagcucacguccuguuccacccuaugcuccaaacauuuccauaucugccucauugccuaagguucuucuggccccaggauaaucuauaaagcacugucaggagaaauauaauaucuagccauaugugcaauuuaagcuuucucacagccaaauuaaaaagaaaaaaaugggcaaaaguaauuuaauaaauuuuauucaauucaauacauccuaaugucauuucagcauauacuuaauauaaacaaaaccacuaaagagauauuuuaugcuccuuuucaugcuaaauuuucaaaaucccauguguaguuuauauacuuuauaucucugucuagaagauaaauguucaguaaaugugauaugccuuaacacaauuaaaaagcucuauuuaguggaaaaauuuuacuugcuucaguuuucaauucuacauuaauugaguacauuaaauuaaaaauccaggucuucagucaccauggucaccaguguccuguggucauuaaugaggacauggagaucuucagaacaugucaucucuuuccuuuggggccuucccugggauccuggccucagagggcaugggaaaggcacaucccccuguccuuggaagcggcaggaugugggacucagccaagguguugugcccagcuggccacugcuguggcuuaggagugugaggaaguucaguuuaccuccacgucuggaacaccauauucucgccaccuaagcuuuaaagccucgccuugauguuaggcaccaaccuaaauaggacuccauaagucuuugaauuauuuagugcucauaaaacucuaugcacugccgagugugguggcacacaccuuugaucccagcuuucaagaggcaaagacagguggauaucugugauuuugaggccagccuggucuacauagugaguucaaggccagccagggcuauguagagagacccugucucaaaaaugaucaucaacaauaauccucucugugucacaauuuuccucauuuuauaguuuaggaaacaggcacagaacagcuaguuagugcaaucauucugcguccagcuucuuuuaaccaucccauuucauagccucaagagugucuauauguacugcucucacagaguauuuuauuagaauguggacagccccaggugccaggaguguugcacgcugccauucuggaaggcugcuccgcaggcuccagggcacuccccugugauccggauaggcauccaugugugcacacgacgguuacccgagccaacucgcuuguucacagcugccuggugcuaggagguagagcuggaguguguucagguuccucggccuucgcuagugcaggcccaggaagaggaccccacuccugggguggugggaugggaaaguggaagcgcaaaccagaauccucuuaauccguggcucucaaccuuccuaacgcuacgacccuuuaauacagccucccagguugcagugaccccagaccauacgauuauucuuguuaccacuccacggguguaacuuuaugugaauaucuguguuuuccaacggucuuaggcaacccccgugaaagggcagucauccccaaaggggcugagacccgcugcucuuaaccuuggagcuacugcaacuugggaaaccaauuuccucaaagcccagcagggggcagucucuccucguugcaagagcuuuaaggucgucggcaguagccucgaucuaggcacgggcacuucuacccaaagcuguuccuucugaaaaaagcugcugggcaaagagggacaguuagaaggugguggccuaccugugagagacuccagggauggagccaaccagcugccagcuggggaggguggaggaugcagggccgaagcuacgcuaacaucucacccagcguucccaccugcaacaucucccguacacacacccgcccacccagcaagauucgccucgcucuggagccccaaagcauuucuccucagcuccuuuuuaccaaaauuauauucagucuuuuguccacaacagcaguguugucauaguuacuugauguuccauuuccucauccccgcgggcuccccuaggccugagaucccauaaaaugguccccacccuaggcuguucuucaucuuuuuaacuugguucccggacuaguugaguggugacgccauccccaucuguuuccuucagggcucagcuacaaugaggagcagauccacaagcuggauaagugagugguccccuucccaucaggcaggugggcaggagggaggagcucaucgggauggagugaaucuuuauucuaggugggaaauagugaagcacuuacccuuggccauggcugggugaaggucguaacuauccgagccuuguuauauagggucacagcugagucagagguuucucacaaucagccuugaaguaacuggcuuuauucccagcaugaacaaguuuauaggauuuuucucucuaauuauucucacugauugguuccuucccccucccugcuuuugaccuuuugaccaugggccugccuagcaucucauagauacuguuucuuggacacccacaucuuccaugaggucucccuggucugguggcuauuuggagauuuuuuuucccucccagagcuauagcaccucuaacuccuacaugcauacacagacacacaugugcacacaccugugcucuccagggcuccguguccuuauuuucucccagggaucaaguugagaguggauguguucauuaaccauuguauuggccuccccugucuccuuauugguacacguggcuuuuucuggccucugggcuuuaggacccaaguguauggucauccucucuucccugagaucugccccugcuuggggcagaggggugguggaugggcuaagucugcaugcagguggcucuggcugcucaccccgguccauggggucucuguccuuccaggguaaauuucagucaucuagccaagaggcugcugcagguguuccaggaggagugugugcagacguaucaggugucgcuggucacacacggcaagcggaugagguaagcagccuagcccuuccucucucugaacucaaggagccugggcuggcccaggguuuccauacuacagaggaccuugggcuaggcuggcccagcccuuccagacugcaaaacaugggcucugcucaguaagagaggaccuagugagaaguauagaaacgguggccggucgaaaugcugggugacuucuacaaaugugcuuuuucaguuccccaguguucacacagccagugcuaccaucuccuuuuucagaugagaggacccaggcucaaaguacuggucucuccuuaaugccacagagcuaauagguagcaggcuuggggcuagaacauaggcgaggaugccccuaaaaaaucuggauuucaccugcugugcugucugucguaaugggucucuucucucuagggagaacagcagcuccccuggggaggagaaacagggaggcagggaagcaggccgggcaguccccacuaacacuccaucccucaaauuugggacuccuuuuucuaacaggcccacggggccccugagaaggaaggucgguuuccucauaugcuguguagccugcgggccugucaugggcucaguuccucuccccucacucuagaaugcaaugccuggcaauccccgacacucugauuugaugggccuaggcagaucuuagcuaucagaucaguaguuuaaaagcuaaccccauaauccuaauguguauccagaguagagagcucacuguuggcuuaauggaccugggacuugauuuccucugugcaauggggaaaugucccuccuugugugcguuccgauuugaaguuagaauucucaagucuugcccuuacucuguuauggaaacagaggcacggacacuccccacauaaaugcucuaguguggccugucauuacucacagagaugcacuagccuggaaggcccucucucucccaagccuugccuggcucuguuugccaguaaccacaugagugacccagcuacauucacacgggcaguguuacugaucaguugggauucucucaguucccucagcauggcaagagagagagagaugggugacucccagaaggacaguccuagagggagcucaaugcauaggacucccugguaagcuaaugacaccuugucccaacgguggagagccguauccugcucuaaucucauucucuacucaaggcaggugcagagggcccagaaccaccugcaucucauuggccacucuguggccaccuguaacucggaagcccggggagcccaggagagucugaacaagguguggggugcuuucagaguucuaggggcugccgaggggaggggcaccuggaucacuuccugccaguggacagagcagccuugaccaaauucagggaugcccaugagggcuggaggucucugacucaccugagaugugagugcccucagauaggaacauuccuagugauuucagacugagggucacuauaagccagggccucuuucucggguucuaugcugccuuggaggucucaaggcuccuccugaggcugugcgaucucuucuugguuuucugauucacucucagucaaggcagcugucuagcuggccacagggaauacagaguggggggcggggggaggcuuccagaagauggcuacacguggcuuccagcaagcggggugggcagccucggagacuguccaggaauggcauccauccaaacuguggcucaugagagguuuagguuagaccuaauggggaacuugccaaaacugaaucauucuucucagaacagaugaaggaaagcuguuagagcaguggggacucccaggaugggaaggaaugggaugcugaaagacgggguaguucugggagcccuagggagauagcuacccuccuucagcaagcauguccccuaaccagccacacgaaagcuggcagguccuuccugacuaacccauggcuucccuucagaucuuugaucagcuccuucuggacagagcuuccgaacagggagcugaggugucaccgcaaccuauggcuccucaucccggcccugauccgaaggaccuggucuuccaguaaguccuggagaguuggagggaaggaggaggcugagguuaaaaccucguugcuucaucccaugccaggccaaagaggcugcuccagggccucugcaagugggcucuggaccaagugacccagggccucagccaucccuuucuugugccuuggacagcaugcaggagcuuuguaaugauaugaagcuauuggccuuugaucuccaggacaacaaccgacucaucgaacgguaagcaucuacugugucuggggaaggcuguguccucccugcugccaagcugcaagcucagggcgcagagucccugggugccccaugcaggauccaugggaccugcugauuuucuaggcaaccacaauggaguguaaggccucauccacaagcaggguaccaucuugaggagcuguagauuuaacucauaggguuugaggcuagcuagccucaguaccucagaguggaguuuggaggcauguggacuugugucaggguggagagaucugcacugaaugugggcaaugugccuaagacuuucucacaccgucucuaggauccucuaagguguccuuggagugaaugccacuaugucuuccccugaaaccauggcacagacaaacugacauuuuugcccaacgucuaucuccugccgcaugggcuccauucuucccaccugcucagagugcugaggccgauacaucuccagauagcacucccuccuguggguggggaccagcagcagugcucaagcuuugggauuccaaaagucacaaaagaaaauguggguguggacauacacaccaggauugugaacugccaguauaacccagaaggucugcucuguagcagucccacuguauaaagcaguuuauuuguuagaggcaggguuucuauguagccuuggcuguccuggaacucacaauguagaccaggcuagcuucaaacucagagaucugccuuccucuuccuccugaguguugggauuaaagacgugcaccaccauguccagcuugacaugggguuuugaagccucagagcccaacccgacuggcacaccuccuccaacaaagccauacuuccuaaucccucucaaauaguuccacccacuggggaccaagcccuuaaacaaaugcaucuccgggugcuauucucacucagaccaccacaccacgcuacugugagacacuagauuugcgcucaggagguagagcaaccaggagcagauccuguggccugucccucagaguuuuuggggguuccugaguuggggaggcauccaccauuggaccauuccagcugaggagaaucugucuccuccacagcuucaguccucucgagcaggaaguucuaaucauuagugccaacauaaaucuuucuugcugugauuauagucuauuuacaaauaucucagaacuuugcuuuagugaauuugcacuuccucauucggaccugcagccaacgagcccagugaaccaaucugagccccuuucuggccucccagagugucuucacauuggaacaguggugcuucuaaaaguauaggggucugggggggacuucuccagagacccugagagaggccugggauaggagucuuuuaagauucccaggggauuccaacaugcagagaugaaaugcagaagguaguaucuggggauaaggaugcuacaggaggagagcuaaggaccugauggcuggguguuccugagcacugauggccuuggguaccaucugcaggcuucuucuauggguaugccaagcuaaaaccugugcuuccccuuacagguuacauagaguuccaucggcaccagaugucugagcucccuggggguucacaaggcacucagaagcaauagaaacauucauauuguaccccuacacugugagaccaaauucagggcaaguucugguuccaucucacuagccuaccucccucuuggccauuggccauuggccaacaaacuagcauuacuuugacuguccucuugggaagcagcuaggacagggacuccuggccaucccaggcaguaucuacagaagagaccaugcggcuaccacagccuuaucaagacaccaagacuguucuuccucacccaggcucuggaggucuggucuuggaaagaaaaggcucagcccucucacgcucugcacuucccaggaccagcaggcgucuccuguggcuucuccugccucuccagggugcuggaucagaaugcuuauucuugguuguuuccugugcugcuuccugaguguccccaucccuggccucaggcaacccacaaacggccccucugugcuuggucuagaugcaccugcauuugagaaagugggugguugaggcuaacugcuggugcuuugaggauucuccuugaccuuuucuccgaggaacgcuugguucuaagaaacagcuggucaguaucaaccacagccaugcuaacuggacagauguuggaacccaaaguccuaaggagagagcaggccugcaccuucagacauggaauaaauacaucgccuuuucuguuu

SEQ ID NO: 12060 - RNA, 6411 nt, Mus musculus
uugcuuccggaagucgcuuuccgaggcggccuuccuacucguguggucuuugugacuuccaccauggcguaccgcggccagggccaaaaggugcagaaggugauggugcagcccaucguauccuacgcugcgugaacucggggcuuugggggccguaggcgccgugagcgugggcggggagccgggcagcccgcugcgggccgcuucccgugaggcccuggggcgaacggggaggcaggaaagcgcgcggaguugaagggcggcgggaggcgggaggcggaaggcgggcuccggguggacccggccaggcuggcgauccgcgaugaaagcgggggauaccgaggaggagaggaggaugugggccaucgggaagguuggagaaacgagggcgguggggagggagcgcaugcucccggcggucguuugugcuugcggauguagcccggccggaccuuggggcgcuggagaguccggcgcgguugggagcggaggcuccgcuguuuguguaguucuuuuccuugaucgccgugcugcagaaccuuaucuucagauacuugcaaaauguacguaaguuguuuccuuacuguuacugaaaugaaaguugggccuguuugacucuuuguaacaaauucucuguuucuagugcuuagacuaaaaaauugggggggggggagaaccagaguugaggauaaggucacagggaaagcgcuaauuauuaauauguccgugcugacuuaaggaugcacacaguuaccauuauucuguaagaacaauguaauuauauuuacuauuaaaauuacucuguaagaacgauuugucaucggauuuagcagugacaguugcauagugcuuuuuccauaguuggacuuagaauggagaaaagacaccaaagcgggguuugggggagugggggcguuauauacagagaagcgaguggcaaaugcucuucuuugaggagauuuuagcgauguuuauuuuagaguguuacaacacagaugaaaaaucguuuuaagccauuguaauuuuuaaucgccagauucgcuuuguacuauccugugaacaguucuaacuguaaguguauucaugccagaagcaaaaauaaauuuucagaguaggaaaauuaguuuggacaggccugcccgagcacuuauuaaauguuucucagcagguuaaccaguguugcuagcucuuagaugaagacuaacuaguucuaguuuuuggcuuauauuuauuggaauuuuuaagauaagucguuuauuguggaaacaaaguaauggagugggauuuguuuacauuucuaaagucauuauuuuuauuucagagaucucgaauucagguguggcuguaugaacaagugaauaugcggauagaagguuguauuauugugaguacccaggcuauuuuuccucaaguuguuauuaaaaaagacaucucagaagauggccaguaagaacaauauacaaggcgucaaggacccaacccaaagaaagcucuucagagcuggaguuauuuauuuagccuuuucuccuugcucugguuaauaggguuagauaauacuucucuuaagaggaagggaagggagagguuaggcggugguggcgcacgccuuuagucccagcacucgggaggcagaggcaggcggauuucugaguuugaggccaggcuggucuacagagugaguuccaggacagccagagcuacacagagaaacccugucuugaaaaaccaaaaaaaaaaaaaaaaaggaagggagaguuaagacuuuuaagaagagcuucguuugugaggagagggaacaaaaacaaaaugagaggggggcggggagugauaaaggacuugcauucuggauuagaucaugccagaauagagcuggugggggugagacuuaugguuuguuaggcuucuaucgugaugguguuggggaucaaaguaccugcucuaccacacagcuaccauggcaauaaguuuuuguuguuauuuuagauuuauuugucugaguguuuugccuguguguguuuaaugcccaaacaggccagaaguuguuggcucaccugaagaugggugauugugagcuuccauguaggugcugggaaccaaaccuggguccuuugcaagagcagcaaggaaggauuuguaacuccaccaccucucccgucucuguuuuuccuuugugugaggcagagucuuuuaagagagacuuacacauggaaauccucuugucugagccucuucaauguuuagauuaauagccaugaaaauggaaaaaaaauuuuuuuaaagauuuauuuauuuuuaugugcaaugguguucugccuacuguuauuugugugagggcaccagauccccugggacuggaguuaucaacaguugugagaugccaugugggugcugggaauugaaucuggguccucuggaagaaaagccagucuucuuaacuacugaacuguccagcucuggcauuguuauuuugaggcaagaaauugcuauguagcccaguaaaggccuugaacuucccauccugccucagccuccugagauuuacagacgugcucagccucacuuuuuuuuuuucuuuuuugcaucaagggagugagugggguugcuuuguacauacucauauguguggauguaugugcuagagguaucuuuuauugcucucugcuuuuugagccuggaacucauggauuuaacaagacuaguuggccagcacuaggugcggcugcaggccacugugcacugcauuguuugaguagggauccaaacucaugacugcauguacuuuaccaauugacaugucucccuaguaccuacccuuccucccaaagcugcacaguauuuuguuauuuuauguagauaucaagagugucuaucaauacucucuuaggaguugguaaacaagcacaguaguuagugggagucguguuagugaggaacaugggugugcagugacagaaggcaauucaugugugcacaugccgaauuggguaguguccagcaggcauuccuggcgaauauuuaccucuaagggauugaaguacuuuggaucucauucuagcuuucuuugcuauuuaaaaagagguaggcuggggaugcagcucaguaguaaaccucuugccuaauggguagaagucggugcgcuaauccucaacaccaucucugcccccaaaaaggaaugaaaaugcccccacgcauugggcaugucacauaugaccaggcaugguggcacauaccuguagucucaacacuuggaauagagaggauaggagauuugugaguuuaaggcuuuccuuggcugugugggaaguuuagggcaaacauaggccacauaagacgcugucucagaaguaaggggcucaacagguaaaaguauuuacuauucuugcagaggaccaaguucaguucaaaguauauaccuuugauggaucacaacugccuguacuucuggcagguggaucuagugccucugcccuccuuaagcaccuguccuaaugugcacgcaucgauccaaaaauaaauacauacagguaacacuuuaaaagaauacaaaguaguuaauaaguaaguagaggcuguagguguuuguguugaaaaaucagugauagcauaaaauucuaaaauuuguugauauuucugaaucuaauuauucuuuuagaauggucggaugugauuugcuuaaaaaugauugucauuugccuucccagggcuuugaugaguacaugaaccucguauuagaugaugcagaagagauucauucuaaaacaaagucaagaaaacaacuggguaaggagauaguuggcuuuacagauuucuguuuauuucacuggcagacuugaauggccuauagcugaaaauucaugcuauaaaguuacauuugaagggagaagcacacuucugaauucaucuuccugccacuuacucuguuacccacuccuuuguuuuguucauugauagggucucagguagcccaggcuacucucagucuugcugagagugacagauugaacuccuggccuuccugccucccccucccaagugcugggaucauagacauucgcaaccaugccuugccaaggauguuaaaucugaugucguuuuuuguguucacuuauauuuaacauuaaguagaauuugacacaguucaauacuuccuugcaauacuuugauaucuuggguuugugacauaguaugucaguuuuuauucaacucuggcuguuuuuuuuuuuuuuuccagacuucuuuauauucauccuuuuuuacccggccauuaaguauuugaggcuggguuccagcucgcccuucacagucuuucccuaggccagcaguucucauucuguagguuaugacccuuuugagaguugaacgauauuucacaguggucuccuaagaccaucagaaaacacagacauuuacaauaugauucauaauaguagcagaauuacaguuauaaauuagcaauaaaaacaauuuuauuguugaggguccgcacaacuugaggaacuguuauuaaggggcugcagcgcuaggaagguugagaggcucuguucuaggcuucuaguguucagugagaucacagcuccagguacuaaucugggcauugacuuccuuauuuauguguauagcccaaaccucuucugaaccuguuuaacuuuccacauagaagguuuuuaaggcagccugucagaagccaacuucacugccugcuuacacuguucagcguggguuugcugaucacuuccuaacggaacaguaguuuccacuaacuuacuaacuuuuguagcucccucauccauuugaaguugcucuccagauguagccaucuuuuugaaacacugggucugaccuuaccagcuuuugcuugaaauuuuccauugucuguuuuuccugaggggacagugugauguuuuggcaagagccuucuuaucuggccugauguucgcucaucuugauucacacugucccauuuucugagcagucuccaugcuugucuccuuucaguuuguuuuuuguuuuggaggguuuugggcuggauuuuuguuuuuuggggggaggggggcugguugguugguuuggggguuucucuguagucuuggcuguccuggaacucucuguagaccaggcuggccucaaacucacagagcucacugcuuccuggagugcugggauuaaagcugugugcccccauugcccagcucuucuuucaauuccuuaagccugcacauuggccucacuuucuguuugagguaggaucuuccuguuuagcccaggcuggccuuaacucugagauccuugcuucauuuucuaaauggcaguguuaacacaauuaucacgccaugguuauuacacuugacuccaucaaauauugcuacguguauuguucacugaucaaacuuucucuaggaaacccaaauuuaauuuaguuuuucugggaugggagaacacaagaugugauauguugacucuguagugaaucauuuauuuuaucguugccucuuuguuagacugcaugcucccugagugcaugagucauguccucucugcuuccaaugaccaccguagugcuucacauaaacucagaaagcccagggaacaagaggacccauggucucauuaagagauacuuuacugagguuagguuaucuuuuguuagaauagucagugcucacgugcguuuauuagugauggaguucagguaucucuuucccaaacccuacugaccaaagcuagauagguggaagguagauucuaagaaaugacucuguuuuuauuugcuuuugaggugcucuaccucuauaacccaggcuguccgaucuuaccuuagccuuccaguacugggacugcaggugugcacugucucacgcagcaagaacucaggcuacugcagauggaauugaaauguauacuugacaaacacucauuucuaaacccucaugaacuuaguauugggagaugcuguauugggccuuuucacuugaccuagacuauaggaacuauguuucauuaaaacagcgcuguuucguucuguuacugaaagcccaguagaccugguggaagccuucaauauggacgauugaaaauguucacauagcguuaugagagagagaagugccucaguacuauucagagccaaacucugaggcugaaagauaaguaaaugucucucucugauuagucacagcuuuuguaacacuuuuuuuguuguuacaggucggaucaugcuaaaaggagauaauauuacucugcuccaaaguguuuccaacuagcagugaauggugaagucuguaggauguugagaagaccccuugagcguguuuaaagaugucugcugcaaccugcauuuacucaacuuguuuuacuugcacauuauuauuaggugacaauaaaugcuguaggaaguuuuuguuaaaauuuuac

SEQ ID NO: 12061 - RNA, 7890 nt, Mus musculus
gcuucaggagucagucaggacucugcucacgaaggaacucagcacugcauccugccagcuccaccgccaccacuacugccaccuccgcugccaccucugcgaugcucuuccgagcugugcugcucugcgcugcccuggggcucagccaggcaggugaguugcgccccgaggcgcccugggacuccucaggcucagacccccuuucuagcagugugggccuggcuguguauuggcaaagagccuggacugcuuaaguccugaggaacugcaacccacuuucagguuucuuauuugcuaaaaaccaauagucuuaauggcuuacagguugucauuaugguaagacaaucugaucaauacuugugaaaagcauagaugugggcaacugaacaagaguggcugcuuugaauaccuguuagaguuuuucuauccacagaaaaauccagaauacauuuuuaaaaauauauuuaaaaugcuaaaacuugacuguuuuaauuuuauuuucuuuacacuaaauuuugacuauugcacuaggucgauccauuuuaauauuuaaagggaugcuuaauaauucuagucuguguguccgaguuauuuuaaaaauguugguaaugugaacuaugaaguuagguccucuguguuucuugcuuaagaauacaaaguugcuugcuauuuccauaaacaguugauaagacagacuuaauuaaaauaaugaccuuuuuaaaucugggucuaccuauguauuugucaaacuuaucauuguaaaguugacccauagugacagaauuaaauccuuaaguuaagaugagaacaaccaagaguaacugacaggauaucuuauuuuuuuaauguagcaaauccuugcuguuccaauccaugucaaaaccguggggaauguaugagcacaggauuugaccaguauaagugugacuguacccggacuggauucuauggugaaaacuguacuacacguaaguuuuuccugggguaucuuccuuuggaauguggccacauguguaaccaucauucuguagauuuguguccuaugggggaggggccugcucauucuuccuccugcuuugucucucuccagcugaauuucugacaagaaucaaauuacugcugaagcccaccccaaacacagugcacuacauccugacccacuucaagggagucuggaacauugugaacaacauccccuuccugcgaaguuuaaucaugaaauaugugcugacauguaaguacaacccucccuuguuuuccagcauccuccaacacaacuaggcacuagaaacccaaccccaagaacuauccugaccuuuucaaagggcuugaaguauaccuuuucuaaucuguuuuuccccugaaaugucuaaaauacagucaugaaaaccuguagucucuauucuaguuuugaccccuguccuucauucguguggaggaagugugguucacuuguucauugaauaaauacccauggcucacagaauuguucggaacacauagaauuguucugaaccuuugaaacaaaugguugacuaggguuugggucagaagagaaaaauagcugucuguaguuauuggugagggccaugcccaaaugucucugucaucagcuauggaacagggaguggguagaaacugaaaagucaagacuacuggagcagaauguccuguguaaaauuuaagcuuuauugaagaugcauuuucagugcucuuuaaaguucagccauuguacagcaggguaucuuugucugaaggaaaucuagucucuguacuugcuacauuguacaaugauaauugauaugcccuuguuguuguuguuguuuuucauaugaggaccaaugauuuuuuuuucuuuaaaauuucagccagaucauauuugauugacaguccaccuacuuacaaugugcacuaugguuacaaaagcugggaagccuucuccaaccucuccuacuacaccagggcccuuccucccguagcagaugacugcccaacucccaugggugugaagggugaguguaaagaaauacagacauagcaacugcagugaggcuuggguguguaccuagaaaagguguccauuauguaaaacuguaaauaguuuugucuuuaguaugguuauccacagagguuuauuaaaaguacagauguaguaugggaaaguaaaucugcauugauguaaugucuuagccuuaguauguuuugcuaaauagaacugauguuaguuacaauucauaaaaaauucaauaacacccccugcuuuauaucuuaacacuugaauuuaaaaccuuagcccagccugggguacaagccugacacugugccucaaaacacaacagucguauugauguugugaucuucuuugagacggugcuucuaagugauggaugcugucauguauuauacagucaucuguuugcuugaacaaauaggugaauggauagauacuuacuuuagaauuuacauguuccaggaaauaaggagcuuccugauucaaaagaagugcuggaaaagguucuucuacggagagaguucaucccugacccccaaggcucaaauaugauguuugcauucuuugcccagcacuucacccaucaguuuuucaagacagaucauaagcgaggaccuggguucacccgaggacugggccauggaguaagugggcuuaacucagauuuauagcaaauccuuagggaaugcugacaucuuaccaugccaaacaaaucacacccauuuuuuuuuaauccaaaugucaugacuacuaaaaccauaauagguguuccauuuucauuuucugauuuaguaaaaaugaacugacacacagagacauauuuuaauguaauuuuccuuacauuuuuaguuuaaaaguuugguccaugaaaagggucuaucuucuguaaauaaauaaauaaauuauuagucaucgguggcauugggaagugaaccuuagaaguuugugcuugccaggcacuggucucugcuauugaggcagaagagguccagccuuuacacacacacacacacacacacacacacacacacacacacacacacacacauacaaaauccccuucuaugcuucuuuaaacaauguaaaauuacuauuaugguuauaaugaagcaaguggcauauuuaauauaggauacuaauacuauucaacauaaagaaauauacagacuuguagcucugguagacaaauuauuuuagaauuuuguggcuaugaaaaagucacuuauugagcuagauuggugauuaagaacaguuguugcuuuugcuuaaguucuuaacaccuacaugacaguucacaaccaccuauaacuccagucaguucuaggagauuccauguuuuguaacauuuuagggcaccagacaagcacaugacauacauacauacauacauacauagaggcaaauucucauacauauaaaaauaaaauaaaucuuaagaaaaucacguggugaauuuuaaagacaacuaaaucaucaauauugaauaagaaauuauaguaaaaaaucaguaaauugaacuuucuccauacuuaauuuucuagguggacuuaaaucacauuuauggugaaacucuggacagacaacauaaacugcgccuuuucaaggauggaaaauugaaauaucagguauuuuccuuaugguuuaaaaaugaccaucugucauuuagacuuacauauuaaaacuauuguggcuuuuuuuuccuucuuuuaacucuguuauuauuguugugauuuaggucauugguggagagguguauccccccacagucaaagacacucagguagagaugaucuacccuccucacaucccugagaaccugcaguuugcuguggggcaggaagucuuuggucuggugccuggucugaugauguaugccaccaucuggcuucgggagcacaacagagugugcgacauacucaagcaggagcauccugaguggggugaugagcaacuauuccaaaccagcagacucauacucauaggugagcaagagagaaauaacaaguaagaucaucuuccccucagaaaagaaaaacucuuccauuugcuauguuuugauuccuucuugugaauagggagaguaaaugugaucugguaacaucccuaccauuuguuguaaggaaacuaaagucucuguguuguguaacaggagagacuaucaagauagugaucgaagacuacgugcaacaccugagcgguuaccacuucaaacucaaguuugacccagagcuccuuuucaaccagcaguuccaguaucagaaccgcauugccucugaauucaacacacucuaucacuggcacccccugcugcccgacaccuucaacauugaagaccaggaguacagcuucaaacaguuucucuacaacaacuccauccuccuggaacauggacucacucaguuuguugagucauucaccagacagauugcuggccggguaagcauuguuccugaaaagcaagaaccagcuggucaguagcuuuaggauuuuugucauagagauagguuuuuuuuuuucuuuuacuuuucuacugguucuuguaacaugacacuuacaagguuuaggaaggguuuuagguucaucuaaaauuauccagcaaauaaugacaccugucuaucuuaaaaccaauauuuuuaaaagauuucagucaucuuauauauuagagaaguuaauauucagacuuguuuaucagcuuauuuuuuuauaaucacaaaaaucauguuccuuauagaauagaagugaugaggucaagacauaggacuucaggaauuugccuaagaaucucauuuuguuauucacuugucuuagguugcugggggaagaaaugugccaauugcuguacaagcaguggcaaaggccuccauugaccagagcagagagaugaaauaccagucucucaaugaguaccgcaaacgcuucucccugaagccguacacaucauuugaagaacuuacaggugaggaaugguuucuaaauuuucuaaaaggaucagggauuaagugggaaaagagaacgugagagggcauuuagugaagggauaaacuaucuuccucuuccuccuccuccuccuccuuuucuucuucuucuucuagaaauagaaaaggaccgaguuuacugagaaagaggagugggaauggggucagcuagugagcgggggaaagccuaugcucaacagccaggacaauugucacccguucccaguuugauguuccuguaucucuaucuuugguaccuuccaggagagaaggaaauggcugcagaauugaaagcccucuacagugacaucgaugucauggaacuguacccugcccugcugguggaaaaaccucguccagaugcuaucuuuggggagaccaugguagagcuuggagcaccauucuccuugaaaggacuuaugggaaaucccaucuguucuccucaauacuggaagccgagcaccuuuggaggcgaaguggguuuuaagaucaucaauacugccucaauucagucucucaucugcaauaaugugaaggggugucccuucacuucuuucaaugugcaagauccacagccuaccaaaacagccaccaucaaugcaagugccucccacuccagacuagaugacauuaacccuacaguacuaaucaaaaggcguucaacugagcuguaaaagucuacugaccauauuuauuuauuuaugugaagaauuuaauuuaauuauuuaauauuuauacugaauuuuuuuucauguaacaucuuccauaacagaaggcaauguucuugaacaauguuacauuugugaagauucccuccgguguuuguccuuuaaauauguguuaccugaaacugaaaggaaaucagcauucauuccucuacauaagccagugagaagggaaaugaauuuugauaucuuuauacuugaauuucagaucaugauuagcuuaacaagaaccaaggaaaaauguaugaauaugugaguguuguuacaagaugaaaaaugcugcagguaucaacacuguugguuacaacugugucuucuuuacuaugauaggagcauguaauguggaauucuucuuaaaucuugcauaucuuuaucucaucaaacaaagggguccaaguucaguuuuaaauaagcauuuaaggcagauacugacaacaaucucauuuuuuaaaauguugucuugagacaaauaauuugaaauuucuaaauugggaguuugaaucacuuuugaaagcucuuacuuucuuaagcugucagguuuguaccgacauggaguaaacagcuaucauaaacguaaaucuccaaaacuaguagaaauuaugucaugauugaugguuaagauaccaugucagggauugucuuuucuuagaaguagugaaagcuacuuacuaugacaaucagaccuuccuuguaugucaaaaugcugguguggaaggugguggagcccgugcugcucugucuuaacuaugagugugagcuuuaaagcucguugaugagugguagccagcaaagccuagagcaacaaaagcuucuacaaaggaacuaaccaagaacaaagaaggguucccaauuaaagaucacauucaggguuaaacuuccaaaggagacauccugauccugguuuugugcuggccugguacucaguagguuuuugcugugagguuaaagacuugccaggcugaacuucgaaacaguuuuucuguugcacaguaugauguaacaguccaucucucaaugcaauagguaucaguggccucgugagcuucuucacaauauugauaugucuuccagcccauugaaccuggacugcagaaggccccaugucaugugugagcucagccuggaugccagcauugcugcuccucuuaguuccguuucucguggucacuuuacuacgagaaacgcugauuggguuuucguagcuguguuccagguuuuuaguaucagaacuauucuuucuuuaaccucuauucauauuuucucuacuugaaguuuuacauucaggaaaaccucagcucaggacuacuauguaccuccccuuuggagggaaaaauuauuuuagguaaaaggcaaaaauuuuuuaaaaauauuuuuauuuauaauuauauggaagggcccuaccaagaugcuagaaauauagggaguuccugacaagaaauuuccauucuuauucugaagaauugcuuucuuacuuaaaaacaaagacaguuugugaguaguucugggcaauagggauaaauauaaaacaauaaugaugaucauuuucuacaucucauuaucagcugagguacuguauauuacugaauuuauugaagauaguuaugucuuuuagacauuguuguuauaaacuauguuuaagccuacuacaaguguuucuuuuugcauuauguuggaauugauguaccuuuuuuaugauuaccucucugaacuauggugugaacaaucaaacaaaaugaugagauuaacguucauggauaaauucuaagaaaacuaguguauuuuuuugaaaaguuugaaguuagaacuuaggcuguuggaauuuacgcauaaagcagacugcauagauccaauauugacugacccaagcauguuauaaagacugacauuuuagacauuuugaaggcccuguaaguguuuauuaauuaguuagaacuuaauugauuaaaaaauauauccaaagcacuauaggcauuagaauucgugcaucaagaaaugaugacaaauaauacuguuauuuauauaaauaacuaaaaagggugucuaaugaagaaauauauuuuauuacaaagaaauuauaaaacauuuugaagauuauaugcuuuaaaaguuuaagaugaaaaaauaaucaaccuuagaaaaaauguauaaaaauauauaaauuguuaaugucauugauuaa

SEQ ID NO: 12062 - RNA, 57078 nt, Mus musculus
caagcgagggaggccugcaccccgccccucucggggcaccguuaagaucguggcgguagcccagagccugucgagacacccugccgugacccaugaccucugguggcucggcuucuagaaguggccacagaggaguacccaugacaucccgggguuuugacgguaaggucgucuugcuccuccgggauaaggacgaggguggcugcguacuuauguagcgcccccgcgcgggcacucgucacagccauaggaggcgagccgggggcggggagaaagaaggaaguggggcgagaggugcggccugagcgcgcguaagcgggugagaaauacacuacauuucccaagagucucuggggcuggaaaccggugaaauccccaaaaaacuggggccgaggcugcugugaacucgcuuucccagcgugccuagcucccgguggcugcgugcgcagagagggcgcggcggcgcggcucuggcugcaccuaacgcgggacucucuuucccagggucccgccgcgggagucucaggcgggcaggcgcgcgagagaccgcgagcgaggcggcggacggggcggcuccggcggcugggcuccgcgcuucuccuugcuccuuggcuucuccuucagccgcugcggcuguugccgcgaucccggccgacauggcggcgguguugcagcaagugcuggagcgcccggaacugaacaaacugccgaagucgacgcagaacaaacuugagaaguuccuggccgagcagcaguccgagaucgacugccugaaggggcggcacgagaaauuuaagguggagagugguaaguguggagacgcucuucgcgcuccggucuggagcuggggcccgaccuccuuugcacgccugcccucuucucccuggugagguguucagguagcagcuucucaggcuccaugugcagcggaggccuucucucuucuccccgcugugugguuuagaucggggggcggggggauccuccccgaucuaaauccaccuucguuuaccucgguuuccuuuuacuaagcguagucuucuguggaaacuccucaaugggcccaccgacagaaacuggagaauuuggcccaguuugcaccagauuuuuaggacuaugcaauccuaaucuaauguuguuuugcuguacuuuaaaugacaguuaagcgccccccccccaguuuguuuguuuuuaaacuggauuuauaagccuuuacccauuuccccccuuuagugccuuguuuuaguguguauagcacccugugaucuaauaaugcaguagauggucgcgaugaggaauuuguauacaaaaggacgguacuagaaagagcaaugaaaugcgauaaaugaauauauggugguucucccagagcguugagacuugauaggaaauauauaauaaaaauaucugcuuguacguucuugucguugcuuuuguauaaggaaauuagagacauagcuuaaauauucuugggagaaagaaaacaguuauuuaaaaaacagagccgggcggugguggcggcgcacgccuuuaauccuagcacuugggaggcagaggcagucguauuucugaguucaaggccagccuggucuacagagugaguuccaggacagccagggcuacacagagaaacccugucucgaaaaaaaaaagaaagaaaaaacagaauuuuuugucacauguuuugguuuaucauuaauugagggaauggggucuauaguaugguagauugauuagaaauuuccaccuaauuuaauuuuuuucuucaauaaaguguaguuaucaagcaacguugauaaguaaaaauauccaguuauuuugugacucuuaagaaguuuguauaauauacuguauucuguuaauuaauuuacacacagucaauacugaguaauuuauaugucccaauaaugggaugaaguagacaaaugcagucccuuuuugugggaagucugcauguuuauuuuuacagaaauuuaggcaucauuuaaauuauuuuuacauuaaccccuuuaaaacaaugcacuuuuuaauuaaguauuuuuauuuauuagguaacuuauauuuaaauguuuaauaaucuccugagaucuggagaaaauacaaccuugccugccuagaugaaauuaauuuaugaacccucuuuuagucaauguugucuuuauaugccaguuaagaauaacaggaaaguccuuuucaguuuuuaaucuguuuauuaagauuaaaauuuccaauaguguaucuuaaguuuugcagucaguauuagaagaaauaaacagugguauuaauacugcuuucaagggcacgugugcaugauguuauucauaguguguggacuugucuuuuguagaacaacaauacuuugagauagagaagaggcucucacagagucaggagaggcuugucacugaaacccgggagugucagaacuugaggcuggagcuugagaagcuaaguaaguauuugauuauaucuuuauaacuguucuuggaugcccagcuacaccuuugaaaaucacacuugcagggagcugccccuccuggaaacagacuuuccagguagcaaagcccuaagcagggauacaaacaagguaagaaucaccuagcucuccugccuucaggccuagaggcagacugaucacacuauggacuccaaaauuguguuguuuacuggaaaaaccuguuuuuaguucuaguguggcucagccauggcacgcacuuuuaaugugggaaacuuucugcaugaguauuguaaacaggcagagcaagcaaccagcugacaggaaguaaauuauaaguaaaguaggauuauuaagaaaaaaaagaaacagccaggcaguaguggcacacgccuuuaauuccagcacuugggaggcagaggcaggcaaguuucugaguucaaggccagccugguuuacagacugaguuccaggacagccagggcuacacagagaaacccuaucuugaaaaaaaacaaaaaagaaaaaagaaaaaaaacagaauaaaaggaagucaggucagauagagaggcauacaggaaguagaagggagggacauuagguuugaaggaggauuuuuuugugauaucuugagagaggagcauuuguucuggaacuucagcugggugccuucucugccucugugagcuugcaaacuuucaccccagcaucuggcucccuagucuucauugauaaaaucaaaagauugagauuuuuguuaauagaaaacauaucuguuacaucuuguaaaucauaugauuuccucauacuaaaugccuuuggaaccuugccuuccucaacccaaaccacaaaaaaagaagaaaaaaacauagugguuuuagucuaaacauagugguuuuagucuaauugauggugucgacagaccuugggccuauaccuccugcucacuccuuccucaccggaaccuuaaaagaacacagugcucucucugagagagccuaagcuuuccuucccuacccucugacuaaaggcauucagaccugugccuucucaauguccucucccucacgucauucucugugagcagcuacuuacagugugggaaaugcucagaggccuuguccgagcaguugcaguuuguguucccauuaguaaaggcgugguaaggacauaggcugucacagucugcagaccugguuucuaauucugacuaauaauaaaaguguucuugccacacgugccauauguagauggcuuuuguaaaaaggauaaaaguaguuggaagcacguguguuuacguagcuuuacacaucaaagguacuauugagagugauugaaguagcuuaaauguguacuugaagguuuaaauagugauuuguuuucauauuaaaaauguaaaaccuacugauuucaugauaccuugugacagcuucugugaguccagcguuucuccuaugaagccugguuccuuaggaaggguuuaggugaagccugugacuuucagaggaggacagaagaaaacuuaaggguugaaaggcuuuucaauuaaauguagcuuaaguuuuuuguuuuguuuuuuucuaagacaggguuucucuguauagcccuggcuggcuauccuggaacucacuuuguagaccaggcuggccucgaacucagaaauccaccugccucugccucccaaaugcugggauuaaaggcgggcgccaccacagcccaccuaaaauuuuuguuugauuugauuucaucaaaaaggaacacaagaagcucaugaucauaaauaaacgugagcuuuucucuagcuguuugguguauaauuccugcagcuacuuuggaugcacuaccauuuaaagaaagcucuguagacacaggcgucuguggugcacagccugaacuguacuucuccaacaaagcaugauaaggcuugcccagaaauggugcuaaagaguaucacgaggaugucucugauuacuucuuuugugagguauuugugaaaauaaagaugaauguagacaaaaaggaguuccuuccuaggguggacaauuguacuugaaguauguguauuuguguacacaauuauagaaaaugguaaguaaaacaaaauagaaaauauagaguaauggguugguuuuuuuguuuuguuuuuuuccuuuuauaaugauacaguuuuuauuuuugggggagggcgggguuguuuuuuuggguuuuuuugguuuuuucgagacagaguuucucuguauagcucuggcuguccuggaacucacucuguagaccaggcuggccucaaacucagaaauccgccugccucugccucccaagugcugggauuaaaggugugcgccagcacugcccagcaugauacaguuuuuaaaauccuguuaaauuaccuguucguaggaacuagggagauggcucaaguaauuaagagcacuugguguucuacaugacccaaguucaguucccaguuccuacaucaaguaacugacaagcucaagcccuucuaaaauucuagcuccuaggcaucuaaagccuucugauucccuugggcaccuguacgcaaauggcuucuacuuaacacaggcacacauugcacauaauuuuuaaauugccuauacaugauguaggguuugcuuguuuccucuuugaagaaaggucuuacuagauagaccugaggaacccaaacuccuucuagcuguagcuauccuuguaucuacccugccuuccaagugcugggauuauaagugugaacaucuaugccuggcuuuagaugcuuucaugaaagaaauuuucaaauguguauuuuuuuauauaacuauauauucuaaugacuagacuuauauaugggaagacaaauguaucaugaauauaagacagagcacaaacuuuuuuuucuaugugaaaggcaugauucuuagugauaaaaaacauggaacuacagauauuuauuauaauauauacugaaugcauuuuauguaggucaaauuacauuauauuuauugguccuggccugcuugcuuuauuuuauauaaauuuaccuagaaaauggaauuuaaaaauuggcauugcuaauuuugcuacaaauugggaacaaacuauuuacaugugauuguagcauacuuaaaccuuuuagucuguaauauaguaagaucagaauguauuugcacauuuggaauauggucauaaaucaguauggacuccaguucuucauuuuaaaaaugugugaugguaguaguuggguaaaaguacaaauuuuaaauuaacauaucuguguccauuacaucccuuuugucuagauaaccaaguaaaaguguuaacugaaaaaaccaaagaacuggaaacugcucaagaccguaaucugggcauucagguaaaggcuuuccaguagcucaguacuagucaacagaagguuaaacguucucaugaaacugccaacaaauacauagaaaugugugcauacauacacuuugaguuguuuuuuauuuaucuauugaauuccaacaguaacccagcauucaugguauuuugauauacuugggagcugggucacucuacauugcugccuguuucuuuagagccgugauaagaauaacagauuaaaugugauagaaaggguugcuacuauguuguuuuaauagaagagugauacccagucuuuaaccauauaggacuguacuuuuaaaauuacauuugauuuaagacucagauuuguuuuucaaaacuauguaagaaaaacaugcuuucagauuccuuauaggagcauaauauacccaaaauauuucaguaaauuaauuuguaaggaauauacaguguuuugagcccuuuaaaaauuuuaauuuguucuuguuuggguuuuguuuuguuugccucgguauuaaaagaaaacuguuuucagaaaacuuaaaauacguauuuauauauggaaaaauaacagcauguucuugggugaaguggguuugcaaauuaauauaggcuuuaaugcaagguccugauacacauucuagauuugaugaaacagcaacagagugaagucuaauccagaagaacuguggacacacgaauagauacaauuuaacaaaacaaaauugggggagaacuagguguuuaacggcccuguaggucagcuuucuguuagacacugggauaaaacauacaacauacuuacuuaguuauauaaauauagaggucuauuuucauugacaauuuuacagguuucugcccaagaucaguuugcuguguuguuuugggccaauggcaagccacauaacauguuagggagauugguggaggaaacuucaccacagaauaggaugcaaagaauagguagcagagggucuggugacccacuuuuuucuuuaaaggcacacccucggugaccuaaaaaagcccuuaugauguuaauaauaucauuuagcaauaauaccacagacuagaacccaaacuaugguccuuagauggccauuugugaagcagcugguuucuauugaaaauaaguaaauagucacguuugugaaaacguuuuagguauauuuagaaguuaauauacaaggacacuagagaacaaaauaugaaaauuguuguucuaaugaaugauaauguugcuuagaaacacaaaauacaacagaaugaauauggaguaccauaacaggaaauugguuuggugguaguagguuugguuuugguuauuuauuuauuuauuuauuuauuuuucuuggaacuauaaaacuggaagacaacagagccaaaacugucagccuuugaauuugacaauggucucuuuagaaaucacaccaaauguuuaagccauaagaacaaaauuaauuaugaccauagcaaacggaagacccugugugcuacaaaggaaauaaagcuaaacaguagcuaccaggaauagggggcaggggaauaucuguaagccacuucucugacaaaggcauauauauuacccaaguuuuauaaagaaguaguaauagaaauaaguaauuuucuuugaaaauggacaaaagacuuauuuucaaagaagacaguaaugagcagguauaugaaaaggucucauuuguuaauuguaaaagaaguaagaaaaaugcaugaacacacaguuuggugauaacacaugguuauuaucaaagauauguuguugcgggaauacagagaaaagggaaugguucuuauuucuugcugauuguacauugcugauuuauguguagcuugauacaaccaaugugaaaaacaauauagaggcucauaaacuaaauauagaauaaccuagcaguccuucuucuggguauaauauucagaggaaucuuuacauuguaaaaguaggcauacucaucuauguucauugcugcauggaucaaaguagccaaaaguuugaaaacaaccuguaguuagucauagacagcuggauaaagaaaaucugcuuauguuuacacacaguauaauauuuggucucaaaaaaauguuaugugccacaaaaugggcaaauauagagaacaucugaauaagccauacacagagaaaugauguggcuuaucgaaagucaucaaagaaaucagucagguauuuggaaacagaucaagcugauuggcggggugaaggaaaugcagguugaaggaacaaauauguagaaugaaaaagucucacaaauguauagaggguucuaguuaauaacacuguauuguguuauaacuuggugaaauggauuuuuuuagccacucugauaaaacaaaugagauuuauucacuuaacuauaaugaugauuugguaugguuuuaucuauauauguuauacacuuuauauauaaacaguuuuauuuaaaagcgguuucuaagugugaaagcauuuuaaggacuuagagugggucugugcagauggcucagcacuaaaucacaugcaucaggcuugagaaccguagguugaauccuagaacucacaagugcuugguggguauggcugccauuuuguaauuucagggcagaaguacuaagugauugccuguaguagacuauaaagacaacauggacucgcugucuuggugagcucuagguucaguugaaacauuaccucagugaauagagaccaaucaagaauuagcaacauggccuuuggucccugagccauggcucuggcucuccuuuuguucuaaggguggucuuaaacuuuuugaguuagggucucuuucuaaaaguaaauaaaucuuuuuaaaaacuguuggaaauagaggcaaaagaaauauguguaaaugauugguagguacauuaauguugcucagcuuguaauagaaaauguaaaacuucacauuugaaguuuaacauucuuuacauaaaaauaugcauaugagccauuaagucuguuuauaauagaugacuucuuucaggugauaaggaaacugcuacaagaaaaauacaugcaaaggaaguauauuauaaguaaugaaagcauaaaauguuuguaguaacaggaaaaugcagguuaaagcaauaguaagauaauuguguuucacuuccauguguugacauguuacacccagcuuguucuaaaugcuuaguuguugguuaacugguugguaucguugcuuaugacucuaaaagccucguaaggaaacucucaagaaguaauuugaacccaaacacaaaugugugauaguucccacaauugguuuuugaagacaugcaaauuaucuauuacauagccaaauauaaaggcuauguaaauaauuggggcacuucgguguaaugagugacaugcauucauaagccuagggaaaauuaauuuaaaacucagaaauagagguguuacgauuaaaaguauuuuuuaguuuguugauacccaaguuauaaggaaagaaagcauuuuuuaaguaacugcuaauguuaguugaauugaugauucaaguaccuguauugauuguuuaacuuacauucuugaacuugguguuucuugauaugacagagccaguuuacaagagcaaaggaagaguuagaagcugaaaaaagagauuuaaucagaaccaaugagagguuaucucaggaaguugaauauuuaacagguaugaaaaaaauaacugugccuuuaacugcauucuuuguuauuguuggugcuaggaguugcuucugauguuauauuucuuuguucuguuucuuuaguguggaaguucgguuuaaaaauacuguuguuccuuccguauacauaucgcuagccauuauuaagauguuggccagguaucacgucaccugccuuuuaaucccaguacucaggauucggugacaggcagaucugaguucaaggccagccuauuuuauauagcuuuaggguagccugggcuacauagagaaacccugucuuaaaaauaaauaaaagaauaaaucaaacuagagaaugggaagcuuaccugacugcacacugaaaaaaacacccucccucagcaaccacugucaguacuuccgggauagguaagcauuguggaccccacacccuuccgagaugggauuggcgggcucagugucuugcaaguguggcccagguaacacauguucauguugcagugaguucauaagugggagcaaguguaguuaaauucacuggacagugaaaagaagccacgagaagguuagcagaggucagaguauagacauagacucucuaugaagaaggcuauuugcagaaaaaggaaggagauaugggggaacacuggacaaaaacuacuaaaguucauuacagugguauaaaagggucuuaaacagaaaaaauauugaauuuaggagacaggaauauaaaauguaucaccauacuaugauauauuugucaaaaaugaguuuuaaauaguuagugauacuugucuuugggcuuuuuuaaaaauuuaauuucuguaaauaggaaaauguucacauguuuauguuguauaguaauacacagcuuggaauuugauuuuuuagaagagagugacauuggaauguuugcugauuguguugauuaccuggcuggugguaauuaggauuaaaugaauuaguuucauaaaaacacgguuauuggagaacagaaaaauauuaaaugauuacauuuuuaauggacaauuuuuauauuauaaccuuuuaacuuaaaugguuauaauaaaauacaaagauuuuaaauagaaauuuaguuuguaauuaugacagaagcaagcuaaaacagggaguugaaaagcacuuacuuuguguuaaagguuuguuucuaauaacauauuuuguuacuuaguuucugugaguguuagcuccucauuauuuucaaaugcucacucucauccuccuuucuagaggauguuaaacgucuaaaugaaaaacuuaaagaaagcaauacgacgaagggugaacuucaguuaaagcuggaugaacuucaagcuucugauguugcugugaaggcaaguaauauugguucccaauaaaugcagacugaaaugccuaaggaucuacuuguuacuguauuuuguguuaccuuaacagucuaauuucuacucugaaauaaaagaucauguaucccugagcuacauuuauuuaaaaauaguuaaauauuauuuuaaaauuuucuuuuuaguaucgagaaaaacgcuuagaacaagaaaaggaauugcuacacaaucaaaauucauggcugaacacagaguugaaaaccaaaacugaugagcuguuggcucuaggaagagaaaaaggaaaugaaauucuggaacuuaaguguaaucuugaaaacaaaaaagaagaggugaguaguaaaugugccuugcuuacgguggagguggccuuuguacaucaauaaguaacacaccuccucaguuacaaaacguguguugcaugugacagcagagcuccacuuuaaccuaggggaauguuuggaggaauuuguaaugacuuuuuaauaccacccacucuaauauuaaaccuuucuuuccaaagauauguuuaagaaguagaccuguuuuugugaauuauguucaaacacauuucuccaucgguugauuuugacuuagaguacacuuaauuuugcauuguaugacaaugcaaacuuaaaguacaaggacagcaucaggcuaaugaacuccuguuuauuuaguuuccuuuuuuggucagucuugucaauuuggagaaacaguaaacccagagccuuugcuccucuuucuguuacuauagagagauguaaguucaguugaauggucuguuuucuuguuacucuuacggaagugagacauuuggugcacugagugguugcaugcagacauuaagagacugcaauacaugauuacuaugguaauucauaacaaggccauuuaaaaucaaagaaagaaaugagcaucaaguaaagguugaccuguaagaagucucuccguguuuuaaccuuguaguuucuacaguaccaccuauguuuacccugggguaucaggagcugcuguuaacacacuucauuguguagaucagaguccacgguagucaucuuaccuaaaauaacuuuugacuaagagcuugaaaaauguuuuuggaucaggacuaaucuuuucaguagaguccguuacaauaguuaauguucaacagauuucugauuguaaccuaauuuauaacuauggcaagggaaguauucuacagaggaaccauuuaaagcauguacuccugcuggaaaacuguaacaaugucagguuugugaguggaacaacaguaccaugaaaauuucucaacguuaaccuuauuuuccaaucauugagauacugaguugccuggauacaguugaucauuguuaaaucuuucuuagauaaaaaugcauccuaaggguccaaaccaaauaauucccuguggaaucauucacuacaggaugacaugaugauaauauggaagcauuuuuaguuucaacacagugcucuaauugguaaugacaguagaauuagaauuaaaaguuuaucuguuuaugguuaaaauuaucuuucauuugaguuuucuucaauucuggacauaauuuaacugaacuguugucuguaguuuuugccacuuugaacuuuuaacgaggaguuuuuuuuuuuuuucuuuuuuaugagugaaucuaaaagccuaaaaccuauauaaaaaccuaaagcuugucuaaagguucaggaauguaauuugaacgaauuaguaaucauuuggaauaucuguuugucaugugguaaacuagaguaugucuaagaucacacaaggauuuguauuugacauagcauauccaguguucaccuaagcuggcugaagauggugucaauuauaaaaucuuauuaugcaugaauagagauauggccuauggagaagaggaaaaagaacaaagguucuguggcagagaauucuuguugcaucaucuccaaggcccaagauguuacuuccuucugaggaaguaagugagguuuacugugagcguauagaguggacaagcgcucucagacaucuagaaccgcucucuuaaaagaagcccugcaguuuuuccacaguguaggugguaaggaacuugguaugggccuccaacaagguucaggagucuucugagaugauuuucaagagacuauguccaggucauacacugugaaaggacuagcugccaucaugaagugauggauugugucugcuuucuuucaccaaauaacaguagucugaucuuauauuaucugaaacuuguacuuuuaugagaaucuuuuuggugaauuucucaaaaguaaaccauuuuugaguuauaucuacuaucugaacuagagguggucuuucuccugcugcuggggaccaagcacucuccguggcauugccuguaugaagcuagagcuccauugguaaagggcacagugguguagucaagugccuuuuuuggccccucucugcucuuucagagaucguuguagguagacuucagauuccacuggacuuuuaaacuacauacucaauagacacaguggacaggaggaauauuguggaggcuggaauauaugcuaaaggaauuucaccacauugcaugaugaugaugacagaggaauaaggucuuauuaaucauaaacauauuuucuuagucaugccuauauguuauaaauuuccauuuuuuggaggggauauauuuuacuuuugacaguauaaacuucauaucaaaugaucucagguguuaugagucuuuccucauuuguuuauagguucugagacuggaagaacagaugaauggcuugaaaacaucaaaugaacaucuucagaaacauguagaggauuuguugacaaaauuaaaagagguauauggugaccucuuaaaaauauuuuuguuguuuugauuuuguugugguggugguuugguuuaguuuggucucccugggcuggccuuaaggcuugcaguauagccauggauagucuugaacucuuaaaccuccuauuuccaccuccagaggucugggauuagagguguacuccuaucacacugguuuuuauacacacuagucaagauucuacuaguggagcuaugugccagucccucaaauaaguuucacuuacaaaauuaugaaagcauguauauuuguguuacuuggcaaaauauugucaaauauuuuuguuuuuguuauuuuuagauaauaucuuucuauguuuuccagaauggaugggccccacuucuuuagcccucaagcuggcuucaaauucuuacuccuucucaguucauuaaugauaggauuguaagccuauacuaccauaccugucugagaccauguucucaucuuucuccauaaaacaaccagaguggcuccaaauauuuucuaagcugauagaaucauaaacagcaguuaacauguuuuagacaaaguacuaaguacaaaaccagugugauuucauuuuauuuuguuauuuugcuugauagguacuauaugauuuucaaaguaauuuacuaucagaaaucaguuccauuuguagucuuuacaaaaggaacuuucugucuugauguuucauacauaucuuaaauauucaagcuguacuugcugguauauacauauaaaguugagcuuuuacuuuguuuuuaggccaaagaacagcaggccaguauggaagagaaauuccacaaugaguuaaaugcucacauaaagcucucuaaucucuacaagguacguccuccggcacacacguuaguccgucuccuggcguuggaguacugccuggugcugacuuugugauuaccuuucagagcgcugcugaugacucagaggcaaagaguaaugagcuaacccgggcaguggacgagcugcacaaacugcucaaagaagcaggagaagguaggacuuagagugcgaggaggugguuuuguuguacauuucuucaaauuuauuucaaauuucuucaaaacugauuuaauuuaaaauaaggauuggcuuuaacugggacaaaauuucauggagagaagaaaaagccuaggcuaagaagauuggaauuauauuuuaaagcaaguaguguauuugaaaauagagaugcuaaguuggugguguuuuccuccuucgucuuagauauucugggugcucucuuacacugucagucugugugugagcguguuuagucagucauccauacacuguguuaaauacaaauccgaauguaaucuuagagaugcuggccucagggauuccaagugacuauucguucaaguuacauaccuggaccuucauaagcuuuaggcuucuagguggguuguaggcucauagauucaggaauguuuccuuguugaaauuucgaacuagcagaaacuacagcuuugcuaguuaaacugaagaaaacucaaggaaauaacauuuuaagcauauguagauaaacuuaacaucuaaagaauugguaccaggauccaucaagaauacuuaaagauccucaguucucuuacuuaaagugaucuagccuaaagcuuaugaagguacacaucugccugucucucuuaccucagcuguaggcuagucacaguacuuaaugcaguguaaguagccccugcuuuaugguuugggggauggugugaaaguggcccugcauuuucaguacagauacuacuuuuuuaucugauuacuuucaagccaccgcugaaucuaacaggugggaucagggaaauggaaggucaacagugucuagaaucuuuaucuuuaucuuuucuauucuuuuuuuuucugucuuaaacuaaaggacaaaauugauuccgaagauguacauaguggucauucucuguuauucauacucucuugugguuuucuuggugagaaauauuaaaaaagagccucgacuagacucaucagacuggaacauuuaaaggcugacaaguagagccaggcuuugagugauaauagucauuaagcguagccucuaggauuuaaugucuccagaaggaaagauucuuaguguuuuaauuaauaaacugcaauauuuuaaugauggcuuucaauauucugucuuuuaaaaugcuuagccaacaaaacaauacaagaucaucuucuacaaguggaagaaucuaaagaucagauggaaaaagaaaugcuugagaaaauaggaaaauuggagaaggaauuagagaaugcaaaugaccugcuuucugcuacaaaacguaaaggugugacuaagauacuugcuaccuguucauuccuugagcugcucgaacauaucuaugcugcaauagaaaaacuugauuauuugaaaaauaauauacuauaagucuuuacagcaucaucagauauaaaugccauuugaccacaauauuauuaauuccuagaacaguuauuuguaauuguugugugguugccauauuugugauauauuugcaauauaauaaguaaaaaauacauuuaaugucacuauuccuucacuuuaaauauuuauuaguggcuugcaguuuugcaaaaacgcaaaaaaaaaaauuguguuugcacaggagcuauauugucugaagaagagcuugcagccaugucucccaccgcagcagcuguagcuaaaauuguaaagccuggcaugaaauuaacugagguaagaaugauacuagaucauguuucauuguuacugaaguacucaggggucuuaucuuccccucccccaauuuauguaauuaccugguaauuagcaggcaauuuuuuaaagaggcuuucuuuggccagugaggcacuuccaugaguaaaacacuugagcuggcauucucaucaacauauuccuguccucaaagccuguguuaagagaagcagcucacagacguuaucaucugacucugcauacacacgggagcacgcaccugcacucauagauacauuuuucacacacaucaguaauguuuuaaaaauaaaaggacaggggugcuggguugaagaggugccucagugguuaaaguaccuacugcucuuuagaggucccaagugcaauucccaguacccacguccugcaguucauagcagccuuccccacccucuggccuccucauguaccuuugcucaaaugaacauagucaugugcccccugccaccccacacacacacacauauaaauaagucuaaacaagaaaugaacuuuuuaacuguuaaguaguuauauguggcaaauaacuacuuacaaauaacaaauacuuuuauguaagugguauguucauuaugagccuccauaaacuacauacuccugucauuacacuucaacuuagugaaaugaccaccuuuuccauucccagcuauauaaugcuuauguggaaacucaggaucaguugcuuuuggaaaaacaagaaaauaaaaggauuaauaaguaucuggaugagauaguaaaagaaguggaagccaaagcaccgauuuugaaacgccagcgcgaagaguaugagcgugcacagaaagcuguggccagucuuucugcaaagcuugagcaagcuaugaagguugguucauuucucaacuugaccuuuaggcacagcuacuacugaaucaucuuguacuggcuacuuuucucauaacacucuuugcacuagaaaagcuugaggcuuucacucccacgaugacaaauucugacuuugacucagcuaaauugugagagucucuuacauauguuaaggugauugagagggaaaucuucuuggaccacucuucaaauauucucauagugcauuagaauguuggcuaauuuagcauaaccauuuuuuuucuuagaggguuugauaagccugucuagaauaaucauagcuugauauuaggucacagauuuuuacaucaauucaaaauuuagccugccuuaguaugcauuacuuuauaauagcuccuuugccauguuaaagguugcacguucgugacuacccuuuugcuaucagaggguauguuuuacuuaaugauguaagaguuuauacucuaauuuaccuuuaugguacagcuuuuuacagagaagucuugaagauuuaagagaauuuuauugaggaaauguagauaaauacauuuauaucuccuauuaacugauauguuuuuuucuuggagaauuugaguaaauuguauccuuaauucugaauuaaaucuucuguuauaauauagaagccgcugacauugagaaguagcuaauaaaguguuuuacagcaguguaacuuuacucauugugcccuaagggacuguuggcaaucugacaaauuaaucuuguauuucuauuuucagagaggucucuugggaccaauuagaucuuuuaaguuucucuguuaauaggauauugccuugaucuucuugguaugugaagugcaugucguuaguuaaauggcagauagacaucaauuagaauagcagcuuucaacuuauaaaacaguuuguuccuucacugucaaagaauaauaaaagggcuuaauggucauuucuucauuuuuuuuuaauaacuggcauuuucuauccacaacaugaauaauguguuuucuaguguaaaucuucagcucuuaauuuguaggguucuaaucgcaaucccacugcaucuacuuugcaucuuaauucaccuuguuuguacuuaguagguuuaugagugcugucuuuucugacuauuucuauacuucuauuuucacguuuccucuugcaccuacacauagcuucuuaaagguguaugaacuaacgagauauauuuaaaaguauaugaaaauaacuacgaaccuaaauaugcauaaauuggaaauagaacacagauuucccuuuaauccaucugaucuugugcuaaugggaggguucucaaaacuccaccucaaacuauggauacugcagagcucaccuacuaaguggguacuguuuugguugcugcuucuuugcaaauugccacagacuuuuaaugaagucuucugugucuuacccagcauauuuaguuuugacaucucaaguguuucagucuaacugugauuaccauugauccuucugaucaugauucuggggucauuuggaaaugcacugggaauuugauacuuauuuuugcauaguuguauuugacaacuuguuaaggguagaaaaugcuuuuuauugucauauauauauauauauauauauauauauauauauauauauauauauauauauacacauacacuauauuucuauuauuauuuauauccugggugacacugaguuuucccuuguguuuauauuuuaaaggagauucagcgauugcaggaggacacugauaaagccaacaaacauucaucgguacuugaaagggacaaucagagaauggaaauacaaauaaaagaccuuucgcaacagguuaggacauuuugugugauuuccaguuucuuugugaugcuugagucugcaucuuaugucucacgacgucucuucuaggaaaggcguauguauucucguccuguagcacuuacauaccaucuugucacugucuucccagagauuuuugauugauuuucacauuguuggugacauuuguaauaaguacacaaacaauugaaacaggaagcguuuuuuuguuguuguuccccauguccuaagaguguaaccaguguuagcaaguuggcguguauguguuucaugccauucauguaucaguaaguacauaucugaauauauaaguguguuuuuguuaaaauuagguuacacuaugcauuacucacuacugcuauuucuugagaaggggacuugaacaacccuuccucaucuuucugggugcugggauuuuaggugcacaccaccaugucugcucuuccucuaccugccauauaaaacaagcacuaaauaaguuacuuguaguuucauguuaaaaaaauagccauuauucugaaauuguauuuuucuacuuucuguaaguuuucuuuauauuaaaaguaacuauuucagcugggcagugguggcaugcuccuuuaucccagcacuugggaggcagaggcaaguagauuucugaguucaaggccagccuggucuacaaagugagcuccaggacagccagggcuauacagagaaagaaacccugucuggaaaaaccaaaaauuuuuuuuuuuuaaagcuauuucguuaaaaucuuuucuuagauuuuuuuuuuuuuuagcauuaaagugauagauuuugauguuuuuaaaaauacuauauauuagcuuugguugguuggguuuuauaacauuaaauuuuuguuucuagauaagagugcucuugauggaacuugaagaagccagggguaaccauguaauucgggaugaggaggucagcucugcugacaucaguaguucgucugaagugauuucgcagcaccuaguaucuuacaggaacaucgaagagcuucagcagcagaaucagcgucugcuauucgcucuucgagaacuuggggaaaccagggaacgagaagagcaagagacaacuuccucuaaguaagcagugaccauggcagugaccauggcuaagcacuggguacugggcuuaguguguccuuagagaugcuggguaauggaggugcuuagggaaacugagcaacgauucuauggaauuauuuuuaauaaggcgguaaacuuccguuuaauaugacuagugcuaaaauagguaaacuuggcagacuucauuuaaguuucaagaaagaagucuucauggaaaagagucugucugagcauuacucaagcacaguacagagguuuuauaaagacaguguguuagggaaggaagaguggcauugacugcaagaagauuaugugucaguaggcuugaugcugagaaaguaaguuuuccagaugcuacuaaugaguacaaguacuuaagucuucuauggugggaguuuuaagaaggaacagaauaaagagcaugaaaauagucagcaugaagguagacgguguuugaaugauuuauaauagacacuguacuccccucugaacacagaccuacaaagacuuuuauuuucugcaggauugcugaacuucagcauaaacuugagaacucucucgcugaacuggaacagcuccgugagucacgacaacaucagaugcagcuuguugauuccauagugcgucagcgugacauguaccgaauuuuauugucacaaacaacaggaauggccauucccuuacaagguagauuuuuauguaacuacaggacaauauuuuggaagugaacuggugaauagguuuuuugacaaaagcaguugcuacucuaauuuggaaauugacuucagcuauugugugugacugauuguaacauugauuuuuaggugucauuuugacacuacuaagaaaaaaaauauuguuaaaaaccauacuuuuuagacuuagugaauuacaugguuuguuuuucuuguuuuaguacuuuaauuuguaauacauugcaucuaauuuaaaaaaugaacaauuuuucccuuuuuuuucuugcauuuuauuucugugugugcuuguguaugugcaugcauaaaggcuacugugugugugaggucaggguaacuagugggaguugguuuucuccugacagcguguggcucccagggaucagacucggcuuacugggcaccuuuucccacugagcuaucaagcuuuaauaguuuuuaauauuuccauucucugauaggucuaguaacacuuuacuuucuacuucuuaauuuaguagugaugcuuuugcaaauaauccuuaaaacugauuuaugaaagcacgcaaaaacaucuuauuugucuuuuuuauuuuucugaagcuucaaguuuagaugauauuucucuucucucaacuccaaaacguucaaguacaucacagacuguuuccacuccugcuccggaacccgucauugacuccacagaggcuauagaagcaaaggcugcccuuaaacagguaaagacuauaccuaguuaaagucauggguuaguuauaccuaguuaaagucauggguuaguuucaaguugaguuuuuggggaaaauaguaucgucuaaugaucuucaauguuuaguugcaggaaaucuuugagaacuauaaaaaagaaaaaauagacagugagaaacuucaaaaugagcagcuagagaaacuucaagagcaagucacagaccugcgcucacaaaacaccaaaauuucuacucagcuagauuuugcuucuaaacgguaaauuuucuuuuguuugggaauuaaugccauuaaauguugcacucacaguguucugaccagucaggucccagagcuaauuuacaccgguguugcuuuuuucuauguaguguguucuaagaugagagacuguaaccuucauuccuuaacauuggcugcgaauucuccuguucagggccaggagugaaagauaacgagguucucuguccucggauugagagacguuguuucuggagcucuuucugaagaggugggaagggggaauuguuugagacagggucuuacaguauagcucuggguagcauagaacucagucaguagacuaggcuagacucaaacugguggcagcccugccugagccucccagugcccauaauggguuuguguugcgggaaauauuaaaaaaggaacuggcacauucccacacaugugccugcaacucuuguacccucugugggcccaccggcucugucuaccugccaacucuccggugcucccaaauuccucucgcugcuacgcaacaaccauccaccccacaaucauaucaccacacccauguaccuguuagaaucucuuaaagcuuauagcuggccaaucagauuuauguaucaauaaauuuucagcuuacaagaugccaauacaguaauuucagaaccaguugauaaugauaaaagcuuuaucccaaucuuucuaaccuuaugauaucauaacuaccuguggcugguuaaagccaugcugguucaugucugccuccaucuuggccuuccccuucucucccugagaugcucugucauuccagcuccauccaccuuugcccuguccaaucacaggccuccugcugcccuaauguaauuggacagggaaaaucuugcaacagguuuguaucucucacuguauacccgcggguagccugauaagcaguagacaggucuagccucaaacuuauggcaauucugccucagcaaugcuaguauugugaguguguggugccauggcuaucauuucuggagccuuuccuucaugugcuuguuaguuuagauacuuaaauuacauugucauuauuuucaauaugaauuuuuaauaaguuauucaaugaaauauuuacuuauuuauaauuucaauuuuaacugguaaauaaggguaguauagaaaguugcacauuauuacacaagccacuuucuaauuuuaaucaugugaaauuaaguuucugugaaauucuucaaagaccuaagaacuggucaucuuuauuaccaguuaugaaaugcugcaagauaauguagaaggauaucgucgagaaauaacaucucuacaagagagaaaucagaaacucacugcaacuacucagaagcaggaacagaucaucaacacaaugacgcaagacuugagaggagccaaugaaaagcuagcaguugcagaagugagaccaacacccccuggcugacauuugauauggcuacuuauuucuuaaauuuuauugguuaaaauagcauaguaaaguguuguuuagacuaugauacauguuuuuuaaauagcuuacauauaucuaggaaaaauuucaaauaaaauuuuaguugaccauuuauaaaaagagaaagaaugcucccaacugaauaucaaauuagauuaugauaaaguuaacgcccaucacuuuuggcuuuuaccuaaaagcuagguacuguaugucaucucuuuuauaaaaguuagguacuguaugucaucucuuuuaugagaaauagguucuaaagcuaguaaguagcuugccucuguugacaguuacgagaaacagauuaguuaggacuugaagacacuggguuuuuuguuugcuacauugcauuuuaucuugcuauacuucaugaugggaaauaggagcuuuuuucaaacuguuuuaaguguugauaauuaguaugacucagaacuaaaucugaauacuuugaagauacugcauuuuaacucacucuugcauuucuccugagacauaagagugcagucuuuaacgaagaaaaaaaaaauugacaacauugguuauugcuuuaaaagaaguccuuagaaacuuuuggcuuauaagacuuaacauaauucauaguguauugauuuugacuaugguauaguuacacacuaauauuuguugugguguuuuggauuuuguucuggguuuuucuuuuuuuucauguguguguguguguagcugugucuacacauaagucccagugcuugaggaguucaaagguaccaggaccuuguccuggaguuacaggcacuuaugagcugccuacugugggcguugagacaucuggaagaacaccaaaugcuuuuaaccacugagcucuuucuccagcuuccauuauauuguuuuuaaagaacaguuugcuagagcuaaauuaacauaaguauguguuaaguccaaucauuuuaguucauuaaacaaggaauuauauuuacuugaucaagaguuguagucuacaucauauuaagaaauacauaguaaagaaaacguuauuuuaauuuuguguauuacuuuugacacaguauuucccaacacuuuuucuuucacuuacauucauuuuaagguaagagcagaaaauuuaaagaaggaaaaagaaaugcuuaaauugucugaaguccgucuuucucagcaaagagagucuuuguuagcugaacagagggggcagaacuuguugcugacuaaucuacagacaauccagguaaacagauaagaagugcauggagugauauuugauauuaucuuuuguaucuucuuaauuuuccuaacuaaaaauuuuauguuacuuuuucauccauuauaguuauauuuaaauuggugguguguaaaagaaaauacuuuaaaggaaacucagaaagagaauugauugaaacaaaguaauuaauaugugagagucuuagaauuauaacuacucuaauguuuuugcccccauuccauaccacuaaauauuuaauaugaaauaaauuuuuuaauaugaaaaguggccaaaauacuuugcauauguccaacaacaaucuucucaauucuaaccucaucauggauuauaaucucauaauuuuauauagcuucuaauauucuucgucuugcuuaauuucuuuauuguuaagcauccuucacuucuucuuacauuagggcauacuagagcgaucugagacugaaaccaaacaaaggcugaauagccagauagaaaaacuggagcaugagaucucucacuugaagaagaaauuggaaaacgagguggaacaaagacauacgcuuacgaggaaucuagacgugaguauuagcaucugggucuauguaauuuauaguuacuguucuguacagaaucuuaaauaugccuggucauucuuaauauuuuuauucuuugacagcucuguacauuuacauaauacauguaaucauaucuguucaccaccuccuuccaacuuccacuauugcacccgcuuugccugccucccaacuuucuguucucauuuucuuuuauuaauuaccccugaguccaauuagugaucccauaagccaauuacagcagccuaccugcagccacauccccaaaggagagcaauucucccucuagcagcuagcagcugccaguagcuucuuccucaucuacaccuaauuuaacuggcuugaucuugggcagguauugucuagauagguaaucucagcuccuugaaggugaugugugcaauagccauguugugacuagagucugcauuucacagcuccccucccagccaccugcucuucuguucuuucugccuccauuuccaagaaauccccagagccucggaugguagggaguugauauaggugaccuguucauggcugaacacucugguguucauuaaccacugcacacugcaagaaagaagcuucccuggccaaagucaagagcagcauaaagcaguguauaaagcggauuauuucgagugcaguucgauagcaugaccauugagcuaaacaacaacaggaaguuuccagcugggggucuacaaacuuccuaguccugggcuuuugacuggguuuacaguacuagguaugaaauucuuacuguagagcaggccuuggaaaccagaaagcaguuuguugccccauagccaucaugccauuguugcacuggugggcacuucuugccgaaaucaguauuacaccacagagggucuagcacuggguaagcaaugucuuuucucucccagcagccuacauagcaccaugugguauaguguaagcuauucuucaaggaaagucuucuguucauuucaagguugaccucuccauucugcagccaaagugcuaaccaucaguaggauccuaacuaucuacuuuaguagggcaacaaauagcaggagucccaggaguugcugaccaugaauuuagauacuggauguuuuguauuguuuagaauuuucccuaguuaacgucuggaagguaguaaaguuaaaaauaguuugaguguugcuuuuaaugaaguauuaagcaggcccagaauggugcuugguuuaacucuacuuauuccucagcacugaugcaagaccuuuguaaaguccuggcuguguggugcagggaauauuugguguuuuuggcugcucuuaacuuucaguauuaggcagucuucauguugagccuuuuggugauaugugauaauuucacaaacaugcuuaucacaaaugugccggacauugaagagagguauacacacacacacacacacacacacacacacacaagcaugaacuagagauacuuuggucuucaggaacuuucuaggucuguguucucaauucagggaaucuguuaagaucucuucauuuucuuaugacauacuccagugucuuauuucaguaagcuaggcuguacuucucuuucuuacacuagaaaccaugauuguaacauguccuuugucauguuaagaauuucuagcuuagcaaguguucuaagauccuuaggauaucacuuuaaauaucuaguuacauaagaaccuagugaucuuuauaguguuaaugcauuuguuucuuacagguucaacuauuagauaccaagagacagcuagauacagaaauaaaucuccaucuuaacacaaaagaacuguuaaaaaaugcucagaaggacauugcuacacugaaacagcaccuuaauaauauggaagcccagcucgcuucacaguccacacagagaaccgguaaagguaaagagaguagcuugguguagcauuaaguaaaacagacaagucuuacaguuuauacucugucgugaaacuaaauccccucuuccugcaugcuaugaaggcugggaaaaacauuuuacuuuccaaauaggaaaguucaguugggaaacauaauaaguuuggaagacuugagaauucaaauaauugucugacaucagacuuggcuguucugaguuuucugaucuuugaagcuaucuauggguauggagugguauauuuucugucgaucaaacccagagcaucacauauguaagacaaguucaccacaacaauaaaaccauuuauugauucuugaaauuaguuuauugauugaaaugagaacuugucuuagaguuguugcugugaagacacaccauggccaaggcagcuuuuagaaaggaauuuaauuagaggaauacuuuaucgucauggcagagagcaugguggcauauagacagacaugguguuagaacaguagcugagagcugcuuucucuggcuagaaagaggggcccugggccuaguauuggcuuuugaaaccucaaagccuacgcccaguggcacaccuacuccaacaagaucacacucucuaacccuuccagacagucuaccaacuggaaaccaagcauacaaauguuggacccugugggugaucagucucauuuaaaccaccauggagguuuuuacuaaucuaugauaaaguccagccuagaacuuauauguagaccaugcuaauccugaaucagugcucugucuaccacugacccccaagugcuggaauuaaaggcaugugccacuaugccuggcuuaguuuuuauucugauauucaacucauuuauuuugauuaguauucuuggauuaaauacuucauuugauuagggugucuuauacagaugaagaaauucaacuuuuuaaacauuuaaaacuuuuguuccauauuaucuuucuauauaguuuuacuaauaauagaaacaagguuauguauguauaauauuuauauauuaaauacaggugucugauauauguuuaauagauguuuuacuaaaaucucuuauugauaugauauuuaugauaaaguaucccuuucaacuuucaguuugcucauuuuccauuuacuuuagcuaaaacaaaaauugagauaaauugcagcuuggauuugguucaauauucuuucaaauagucuuaauuuucgugaugagauuuuaaacacuuaaauuuucggaagcagugagacagcagacuuuuaaauuuuccuuccuuucuccucuuccuuucuucuuucuucuuucucuucuuucuuuuuuccuucuuuccuuucucagacacuagcuuccauggcucuggccagccuagaacuuauauguagaccaugccaaaccugagucagcgaucugucuaccacugcuccccaagcacuggaauuaaaggcaugugccaccaugccugacuuaguuuuuauucugauauucaacauggauuauaaauuaaaauacacuuuguagauaauuuuagcuuuaauccugauuucauguacuuuugauagaagucauuuuuauuauuucuuaaaacauuaauugaaaguauauauuuuacuagagcguuuuauuucuuccaggucagccuggugacagagaugacguugaugaucuuaaaagucagcuaaggcaggcugaagaacaggucaaugacuugaaggagagacucaagacaaguaccaguaauguggagcaguaucgagccauggugaccagcuuagaagauucccugaacaaggagaaacagguacauagaagccacacuguccuuaauuaagaacuugcuuguuuauaaagcaguguguuauggguuaggcugacaucguuucuuuuacuuuuggaaaguuuuugggucuaauaagucaaaacaaaagucacacgauuuagaaagcucaggcauuggggagaaugaauaugaguuaucugcugcucgugcaugacuccgcgucacgguugacaaguggguaccuuugaauagagagccaugcaggucaucaaaauaguggaaagcugucaagccucaaucgagagaguauucagauaagcaugucagguuauuuuugugugcuuauauggaaccauugauucuuaaugugucauaguuagaaaauuuucuucaaaggguaguguaguggauuaaggauauauuguagagaguaccaccacuuuuuaaaaaugcuguugugacuggcaucaauccauaucuuuuacugauagacuaaguagauuugggcaaauggauaugaggcuggaagggaaaauaaagagauucagauuucaauauggaaaaacccagguugaaagagaaguuacgcuucuagauuuaugugguauaucugcuuggcuaaucaucuuagggauucuucuccuaguauaagacaaauaguaacuuuaguuugguuccaguucaguuuaaauugggaaaaguauugcauaucauguuauuacucuuguuucuggcugcuuaugaaggugacugaggagguucauaagaacauugaaguucgcuugaaagaaucagcagaguuucagacacaguuggagaagaaauugauggaaguagagaaggaaaagcaagaacuucaggaugauaagaggaaagccaucgagagcauggaacagcaagugaguucacugggauucacaggagcuugcuuucuuagcaaccugaguucacuuuauuaguucauaaguuauacuuugguuugucucaucagaaauugcuugaaugcauaccuaugaauuuuaauuuuauauuuucacucaauucugugcaucuguauaaauuuccuuuugaaaaauuuagaucacuuaacaaaauugauuauuuagugcugcuuuuuagaaagaagcucugccuuggauuuugcagauaguagccagaguuaaaaacuguagauuauaucagauuauauagcuguauucaguuuacuuaaguggauuguuuaaugucuuaaguauuuucccagauuguaauuaacuguggcuuacucuuguuuaguuaagugaauugaagaaaacacugucuacuguucagaaugaaguacaagaagcucuucagagagcaagcacagcuuuaaguaaugaacagcaagccaggcgugacugucaggaacaaguaaguguucuucucauaguuucugagcaguguguuuuaagccucagguuggauuccagcuuccagacaugugaaagcccagugcugugggaggcggaagguuguaggguugcuggcuaccagaagggugcagugagagacccugucugaaaauaauagacagagagcucuagagcaggacacccaaaguccuuuagccuucacacaugugcguauauaacagaaauauugugugugugugugugugugugugugucuaaguauuaauuuguggaucuuaaucuuuaucgaugggggaauuguuaauugcaggcuaaaaucgcuguggaagcccagaauaaguaugagagagaauugaugcuacaugcugcugaugucgaagcucugcaagcugccaaggaacagguuucaaaaaugacaucaauccgucagcauuuggaagaaacaacucagaaagcagaaucccaguuguuggaauguaaagcaucuugggaagagagagagagaguguugaagguaauguuguaggucgcaguagaauguucugaagaaaggaaaggguuucuuauguuuguuuuuccuguacauuugggaaaacauuaugauggacccuuggcuuguaggaugaaguuuccaaaagugugucucgcugugaagaucuagagaaacaaaaccgacuacuucaugaucaaaucgaaaaauuaagugacaagguggucaccucuaugaaggaugcugugcaagcgccauuaaauguaucucucaaugaagaagggaaaucucaagaacaaauucuagaaauucuuagguaagucagcuacauucuuacaguggcccaguaaugaggaaggcacggacguagugcuguacagcucacuccgccucaguuggccaaggaaccuagugcucacuauugauacugagaugaaauccaugcuuguaagguugaaucucauaggaagaacuugagcugcuuuuucugagaaacuaaagauaaagaccagcucugcguggugagaagggcacaucuguaauccuagaaggccaaggugggaacuggccauuacaggacagccugggcuacauaacaagaucccauuucacgaaaggaaagggaaacuagaugucucaaauuauuuuaaagauauuuuuuuccucacuaaccccagcugcuucucccucucgaguguuaggauuauggaugugugucauuggacacagccuaaagauaaucuaucuuuaauuguuuacucacguauuauuacugaguguuugugugcgugcaugucaugcacaaguacuguuauuuccuuagccauuuuguaggcccagaauaauauguuucugaugcuacuaucuaagcccaaaaguaaucugucguugaaauaugaaagugaauacuaaagugaugcauuuuguugucuuaauucuccaaguuuuaaaacacuaaacuuagaguuuucuaaaauuuuaacaugccuucuuguagauuuauucgacgagaaaaagaaauugcugaaacuagguuugagguggcucagguugagaguuugcgguaucgacaaagaguugaacuucuagaacgggaguugcaagaacugcaggauagccugaauguggaaagggaaaaggugcagguauguccauacaccaagcuuaaagaaggaaagcucauguguuucuaccacgauacacuaauuugagcacucauccuaaaguuguaaauuuagcaucuguccaguauugccgaguuguguggugauuagaagcucuguuguagaggucugguuuggaauucugcuuccauaggauuagcucgauaugcugaacauugcuuagcuucccuccucuuagucuccuugucuguagaugagagguaggauugagauugugcaugcgaaucaucuggacuguaguauacaguauauaaaauuccagcuuucuaaucuuuugcagcugcuauauauaaauaccuugugauucauucuaaaauaaaagucuagagucauucuagauagaauagauugaaacuaagaaauuaaacuaaacacaccaugguaacuccaagcacugguggcucucaacucacugcugaguccaugagcucacuuacuguaccuguuacuagaguaacauaacuaaauguucagaauccugagcaggugugggaaggggaaaagccaggagucaaaguaacaguacuuuagagcucauaccaaaguacaagcaaaaauaccuguagugcuggcagcauuuguaguccuuuuuucuuuaagucucuuacauuuauuuaaacucauuugaaauuaacaugucucaggaaaauaaccugcaagcuuucaaaguuucaguuaaaguugaaguuuaaauucucuauacuuuuuuauugggaagauuagaacugguaggaaaaagacgagucugagugcugguuguugaucuauguguuugucacuguuucagguaacugcaaaaacaauggcgcaacaugaagagcugaugaagaaaacugaaacaaugaacguuguuauggagaccaacaagaugcuacgggaggaaaaggaaaggcucgaacagaaccuacaacaaaugcaagccaagguuugugccuuaccagcugagcgcagaagcccuuacuauuuauaaagauacagauugccacacccacuccaggagugacuugagugacaggucuagaagcuuggccgcagucccgaggcaaaaaguucacagaaacuuagucaccuggaaccagggcauccuguauaacgagugcuccaaaucuguccuugcuuuaguagagaacggauccgugugcuuuccuucaguauuguuuuauuauaagugccucuaaggauugauuuuuuuugacauauagcuaaguuagauuagccuccuccaaugucccuauguccuaggcaguccuugagccaauccugggcuuggaauucaguaagaauguugccuauuaagugacguucagaauuaccucuaguauuguaagggagacagugaaagaaauuaggcuuuacaguuacuugaauagagcuagaaaucucagucuacauaguaaauacuuaugaacaauaauugccgagucacucccauacacaggaauuuacaauggccuaggaggaaggaagguugugguuuuaggaggaacugggaguguuguacuauucaugaaaggguuaaucguaagaacuccccuggugcauguuuuucacuaggucuggaggauuagcguaaguagguauguacuaagggaccccuggugguggguuuaacaauagacuagcauugcaucagaccuuucaccuggcuccuguaaauagcugauuuuacacagggcugaucauaccucuauuguaaaccuugccugguuccugccagucauuuuguaugcauuuuuuguuuugugucagauaauuucaauguaccucgucugaccuuaauguaucacuuaacuucuuuguuuucuguaauauauaaaagucucaugcucacuuugacaaauuacauucagauacaacacccuuuugugucuguauuuguuugucauuuuucacugaaucccugacuaccuuuacaggacugauuuucccacggagcaaggggcccaacugaggccaguccgcggcacagauuaauuuaccauuuguuauaaacauacuugggacucuuuucaggugaggaaacuggaguuagacauuuuacccuuacaagaagccaaugcugagcugagugagaaaagcgguaugcuccaggcagaaaagaagcuacuggaagaggauguuaagcguuggaaagcacggaaccaggugaguacaguuagccauuuacugacacagaaaugagcuucagcaguguaagaauuagagauggaaaauaguugugaaacuagugaaaauugcauucaccauuagaagacuaauaguuauaagucuauuggggaugagaccauauagcauagugcauuuagugagaagucuaccuugaaaauacuaguuacguagcgugugaccuccaugcgaguuuucuaacuuugcuagacuaguuuucuucauuugcagggcgugguggcgcacgccuuuagucccagcacucgggaggcagaggcaggaggauuucugaguucgaggccagccuggucuacaaagugaauuccaguauagccagggcuauauagagaaacccugucucaaaaaaaaaaaaaaaucaaacaaacaaacaaaaagaauauggcucuuaaagcagugguuuuuuugggggagggggaacuuuugggauagcauuguaaauguaaaugaagaaaauaccuaauuuaaaaaaaaauguuuuuggugacagaaauuaaacucaguuucucagauaccgagaaauucuguagaaugguaaccauuuaaggauaaagaaauauuucagaauuucagagcacuuuuauucuucauuuugcucuuuguagacacacaaugaggaaaguccagugagauggcuaauugcagucuggccugaagaccuaaacuuaagucuccagagccaacauaaagacagugagaacugacuuuuacaaguugacuuccacauguguuuaauggcaugugcgcgugcacaaacaaauauacacacucacucacauaaacauacacacacauuacaugcacaauaacauacuaaauguuaaaagaaaaaaagaaacuuaagucaaauucguucaaguucauucacagcucugaaaaaugauaaacaguuaauaaaauuugauguuuuuuugcccgucuaucuuggcuagauuuugcucuccuaauuaaaacuucaaacaugcuguuuugauacuuacuacucuguaggcaagacaguuaaagugaauaagcuagauuuuuaaucacuuuacuauagcacuuuguguuuagauaaccugacaguaugcacuucuauuuuucuagcaacuaauaaaucaacagaaagauccagacacagaagaauaucgaaaguugcuuucugaaaaggaaauucacacuaagagaauccaacagcuaaaugaagaaguuggaaggcuuaaggcugaaauugcaagguauuagggaugaacguuuuaaauuauauguagugcacgauuuuccccaugagaugaggucucucuguagcccagaguacccuaggucuaguccauguguaacccaggguggccuugaacucaguguuucccucccaagugcugaaugacaauauguucucugugauccugcuuuguaggaagguaaaagcccuucgcugcggcucuuugccuuuguuucuuuucaguaagacaacaaaacauugaauucuuuguguccauauaucaagguuuuuucuugaguauuuaaaagcuacauguuguaccucuaaagcuaauuucuuuucuaacaauugauagucaauaacguacguacaauuuauguuuuuguuuuucuguucauagccucuuuaugaaaaucuauaaagcuuuuuguuguuguuuuuuuuaauugugcuaauccugucucuuauugaaaacuauagcuuacaaaucucuguuacauguuuuuuucuuuauuccaaacaguauuuuggcaugcucaguaugagagauacuauuucuuuaaaaaaaguaaaaacaaagagaggaagaaagaaaaagaaaaaaagaaaauucaaaaagcuugaguuuauacuuguacaaaguuggaauuagcugcugcucuuuuuagguugucuugcuaugaaaguucaguucaugacauguacaguaggacaaacuauauagaauacuaacaguugugcauaaagaauaauaugugaggaaacuguauauaggcuuuaagccccagcugacaaaguuccucugccgcuuaugggaaaccuggagacucugaccuacagagaacccuuggucgcaggucuagugagacugcgugccgccacuugagggcuucacuuagcacuucaguguuucuucagaacuggauuagaccugugcaauaaggucuaauaaaagaccaaaaucauaaaguacaugucuuucagguggagggaauuuuaauuagaaagcuauuauuaauuaaagcaguacuuaagcugaaaauuugccaaacauuguguauuugguucuuuuaagaaaccucuccucuuuuuuuucaaagaucaaaugcauccuugacuaacaaccagaauuuaauccagagucugcgggaagacuuaaguaaagcacggacugaaaaggaaggcauucagaaagauuuagaugccaaaauaauugauauacaggaaaaggucaaaacaaucacucaagucaagaaaauuggacgcagguacaagacucaguuugaagaacugaaagcgcaacaaaacaagguauuuugaggaaauguaauccccagcccuaauuuugacuguuaaugguuuuuagucuuaacucauagaaguacagugauauguuuauuugguuuugguuuuaaguuacuauuaaccuuuuuccuuuuuuuuuuuuuucuuuuucuuuucuuuuuuuuuuuuucuuuuggcgauagaguagggaaggcuggccugaaacuuagccugcuguugccucucagaugcugggauuaaagguguacacuaucaugccuggccuuuuuauauuucuaauacuguuucuuugcaaagcugauuucagaacuguauaguuacacuuucucgugacccaguaucauuguguuuaggggauacaggcccaucgcugcggagggagaaggaaggcgugacuuugagggucuguggcaggaacaugggaacaugcuccugcauuuucccucuccagaacaggcuguaucccccccucucaguuauuaauucuuucugagaaacccucagagauucacccuaggugggcacaucagugccucacucaaguguuuguuaccuuaauccaguugacaguccagaaauaaccaucacauuggcucauuguuaauuaaaguuaaggauaugcgauuuuacaacuaauagguuuuauaucauuuuagauaaguugugcaugauaacuaucaaugcuuuuaauccuuuuucuuuuuguuagcacuuuaguguguuuuucuuggcauagaacuuucccaagugugucauuugcauaugcuaucaugucacuauuuuccgacugaaucaucauuagggaguuguucuaugucagagugcauuuacaaagugccaccucuaaugucuacuuguauggauaaccauaacucauucccugauucugaacacugaaauuguuuuauagaaauucauuuuugagugcucuuauaaguaauuuugaacauuuaggauugucucuaaguugcagcaguagaauuacuaaauaaaaacauguuauuacuacacaccaucuuaggccauggagacuuccacucagucuucaggagaccaucaggaacagcacaucucuguccaggaaaugcaggagcucaaagauacccucagccaauccgaaacaaagacaaagucacuugagggucaaguagagaaucugcagaagguaggauuuugagggcuauggaagguuccuaguucucucuguaagccucagguaauagguuuaaacauugacacuccauuaccauuuaaagcuuguaaaaguguuccaauaguuuauaaaacacaaacuuugaggaacaacaauaugaacuaaccagugcccccagagcucuugacucuagcugcauauguagcagaagauggccuagucggccaucauugggaagagaggccccuuggucuugcaaacuuuauaugccucaguacaggggaacaccagggccaagaagugggaguggagggguagggaagcagggcagggggagggcauaggggacuuuugggauagcauuugaaauguaaaugaagaaaauaccuaauuaaaaauaaauaaauuuuaaaaaaacccacaaacugaacugauuugaguuaugugauacuuuuuuuuccuuaaaaagacauuaucugaaaaagagacagaagcaagaagucuccaggagcagacggugcagcuucagucugaacugucacgccuucgucaggaccuccaggauaaaaccacagaggagcagcuccgacagcaaaugaaugaaaagacuuggaagacacuugcacuagccaaaucaaaaauuacacaucuaucugguaauuucguguauccuauacacacacacacaacaugugugccugguacccacacagacaaaaagagaguguuaccuauucuggaaguugagucauggauaguugcaagccacuagauagguguugggaaucaaacuugacuccuagaagaacagcuaauacucuuuaaaccauccaucucucuagccuuggaaaauacaauuuucaaaugauguguuugcuguacuuacaaagagcacugguaauuagcuugggguacuguuccccuugugaccauauggaacaguucuacuugugacguucuuuaaguccagauugcugccuaccugcuuuguaaacaacacagaauguuuucuuaccagccuaaggauguuucucuacuuuuaguggaguacucccauggacuuccuggagagugaguggucuaucacaugcguaagguucccaguuaaacagcaggucacucugcuuuuccugucugauuauucuuuaugauaucuaagguuaucuuacagcaacuucaaaaaaauacuguuuugauuuuuuuuuuuuuuuuuuuuuuuuuuggacaggcagggguggugggggggggaugguuugaguccaauuguuucucuguauuaacagccuuggcuauccuagaaauuacuuuguagaccaggcuggucuccagcucacaagagaugugccugccuccugaguacuaggacuaaaggugugcaccacuacaccuggcaucacuggucuacuuuuuuauuauauacuauauaaauugugugaugugaauauuuuauaauuccuaguaacgaauaauauucauauaugaacaagcuccugguaaaguuaauuuacauuaacuuaaauuuuuuaggauaauuuaccuauuuuuaugcuggaguaaguaauaaacauagaucugucuagagauuugcuuacugagauauagauagugaguguaccagaacuaauauauagcauagggcaggauguaaugcuaacuguacaugccauuuaauugcauaauguuucugaugucugguuauauuuauaugcuuauuuuaggugugaaagaucagcugacuaaagaaauugaagaacuuaaacaaaggaacggagcucuagaucagcagaaagaugagcuugauguccgaaugacugcucuuaagucccaguaugaaggucggauuagucgcuuagagagagagcucagagagcaucaagagcgacaccuugagcagagggaugagccucaagaacccacuaauaaggugacugccgcuugcgcuuccaugacaaaccacuugugacuuguguauauuuuauuuggaagugccugguuuuuaggagucuguuagaauuuggacuaaaauuucaaauauacagacaguugauaauaaauagccuaacaucuuuguucaguggacguuuggguguaauaaacacagaaguuaauccuucucuucuuuauaggcuccagaacagcaaagacaaaucacacugaaaaccacuccagcuucuggugaaagaggaaugugaguucuaguucuuuuauagucugccuuuaaaguuccaaaagaaucaggugauguaguuuucaaaucuuguuaucaguaugcuuucauuccuaugucuaaagcuguagugaccagaaacaccuuguggcuuaguuuauaauugguuuauaaauaagauaagcuccuacucacgccuuaucauguucauaacagcucuaaaagucuaggcugggguuggagagaugauggcucaccacuggcugcacuuccagaggacuugggcuucauucccagcaccuauguaucucacaaccauccauaacucccaguuccagaggauccaacacuguccagucucacugggcaccaggcacacacaugaugccuagacauucaugcagacaaacauccauauacauaaaucauaaaauauuuuacaaauuuaaguucuggguugaaaguaacucaacauuuaggugcuuuuucuauauugccagauuauaccacucuggaacaugcccuacaguuuuuaguacugaaauucaaauccuuuauuaauaaguuuuaggauuucaugccuagaaagucaaaggcuauauucauugucuuuaaaacuaccuauuuuaaaccuaccaaguauauccaaaauagaguucagaaaaaauaguaagauuugaacuggguuaagguaauaccugcugaauaagauaucacuuuaaauagggcaugccuuccuuuuuauagggugcauagauuuuacaagggcucaucaauuuaauucucacuggguuauuuuggauuuuucuuucauuaagugccagcacaucagacccaccaacagccaauaucaagccaacuccuguuguuucuacuccaaguaaagugacagcugcagcuauggcugggaauaagucgacacccagggcaaguauccgcccaaugguuacaccugcaacggucacaaauccgaccacuaccccaacagcaaccguaaugccuacuacacagguggagucacaggaaggugagugaaagaacacaucugauuggcugacugcuuguaugcauuucuuuugagaggauaagagcuguaaggguaaguguagcauauaaagucuaagucagaucaugcaugacaaaaguagugaauauuuugaaguauaugauuccuagaacacuugugcuugggguuuuuuucuccccaauagucaucaaacucagguaagugguuuuugacuaaccuacauucucagcccuguuuguuuauuuuuggguccaggcuggucuucaacucaagaucuuucugccucauaggcaugugccauguggcugcccaagauacauauuguaaauacaguaaauuucuuccuucucuucugcuguucuuuucuuaagcuaacaaagagggaaaauauauucccaacauccaucgcuuugcuuucuggaaccacauguucucuucuaaugacuaagauauaugcuaugaaauccauuuuggaaaaccauaguauaaaauugcucuuucaaaucgaauaucauccuuucaccggagcucccugcacuuccugaugcuuucucuuacucucuucccauugaauuguaguaauucgaucauugcacuugauuucacguguacuuuucaaucuacuauauuaggaaucagaguuucauuuucuucguuguucaaucucuuuccuuaacaaguagauguucaauaaaagguuugcaagaucuuaaacugcuuugauguguuagaauugaguaaauguacagguaguuguugguguuaaauaccuuuuaucucaucagaaagagagguaggcagguagguaucuaguucaaggccaaccaaaguucuauagaaagaccauguccccaacaaugugucuuagucaggguuucuacuccugcgggguuuauucagcuuacacuuccacauugcuguucaucaccaaaagaagucaggacuggaacucaagcaggucaggaagcaggagcugaugcagaggccauggagggauguuacuuacuggcuugcuuacccuggcuugcucagcuugcuuucuuaaagaacccagagcuaccagcccagggauuguaccacccacaaugggcugagcccuccacccuucguugagaaaaugccuuacaacuagaucucauggaggcauuuccucaagggaggcuccuuuauuugugauaacuucagccuguaucaaguugacacacaaaaccagccaguacacaauguauaauguaaacacuccaaaaauaaauauauauccuccauucaauaaaagauuaacagauagauuaccaaacuaaacuuuuuuuuuuuaggacagagaaacuuugguugguugguugguugguugguugguugguuuugugcgguuaaggaucaaaccuuacgcauguacaaacacuguaccauucagcucugaacccauuuccuguuuucauggugucauugugauaccaguuaaaaacaaaauuucucaccauguucagcuucuuaauguuaauuacaucugguuauaauuuuauuagaccaauaaauaguacaacacuuucaaacauguacuuacccaccaaauauuacauacuacuguauuagacacauaggcaguacaauauauaacuuuugugcacauuuuuguguauuaaaugguaagacauagaaaaaacaguuaauaagauguaugucaaagaauaagguaaaauaacucaguuuugguagauuagaaggcauacuuacuaaauauugucauuguuuucagcuaugcagucagaagggccuguggaacauguuccaguauuuggaaacgcaaguggaucuguucguucuacuaguccuaauguucagcccuccauuucucagcccauccuaacuguacagcagcaaacacaagcuacagcuuuuguacaacccacucaacagagccacccgcagauugagccuacaaaucaagaauuguccccaaacauaguugagguaguacaaaguuccccaguggagcguccaucuacuuccacagcaguauuuggcacugguaagauuucauuuuaauauuuucuauuguuuuauuuuaugucuauggaugcucugucucuguauauuugggugucauguacgagccuaguguccacagagaucaaagaagggcaucauauccccggaaacuguagugacagguauuggggacugacccuggguccucuugaagagcaucagugcucuuaacugguugcuuaagauggcuaagccaucuucuagacuaauaagauuaauuuuuaaaaugaagcugcaguagacauauaugcuucacauuucuuaggugcaauacaucuugacuauugccuaaaacaauuugcuuucuauccaguguuacuaugaagaaagaaaauauuuuuauuuaguuuuaaucauacuuaacaguagauacaagaacaguucaaaugugcgcuugauguagcuuaaaaauuacauuuauuguaauuuaaauuauuagaaaauaauauucauauuuacuauuaguucaauuucaguuuuuaucauuaaguaaaagcccuccuacccccagauauuuugggcuguuuuuaaaggggaaaaauagccaacauauuauauguaacuuaaugugaauccugaaaauuaaagcuguucauauuauuuagcauauacaguaugauuuuucuuuauuuuuauagaaaguccuauguaaacuuuguaaauagcaauuuaucagaugugucauacaaaguucuaguuuuaagacugguuguaauauuaucuuugucuaaaugaaguuaccaugaucugacuuuugagguugaaauuguaugaucugaaaguuucagcuaccccaaguuccuccuugccaaagcgcacucgggaggaggaagaggacagcaccauggaagcaggagaccaagucucugaggacacaguggaaaugccucucccgaagaagcugaagauggucacacccguuggaaccgaggucugucacacuccuguguauuaccauugcaucagcagcuaagagcuagcugucagucauacucaaugucaaauuaaguuuugggagauuauccuaaaaauuccugaacuguaguuuucacuuauagcuaagguauuuugccauuaucacuugguuuauagucuuugcauaucuuuucaugaauuccuucccauuuaauaaaagcagaagcaaauuaaauucugcuuuuguaaggaagucuagucauuggcauucugcacauugacauuacuugccaugugauuuuaagauuaaggcuagccaaaauuacguuccuuuucaaccauagacugugaugaguuagguuguauaacaguaauaauacuaaauguuauacguguguauucauuaauguucguugaagaaguauuugaguauguuuauauaaacauuuguggcacagcuucauagaauugucgacuuaacguuuuagagaaacacugaugacgauucguguaguucacugacucaguaagaaauaaccuauuaugauuuaggaagaaguuauggcagaagaaaguacugauggagaggcagaaacucaagccuauaaucaggacucucaagauuccauuggagaagugaguaaacauauacaacuauuaaaaaucaauuguuuugaccuauugaaacacuacuugcuuuuuuuuuuuuuuuuuuuuuuuuugguuuuuugagacaggguuucucuguguagcucuggcuguccuggaacucauuuuguagaccaggcuggccucggaacucagaaauccgccugccucugccuccugagugcugggauuaaaggcgugcgccaccacgcccggcucacuacuugcauuuuuaaauuuguuuuguuuugcuuuuugaggcaaguuuuuaccauguagccuaggcuagccuuaaauucagacagcccugcuuuuuuuaaguguuggaauuacaggcauauacuaucaugucugacacugugugcuuuaaaacagguucuuaaauuuguuucucugauuuuauuguuuguuauuguauauuguuuuguauugauuguugucguucauaaauuucuuaacucauagaugcuacuuaauaauuugaaaaaaaauagauuuacugaauacuuaagccaaaugauucauuuuuaaaucagugucagaaauuuuuguuaauaguuuauuuuaauagcaagcaaaauguagaaaguaauuaugcaaaaaauuauuuuaguaucuagcauaugcugaauauugaguaucccuuauccaguaccaacagcauuucaugcagacuuuggcguauuugucuagagccagcaaaaagcacuguuugggcuugcugucacuuguuaaugucgguuuaggcugauguucugaggaguuaaagcuugagcacuuugggugccauggcucaccuauggagcuguccucccagccucccaguucuugauaugcuuguuuuuagaggaugcucugagaaugaaccugaucuuuagagugcagagcuuugguuuaugccagucuuugccacauguagacggaaaggcuuaaccaucuguaaauuacuuuuuauuuuuaauucuuguauauuuuuaauuaaaacauaauuauaucacucuuccuuucuucagccacuccagcuucuuccauguacccccuucccuaucaaagugguaacuuuuucccuguuauuauuauuacauguucuauguauguaugcauaagugcauacauguacauauacauaaauaaaaccuacugggucccauuuucacauuuuauauguacauaacuugaagguuuuguguauauuggacaaucagguaugggcucaucccuggaauagacuaacucuaccucucagcugucaucacuugccuguagguguggcccugugagauauccuuuuauuuacuuaauggauuuauugcuguauauucuugcuccuuaaccuccucccacugcaccuccucuucuuucaaguguuaugcaagugcucagaacguuucagguuccaguuuuuggguuacggauagucaguuuauauguguauugcaguguuucaaacauaauccguguaaugggguaacauuaguuuuuuuguuauguguuuuauuuuaaaacaauagaaauauuuuaguuuauucauuauguauccagauuauugcuaguuuugguaaagaccuuuuuaacucuuaaagggaguuacccagggagauuauacaccaauggaagacagugaagaaacaucacaaucucuacaaaucgaucuuggaccacuucagucagaucaacagacuacuuccucucaagauggucaaggcaaaggagaugauguaauuguaauugacagugaugaugaagaugaugaugaagaaaaugauggcgaacaugaagugaguuuaguaucuaucagccuuccuucugcuucccuuccagagcuagggcucaaagccagugcacugugcacauuggccuugagcucuggaucuucugaccuucuaccugugugcugcuuucaaccauugugcuuuaagucuuugguguuucuaauauaucaaguaguggauucucauucccagucaguuuuauuagauuaucaaguucuuuuauacagauuaguucaggaauguaggauuguguauuagaauuaaaaagcugaugguggauaaucaauuuuuaaacauuuuguuuaccuuguuuuggcugcauuauuuuguuauuuauuagagguaggaucuugguauaucauauagcccaagcuugcugugaagucucaaaaauucugcuucagucuuuugaaugcugagauuauagaaauguauggccugccuagcuuguuuguaaaugauugcuguaucauuuaggauuuguuuucagauuucaucuuuagucuuaauaaaaauggcuauaugaaucugauggucugugcucuuguuucuggaaaucaaagaagaaacaggaguucauaguuguuuuauuuguuuguuucuacuuuaccacccuguaccauuuccaaaucaaucacuuucauucuuugaaauguuacaguuuuuuguuuguuuguuuguuuguuuuuucccuuacuguggaaacgucaaaacucuugaaacacuccuguaugcuauucuaagugugcaaaaggaguggcgugcacuuuauucacacuuggacaucuucuucuaggauuaugaagaagacgaagaugaugaugaugaugaagaagaugacacggggaugggagaugagggugaagauaguaaugaaggaacugguagugcagaugguaaugauggauaugaagcugaugaugcugagguaacugguuagaauugaaacugucuccuuaagaacugugcuuagaaagcuugcuguuuuccugucauauagaaaaucuuguguuaccaggauaauaaaagucuucauaccuuugaaguuuuguuuguuuggcuugcuugguuugguuuuccucugguuuguuugcuuuuaaucauuugguguggcuuuuuuuguaaccuagucauuugaucugcuucagucauuacauuuuguucuuaggguggugaugggacugauccagguacagaaacagaagaaaguauggguggagcugaaagucaucagagagcugcugauucucaaaacagugguaagagcauuagucuuucaguagaguagucugguaauauuuuuuaauauuuuacuagaguuguacuucugauguaguauaacucuaguaaauugguaacuaagugcucugcccuccugauguggccauuagaugccauuauacuaucuguccaccucauugaacuauugugaaggucaaauguccuagacucucuaauguagcauaaagccauuuggaauaauuaaagcagggauggguagcagcucacagcuagaagagguugguccaccaaaacccuguuuuaagauuuguauguagaugugucuuuagauacuaccacugaagguuuuuucgcaaaagauauucuuagccauuuucccccaaauauaacacauauaaauguucuuuccguaagacuucuuuugggaggaguggguacuuuugugucaaucaaaauuaaguucuaguagucuuaagguuagaguugguccauuuucaaauuguuuauaggguuagagagaugguuccguauuuuuuaagagcacuuggcuccucuuggaaaggcaccagauucagauccuagcacucauguggagccccacaguaauuccccuuccaggugaucuggcaaccucucacagccucuauggacaccaggcaugcauauaguaguacacagacauauaugcaggcaaaaaucucaaacacauaaaguaaaaauaauuucuuuuuguuaagguacuacucuugugacuaguuuuauuugucccaaauucucaaacuaaauuuaaguuaauaauuuggauuauagaaaaguaaaguguuuuaaauaccaacugucaggacaggguucugauucuagaucagauuuagaaacuauucucuggcauccuacauuucauaguggagacaacaagaucuagauaccugaguaguaauuggaauuugaaguuugggagaaccaaaauauaaaaauauuaacagugaggcuuuuucuuagucaccuugauugauugacaugcuguuucucuagaaagggguaaguagcuugugcagugauuaagaauaguauuggacuagagagauaacucagugguuaagagcacauauugcucuuuaaucggccugaauuuaguuucuguauuaggugguauauagccauauauaacacaugcugcaggggacccacucucuuccagcuuccauaggcacacagacacucauaagcacauuuaaacauuaagaaauuauaguaccauaagucaaaauguaguaaauacaugcuugaucaaaucuugagcaaagugcuuucaucugucguuugagucuugaagggagggugcuuacuugccuguuugucuguuaaccauccagagugagacagagguaaucccaguauucggcagguaggaggagcugaaguucaaggcuagccuacuacauagcaaguuugaaaugagccaggacucugugagacccuucgagguuuaggccaugugauuucauagucugggcuugguuuccaaacugaagucuuucuuccauaggugaaggaaauacaagugcagcagagucuuccuucucucaggagguugccagggaacagcagcccacgucagcgucugagagacagacuccgcaagcaccgcagucaccaaggcgcccuccacauccucuccccccacgccugaccauucacgccccaccucaggagcugggaccaccaguucagguauuaaaagaacccagcuucugaaaaagccaccuuguaaauucucuuuuccaucacaugguccuuccuuuauuccuuccaaauaguagaauuuuuaauguuuuggcauguuguaagauacuacuuuuaauugaaacuaaucuccaguuucugagugugaaugaguuggcuuuugaaaacacaacuugcuaaaaauuguauaguuauuaaagugauuauagucauagcaaauacaauucugcuugcuguuauuauaggcuuaaaauuucuuaaauuuuauuuaauguaaaaugcauuuagcuggcuuaguaacaguuuugaacauuucuuacuuaagguucauagauuuuuuuuuauuguuauucuaccuaaccauuuuuucacaucaaauauuucuacuuaguucauuagugacccuauguauucagcauggaguaaguuaauucaucuagcuugguucuuauucuggacauggugaguguauugagaaccaaccauuauguauaaaucaaauuaaaauaaaaguaguggaaauuacuugauauuugaaaauacagagucuaaaggaacuauaugacuaggcaucacaaagcauucagucugccaauucaagauuguuuuagcugugaaguaagaagucaguugguauauaaacuacaacggaaaaccucacuuaguauuuucagccaaggagauagaaucuaaauguauguacaugcuugaauuauaaauaugccuuuuaguuuauaaauaucuuuauuaauaaaauuuaaacuuucucacuuauauuuaugauagauauuagcaauucagaaauguccuguuaauucuaaaucuucuaaaauuaguugauauuucauuacaaaaguaauaaacuguaucuuugguguuuguuuuaauugccuaauucuuaaagcaaauauaauucuuuuucaaacagagaauucagaugacccggaggcagucuguagggcguggucuucaguugacuccaggaauagguggcaugguuaguauccacccauccugugcauguaauucacauguaugugguuaggccuauuaaauacugugcucugucuguguuucagcaacaacacuuuuuugaugaugaagacagaacagucccgaguaccccaacucuuguggugccacaucgcacugauggguuugcugaagcuauucaguaaguugauguaaugagaaugaauguuuggugaucccuagcugcuuucucuuuaccuucuaaauuguuuuuuuggauguguuauuuguagaguccuacccuacuuguccaugaaucuauauauguaauaggaucgugaaaaagucguguugaggaagacuaucuagggugaauaaaguauaccuucuucuaacugaagcacaguguuacagugcuuaugaaggugguuucuacgguucgagugcuuccucacaagagcaggcuccuugcucucccuucugaguaaccucauuuuacugauaauacaguuugugcuuacauguuuagauacgaccugacauauauaaguaaaugcuguauugguacuaggggugauguugguuauuaaagugaucaugauaggugguuuauuguaggagcucaggucucaguagccagguguaaugcaacaggcuagaagcacgacagugugccugaugaucuucauugagccaagugaaguaauuguucuaacaacuaauaagugagcacaccugucuuacacuuccuagugauuacuuagaauuucuaugcguuauuuaauccucaaaacucugaacuuagaauagacuagaguaacuuauuuuauauugcuaaacagugaaaacugaaauuuaaaaaaaagaaaaaaacuucuuuuguuguugugcuuccuguugcaguguaucuguuucaaacaaguugaaaaaaaucagcauaauuuggggaagcuaaaaguuaaauuauguuacuuauauuacuaaauuuauuuccaauaucuuugcaagaaacccuugacgaauuauuuucauuguuuccuucccuauuuauugauuuuuuuuuuuuaaagcaaccuuuuccucuuuugguuuaaacagguagcauuaaauuucucaucaaauuaauuuuuguucauuuaguuccccacagguugccgguguuccuagauuccgguuugggccaccugaagacaugccacagacaaguuccagucacucugaucuuggccaacuugcuucucaaggagguaaaauaggcaaaagccagagguuucuucagugugucuacugaguagaaguuaguaugcucugcuuuucuucagcugcuaucaguguaaccccgguucuuauuuauaaaguuacugacauggcacugccuuuucuaauaaauaccucuucaggaagguucuaguuccuuuagccuaaagacuggcuuuuauauauauauauuuuuuuauauauauuucuguauugcuuaauuaccguuuuauugccauauugaaacaccaugacaaaggcaacuuuuuuuuuuaaugcauuuaauuggcuugcuuacaguuuuagacaauuagucuguuauuguggcagggagcaugguagcagacagacaugauacuggaaaaguagcugagagcuuuacauccuauucuucaagggaaucgagggacacugggcuuggcaugugcuuuugaaaccucaaagccuagcccuagucacacacuugcucacaaggucauaccuuguccuaccaggcuauaccuccuaguccuucccagacaguucaacuaacugcgggccacgcacucaaacauaggagucuauuggauccauucucauucaaaucuccacauaauguaugaugaacaaguaaaugcugcuaagaagugccagcuccuuuaaaauuuaggaguacaguguauuuuuugcuuacaauuugagaguuguggcauaccuaguuaaauauaugacuaauuagacuuucccuagcaacaaaacaaaacaaaauugccaggcgugguggcacacaccuuuauuuaaccccagcacuugggaggcagaggcagguggauuucugaguucgaggccaaccuggucuacaaagugaguuccaggacagccagggcuauacaaagaaacccugucuugaaaaacaaucaaucaaucaaucaaucaauaaaauguuaaauauaaaauuaaguaguagugguagaugauacuuguaugugaguuuugguauuuguggaauuaucauuuaguccaugggugaaauuugauagauuucuggaaacuagcauuuugcaagugaauagagaagccacuacuaacuugcuuuguaaccauaggggaaguuuaaguuucaccagcagaaaggauuaauaacuuuggcaguuaagugaggaaaagauuuugacauaauacuuguuuauauuuggauauucuguaaaauuagcaauuuagggaugcuuuuauuaguauuaaagaauuuaaaagauguguugaauauauuuugaggaacuugauuuuugcuugauggaggagccucauuaugagcuucaagaaaauuauacacuuuguacuaauucuuuucuuugguguuuuuauguucuuucaucauucacuaauacuuaaauuuuucucuagguuugggaauguaugaaacaccccuuuuucuggcucaugaagaagagucugguggccgcagcguucccacuacgccucuccaaguagcagccccaggugggugccacgucaaugaggacuuuuuuuuuuuuaauuggugacauagaacacauugaaaccuauucuggcucagaacuaaugaaccacaaagguaaagguaucuguuguucuuuuuaagugacuguguucacugagaguaccaccucugaugcuucagaacaugccucucagucgguucccauggugacaacgucuacgggcacuuuauccacgacaaacgaaacagcagcaggugacgacggagaugaaguauuuguagaggcggagucugaaggguacgauuuuauugugugguuuuuguuugcuguagguucauuauguugucauaguuguuuguguuagcaagcaaauacauuaaaaucuguuuucagugcuauccugccccguggaaaagccaaagcacauauuuaaaaagcuacucagcauucagaauuuaggguuacuaugagagaggcaguuuauaaaaacauuauugaaaauuuuuuguuuuguuuucuaaggaaacagaaauaauuugcuagaagaagcccauaggcagugguuuuguagaguuaagucucaaaccugggaucuuaauucuuauaaacugagaaguuuguacauuuuagugguugagaaauagaacacagauuuuucugcucagagcucaaggacuugauuugacagugcuucauaagcaaggucuccuaggauauaauggguaagaggcaggucuguuuguauucuuuaacaucaguguuuaauugaggggagguuacaagucccagugagaaugcuagcuguuacuaauuauauacauauuuucaggucacuuuauauuuguccuucuaacccacacacuauuccuaaaauauauuacuucccaucauagaaauuaaguucagagcacguuaacaauaaugugcuuggacuauucuacugguaacagcucagugagaauuaaaagucuuaacgucagccccaugcuauuuacauguccccgucuugcaaccuugggggucucagguaaguuguuaccaguagcugcacuaauauuugcagauuuuuaaaaaguaaaguucaggccagguucagguuuuuuacugucuacucuucugugcuucuuaaaaggagcaagaugaaagaacagccacugagcuaggaacucugaugcccauagcuuguuaggucuggguuaguacucagggugacugaccgaucugcuguuacuaguuauguuuccaguuuaucaaaguccacucacuccugugagugucaagacuauaaacaugcuugucaaauggaaaaagaagggcugcugaaacagugguaaaaaguagaauugucgaguauccuaguaagggugugaaaaaaacccaacucaucccaucuccugguccaccuuacgauuaaaaauaaacacacuuaauaaccuauaacugagucuaauucuuaguuaacuagaacucugaaagucauuauaaaauaaaucaaaacgaacuuaggaacauuuaaaauaaauuguagaaucaguuuuccauuuucuaaucaauauuuauuucuuaguauuaguucagaggcaggccuagaaauugauagccagcaggaagaggagccuguccaagcaucugaugaaucagaucuucccucaaccagccaagaucccccuucgagcuccuccguagguaaguacugucccaugcagcuugacaucuccagguucagcucccacaccuauauuuuaacagcuaccuucuuuacauaaccacauuccauacaccuuaaagucaggauuauaaauaauauaaauuauaaauaauauaaauaauauguauaaauuguaacucucagcuuuauguacaaaagaaucagaaauuauagguaugguaauuauuaguccuguugauagucucugagaauugucuguccucuguacuagaauuaauacuaguuaucaaacuaucccuugagugaaaaaugugauugguuguuccuaggaaauagaaugucuuuacauuaauuuccuuaugggugacacuaucucugacuggguacucauucagcaaauuugaaugccuaaccuagcagggaaauccccauguccaagaaagugacauuuaggaaaggauuacaucucugugcuuggaacuaaccucuaauaaucaugaacccauugaaccacucaaauggugccaagucccaccacaacaaagaaaagaggaaugcaaggucccaacccccgaaucagagacuuccgcaacaaauauuguugaugucgguggaggagauugucggaggacucuugggugcaaggagccuccucagcccagaaauggagaccgggaaggaggugaugucgagugaggagcugguggaaacacuuacaaggccagauuucaacuccaaauugacguuuugaguauagaugugaggauauauaaacuugcugcaaauguugaguccaugacauuagcacuaacgaacucaaccaagucucuugcgguauuaacuacccgaguuacaucaguuucagacaccauugagcaccuuaccaggaaaauagagaaccucgagacagcaauugagaaagugggagagaaaguggacuuuguccaugccagaucugccauaggaaugcugagcaccgauguggaugggccagugugcccagcugccccaaccuguuaucccgucagugagccagccaguaucucauccucacggggcuuaaucauugauuuaaaaaaaagaaaaaggaaaaaaaagaugguuuauauaaugucccauaagccaauaggaugugcuugagacauucagagucagcacggaggucaugugacuggagcagaauggggagcaagauucaagaguguaugaaaagaguaaugaagaaaaagcaccuagaucuuuguaguugcucugagucucauggagcuagaaaacaauugaaauucuucacauagaauaauggcaugacacugcaguuguuuuggccaugguauguaagaggcuaaaauucauggucaacuuuuuuuguguguguuuguauaacugcuuagcuuccuuugcucuuaaaguagacuugaauguggaaaacaaauggcacaucuguuuuugugugauuuaaugauuauauaaugcugcuuuccuguuuuuuuuuuaaacuugcuuuccacaugucuugaugcuuucuguagauaccaguaguagucaaccgaagccuuucagacgaguaagacuucagacaaccuugagacaggguguucguggucgucaguuuaaccgacaaagaggugaguuucuggcauacuguuuacuugauaugugggauaauagcauuuguaucaauuucuaagguaaaccuaaggauugauuuauaauuacauguugaucgugugacacuuagccagaaagcuucuuuuaggcaaguugucauaguuauaaaaugaauguguuuuuaaaauugguguauuuuauuucauuagauccaaaaaaagauuuggaaaaucaaguguuagcauguugugcauuaucuguauucuuaugguguuaaguuuuguuuuguuuuguuuucugcaccgaaaguuuuguggcuauuaguagcuaguaaagaaauagaagauuuuaauauuuucacauucuucaaaauaacucauuuagacuguauuaacaucauaaaucuaguaacccagcuauaauaauuaccagucaacauggagaauaucuuuuuauauccauaucuuagauauuucuacugaaaaugaauuuugccguuuccuucuacagguauaagccaugcaaugggaggaagaggaggaauaaauagagggaauauuaauuaagugaucucuaaacugugacacaugugaauaagauugacgaaucuguuuuaauauaaugauugucaaguugagaacuguuuuguauuuaaauagguaugcucauuucaacauucuuuauuaauaaaauguauuucaaugucaa

SEQ ID NO: 12063 - RNA, 57078 nt, Mus musculus
uugacauugaaauacauuuuauuaauaaagaauguugaaaugagcauaccuauuuaaauacaaaacaguucucaacuugacaaucauuauauuaaaacagauucgucaaucuuauucacaugugucacaguuuagagaucacuuaauuaauauucccucuauuuauuccuccucuuccucccauugcauggcuuauaccuguagaaggaaacggcaaaauucauuuucaguagaaauaucuaagauauggauauaaaaagauauucuccauguugacugguaauuauuauagcuggguuacuagauuuaugauguuaauacagucuaaaugaguuauuuugaagaaugugaaaauauuaaaaucuucuauuucuuuacuagcuacuaauagccacaaaacuuucggugcagaaaacaaaacaaaacaaaacuuaacaccauaagaauacagauaaugcacaacaugcuaacacuugauuuuccaaaucuuuuuuuggaucuaaugaaauaaaauacaccaauuuuaaaaacacauucauuuuauaacuaugacaacuugccuaaaagaagcuuucuggcuaagugucacacgaucaacauguaauuauaaaucaauccuuagguuuaccuuagaaauugauacaaaugcuauuaucccacauaucaaguaaacaguaugccagaaacucaccucuuugucgguuaaacugacgaccacgaacacccugucucaagguugucugaagucuuacucgucugaaaggcuucgguugacuacuacugguaucuacagaaagcaucaagacauguggaaagcaaguuuaaaaaaaaaacaggaaagcagcauuauauaaucauuaaaucacacaaaaacagaugugccauuuguuuuccacauucaagucuacuuuaagagcaaaggaagcuaagcaguuauacaaacacacacaaaaaaaguugaccaugaauuuuagccucuuacauaccauggccaaaacaacugcagugucaugccauuauucuaugugaagaauuucaauuguuuucuagcuccaugagacucagagcaacuacaaagaucuaggugcuuuuucuucauuacucuuuucauacacucuugaaucuugcuccccauucugcuccagucacaugaccuccgugcugacucugaaugucucaagcacauccuauuggcuuaugggacauuauauaaaccaucuuuuuuuuccuuuuucuuuuuuuuaaaucaaugauuaagccccgugaggaugagauacuggcuggcucacugacgggauaacagguuggggcagcugggcacacuggcccauccacaucggugcucagcauuccuauggcagaucuggcauggacaaaguccacuuucucucccacuuucucaauugcugucucgagguucucuauuuuccugguaaggugcucaauggugucugaaacugauguaacucggguaguuaauaccgcaagagacuugguugaguucguuagugcuaaugucauggacucaacauuugcagcaaguuuauauauccucacaucuauacucaaaacgucaauuuggaguugaaaucuggccuuguaaguguuuccaccagcuccucacucgacaucaccuccuucccggucuccauuucugggcugaggaggcuccuugcacccaagaguccuccgacaaucuccuccaccgacaucaacaauauuuguugcggaagucucugauucggggguugggaccuugcauuccucuuuucuuuguuguggugggacuuggcaccauuugagugguucaauggguucaugauuauuagagguuaguuccaagcacagagauguaauccuuuccuaaaugucacuuucuuggacauggggauuucccugcuagguuaggcauucaaauuugcugaaugaguacccagucagagauagugucacccauaaggaaauuaauguaaagacauucuauuuccuaggaacaaccaaucacauuuuucacucaagggauaguuugauaacuaguauuaauucuaguacagaggacagacaauucucagagacuaucaacaggacuaauaauuaccauaccuauaauuucugauucuuuuguacauaaagcugagaguuacaauuuauacauauuauuuauauuauuuauaauuuauauuauuuauaauccugacuuuaagguguauggaaugugguuauguaaagaagguagcuguuaaaauauaggugugggagcugaaccuggagaugucaagcugcaugggacaguacuuaccuacggaggagcucgaagggggaucuuggcugguugagggaagaucugauucaucagaugcuuggacaggcuccucuuccugcuggcuaucaauuucuaggccugccucugaacuaauacuaagaaauaaauauugauuagaaaauggaaaacugauucuacaauuuauuuuaaauguuccuaaguucguuuugauuuauuuuauaaugacuuucagaguucuaguuaacuaagaauuagacucaguuauagguuauuaaguguguuuauuuuuaaucguaagguggaccaggagaugggaugaguuggguuuuuuucacacccuuacuaggauacucgacaauucuacuuuuuaccacuguuucagcagcccuucuuuuuccauuugacaagcauguuuauagucuugacacucacaggagugaguggacuuugauaaacuggaaacauaacuaguaacagcagaucggucagucacccugaguacuaacccagaccuaacaagcuaugggcaucagaguuccuagcucaguggcuguucuuucaucuugcuccuuuuaagaagcacagaagaguagacaguaaaaaaccugaaccuggccugaacuuuacuuuuuaaaaaucugcaaauauuagugcagcuacugguaacaacuuaccugagacccccaagguugcaagacggggacauguaaauagcauggggcugacguuaagacuuuuaauucucacugagcuguuaccaguagaauaguccaagcacauuauuguuaacgugcucugaacuuaauuucuaugaugggaaguaauauauuuuaggaauaguguguggguuagaaggacaaauauaaagugaccugaaaauauguauauaauuaguaacagcuagcauucucacugggacuuguaaccuccccucaauuaaacacugauguuaaagaauacaaacagaccugccucuuacccauuauauccuaggagaccuugcuuaugaagcacugucaaaucaaguccuugagcucugagcagaaaaaucuguguucuauuucucaaccacuaaaauguacaaacuucucaguuuauaagaauuaagaucccagguuugagacuuaacucuacaaaaccacugccuaugggcuucuucuagcaaauuauuucuguuuccuuagaaaacaaaacaaaaaauuuucaauaauguuuuuauaaacugccucucucauaguaacccuaaauucugaaugcugaguagcuuuuuaaauaugugcuuuggcuuuuccacggggcaggauagcacugaaaacagauuuuaauguauuugcuugcuaacacaaacaacuaugacaacauaaugaaccuacagcaaacaaaaaccacacaauaaaaucguacccuucagacuccgccucuacaaauacuucaucuccgucgucaccugcugcuguuucguuugucguggauaaagugcccguagacguugucaccaugggaaccgacugagaggcauguucugaagcaucagaggugguacucucagugaacacagucacuuaaaaagaacaacagauaccuuuaccuuugugguucauuaguucugagccagaauagguuucaauguguucuaugucaccaauuaaaaaaaaaaaaguccucauugacguggcacccaccuggggcugcuacuuggagaggcguagugggaacgcugcggccaccagacucuucuucaugagccagaaaaagggguguuucauacauucccaaaccuagagaaaaauuuaaguauuagugaaugaugaaagaacauaaaaacaccaaagaaaagaauuaguacaaaguguauaauuuucuugaagcucauaaugaggcuccuccaucaagcaaaaaucaaguuccucaaaauauauucaacacaucuuuuaaauucuuuaauacuaauaaaagcaucccuaaauugcuaauuuuacagaauauccaaauauaaacaaguauuaugucaaaaucuuuuccucacuuaacugccaaaguuauuaauccuuucugcuggugaaacuuaaacuuccccuaugguuacaaagcaaguuaguaguggcuucucuauucacuugcaaaaugcuaguuuccagaaaucuaucaaauuucacccauggacuaaaugauaauuccacaaauaccaaaacucacauacaaguaucaucuaccacuacuacuuaauuuuauauuuaacauuuuauugauugauugauugauugauuguuuuucaagacaggguuucuuuguauagcccuggcuguccuggaacucacuuuguagaccagguuggccucgaacucagaaauccaccugccucugccucccaagugcugggguuaaauaaaggugugugccaccacgccuggcaauuuuguuuuguuuuguugcuagggaaagucuaauuagucauauauuuaacuagguaugccacaacucucaaauuguaagcaaaaaauacacuguacuccuaaauuuuaaaggagcuggcacuucuuagcagcauuuacuuguucaucauacauuauguggagauuugaaugagaauggauccaauagacuccuauguuugagugcguggcccgcaguuaguugaacugucugggaaggacuaggagguauagccugguaggacaagguaugaccuugugagcaagugugugacuagggcuaggcuuugagguuucaaaagcacaugccaagcccagugucccucgauucccuugaagaauaggauguaaagcucucagcuacuuuuccaguaucaugucugucugcuaccaugcucccugccacaauaacagacuaauugucuaaaacuguaagcaagccaauuaaaugcauuaaaaaaaaaaguugccuuugucaugguguuucaauauggcaauaaaacgguaauuaagcaauacagaaauauauauaaaaaaauauauauauauaaaagccagucuuuaggcuaaaggaacuagaaccuuccugaagagguauuuauuagaaaaggcagugccaugucaguaacuuuauaaauaagaaccgggguuacacugauagcagcugaagaaaagcagagcauacuaacuucuacucaguagacacacugaagaaaccucuggcuuuugccuauuuuaccuccuugagaagcaaguuggccaagaucagagugacuggaacuugucuguggcaugucuucagguggcccaaaccggaaucuaggaacaccggcaaccuguggggaacuaaaugaacaaaaauuaauuugaugagaaauuuaaugcuaccuguuuaaaccaaaagaggaaaagguugcuuuaaaaaaaaaaaaucaauaaauagggaaggaaacaaugaaaauaauucgucaaggguuucuugcaaagauauuggaaauaaauuuaguaauauaaguaacauaauuuaacuuuuagcuuccccaaauuaugcugauuuuuuucaacuuguuugaaacagauacacugcaacaggaagcacaacaacaaaagaaguuuuuuucuuuuuuuuaaauuucaguuuucacuguuuagcaauauaaaauaaguuacucuagucuauucuaaguucagaguuuugaggauuaaauaacgcauagaaauucuaaguaaucacuaggaaguguaagacaggugugcucacuuauuaguuguuagaacaauuacuucacuuggcucaaugaagaucaucaggcacacugucgugcuucuagccuguugcauuacaccuggcuacugagaccugagcuccuacaauaaaccaccuaucaugaucacuuuaauaaccaacaucaccccuaguaccaauacagcauuuacuuauauaugucaggucguaucuaaacauguaagcacaaacuguauuaucaguaaaaugagguuacucagaagggagagcaaggagccugcucuugugaggaagcacucgaaccguagaaaccaccuucauaagcacuguaacacugugcuucaguuagaagaagguauacuuuauucacccuagauagucuuccucaacacgacuuuuucacgauccuauuacauauauagauucauggacaaguaggguaggacucuacaaauaacacauccaaaaaaacaauuuagaagguaaagagaaagcagcuagggaucaccaaacauucauucucauuacaucaacuuacugaauagcuucagcaaacccaucagugcgauguggcaccacaagaguugggguacucgggacuguucugucuucaucaucaaaaaaguguuguugcugaaacacagacagagcacaguauuuaauaggccuaaccacauacaugugaauuacaugcacaggauggguggauacuaaccaugccaccuauuccuggagucaacugaagaccacgcccuacagacugccuccgggucaucugaauucucuguuugaaaaagaauuauauuugcuuuaagaauuaggcaauuaaaacaaacaccaaagauacaguuuauuacuuuuguaaugaaauaucaacuaauuuuagaagauuuagaauuaacaggacauuucugaauugcuaauaucuaucauaaauauaagugagaaaguuuaaauuuuauuaauaaagauauuuauaaacuaaaaggcauauuuauaauucaagcauguacauacauuuagauucuaucuccuuggcugaaaauacuaagugagguuuuccguuguaguuuauauaccaacugacuucuuacuucacagcuaaaacaaucuugaauuggcagacugaaugcuuugugaugccuagucauauaguuccuuuagacucuguauuuucaaauaucaaguaauuuccacuacuuuuauuuuaauuugauuuauacauaaugguugguucucaauacacucaccauguccagaauaagaaccaagcuagaugaauuaacuuacuccaugcugaauacauagggucacuaaugaacuaaguagaaauauuugaugugaaaaaaugguuagguagaauaacaauaaaaaaaaaucuaugaaccuuaaguaagaaauguucaaaacuguuacuaagccagcuaaaugcauuuuacauuaaauaaaauuuaagaaauuuuaagccuauaauaacagcaagcagaauuguauuugcuaugacuauaaucacuuuaauaacuauacaauuuuuagcaaguuguguuuucaaaagccaacucauucacacucagaaacuggagauuaguuucaauuaaaaguaguaucuuacaacaugccaaaacauuaaaaauucuacuauuuggaaggaauaaaggaaggaccaugugauggaaaagagaauuuacaagguggcuuuuucagaagcuggguucuuuuaauaccugaacugguggucccagcuccugagguggggcgugaauggucaggcguggggggagaggauguggagggcgccuuggugacugcggugcuugcggagucugucucucagacgcugacgugggcugcuguucccuggcaaccuccugagagaaggaagacucugcugcacuuguauuuccuucaccuauggaagaaagacuucaguuuggaaaccaagcccagacuaugaaaucacauggccuaaaccucgaagggucucacagaguccuggcucauuucaaacuugcuauguaguaggcuagccuugaacuucagcuccuccuaccugccgaauacugggauuaccucugucucacucuggaugguuaacagacaaacaggcaaguaagcacccucccuucaagacucaaacgacagaugaaagcacuuugcucaagauuugaucaagcauguauuuacuacauuuugacuuaugguacuauaauuucuuaauguuuaaaugugcuuaugagugucugugugccuauggaagcuggaagagaguggguccccugcagcauguguuauauauggcuauauaccaccuaauacagaaacuaaauucaggccgauuaaagagcaauaugugcucuuaaccacugaguuaucucucuaguccaauacuauucuuaaucacugcacaagcuacuuaccccuuucuagagaaacagcaugucaaucaaucaaggugacuaagaaaaagccucacuguuaauauuuuuauauuuugguucucccaaacuucaaauuccaauuacuacucagguaucuagaucuuguugucuccacuaugaaauguaggaugccagagaauaguuucuaaaucugaucuagaaucagaacccuguccugacaguugguauuuaaaacacuuuacuuuucuauaauccaaauuauuaacuuaaauuuaguuugagaauuugggacaaauaaaacuagucacaagaguaguaccuuaacaaaaagaaauuauuuuuacuuuauguguuugagauuuuugccugcauauaugucuguguacuacuauaugcaugccugguguccauagaggcugugagagguugccagaucaccuggaaggggaauuacuguggggcuccacaugagugcuaggaucugaaucuggugccuuuccaagaggagccaagugcucuuaaaaaauacggaaccaucucucuaacccuauaaacaauuugaaaauggaccaacucuaaccuuaagacuacuagaacuuaauuuugauugacacaaaaguacccacuccucccaaaagaagucuuacggaaagaacauuuauauguguuauauuugggggaaaauggcuaagaauaucuuuugcgaaaaaaccuucagugguaguaucuaaagacacaucuacauacaaaucuuaaaacaggguuuugguggaccaaccucuucuagcugugagcugcuacccaucccugcuuuaauuauuccaaauggcuuuaugcuacauuagagagucuaggacauuugaccuucacaauaguucaaugagguggacagauaguauaauggcaucuaauggccacaucaggagggcagagcacuuaguuaccaauuuacuagaguuauacuacaucagaaguacaacucuaguaaaauauuaaaaaauauuaccagacuacucuacugaaagacuaaugcucuuaccacuguuuugagaaucagcagcucucugaugacuuucagcuccacccauacuuucuucuguuucuguaccuggaucagucccaucaccacccuaagaacaaaauguaaugacugaagcagaucaaaugacuagguuacaaaaaaagccacaccaaaugauuaaaagcaaacaaaccagaggaaaaccaaaccaagcaagccaaacaaacaaaacuucaaagguaugaagacuuuuauuauccugguaacacaagauuuucuauaugacaggaaaacagcaagcuuucuaagcacaguucuuaaggagacaguuucaauucuaaccaguuaccucagcaucaucagcuucauauccaucauuaccaucugcacuaccaguuccuucauuacuaucuucacccucaucucccauccccgugucaucuucuucaucaucaucaucaucuucgucuucuucauaauccuagaagaagauguccaagugugaauaaagugcacgccacuccuuuugcacacuuagaauagcauacaggaguguuucaagaguuuugacguuuccacaguaagggaaaaaacaaacaaacaaacaaacaaaaaacuguaacauuucaaagaaugaaagugauugauuuggaaaugguacagggugguaaaguagaaacaaacaaauaaaacaacuaugaacuccuguuucuucuuugauuuccagaaacaagagcacagaccaucagauucauauagccauuuuuauuaagacuaaagaugaaaucugaaaacaaauccuaaaugauacagcaaucauuuacaaacaagcuaggcaggccauacauuucuauaaucucagcauucaaaagacugaagcagaauuuuugagacuucacagcaagcuugggcuauaugauauaccaagauccuaccucuaauaaauaacaaaauaaugcagccaaaacaagguaaacaaaauguuuaaaaauugauuauccaccaucagcuuuuuaauucuaauacacaauccuacauuccugaacuaaucuguauaaaagaacuugauaaucuaauaaaacugacugggaaugagaauccacuacuugauauauuagaaacaccaaagacuuaaagcacaaugguugaaagcagcacacagguagaaggucagaagauccagagcucaaggccaaugugcacagugcacuggcuuugagcccuagcucuggaagggaagcagaaggaaggcugauagauacuaaacucacuucauguucgccaucauuuucuucaucaucaucuucaucaucacugucaauuacaauuacaucaucuccuuugccuugaccaucuugagaggaaguagucuguugaucugacugaagugguccaagaucgauuuguagagauugugauguuucuucacugucuuccauugguguauaaucucccuggguaacucccuuuaagaguuaaaaaggucuuuaccaaaacuagcaauaaucuggauacauaaugaauaaacuaaaauauuucuauuguuuuaaaauaaaacacauaacaaaaaaacuaauguuaccccauuacacggauuauguuugaaacacugcaauacacauauaaacugacuauccguaacccaaaaacuggaaccugaaacguucugagcacuugcauaacacuugaaagaagaggaggugcagugggaggagguuaaggagcaagaauauacagcaauaaauccauuaaguaaauaaaaggauaucucacagggccacaccuacaggcaagugaugacagcugagagguagaguuagucuauuccagggaugagcccauaccugauuguccaauauacacaaaaccuucaaguuauguacauauaaaaugugaaaaugggacccaguagguuuuauuuauguauauguacauguaugcacuuaugcauacauacauagaacauguaauaauaauaacagggaaaaaguuaccacuuugauagggaaggggguacauggaagaagcuggaguggcugaagaaaggaagagugauauaauuauguuuuaauuaaaaauauacaagaauuaaaaauaaaaaguaauuuacagaugguuaagccuuuccgucuacauguggcaaagacuggcauaaaccaaagcucugcacucuaaagaucagguucauucucagagcauccucuaaaaacaagcauaucaagaacugggaggcugggaggacagcuccauaggugagccauggcacccaaagugcucaagcuuuaacuccucagaacaucagccuaaaccgacauuaacaagugacagcaagcccaaacagugcuuuuugcuggcucuagacaaauacgccaaagucugcaugaaaugcuguugguacuggauaagggauacucaauauucagcauaugcuagauacuaaaauaauuuuuugcauaauuacuuucuacauuuugcuugcuauuaaaauaaacuauuaacaaaaauuucugacacugauuuaaaaaugaaucauuuggcuuaaguauucaguaaaucuauuuuuuuucaaauuauuaaguagcaucuaugaguuaagaaauuuaugaacgacaacaaucaauacaaaacaauauacaauaacaaacaauaaaaucagagaaacaaauuuaagaaccuguuuuaaagcacacagugucagacaugauaguauaugccuguaauuccaacacuuaaaaaaagcagggcugucugaauuuaaggcuagccuaggcuacaugguaaaaacuugccucaaaaagcaaaacaaaacaaauuuaaaaaugcaaguagugagccgggcgugguggcgcacgccuuuaaucccagcacucaggaggcagaggcaggcggauuucugaguuccgaggccagccuggucuacaaaaugaguuccaggacagccagagcuacacagagaaacccugucucaaaaaaccaaaaaaaaaaaaaaaaaaaaaaaaagcaaguaguguuucaauaggucaaaacaauugauuuuuaauaguuguauauguuuacucacuucuccaauggaaucuugagaguccugauuauaggcuugaguuucugccucuccaucaguacuuucuucugccauaacuucuuccuaaaucauaauagguuauuucuuacugagucagugaacuacacgaaucgucaucaguguuucucuaaaacguuaagucgacaauucuaugaagcugugccacaaauguuuauauaaacauacucaaauacuucuucaacgaacauuaaugaauacacacguauaacauuuaguauuauuacuguuauacaaccuaacucaucacagucuaugguugaaaaggaacguaauuuuggcuagccuuaaucuuaaaaucacauggcaaguaaugucaaugugcagaaugccaaugacuagacuuccuuacaaaagcagaauuuaauuugcuucugcuuuuauuaaaugggaaggaauucaugaaaagauaugcaaagacuauaaaccaagugauaauggcaaaauaccuuagcuauaagugaaaacuacaguucaggaauuuuuaggauaaucucccaaaacuuaauuugacauugaguaugacugacagcuagcucuuagcugcugaugcaaugguaauacacaggagugugacagaccucgguuccaacgggugugaccaucuucagcuucuucgggagaggcauuuccacuguguccucagagacuuggucuccugcuuccauggugcuguccucuuccuccucccgagugcgcuuuggcaaggaggaacuugggguagcugaaacuuucagaucauacaauuucaaccucaaaagucagaucaugguaacuucauuuagacaaagauaauauuacaaccagucuuaaaacuagaacuuuguaugacacaucugauaaauugcuauuuacaaaguuuacauaggacuuucuauaaaaauaaagaaaaaucauacuguauaugcuaaauaauaugaacagcuuuaauuuucaggauucacauuaaguuacauauaauauguuggcuauuuuuccccuuuaaaaacagcccaaaauaucuggggguaggagggcuuuuacuuaaugauaaaaacugaaauugaacuaauaguaaauaugaauauuauuuucuaauaauuuaaauuacaauaaauguaauuuuuaagcuacaucaagcgcacauuugaacuguucuuguaucuacuguuaaguaugauuaaaacuaaauaaaaauauuuucuuucuucauaguaacacuggauagaaagcaaauuguuuuaggcaauagucaagauguauugcaccuaagaaaugugaagcauauaugucuacugcagcuucauuuuaaaaauuaaucuuauuagucuagaagauggcuuagccaucuuaagcaaccaguuaagagcacugaugcucuucaagaggacccagggucaguccccaauaccugucacuacaguuuccggggauaugaugcccuucuuugaucucuguggacacuaggcucguacaugacacccaaauauacagagacagagcauccauagacauaaaauaaaacaauagaaaauauuaaaaugaaaucuuaccagugccaaauacugcuguggaaguagauggacgcuccacuggggaacuuuguacuaccucaacuauguuuggggacaauucuugauuuguaggcucaaucugcggguggcucuguugaguggguuguacaaaagcuguagcuuguguuugcugcuguacaguuaggaugggcugagaaauggagggcugaacauuaggacuaguagaacgaacagauccacuugcguuuccaaauacuggaacauguuccacaggcccuucugacugcauagcugaaaacaaugacaauauuuaguaaguaugccuucuaaucuaccaaaacugaguuauuuuaccuuauucuuugacauacaucuuauuaacuguuuuuucuaugucuuaccauuuaauacacaaaaaugugcacaaaaguuauauauuguacugccuaugugucuaauacaguaguauguaauauuugguggguaaguacauguuugaaaguguuguacuauuuauuggucuaauaaaauuauaaccagauguaauuaacauuaagaagcugaacauggugagaaauuuuguuuuuaacugguaucacaaugacaccaugaaaacaggaaauggguucagagcugaaugguacaguguuuguacaugcguaagguuugauccuuaaccgcacaaaaccaaccaaccaaccaaccaaccaaccaaccaaaguuucucuguccuaaaaaaaaaaaguuuaguuugguaaucuaucuguuaaucuuuuauugaauggaggauauauauuuauuuuuggaguguuuacauuauacauuguguacuggcugguuuugugugucaacuugauacaggcugaaguuaucacaaauaaaggagccucccuugaggaaaugccuccaugagaucuaguuguaaggcauuuucucaacgaaggguggagggcucagcccauugugggugguacaaucccugggcugguagcucuggguucuuuaagaaagcaagcugagcaagccaggguaagcaagccaguaaguaacaucccuccauggccucugcaucagcuccugcuuccugaccugcuugaguuccaguccugacuucuuuuggugaugaacagcaauguggaaguguaagcugaauaaaccccgcaggaguagaaacccugacuaagacacauuguuggggacauggucuuucuauagaacuuugguuggccuugaacuagauaccuaccugccuaccucucuuucugaugagauaaaagguauuuaacaccaacaacuaccuguacauuuacucaauucuaacacaucaaagcaguuuaagaucuugcaaaccuuuuauugaacaucuacuuguuaaggaaagagauugaacaacgaagaaaaugaaacucugauuccuaauauaguagauugaaaaguacacgugaaaucaagugcaaugaucgaauuacuacaauucaaugggaagagaguaagagaaagcaucaggaagugcagggagcuccggugaaaggaugauauucgauuugaaagagcaauuuuauacuaugguuuuccaaaauggauuucauagcauauaucuuagucauuagaagagaacaugugguuccagaaagcaaagcgauggauguugggaauauauuuucccucuuuguuagcuuaagaaaagaacagcagaagagaaggaagaaauuuacuguauuuacaauauguaucuugggcagccacauggcacaugccuaugaggcagaaagaucuugaguugaagaccagccuggacccaaaaauaaacaaacagggcugagaauguagguuagucaaaaaccacuuaccugaguuugaugacuauuggggagaaaaaaaccccaagcacaaguguucuaggaaucauauacuucaaaauauucacuacuuuugucaugcaugaucugacuuagacuuuauaugcuacacuuacccuuacagcucuuauccucucaaaagaaaugcauacaagcagucagccaaucagauguguucuuucacucaccuuccugugacuccaccuguguaguaggcauuacgguugcuguugggguaguggucggauuugugaccguugcagguguaaccauugggcggauacuugcccugggugucgacuuauucccagccauagcugcagcugucacuuuacuuggaguagaaacaacaggaguuggcuugauauuggcuguuggugggucugaugugcuggcacuuaaugaaagaaaaauccaaaauaacccagugagaauuaaauugaugagcccuuguaaaaucuaugcacccuauaaaaaggaaggcaugcccuauuuaaagugauaucuuauucagcagguauuaccuuaacccaguucaaaucuuacuauuuuuucugaacucuauuuuggauauacuugguagguuuaaaauagguaguuuuaaagacaaugaauauagccuuugacuuucuaggcaugaaauccuaaaacuuauuaauaaaggauuugaauuucaguacuaaaaacuguagggcauguuccagagugguauaaucuggcaauauagaaaaagcaccuaaauguugaguuacuuucaacccagaacuuaaauuuguaaaauauuuuaugauuuauguauauggauguuugucugcaugaaugucuaggcaucaugugugugccuggugcccagugagacuggacaguguuggauccucuggaacugggaguuauggaugguugugagauacauaggugcugggaaugaagcccaaguccucuggaagugcagccaguggugagccaucaucucuccaaccccagccuagacuuuuagagcuguuaugaacaugauaaggcgugaguaggagcuuaucuuauuuauaaaccaauuauaaacuaagccacaagguguuucuggucacuacagcuuuagacauaggaaugaaagcauacugauaacaagauuugaaaacuacaucaccugauucuuuuggaacuuuaaaggcagacuauaaaagaacuagaacucacauuccucuuucaccagaagcuggagugguuuucagugugauuugucuuugcuguucuggagccuauaaagaagagaaggauuaacuucuguguuuauuacacccaaacguccacugaacaaagauguuaggcuauuuauuaucaacugucuguauauuugaaauuuuaguccaaauucuaacagacuccuaaaaaccaggcacuuccaaauaaaauauacacaagucacaagugguuugucauggaagcgcaagcggcagucaccuuauuaguggguucuugaggcucaucccucugcucaaggugucgcucuugaugcucucugagcucucucucuaagcgacuaauccgaccuucauacugggacuuaagagcagucauucggacaucaagcucaucuuucugcugaucuagagcuccguuccuuuguuuaaguucuucaauuucuuuagucagcugaucuuucacaccuaaaauaagcauauaaauauaaccagacaucagaaacauuaugcaauuaaauggcauguacaguuagcauuacauccugcccuaugcuauauauuaguucugguacacucacuaucuauaucucaguaagcaaaucucuagacagaucuauguuuauuacuuacuccagcauaaaaauagguaaauuauccuaaaaaauuuaaguuaauguaaauuaacuuuaccaggagcuuguucauauaugaauauuauucguuacuaggaauuauaaaauauucacaucacacaauuuauauaguauauaauaaaaaaguagaccagugaugccagguguaguggugcacaccuuuaguccuaguacucaggaggcaggcacaucucuugugagcuggagaccagccuggucuacaaaguaauuucuaggauagccaaggcuguuaauacagagaaacaauuggacucaaaccaucccccccccaccaccccugccuguccaaaaaaaaaaaaaaaaaaaaaaaaaaucaaaacaguauuuuuuugaaguugcuguaagauaaccuuagauaucauaaagaauaaucagacaggaaaagcagagugaccugcuguuuaacugggaaccuuacgcaugugauagaccacucacucuccaggaaguccaugggaguacuccacuaaaaguagagaaacauccuuaggcugguaagaaaacauucuguguuguuuacaaagcagguaggcagcaaucuggacuuaaagaacgucacaaguagaacuguuccauauggucacaaggggaacaguaccccaagcuaauuaccagugcucuuuguaaguacagcaaacacaucauuugaaaauuguauuuuccaaggcuagagagauggaugguuuaaagaguauuagcuguucuucuaggagucaaguuugauucccaacaccuaucuaguggcuugcaacuauccaugacucaacuuccagaauagguaacacucucuuuuugucuguguggguaccaggcacacauguuguguguguguguauaggauacacgaaauuaccagauagauguguaauuuuugauuuggcuagugcaagugucuuccaagucuuuucauucauuugcugucggagcugcuccucugugguuuuauccuggagguccugacgaaggcgugacaguucagacugaagcugcaccgucugcuccuggagacuucuugcuucugucucuuuuucagauaaugucuuuuuaaggaaaaaaaaguaucacauaacucaaaucaguucaguuuguggguuuuuuuaaaauuuauuuauuuuuaauuagguauuuucuucauuuacauuucaaaugcuaucccaaaaguccccuaugcccucccccugcccugcuucccuaccccuccacucccacuucuuggcccugguguuccccuguacugaggcauauaaaguuugcaagaccaaggggccucucuucccaaugauggccgacuaggccaucuucugcuacauaugcagcuagagucaagagcucugggggcacugguuaguucauauuguuguuccucaaaguuuguguuuuauaaacuauuggaacacuuuuacaagcuuuaaaugguaauggagugucaauguuuaaaccuauuaccugaggcuuacagagagaacuaggaaccuuccauagcccucaaaauccuaccuucugcagauucucuacuugacccucaagugacuuugucuuuguuucggauuggcugaggguaucuuugagcuccugcauuuccuggacagagaugugcuguuccugauggucuccugaagacugaguggaagucuccauggccuaagaugguguguaguaauaacauguuuuuauuuaguaauucuacugcugcaacuuagagacaauccuaaauguucaaaauuacuuauaagagcacucaaaaaugaauuucuauaaaacaauuucaguguucagaaucagggaaugaguuaugguuauccauacaaguagacauuagagguggcacuuuguaaaugcacucugacauagaacaacucccuaaugaugauucagucggaaaauagugacaugauagcauaugcaaaugacacacuugggaaaguucuaugccaagaaaaacacacuaaagugcuaacaaaaagaaaaaggauuaaaagcauugauaguuaucaugcacaacuuaucuaaaaugauauaaaaccuauuaguuguaaaaucgcauauccuuaacuuuaauuaacaaugagccaaugugaugguuauuucuggacugucaacuggauuaagguaacaaacacuugagugaggcacugaugugcccaccuagggugaaucucugaggguuucucagaaagaauuaauaacugagagggggggauacagccuguucuggagagggaaaaugcaggagcauguucccauguuccugccacagacccucaaagucacgccuuccuucucccuccgcagcgaugggccuguauccccuaaacacaaugauacugggucacgagaaaguguaacuauacaguucugaaaucagcuuugcaaagaaacaguauuagaaauauaaaaaggccaggcaugauaguguacaccuuuaaucccagcaucugagaggcaacagcaggcuaaguuucaggccagccuucccuacucuaucgccaaaagaaaaaaaaaaaaagaaaagaaaaagaaaaaaaaaaaaaaggaaaaagguuaauaguaacuuaaaaccaaaaccaaauaaacauaucacuguacuucuaugaguuaagacuaaaaaccauuaacagucaaaauuagggcuggggauuacauuuccucaaaauaccuuguuuuguugcgcuuucaguucuucaaacugagucuuguaccugcguccaauuuucuugacuugagugauuguuuugaccuuuuccuguauaucaauuauuuuggcaucuaaaucuuucugaaugccuuccuuuucaguccgugcuuuacuuaagucuucccgcagacucuggauuaaauucugguuguuagucaaggaugcauuugaucuuugaaaaaaaagaggagagguuucuuaaaagaaccaaauacacaauguuuggcaaauuuucagcuuaaguacugcuuuaauuaauaauagcuuucuaauuaaaauucccuccaccugaaagacauguacuuuaugauuuuggucuuuuauuagaccuuauugcacaggucuaauccaguucugaagaaacacugaagugcuaagugaagcccucaaguggcggcacgcagucucacuagaccugcgaccaaggguucucuguaggucagagucuccagguuucccauaagcggcagaggaacuuugucagcuggggcuuaaagccuauauacaguuuccucacauauuauucuuuaugcacaacuguuaguauucuauauaguuuguccuacuguacaugucaugaacugaacuuucauagcaagacaaccuaaaaagagcagcagcuaauuccaacuuuguacaaguauaaacucaagcuuuuugaauuuucuuuuuuucuuuuucuuucuuccucucuuuguuuuuacuuuuuuuaaagaaauaguaucucucauacugagcaugccaaaauacuguuuggaauaaagaaaaaaacauguaacagagauuuguaagcuauaguuuucaauaagagacaggauuagcacaauuaaaaaaaacaacaacaaaaagcuuuauagauuuucauaaagaggcuaugaacagaaaaacaaaaacauaaauuguacguacguuauugacuaucaauuguuagaaaagaaauuagcuuuagagguacaacauguagcuuuuaaauacucaagaaaaaaccuugauauauggacacaaagaauucaauguuuuguugucuuacugaaaagaaacaaaggcaaagagccgcagcgaagggcuuuuaccuuccuacaaagcaggaucacagagaacauauugucauucagcacuugggagggaaacacugaguucaaggccacccuggguuacacauggacuagaccuaggguacucugggcuacagagagaccucaucucauggggaaaaucgugcacuacauauaauuuaaaacguucaucccuaauaccuugcaauuucagccuuaagccuuccaacuucuucauuuagcuguuggauucucuuagugugaauuuccuuuucagaaagcaacuuucgauauucuucugugucuggaucuuucuguugauuuauuaguugcuagaaaaauagaagugcauacugucagguuaucuaaacacaaagugcuauaguaaagugauuaaaaaucuagcuuauucacuuuaacugucuugccuacagaguaguaaguaucaaaacagcauguuugaaguuuuaauuaggagagcaaaaucuagccaagauagacgggcaaaaaaacaucaaauuuuauuaacuguuuaucauuuuucagagcugugaaugaacuugaacgaauuugacuuaaguuucuuuuuuucuuuuaacauuuaguauguuauugugcauguaauguguguguauguuuaugugagugaguguguauauuuguuugugcacgcgcacaugccauuaaacacauguggaagucaacuuguaaaagucaguucucacugucuuuauguuggcucuggagacuuaaguuuaggucuucaggccagacugcaauuagccaucucacuggacuuuccucauugugugucuacaaagagcaaaaugaagaauaaaagugcucugaaauucugaaauauuucuuuauccuuaaaugguuaccauucuacagaauuucucgguaucugagaaacugaguuuaauuucugucaccaaaaacauuuuuuuuuaaauuagguauuuucuucauuuacauuuacaaugcuaucccaaaaguucccccucccccaaaaaaaccacugcuuuaagagccauauucuuuuuguuuguuuguuugauuuuuuuuuuuuuuugagacaggguuucucuauauagcccuggcuauacuggaauucacuuuguagaccaggcuggccucgaacucagaaauccuccugccucugccucccgagugcugggacuaaaggcgugcgccaccacgcccugcaaaugaagaaaacuagucuagcaaaguuagaaaacucgcauggaggucacacgcuacguaacuaguauuuucaagguagacuucucacuaaaugcacuaugcuauauggucucauccccaauagacuuauaacuauuagucuucuaauggugaaugcaauuuucacuaguuucacaacuauuuuccaucucuaauucuuacacugcugaagcucauuucugugucaguaaauggcuaacuguacucaccugguuccgugcuuuccaacgcuuaacauccucuuccaguagcuucuuuucugccuggagcauaccgcuuuucucacucagcucagcauuggcuucuuguaaggguaaaaugucuaacuccaguuuccucaccugaaaagagucccaaguauguuuauaacaaaugguaaauuaaucugugccgcggacuggccucaguugggccccuugcuccgugggaaaaucaguccuguaaagguagucagggauucagugaaaaaugacaaacaaauacagacacaaaaggguguuguaucugaauguaauuugucaaagugagcaugagacuuuuauauauuacagaaaacaaagaaguuaagugauacauuaaggucagacgagguacauugaaauuaucugacacaaaacaaaaaaugcauacaaaaugacuggcaggaaccaggcaagguuuacaauagagguaugaucagcccuguguaaaaucagcuauuuacaggagccaggugaaaggucugaugcaaugcuagucuauuguuaaacccaccaccaggggucccuuaguacauaccuacuuacgcuaauccuccagaccuagugaaaaacaugcaccaggggaguucuuacgauuaacccuuucaugaauaguacaacacucccaguuccuccuaaaaccacaaccuuccuuccuccuaggccauuguaaauuccuguguaugggagugacucggcaauuauuguucauaaguauuuacuauguagacugagauuucuagcucuauucaaguaacuguaaagccuaauuucuuucacugucucccuuacaauacuagagguaauucugaacgucacuuaauaggcaacauucuuacugaauuccaagcccaggauuggcucaaggacugccuaggacauagggacauuggaggaggcuaaucuaacuuagcuauaugucaaaaaaaaucaauccuuagaggcacuuauaauaaaacaauacugaaggaaagcacacggauccguucucuacuaaagcaaggacagauuuggagcacucguuauacaggaugcccugguuccaggugacuaaguuucugugaacuuuuugccucgggacugcggccaagcuucuagaccugucacucaagucacuccuggaguggguguggcaaucuguaucuuuauaaauaguaagggcuucugcgcucagcugguaaggcacaaaccuuggcuugcauuuguuguagguucuguucgagccuuuccuuuuccucccguagcaucuuguuggucuccauaacaacguucauuguuucaguuuucuucaucagcucuucauguugcgccauuguuuuugcaguuaccugaaacagugacaaacacauagaucaacaaccagcacucagacucgucuuuuuccuaccaguucuaaucuucccaauaaaaaaguauagagaauuuaaacuucaacuuuaacugaaacuuugaaagcuugcagguuauuuuccugagacauguuaauuucaaaugaguuuaaauaaauguaagagacuuaaagaaaaaaggacuacaaaugcugccagcacuacagguauuuuugcuuguacuuugguaugagcucuaaaguacuguuacuuugacuccuggcuuuuccccuucccacaccugcucaggauucugaacauuuaguuauguuacucuaguaacagguacaguaagugagcucauggacucagcagugaguugagagccaccagugcuuggaguuaccaugguguguuuaguuuaauuucuuaguuucaaucuauucuaucuagaaugacucuagacuuuuauuuuagaaugaaucacaagguauuuauauauagcagcugcaaaagauuagaaagcuggaauuuuauauacuguauacuacaguccagaugauucgcaugcacaaucucaauccuaccucucaucuacagacaaggagacuaagaggagggaagcuaagcaauguucagcauaucgagcuaauccuauggaagcagaauuccaaaccagaccucuacaacagagcuucuaaucaccacacaacucggcaauacuggacagaugcuaaauuuacaacuuuaggaugagugcucaaauuaguguaucgugguagaaacacaugagcuuuccuucuuuaagcuugguguauggacauaccugcaccuuuucccuuuccacauucaggcuauccugcaguucuugcaacucccguucuagaaguucaacucuuugucgauaccgcaaacucucaaccugagccaccucaaaccuaguuucagcaauuucuuuuucucgucgaauaaaucuacaagaaggcauguuaaaauuuuagaaaacucuaaguuuaguguuuuaaaacuuggagaauuaagacaacaaaaugcaucacuuuaguauucacuuucauauuucaacgacagauuacuuuugggcuuagauaguagcaucagaaacauauuauucugggccuacaaaauggcuaaggaaauaacaguacuugugcaugacaugcacgcacacaaacacucaguaauaauacgugaguaaacaauuaaagauagauuaucuuuaggcuguguccaaugacacacauccauaauccuaacacucgagagggagaagcagcugggguuagugaggaaaaaaauaucuuuaaaauaauuugagacaucuaguuucccuuuccuuucgugaaaugggaucuuguuauguagcccaggcuguccuguaauggccaguucccaccuuggccuucuaggauuacagaugugcccuucucaccacgcagagcuggucuuuaucuuuaguuucucagaaaaagcagcucaaguucuuccuaugagauucaaccuuacaagcauggauuucaucucaguaucaauagugagcacuagguuccuuggccaacugaggcggagugagcuguacagcacuacguccgugccuuccucauuacugggccacuguaagaauguagcugacuuaccuaagaauuucuagaauuuguucuugagauuucccuucuucauugagagauacauuuaauggcgcuugcacagcauccuucauagaggugaccaccuugucacuuaauuuuucgauuugaucaugaaguagucgguuuuguuucucuagaucuucacagcgagacacacuuuuggaaacuucauccuacaagccaaggguccaucauaauguuuucccaaauguacaggaaaaacaaacauaagaaacccuuuccuuucuucagaacauucuacugcgaccuacaacauuaccuucaacacucucucucucucuucccaagaugcuuuacauuccaacaacugggauucugcuuucugaguuguuucuuccaaaugcugacggauugaugucauuuuugaaaccuguuccuuggcagcuugcagagcuucgacaucagcagcauguagcaucaauucucucucauacuuauucugggcuuccacagcgauuuuagccugcaauuaacaauucccccaucgauaaagauuaagauccacaaauuaauacuuagacacacacacacacacacacacacacaauauuucuguuauauacgcacaugugugaaggcuaaaggacuuuggguguccugcucuagagcucucugucuauuauuuucagacagggucucucacugcacccuucugguagccagcaacccuacaaccuuccgccucccacagcacugggcuuucacaugucuggaagcuggaauccaaccugaggcuuaaaacacacugcucagaaacuaugagaagaacacuuacuuguuccugacagucacgccuggcuugcuguucauuacuuaaagcugugcuugcucucugaagagcuucuuguacuucauucugaacaguagacaguguuuucuucaauucacuuaacuaaacaagaguaagccacaguuaauuacaaucugggaaaauacuuaagacauuaaacaauccacuuaaguaaacugaauacagcuauauaaucugauauaaucuacaguuuuuaacucuggcuacuaucugcaaaauccaaggcagagcuucuuucuaaaaagcagcacuaaauaaucaauuuuguuaagugaucuaaauuuuucaaaaggaaauuuauacagaugcacagaauugagugaaaauauaaaauuaaaauucauagguaugcauucaagcaauuucugaugagacaaaccaaaguauaacuuaugaacuaauaaagugaacucagguugcuaagaaagcaagcuccugugaaucccagugaacucacuugcuguuccaugcucucgauggcuuuccucuuaucauccugaaguucuugcuuuuccuucucuacuuccaucaauuucuucuccaacugugucugaaacucugcugauucuuucaagcgaacuucaauguucuuaugaaccuccucagucaccuucauaagcagccagaaacaagaguaauaacaugauaugcaauacuuuucccaauuuaaacugaacuggaaccaaacuaaaguuacuauuugucuuauacuaggagaagaaucccuaagaugauuagccaagcagauauaccacauaaaucuagaagcguaacuucucuuucaaccuggguuuuuccauauugaaaucugaaucucuuuauuuucccuuccagccucauauccauuugcccaaaucuacuuagucuaucaguaaaagauauggauugaugccagucacaacagcauuuuuaaaaaguggugguacucucuacaauauauccuuaauccacuacacuacccuuugaagaaaauuuucuaacuaugacacauuaagaaucaaugguuccauauaagcacacaaaaauaaccugacaugcuuaucugaauacucucucgauugaggcuugacagcuuuccacuauuuugaugaccugcauggcucucuauucaaagguacccacuugucaaccgugacgcggagucaugcacgagcagcagauaacucauauucauucuccccaaugccugagcuuucuaaaucgugugacuuuuguuuugacuuauuagacccaaaaacuuuccaaaaguaaaagaaacgaugucagccuaacccauaacacacugcuuuauaaacaagcaaguucuuaauuaaggacaguguggcuucuauguaccuguuucuccuuguucagggaaucuucuaagcuggucaccauggcucgauacugcuccacauuacugguacuugucuugagucucuccuucaagucauugaccuguucuucagccugccuuagcugacuuuuaagaucaucaacgucaucucugucaccaggcugaccuggaagaaauaaaacgcucuaguaaaauauauacuuucaauuaauguuuuaagaaauaauaaaaaugacuucuaucaaaaguacaugaaaucaggauuaaagcuaaaauuaucuacaaaguguauuuuaauuuauaauccauguugaauaucagaauaaaaacuaagucaggcaugguggcacaugccuuuaauuccagugcuuggggagcagugguagacagaucgcugacucagguuuggcauggucuacauauaaguucuaggcuggccagagccauggaagcuagugucugagaaaggaaagaaggaaaaaagaaagaagagaaagaagaaagaagaaaggaagaggagaaaggaaggaaaauuuaaaagucugcugucucacugcuuccgaaaauuuaaguguuuaaaaucucaucacgaaaauuaagacuauuugaaagaauauugaaccaaauccaagcugcaauuuaucucaauuuuuguuuuagcuaaaguaaauggaaaaugagcaaacugaaaguugaaagggauacuuuaucauaaauaucauaucaauaagagauuuuaguaaaacaucuauuaaacauauaucagacaccuguauuuaauauauaaauauuauacauacauaaccuuguuucuauuauuaguaaaacuauauagaaagauaauauggaacaaaaguuuuaaauguuuaaaaaguugaauuucuucaucuguauaagacacccuaaucaaaugaaguauuuaauccaagaauacuaaucaaaauaaaugaguugaauaucagaauaaaaacuaagccaggcauaguggcacaugccuuuaauuccagcacuugggggucagugguagacagagcacugauucaggauuagcauggucuacauauaaguucuaggcuggacuuuaucauagauuaguaaaaaccuccauggugguuuaaaugagacugaucacccacaggguccaacauuuguaugcuugguuuccaguugguagacugucuggaaggguuagagagugugaucuuguuggaguaggugugccacugggcguaggcuuugagguuucaaaagccaauacuaggcccagggccccucuuucuagccagagaaagcagcucucagcuacuguucuaacaccaugucugucuauaugccaccaugcucucugccaugacgauaaaguauuccucuaauuaaauuccuuucuaaaagcugccuuggccauggugugucuucacagcaacaacucuaagacaaguucucauuucaaucaauaaacuaauuucaagaaucaauaaaugguuuuauuguuguggugaacuugucuuacauaugugaugcucuggguuugaucgacagaaaauauaccacuccauacccauagauagcuucaaagaucagaaaacucagaacagccaagucugaugucagacaauuauuugaauucucaagucuuccaaacuuauuauguuucccaacugaacuuuccuauuuggaaaguaaaauguuuuucccagccuucauagcaugcaggaagaggggauuuaguuucacgacagaguauaaacuguaagacuugucuguuuuacuuaaugcuacaccaagcuacucucuuuaccuuuaccgguucucuguguggacugugaagcgagcugggcuuccauauuauuaaggugcuguuucaguguagcaauguccuucugagcauuuuuuaacaguucuuuuguguuaagauggagauuuauuucuguaucuagcugucucuugguaucuaauaguugaaccuguaagaaacaaaugcauuaacacuauaaagaucacuagguucuuauguaacuagauauuuaaagugauauccuaaggaucuuagaacacuugcuaagcuagaaauucuuaacaugacaaaggacauguuacaaucaugguuucuaguguaagaaagagaaguacagccuagcuuacugaaauaagacacuggaguaugucauaagaaaaugaagagaucuuaacagauucccugaauugagaacacagaccuagaaaguuccugaagaccaaaguaucucuaguucaugcuuguguguguguguguguguguguguguguguguauaccucucuucaauguccggcacauuugugauaagcauguuugugaaauuaucacauaucaccaaaaggcucaacaugaagacugccuaauacugaaaguuaagagcagccaaaaacaccaaauauucccugcaccacacagccaggacuuuacaaaggucuugcaucagugcugaggaauaaguagaguuaaaccaagcaccauucugggccugcuuaauacuucauuaaaagcaacacucaaacuauuuuuaacuuuacuaccuuccagacguuaacuagggaaaauucuaaacaauacaaaacauccaguaucuaaauucauggucagcaacuccugggacuccugcuauuuguugcccuacuaaaguagauaguuaggauccuacugaugguuagcacuuuggcugcagaauggagaggucaaccuugaaaugaacagaagacuuuccuugaagaauagcuuacacuauaccacauggugcuauguaggcugcugggagagaaaagacauugcuuacccagugcuagacccucugugguguaauacugauuucggcaagaagugcccaccagugcaacaauggcaugauggcuauggggcaacaaacugcuuucugguuuccaaggccugcucuacaguaagaauuucauaccuaguacuguaaacccagucaaaagcccaggacuaggaaguuuguagacccccagcuggaaacuuccuguuguuguuuagcucaauggucaugcuaucgaacugcacucgaaauaauccgcuuuauacacugcuuuaugcugcucuugacuuuggccagggaagcuucuuucuugcagugugcagugguuaaugaacaccagaguguucagccaugaacaggucaccuauaucaacucccuaccauccgaggcucuggggauuucuuggaaauggaggcagaaagaacagaagagcagguggcugggaggggagcugugaaaugcagacucuagucacaacauggcuauugcacacaucaccuucaaggagcugagauuaccuaucuagacaauaccugcccaagaucaagccaguuaaauuagguguagaugaggaagaagcuacuggcagcugcuagcugcuagagggagaauugcucuccuuuggggauguggcugcagguaggcugcuguaauuggcuuaugggaucacuaauuggacucagggguaauuaauaaaagaaaaugagaacagaaaguugggaggcaggcaaagcgggugcaauaguggaaguuggaaggagguggugaacagauaugauuacauguauuauguaaauguacagagcugucaaagaauaaaaauauuaagaaugaccaggcauauuuaagauucuguacagaacaguaacuauaaauuacauagacccagaugcuaauacucacgucuagauuccucguaagcguaugucuuuguuccaccucguuuuccaauuucuucuucaagugagagaucucaugcuccaguuuuucuaucuggcuauucagccuuuguuugguuucagucucagaucgcucuaguaugcccuaauguaagaagaagugaaggaugcuuaacaauaaagaaauuaagcaagacgaagaauauuagaagcuauauaaaauuaugagauuauaauccaugaugagguuagaauugagaagauuguuguuggacauaugcaaaguauuuuggccacuuuucauauuaaaaaauuuauuucauauuaaauauuuagugguauggaaugggggcaaaaacauuagaguaguuauaauucuaagacucucacauauuaauuacuuuguuucaaucaauucucuuucugaguuuccuuuaaaguauuuucuuuuacacaccaccaauuuaaauauaacuauaauggaugaaaaaguaacauaaaauuuuuaguuaggaaaauuaagaagauacaaaagauaauaucaaauaucacuccaugcacuucuuaucuguuuaccuggauugucuguagauuagucagcaacaaguucugcccccucuguucagcuaacaaagacucucuuugcugagaaagacggacuucagacaauuuaagcauuucuuuuuccuucuuuaaauuuucugcucuuaccuuaaaaugaauguaagugaaagaaaaaguguugggaaauacugugucaaaaguaauacacaaaauuaaaauaacguuuucuuuacuauguauuucuuaauaugauguagacuacaacucuugaucaaguaaauauaauuccuuguuuaaugaacuaaaaugauuggacuuaacacauacuuauguuaauuuagcucuagcaaacuguucuuuaaaaacaauauaauggaagcuggagaaagagcucagugguuaaaagcauuugguguucuuccagaugucucaacgcccacaguaggcagcucauaagugccuguaacuccaggacaagguccugguaccuuugaacuccucaagcacugggacuuauguguagacacagcuacacacacacacacaugaaaaaaaagaaaaacccagaacaaaauccaaaacaccacaacaaauauuaguguguaacuauaccauagucaaaaucaauacacuaugaauuauguuaagucuuauaagccaaaaguuucuaaggacuucuuuuaaagcaauaaccaauguugucaauuuuuuuuuucuucguuaaagacugcacucuuaugucucaggagaaaugcaagagugaguuaaaaugcaguaucuucaaaguauucagauuuaguucugagucauacuaauuaucaacacuuaaaacaguuugaaaaaagcuccuauuucccaucaugaaguauagcaagauaaaaugcaauguagcaaacaaaaaacccagugucuucaaguccuaacuaaucuguuucucguaacugucaacagaggcaagcuacuuacuagcuuuagaaccuauuucucauaaaagagaugacauacaguaccuaacuuuuauaaaagagaugacauacaguaccuagcuuuuagguaaaagccaaaagugaugggcguuaacuuuaucauaaucuaauuugauauucaguugggagcauucuuucucuuuuuauaaauggucaacuaaaauuuuauuugaaauuuuuccuagauauauguaagcuauuuaaaaaacauguaucauagucuaaacaacacuuuacuaugcuauuuuaaccaauaaaauuuaagaaauaaguagccauaucaaaugucagccaggggguguuggucucacuucugcaacugcuagcuuuucauuggcuccucucaagucuugcgucauuguguugaugaucuguuccugcuucugaguaguugcagugaguuucugauuucucucuuguagagauguuauuucucgacgauauccuucuacauuaucuugcagcauuucauaacugguaauaaagaugaccaguucuuaggucuuugaagaauuucacagaaacuuaauuucacaugauuaaaauuagaaaguggcuuguguaauaaugugcaacuuucuauacuacccuuauuuaccaguuaaaauugaaauuauaaauaaguaaauauuucauugaauaacuuauuaaaaauucauauugaaaauaaugacaauguaauuuaaguaucuaaacuaacaagcacaugaaggaaaggcuccagaaaugauagccauggcaccacacacucacaauacuagcauugcugaggcagaauugccauaaguuugaggcuagaccugucuacugcuuaucaggcuacccgcggguauacagugagagauacaaaccuguugcaagauuuucccuguccaauuacauuagggcagcaggaggccugugauuggacagggcaaagguggauggagcuggaaugacagagcaucucagggagagaaggggaaggccaagauggaggcagacaugaaccagcauggcuuuaaccagccacagguaguuaugauaucauaagguuagaaagauugggauaaagcuuuuaucauuaucaacugguucugaaauuacuguauuggcaucuuguaagcugaaaauuuauugauacauaaaucugauuggccagcuauaagcuuuaagagauucuaacagguacauggguguggugauaugauugugggguggaugguuguugcguagcagcgagaggaauuugggagcaccggagaguuggcagguagacagagccggugggcccacagaggguacaagaguugcaggcacaugugugggaaugugccaguuccuuuuuuaauauuucccgcaacacaaacccauuaugggcacugggaggcucaggcagggcugccaccaguuugagucuagccuagucuacugacugaguucuaugcuacccagagcuauacuguaagacccugucucaaacaauucccccuucccaccucuucagaaagagcuccagaaacaacgucucucaauccgaggacagagaaccucguuaucuuucacuccuggcccugaacaggagaauucgcagccaauguuaaggaaugaagguuacagucucucaucuuagaacacacuacauagaaaaaagcaacaccgguguaaauuagcucugggaccugacuggucagaacacugugagugcaacauuuaauggcauuaauucccaaacaaaagaaaauuuaccguuuagaagcaaaaucuagcugaguagaaauuuugguguuuugugagcgcaggucugugacuugcucuugaaguuucucuagcugcucauuuugaaguuucucacugucuauuuuuucuuuuuuauaguucucaaagauuuccugcaacuaaacauugaagaucauuagacgauacuauuuuccccaaaaacucaacuugaaacuaacccaugacuuuaacuagguauaacuaacccaugacuuuaacuagguauagucuuuaccuguuuaagggcagccuuugcuucuauagccucuguggagucaaugacggguuccggagcaggaguggaaacagucugugauguacuugaacguuuuggaguugagagaagagaaauaucaucuaaacuugaagcuucagaaaaauaaaaaagacaaauaagauguuuuugcgugcuuucauaaaucaguuuuaaggauuauuugcaaaagcaucacuacuaaauuaagaaguagaaaguaaaguguuacuagaccuaucagagaauggaaauauuaaaaacuauuaaagcuugauagcucagugggaaaaggugcccaguaagccgagucugaucccugggagccacacgcugucaggagaaaaccaacucccacuaguuacccugaccucacacacacaguagccuuuaugcaugcacauacacaagcacacacagaaauaaaaugcaagaaaaaaaagggaaaaauuguucauuuuuuaaauuagaugcaauguauuacaaauuaaaguacuaaaacaagaaaaacaaaccauguaauucacuaagucuaaaaaguaugguuuuuaacaauauuuuuuuucuuaguagugucaaaaugacaccuaaaaaucaauguuacaaucagucacacacaauagcugaagucaauuuccaaauuagaguagcaacugcuuuugucaaaaaaccuauucaccaguucacuuccaaaauauuguccuguaguuacauaaaaaucuaccuuguaagggaauggccauuccuguuguuugugacaauaaaauucgguacaugucacgcugacgcacuauggaaucaacaagcugcaucugauguugucgugacucacggagcuguuccaguucagcgagagaguucucaaguuuaugcugaaguucagcaauccugcagaaaauaaaagucuuuguaggucuguguucagaggggaguacagugucuauuauaaaucauucaaacaccgucuaccuucaugcugacuauuuucaugcucuuuauucuguuccuucuuaaaacucccaccauagaagacuuaaguacuuguacucauuaguagcaucuggaaaacuuacuuucucagcaucaagccuacugacacauaaucuucuugcagucaaugccacucuuccuucccuaacacacugucuuuauaaaaccucuguacugugcuugaguaaugcucagacagacucuuuuccaugaagacuucuuucuugaaacuuaaaugaagucugccaaguuuaccuauuuuagcacuagucauauuaaacggaaguuuaccgccuuauuaaaaauaauuccauagaaucguugcucaguuucccuaagcaccuccauuacccagcaucucuaaggacacacuaagcccaguacccagugcuuagccauggucacugccauggucacugcuuacuuagaggaaguugucucuugcucuucucguucccugguuuccccaaguucucgaagagcgaauagcagacgcugauucugcugcugaagcucuucgauguuccuguaagauacuaggugcugcgaaaucacuucagacgaacuacugaugucagcagagcugaccuccucaucccgaauuacaugguuaccccuggcuucuucaaguuccaucaagagcacucuuaucuagaaacaaaaauuuaauguuauaaaacccaaccaaccaaagcuaauauauaguauuuuuaaaaacaucaaaaucuaucacuuuaaugcuaaaaaaaaaaaaaaucuaagaaaagauuuuaacgaaauagcuuuaaaaaaaaaaaauuuuugguuuuuccagacaggguuucuuucucuguauagcccuggcuguccuggagcucacuuuguagaccaggcuggccuugaacucagaaaucuacuugccucugccucccaagugcugggauaaaggagcaugccaccacugcccagcugaaauaguuacuuuuaauauaaagaaaacuuacagaaaguagaaaaauacaauuucagaauaauggcuauuuuuuuaacaugaaacuacaaguaacuuauuuagugcuuguuuuauauggcagguagaggaagagcagacaugguggugugcaccuaaaaucccagcacccagaaagaugaggaaggguuguucaaguccccuucucaagaaauagcaguagugaguaaugcauaguguaaccuaauuuuaacaaaaacacacuuauauauucagauauguacuuacugauacaugaauggcaugaaacacauacacgccaacuugcuaacacugguuacacucuuaggacauggggaacaacaacaaaaaaacgcuuccuguuucaauuguuuguguacuuauuacaaaugucaccaacaaugugaaaaucaaucaaaaaucucugggaagacagugacaagaugguauguaagugcuacaggacgagaauacauacgccuuuccuagaagagacgucgugagacauaagaugcagacucaagcaucacaaagaaacuggaaaucacacaaaauguccuaaccuguugcgaaaggucuuuuauuuguauuuccauucucugauugucccuuucaaguaccgaugaauguuuguuggcuuuaucaguguccuccugcaaucgcugaaucuccuuuaaaauauaaacacaagggaaaacucagugucacccaggauauaaauaauaauagaaauauaguguauguguauauauauauauauauauauauauauauauauauauauauauauauauauaugacaauaaaaagcauuuucuacccuuaacaaguugucaaauacaacuaugcaaaaauaaguaucaaauucccagugcauuuccaaaugaccccagaaucaugaucagaaggaucaaugguaaucacaguuagacugaaacacuugagaugucaaaacuaaauaugcuggguaagacacagaagacuucauuaaaagucuguggcaauuugcaaagaagcagcaaccaaaacaguacccacuuaguaggugagcucugcaguauccauaguuugagguggaguuuugagaacccucccauuagcacaagaucagauggauuaaagggaaaucuguguucuauuuccaauuuaugcauauuuagguucguaguuauuuucauauacuuuuaaauauaucucguuaguucauacaccuuuaagaagcuauguguaggugcaagaggaaacgugaaaauagaaguauagaaauagucagaaaagacagcacucauaaaccuacuaaguacaaacaaggugaauuaagaugcaaaguagaugcagugggauugcgauuagaacccuacaaauuaagagcugaagauuuacacuagaaaacacauuauucauguuguggauagaaaaugccaguuauuaaaaaaaaaugaagaaaugaccauuaagcccuuuuauuauucuuugacagugaaggaacaaacuguuuuauaaguugaaagcugcuauucuaauugaugucuaucugccauuuaacuaacgacaugcacuucacauaccaagaagaucaaggcaauauccuauuaacagagaaacuuaaaagaucuaauuggucccaagagaccucucugaaaauagaaauacaagauuaauuugucagauugccaacagucccuuagggcacaaugaguaaaguuacacugcuguaaaacacuuuauuagcuacuucucaaugucagcggcuucuauauuauaacagaagauuuaauucagaauuaaggauacaauuuacucaaauucuccaagaaaaaaacauaucaguuaauaggagauauaaauguauuuaucuacauuuccucaauaaaauucucuuaaaucuucaagacuucucuguaaaaagcuguaccauaaagguaaauuagaguauaaacucuuacaucauuaaguaaaacauacccucugauagcaaaaggguagucacgaacgugcaaccuuuaacauggcaaaggagcuauuauaaaguaaugcauacuaaggcaggcuaaauuuugaauugauguaaaaaucugugaccuaauaucaagcuaugauuauucuagacaggcuuaucaaacccucuaagaaaaaaaaugguuaugcuaaauuagccaacauucuaaugcacuaugagaauauuugaagagugguccaagaagauuucccucucaaucaccuuaacauauguaagagacucucacaauuuagcugagucaaagucagaauuugucaucgugggagugaaagccucaagcuuuucuagugcaaagaguguuaugagaaaaguagccaguacaagaugauucaguaguagcugugccuaaaggucaaguugagaaaugaaccaaccuucauagcuugcucaagcuuugcagaaagacuggccacagcuuucugugcacgcucauacucuucgcgcuggcguuucaaaaucggugcuuuggcuuccacuucuuuuacuaucucauccagauacuuauuaauccuuuuauuuucuuguuuuuccaaaagcaacugauccugaguuuccacauaagcauuauauagcugggaauggaaaagguggucauuucacuaaguugaaguguaaugacaggaguauguaguuuauggaggcucauaaugaacauaccacuuacauaaaaguauuuguuauuuguaaguaguuauuugccacauauaacuacuuaacaguuaaaaaguucauuucuuguuuagacuuauuuauaugugugugugugugggguggcagggggcacaugacuauguucauuugagcaaagguacaugaggaggccagaggguggggaaggcugcuaugaacugcaggacguggguacugggaauugcacuugggaccucuaaagagcaguagguacuuuaaccacugaggcaccucuucaacccagcaccccuguccuuuuauuuuuaaaacauuacugaugugugugaaaaauguaucuaugagugcaggugcgugcucccguguguaugcagagucagaugauaacgucugugagcugcuucucuuaacacaggcuuugaggacaggaauauguugaugagaaugccagcucaaguguuuuacucauggaagugccucacuggccaaagaaagccucuuuaaaaaauugccugcuaauuaccagguaauuacauaaauugggggaggggaagauaagaccccugaguacuucaguaacaaugaaacaugaucuaguaucauucuuaccucaguuaauuucaugccaggcuuuacaauuuuagcuacagcugcugcggugggagacauggcugcaagcucuucuucagacaauauagcuccugugcaaacacaauuuuuuuuuuugcguuuuugcaaaacugcaagccacuaauaaauauuuaaagugaaggaauagugacauuaaauguauuuuuuacuuauuauauugcaaauauaucacaaauauggcaaccacacaacaauuacaaauaacuguucuaggaauuaauaauauuguggucaaauggcauuuauaucugaugaugcuguaaagacuuauaguauauuauuuuucaaauaaucaaguuuuucuauugcagcauagauauguucgagcagcucaaggaaugaacagguagcaaguaucuuagucacaccuuuacguuuuguagcagaaagcaggucauuugcauucucuaauuccuucuccaauuuuccuauuuucucaagcauuucuuuuuccaucugaucuuuagauucuuccacuuguagaagaugaucuuguauuguuuuguuggcuaagcauuuuaaaagacagaauauugaaagccaucauuaaaauauugcaguuuauuaauuaaaacacuaagaaucuuuccuucuggagacauuaaauccuagaggcuacgcuuaaugacuauuaucacucaaagccuggcucuacuugucagccuuuaaauguuccagucugaugagucuagucgaggcucuuuuuuaauauuucucaccaagaaaaccacaagagaguaugaauaacagagaaugaccacuauguacaucuucggaaucaauuuuguccuuuaguuuaagacagaaaaaaaaagaauagaaaagauaaagauaaagauucuagacacuguugaccuuccauuucccugaucccaccuguuagauucagcgguggcuugaaaguaaucagauaaaaaaguaguaucuguacugaaaaugcagggccacuuucacaccaucccccaaaccauaaagcaggggcuacuuacacugcauuaaguacugugacuagccuacagcugagguaagagagacaggcagauguguaccuucauaagcuuuaggcuagaucacuuuaaguaagagaacugaggaucuuuaaguauucuugauggauccugguaccaauucuuuagauguuaaguuuaucuacauaugcuuaaaauguuauuuccuugaguuuucuucaguuuaacuagcaaagcuguaguuucugcuaguucgaaauuucaacaaggaaacauuccugaaucuaugagccuacaacccaccuagaagccuaaagcuuaugaagguccagguauguaacuugaacgaauagucacuuggaaucccugaggccagcaucucuaagauuacauucggauuuguauuuaacacaguguauggaugacugacuaaacacgcucacacacagacugacaguguaagagagcacccagaauaucuaagacgaaggaggaaaacaccaccaacuuagcaucucuauuuucaaauacacuacuugcuuuaaaauauaauuccaaucuucuuagccuaggcuuuuucuucucuccaugaaauuuugucccaguuaaagccaauccuuauuuuaaauuaaaucaguuuugaagaaauuugaaauaaauuugaagaaauguacaacaaaaccaccuccucgcacucuaaguccuaccuucuccugcuucuuugagcaguuugugcagcucguccacugcccggguuagcucauuacucuuugccucugagucaucagcagcgcucugaaagguaaucacaaagucagcaccaggcaguacuccaacgccaggagacggacuaacgugugugccggaggacguaccuuguagagauuagagagcuuuaugugagcauuuaacucauuguggaauuucucuuccauacuggccugcuguucuuuggccuaaaaacaaaguaaaagcucaacuuuauauguauauaccagcaaguacagcuugaauauuuaagauauguaugaaacaucaagacagaaaguuccuuuuguaaagacuacaaauggaacugauuucugauaguaaauuacuuugaaaaucauauaguaccuaucaagcaaaauaacaaaauaaaaugaaaucacacugguuuuguacuuaguacuuugucuaaaacauguuaacugcuguuuaugauucuaucagcuuagaaaauauuuggagccacucugguuguuuuauggagaaagaugagaacauggucucagacagguaugguaguauaggcuuacaauccuaucauuaaugaacugagaaggaguaagaauuugaagccagcuugagggcuaaagaaguggggcccauccauucuggaaaacauagaaagauauuaucuaaaaauaacaaaaacaaaaauauuugacaauauuuugccaaguaacacaaauauacaugcuuucauaauuuuguaagugaaacuuauuugagggacuggcacauagcuccacuaguagaaucuugacuaguguguauaaaaaccagugugauaggaguacaccucuaaucccagaccucuggagguggaaauaggagguuuaagaguucaagacuauccauggcuauacugcaagccuuaaggccagcccagggagaccaaacuaaaccaaaccaccaccacaacaaaaucaaaacaacaaaaauauuuuuaagaggucaccauauaccucuuuuaauuuugucaacaaauccucuacauguuucugaagauguucauuugauguuuucaagccauucaucuguucuuccagucucagaaccuauaaacaaaugaggaaagacucauaacaccugagaucauuugauaugaaguuuauacugucaaaaguaaaauauauccccuccaaaaaauggaaauuuauaacauauaggcaugacuaagaaaauauguuuaugauuaauaagaccuuauuccucugucaucaucaucaugcaauguggugaaauuccuuuagcauauauuccagccuccacaauauuccuccuguccacugugucuauugaguauguaguuuaaaaguccaguggaaucugaagucuaccuacaacgaucucugaaagagcagagaggggccaaaaaaggcacuugacuacaccacugugcccuuuaccaauggagcucuagcuucauacaggcaaugccacggagagugcuugguccccagcagcaggagaaagaccaccucuaguucagauaguagauauaacucaaaaaugguuuacuuuugagaaauucaccaaaaagauucucauaaaaguacaaguuucagauaauauaagaucagacuacuguuauuuggugaaagaaagcagacacaauccaucacuucaugauggcagcuaguccuuucacaguguaugaccuggacauagucucuugaaaaucaucucagaagacuccugaaccuuguuggaggcccauaccaaguuccuuaccaccuacacuguggaaaaacugcagggcuucuuuuaagagagcgguucuagaugucugagagcgcuuguccacucuauacgcucacaguaaaccucacuuacuuccucagaaggaaguaacaucuugggccuuggagaugaugcaacaagaauucucugccacagaaccuuuguucuuuuuccucuucuccauaggccauaucucuauucaugcauaauaagauuuuauaauugacaccaucuucagccagcuuaggugaacacuggauaugcuaugucaaauacaaauccuugugugaucuuagacauacucuaguuuaccacaugacaaacagauauuccaaaugauuacuaauucguucaaauuacauuccugaaccuuuagacaagcuuuagguuuuuauauagguuuuaggcuuuuagauucacucauaaaaaagaaaaaaaaaaaaaacuccucguuaaaaguucaaaguggcaaaaacuacagacaacaguucaguuaaauuauguccagaauugaagaaaacucaaaugaaagauaauuuuaaccauaaacagauaaacuuuuaauucuaauucuacugucauuaccaauuagagcacuguguugaaacuaaaaaugcuuccauauuaucaucaugucauccuguagugaaugauuccacagggaauuauuugguuuggacccuuaggaugcauuuuuaucuaagaaagauuuaacaaugaucaacuguauccaggcaacucaguaucucaaugauuggaaaauaagguuaacguugagaaauuuucaugguacuguuguuccacucacaaaccugacauuguuacaguuuuccagcaggaguacaugcuuuaaaugguuccucuguagaauacuucccuugccauaguuauaaauuagguuacaaucagaaaucuguugaacauuaacuauuguaacggacucuacugaaaagauuaguccugauccaaaaacauuuuucaagcucuuagucaaaaguuauuuuagguaagaugacuaccguggacucugaucuacacaaugaaguguguuaacagcagcuccugauaccccaggguaaacauaggugguacuguagaaacuacaagguuaaaacacggagagacuucuuacaggucaaccuuuacuugaugcucauuucuuucuuugauuuuaaauggccuuguuaugaauuaccauaguaaucauguauugcagucucuuaaugucugcaugcaaccacucagugcaccaaaugucucacuuccguaagaguaacaagaaaacagaccauucaacugaacuuacaucucucuauaguaacagaaagaggagcaaaggcucuggguuuacuguuucuccaaauugacaagacugaccaaaaaaggaaacuaaauaaacaggaguucauuagccugaugcuguccuuguacuuuaaguuugcauugucauacaaugcaaaauuaaguguacucuaagucaaaaucaaccgauggagaaauguguuugaacauaauucacaaaaacaggucuacuucuuaaacauaucuuuggaaagaaagguuuaauauuagagugggugguauuaaaaagucauuacaaauuccuccaaacauuccccuagguuaaaguggagcucugcugucacaugcaacacacguuuuguaacugaggagguguguuacuuauugauguacaaaggccaccuccaccguaagcaaggcacauuuacuacucaccucuucuuuuuuguuuucaagauuacacuuaaguuccagaauuucauuuccuuuuucucuuccuagagccaacagcucaucaguuuugguuuucaacucuguguucagccaugaauuuugauuguguagcaauuccuuuucuuguucuaagcguuuuucucgauacuaaaaagaaaauuuuaaaauaauauuuaacuauuuuuaaauaaauguagcucagggauacaugaucuuuuauuucagaguagaaauuagacuguuaagguaacacaaaauacaguaacaaguagauccuuaggcauuucagucugcauuuauugggaaccaauauuacuugccuucacagcaacaucagaagcuugaaguucauccagcuuuaacugaaguucacccuucgucguauugcuuucuuuaaguuuuucauuuagacguuuaacauccucuagaaaggaggaugagagugagcauuugaaaauaaugaggagcuaacacucacagaaacuaaguaacaaaauauguuauuagaaacaaaccuuuaacacaaaguaagugcuuuucaacucccuguuuuagcuugcuucugucauaauuacaaacuaaauuucuauuuaaaaucuuuguauuuuauuauaaccauuuaaguuaaaagguuauaauauaaaaauuguccauuaaaaauguaaucauuuaauauuuuucuguucuccaauaaccguguuuuuaugaaacuaauucauuuaauccuaauuaccaccagccagguaaucaacacaaucagcaaacauuccaaugucacucucuucuaaaaaaucaaauuccaagcuguguauuacuauacaacauaaacaugugaacauuuuccuauuuacagaaauuaaauuuuuaaaaaagcccaaagacaaguaucacuaacuauuuaaaacucauuuuugacaaauauaucauaguauggugauacauuuuauauuccugucuccuaaauucaauauuuuuucuguuuaagacccuuuuauaccacuguaaugaacuuuaguaguuuuuguccaguguucccccauaucuccuuccuuuuucugcaaauagccuucuucauagagagucuaugucuauacucugaccucugcuaaccuucucguggcuucuuuucacuguccagugaauuuaacuacacuugcucccacuuaugaacucacugcaacaugaacauguguuaccugggccacacuugcaagacacugagcccgccaaucccaucucggaagggugugggguccacaaugcuuaccuaucccggaaguacugacagugguugcugagggaggguguuuuuuucagugugcagucagguaagcuucccauucucuaguuugauuuauucuuuuauuuauuuuuaagacaggguuucucuauguagcccaggcuacccuaaagcuauauaaaauaggcuggccuugaacucagaucugccugucaccgaauccugaguacugggauuaaaaggcaggugacgugauaccuggccaacaucuuaauaauggcuagcgauauguauacggaaggaacaacaguauuuuuaaaccgaacuuccacacuaaagaaacagaacaaagaaauauaacaucagaagcaacuccuagcaccaacaauaacaaagaaugcaguuaaaggcacaguuauuuuuuucauaccuguuaaauauucaacuuccugagauaaccucucauugguucugauuaaaucucuuuuuucagcuucuaacucuuccuuugcucuuguaaacuggcucugucauaucaagaaacaccaaguucaagaauguaaguuaaacaaucaauacagguacuugaaucaucaauucaacuaacauuagcaguuacuuaaaaaaugcuuucuuuccuuauaacuuggguaucaacaaacuaaaaaauacuuuuaaucguaacaccucuauuucugaguuuuaaauuaauuuucccuaggcuuaugaaugcaugucacucauuacaccgaagugccccaauuauuuacauagccuuuauauuuggcuauguaauagauaauuugcaugucuucaaaaaccaauugugggaacuaucacacauuuguguuuggguucaaauuacuucuugagaguuuccuuacgaggcuuuuagagucauaagcaacgauaccaaccaguuaaccaacaacuaagcauuuagaacaagcuggguguaacaugucaacacauggaagugaaacacaauuaucuuacuauugcuuuaaccugcauuuuccuguuacuacaaacauuuuaugcuuucauuacuuauaauauacuuccuuugcauguauuuuucuuguagcaguuuccuuaucaccugaaagaagucaucuauuauaaacagacuuaauggcucauaugcauauuuuuauguaaagaauguuaaacuucaaaugugaaguuuuacauuuucuauuacaagcugagcaacauuaauguaccuaccaaucauuuacacauauuucuuuugccucuauuuccaacaguuuuuaaaaagauuuauuuacuuuuagaaagagacccuaacucaaaaaguuuaagaccacccuuagaacaaaaggagagccagagccauggcucagggaccaaaggccauguugcuaauucuugauuggucucuauucacugagguaauguuucaacugaaccuagagcucaccaagacagcgaguccauguugucuuuauagucuacuacaggcaaucacuuaguacuucugcccugaaauuacaaaauggcagccauacccaccaagcacuugugaguucuaggauucaaccuacgguucucaagccugaugcaugugauuuagugcugagccaucugcacagacccacucuaaguccuuaaaaugcuuucacacuuagaaaccgcuuuuaaauaaaacuguuuauauauaaaguguauaacauauauagauaaaaccauaccaaaucaucauuauaguuaagugaauaaaucucauuuguuuuaucagaguggcuaaaaaaauccauuucaccaaguuauaacacaauacaguguuauuaacuagaacccucuauacauuugugagacuuuuucauucuacauauuuguuccuucaaccugcauuuccuucaccccgccaaucagcuugaucuguuuccaaauaccugacugauuucuuugaugacuuucgauaagccacaucauuucucuguguauggcuuauucagauguucucuauauuugcccauuuuguggcacauaacauuuuuuugagaccaaauauuauacuguguguaaacauaagcagauuuucuuuauccagcugucuaugacuaacuacagguuguuuucaaacuuuuggcuacuuugauccaugcagcaaugaacauagaugaguaugccuacuuuuacaauguaaagauuccucugaauauuauacccagaagaaggacugcuagguuauucuauauuuaguuuaugagccucuauauuguuuuucacauugguuguaucaagcuacacauaaaucagcaauguacaaucagcaagaaauaagaaccauucccuuuucucuguauucccgcaacaacauaucuuugauaauaaccauguguuaucaccaaacuguguguucaugcauuuuucuuacuucuuuuacaauuaacaaaugagaccuuuucauauaccugcucauuacugucuucuuugaaaauaagucuuuuguccauuuucaaagaaaauuacuuauuucuauuacuacuucuuuauaaaacuuggguaauauauaugccuuugucagagaaguggcuuacagauauuccccugcccccuauuccugguagcuacuguuuagcuuuauuuccuuuguagcacacagggucuuccguuugcuauggucauaauuaauuuuguucuuauggcuuaaacauuuggugugauuucuaaagagaccauugucaaauucaaaggcugacaguuuuggcucuguugucuuccaguuuuauaguuccaagaaaaauaaauaaauaaauaaauaaauaaccaaaaccaaaccuacuaccaccaaaccaauuuccuguuaugguacuccauauucauucuguuguauuuuguguuucuaagcaacauuaucauucauuagaacaacaauuuucauauuuuguucucuaguguccuuguauauuaacuucuaaauauaccuaaaacguuuucacaaacgugacuauuuacuuauuuucaauagaaaccagcugcuucacaaauggccaucuaaggaccauaguuuggguucuagucugugguauuauugcuaaaugauauuauuaacaucauaagggcuuuuuuaggucaccgagggugugccuuuaaagaaaaaagugggucaccagacccucugcuaccuauucuuugcauccuauucuguggugaaguuuccuccaccaaucucccuaacauguuauguggcuugccauuggcccaaaacaacacagcaaacugaucuugggcagaaaccuguaaaauugucaaugaaaauagaccucuauauuuauauaacuaaguaaguauguuguauguuuuaucccagugucuaacagaaagcugaccuacagggccguuaaacaccuaguucucccccaauuuuguuuuguuaaauuguaucuauucguguguccacaguucuucuggauuagacuucacucuguugcuguuucaucaaaucuagaauguguaucaggaccuugcauuaaagccuauauuaauuugcaaacccacuucacccaagaacaugcuguuauuuuuccauauauaaauacguauuuuaaguuuucugaaaacaguuuucuuuuaauaccgaggcaaacaaaacaaaacccaaacaagaacaaauuaaaauuuuuaaagggcucaaaacacuguauauuccuuacaaauuaauuuacugaaauauuuuggguauauuaugcuccuauaaggaaucugaaagcauguuuuucuuacauaguuuugaaaaacaaaucugagucuuaaaucaaauguaauuuuaaaaguacaguccuauaugguuaaagacuggguaucacucuucuauuaaaacaacauaguagcaacccuuucuaucacauuuaaucuguuauucuuaucacggcucuaaagaaacaggcagcaauguagagugacccagcucccaaguauaucaaaauaccaugaaugcuggguuacuguuggaauucaauagauaaauaaaaaacaacucaaaguguauguaugcacacauuucuauguauuuguuggcaguuucaugagaacguuuaaccuucuguugacuaguacugagcuacuggaaagccuuuaccugaaugcccagauuacggucuugagcaguuuccaguucuuugguuuuuucaguuaacacuuuuacuugguuaucuagacaaaagggauguaauggacacagauauguuaauuuaaaauuuguacuuuuacccaacuacuaccaucacacauuuuuaaaaugaagaacuggaguccauacugauuuaugaccauauuccaaaugugcaaauacauucugaucuuacuauauuacagacuaaaagguuuaaguaugcuacaaucacauguaaauaguuuguucccaauuuguagcaaaauuagcaaugccaauuuuuaaauuccauuuucuagguaaauuuauauaaaauaaagcaagcaggccaggaccaauaaauauaauguaauuugaccuacauaaaaugcauucaguauauauuauaauaaauaucuguaguuccauguuuuuuaucacuaagaaucaugccuuucacauagaaaaaaaaguuugugcucugucuuauauucaugauacauuugucuucccauauauaagucuagucauuagaauauauaguuauauaaaaaaauacacauuugaaaauuucuuucaugaaagcaucuaaagccaggcauagauguucacacuuauaaucccagcacuuggaaggcaggguagauacaaggauagcuacagcuagaaggaguuuggguuccucaggucuaucuaguaagaccuuucuucaaagaggaaacaagcaaacccuacaucauguauaggcaauuuaaaaauuaugugcaaugugugccuguguuaaguagaagccauuugcguacaggugcccaagggaaucagaaggcuuuagaugccuaggagcuagaauuuuagaagggcuugagcuugucaguuacuugauguaggaacugggaacugaacuugggucauguagaacaccaagugcucuuaauuacuugagccaucucccuaguuccuacgaacagguaauuuaacaggauuuuaaaaacuguaucaugcugggcagugcuggcgcacaccuuuaaucccagcacuugggaggcagaggcaggcggauuucugaguuugaggccagccuggucuacagagugaguuccaggacagccagagcuauacagagaaacucugucucgaaaaaaccaaaaaaacccaaaaaaacaaccccgcccucccccaaaaauaaaaacuguaucauuauaaaaggaaaaaaacaaaacaaaaaaaccaacccauuacucuauauuuucuauuuuguuuuacuuaccauuuucuauaauuguguacacaaauacacauacuucaaguacaauuguccacccuaggaaggaacuccuuuuugucuacauucaucuuuauuuucacaaauaccucacaaaagaaguaaucagagacauccucgugauacucuuuagcaccauuucugggcaagccuuaucaugcuuuguuggagaaguacaguucaggcugugcaccacagacgccugugucuacagagcuuucuuuaaaugguagugcauccaaaguagcugcaggaauuauacaccaaacagcuagagaaaagcucacguuuauuuaugaucaugagcuucuuguguuccuuuuugaugaaaucaaaucaaacaaaaauuuuaggugggcugugguggcgcccgccuuuaaucccagcauuugggaggcagaggcagguggauuucugaguucgaggccagccuggucuacaaagugaguuccaggauagccagccagggcuauacagagaaacccugucuuagaaaaaaacaaaacaaaaaacuuaagcuacauuuaauugaaaagccuuucaacccuuaaguuuucuucuguccuccucugaaagucacaggcuucaccuaaacccuuccuaaggaaccaggcuucauaggagaaacgcuggacucacagaagcugucacaagguaucaugaaaucaguagguuuuacauuuuuaauaugaaaacaaaucacuauuuaaaccuucaaguacacauuuaagcuacuucaaucacucucaauaguaccuuugauguguaaagcuacguaaacacacgugcuuccaacuacuuuuauccuuuuuacaaaagccaucuacauauggcacguguggcaagaacacuuuuauuauuagucagaauuagaaaccaggucugcagacugugacagccuauguccuuaccacgccuuuacuaaugggaacacaaacugcaacugcucggacaaggccucugagcauuucccacacuguaaguagcugcucacagagaaugacgugagggagaggacauugagaaggcacaggucugaaugccuuuagucagaggguagggaaggaaagcuuaggcucucucagagagagcacuguguucuuuuaagguuccggugaggaaggagugagcaggagguauaggcccaaggucugucgacaccaucaauuagacuaaaaccacuauguuuagacuaaaaccacuauguuuuuuucuucuuuuuuugugguuuggguugaggaaggcaagguuccaaaggcauuuaguaugaggaaaucauaugauuuacaagauguaacagauauguuuucuauuaacaaaaaucucaaucuuuugauuuuaucaaugaagacuagggagccagaugcuggggugaaaguuugcaagcucacagaggcagagaaggcacccagcugaaguuccagaacaaaugcuccucucucaagauaucacaaaaaaauccuccuucaaaccuaaugucccucccuucuacuuccuguaugccucucuaucugaccugacuuccuuuuauucuguuuuuuuucuuuuuucuuuuuuguuuuuuuucaagauaggguuucucuguguagcccuggcuguccuggaacucagucuguaaaccaggcuggccuugaacucagaaacuugccugccucugccucccaagugcuggaauuaaaggcgugugccacuacugccuggcuguuucuuuuuuuucuuaauaauccuacuuuacuuauaauuuacuuccugucagcugguugcuugcucugccuguuuacaauacucaugcagaaaguuucccacauuaaaagugcgugccauggcugagccacacuagaacuaaaaacagguuuuuccaguaaacaacacaauuuuggaguccauagugugaucagucugccucuaggccugaaggcaggagagcuaggugauucuuaccuuguuuguaucccugcuuagggcuuugcuaccuggaaagucuguuuccaggaggggcagcucccugcaagugugauuuucaaagguguagcugggcauccaagaacaguuauaaagauauaaucaaauacuuacuuagcuucucaagcuccagccucaaguucugacacucccggguuucagugacaagccucuccugacucugugagagccucuucucuaucucaaaguauuguuguucuacaaaagacaaguccacacacuaugaauaacaucaugcacacgugcccuugaaagcaguauuaauaccacuguuuauuucuucuaauacugacugcaaaacuuaagauacacuauuggaaauuuuaaucuuaauaaacagauuaaaaacugaaaaggacuuuccuguuauucuuaacuggcauauaaagacaacauugacuaaaagaggguucauaaauuaauuucaucuaggcaggcaagguuguauuuucuccagaucucaggagauuauuaaacauuuaaauauaaguuaccuaauaaauaaaaauacuuaauuaaaaagugcauuguuuuaaagggguuaauguaaaaauaauuuaaaugaugccuaaauuucuguaaaaauaaacaugcagacuucccacaaaaagggacugcauuugucuacuucaucccauuauugggacauauaaauuacucaguauugacuguguguaaauuaauuaacagaauacaguauauuauacaaacuucuuaagagucacaaaauaacuggauauuuuuacuuaucaacguugcuugauaacuacacuuuauugaagaaaaaaauuaaauuagguggaaauuucuaaucaaucuaccauacuauagaccccauucccucaauuaaugauaaaccaaaacaugugacaaaaaauucuguuuuuucuuucuuuuuuuuuucgagacaggguuucucuguguagcccuggcuguccuggaacucacucuguagaccaggcuggccuugaacucagaaauacgacugccucugccucccaagugcuaggauuaaaggcgugcgccgccaccaccgcccggcucuguuuuuuaaauaacuguuuucuuucucccaagaauauuuaagcuaugucucuaauuuccuuauacaaaagcaacgacaagaacguacaagcagauauuuuuauuauauauuuccuaucaagucucaacgcucugggagaaccaccauauauucauuuaucgcauuucauugcucuuucuaguaccguccuuuuguauacaaauuccucaucgcgaccaucuacugcauuauuagaucacagggugcuauacacacuaaaacaaggcacuaaaggggggaaauggguaaaggcuuauaaauccaguuuaaaaacaaacaaacuggggggggggcgcuuaacugucauuuaaaguacagcaaaacaacauuagauuaggauugcauaguccuaaaaaucuggugcaaacugggccaaauucuccaguuucugucggugggcccauugaggaguuuccacagaagacuacgcuuaguaaaaggaaaccgagguaaacgaagguggauuuagaucggggaggauccccccgccccccgaucuaaaccacacagcggggagaagagagaaggccuccgcugcacauggagccugagaagcugcuaccugaacaccucaccagggagaagagggcaggcgugcaaaggaggucgggccccagcuccagaccggagcgcgaagagcgucuccacacuuaccacucuccaccuuaaauuucucgugccgccccuucaggcagucgaucucggacugcugcucggccaggaacuucucaaguuuguucugcgucgacuucggcaguuuguucaguuccgggcgcuccagcacuugcugcaacaccgccgccaugucggccgggaucgcggcaacagccgcagcggcugaaggagaagccaaggagcaaggagaagcgcggagcccagccgccggagccgccccguccgccgccucgcucgcggucucucgcgcgccugcccgccugagacucccgcggcgggacccugggaaagagagucccgcguuaggugcagccagagccgcgccgccgcgcccucucugcgcacgcagccaccgggagcuaggcacgcugggaaagcgaguucacagcagccucggccccaguuuuuuggggauuucaccgguuuccagccccagagacucuugggaaauguaguguauuucucacccgcuuacgcgcgcucaggccgcaccucucgccccacuuccuucuuucuccccgcccccggcucgccuccuauggcugugacgagugcccgcgcgggggcgcuacauaaguacgcagccacccucguccuuaucccggaggagcaagacgaccuuaccgucaaaaccccgggaugucauggguacuccucuguggccacuucuagaagccgagccaccagaggucaugggucacggcagggugucucgacaggcucugggcuaccgccacgaucuuaacggugccccgagaggggcggggugcaggccucccucgcuug

SEQ ID NO: 12064 - RNA, 226654 nt, Mus musculus
gcaaagcaccauuucuccaaguuggggggcucagaggggagccaucaugagcgauguuaccauugugaaagaagguuggguucagaagagggguaaguuaagugcugagcugugagugggugcugagaguuggucuuuccucuggcgcuguugaaucaagugggaagugcugucugauagggcugaaagaaacuuuaccauguauguuaggagucugcuuauuuagggauuuccuucuaauucuuuuuuuuuuguaguuuauaauuaugacguuagauuuuugcaugcaugcauguuaguaauguauuuuucuauaaugucuucagauucaacagacuuuacagaauuuaacauagaaaugaacucuugugucuauaaaugauauauugauauuuagauaaaaauauggcucuguguaaauuuguaugguagcauaaagaauuaauauaguaaggcgagggcuuacauuuaaacuguuagacuaaacagacccauaaauuagguaaauuaaagcucuuauauaaaaauucaaauguggacagugauuuuuuuuguuuaauuuuauauuuuuuguuuacaugaucuacuuuuacuguauauuuccuguccacucuuuuuugauaaaggcauuauuuuuauuauuaaauaacugcuauaaaauuuaguuuauaaugugagugaucaccuccuuacuuaaucuauauguuuauuagagaucuggacuuuaggcuaguugcucagcaauuauaccugucuacguacauggccagauucaguagacugaggaauccuuuuggcccuauuugagaguugaaaguuaccucuaaccacugacuuucauuucuuugaaaaucuuugguuaaugcuuaggcuaaagagcuguugucaguuuuuaaauggaauuuuaaaauaggccuuaucaaguuauaauuuacauacaauaaauauuccaaaaaacccuuuuaauggguugugccuuuuuaugguguacauuuguggugauguaacaaacacuacaggccuaaaauagaacauuucuaucacucuaaaaaguucuuuccauguugcuuuuaguucacugcuucucuuucaacuuuggcaaucaccugauguguugucucuuacuauaauuaugauuuucaaagauuucaguucaguggacucauaaaacccauggucuuuugugucuaguuucuuuccuacucacacuucacugcuuuauccaugucguuuaugugaaaagaagaacuacuucaggaaauacuauucuucauuuauuuguuuauuuuuaacuaauuuucuuuuugaaacagaaucucacuuuauacccaaguugcaguuagacuuacuauguagcucagguaguuauucaacuugaugauucuccugucuaggucucuugagaacugggguuauaggcauguuuuaccacuccuggcuuugucuuuuuaauacuugguagaaauuugguuugucucuggauauugugaauaaaguuuuuaugaacauugaguacaugauguuuccauuuguauugguaauaaccuaggauaagauugcagguuauaugguaagugccuguuuaaauuuauaaaacugccaauuuauuuuccaaagugacugaccauuugugucauuauauuuguccuuugcuuuauucucucauguauuuggaaaguauuuucagauuuuaguguuguguuuuuuguuuucuuucuuaacuaguuuauauucuuucaccuuuuuagaggggagcaaaggagaggaaauggcaagucacuuaaaccucuaaaaauuuccuuuauuauuuccuaaaauuugauccuaagaucauuguaagacucaagugaaauaaugaaucugccuuucuguauacucaugucugucuaaggucuuagggugguucuuaauucuguaaaauuacaucuuuucugaaguaccaugaugaaagcuuaguguuuagcucauaagauauauaauagaaaacaaagaaaaugguacauaagaaauuuuguuguucagagguccucccccaacguguaucugccuuucugcauucauguucgugcuuauugaaaaauaauagccaucugaacauauugugaguaguacucaaauguaugaaaugaaauguaaagacccuucuguacuuuaccucuucagcugguucuucuucuguugaucaguauccuaauugugcauauaauauacaauacuuuauuuucggauagccauuuucucauaaucuaguguuucuguuaugaaaaugaaaaaaauaccuuugaaggccggcuuauccugcucaccccgcucacccugcucuccccgcucaccaauucacccuccuuuuuugggugggguuggguuuccggcuaagacuuugauguuagaucaucacuuuugagaacuuuuauuucuaaauuugcuucuuguaaacuauguugaauucccaacauucccuucauggauugugccaucauuaaugcuuauuacauauugucaaggcuuauaguaguuaaacuuguugaaucugaaaagcaaugaauaacauuauaauucuuuaauguuagugauaugauaguacccuaaauauaaaagagauuuuucacaccucaguucucaauagcauguauucuauaguuuauauaaugacuauuuuuuuuuugaacuucuuuucuuaucuuuuugauuuucuuuccuauuuugacuuuucagacgaggucugacuacauauucuaggcagaccuucaacuugaguuucuccuaccucagucucccaaguuuggaauugucgauauuggccacaguauggcuuuccccugaacauucugauggccauguuuuccccaugcugauugaaggacauaugccuuauugauuguuuagcuuuuuuuuuuuuuugguuuuucaagacuggguuucucuguauagcccuggcuguccuggaauucacucuguagaccaggcuggccagaaauccgccugccucugccucccaagugcugggauuaaaggcgugcgccaccacgcccggcaauuguuuagcuuuuuauuuacaauguuugaaguacuagugcaugguuuucuggauaugauacuuacaaauacuauggaauguaauucucugucaaguuccacacguucuugaaucucaugucauuacucuuuuguuuuggacucauuuuacacuuuccugagcguuuccugagcugauccuuguuuccaggaggaauguguacgggugcuugucagugugauauuuaaaacucuccuuuggacuuucaugucugguacauuucuugccuguguauacuucacauuuaaauugcuuucauucagaacuuugaaaguugcuuuguuuugcuuuuagcaaccaguuuuacugaggagaggguugaugcucaugaguuauuucuucauaggaaacccauuuuugugcucuggaaccuguugaugcuucuguaucuuuggaauuaugaaauuaaaggaggaugaguugcagucuaauuuuguucauuguguuuaaaguuuuaggggacaauuugaauaugaagguuuagguuggucuuuucuauuucuauaauuuuuuuauaucuuugguuauuuuuuucucuuguguauuuucuuauuuccuagagccucuaaauuaaucugagauguaaaacaaaaaauucuuuauuuccaugucuuuuuaggaaggaggagagaaacuuuuucuugaacauuuuauuuacuuuuucuuccaguauguuauuucugcuguuuugauauuucuaggaauuguuuguacuuuauaguugcuuuuucuuauaauaguuuagaacacuugauucuauuuugaaguuuuucuucuuuuuaaguacuuugauuaguuaauuauagcucuuucuugguggccguuucuuuaggugucucaugguacuauuuguacaguuaugagaggauuggguuacuggcagugcucucuguuugucacuguuuucucuguauuauugacaaguagguuugcugaguuaggaauugugaugguaaguaacuguacucuugaaagcaacaguugaaacacuagaguaacacauguugacauccuccacuauuaguucuuguagacaaucucaguauuguaugaguaauaauguaaaguuucagucaagcauauuucacaggguaaacuguugcuuggaauuucuuuggcuccaagaauuucucuuccccaaagaauuauuucuuuuuuauccuggucagauaauuacaaccugaucucugguguauuuauuuggaaauaucugucuccuucacagugugguuuaagcaguauuaggucugaguguagaaagaagauauuaaaauuacuuacucuagugaguaaaauauaaaaaguuaggaugaaguuaaaaucauugccaagaguugcucugugguuguucagugguagagcucauccuccaaccacugaaaaagccauaauacaguuccugguuugaaucuuagucuugguucucaacccuguacauuuggaucaguuucugauaauugagcuccuuucuggaugcuaccuuauuuguacuuuuaauguaagucgguuuuugaguaaauacuuucccagacagugaggaaagggagcuaaauacugauguuuauguaggauaaguuaaucuuguuuguuagagauuuaucaauaaugaaauuaucuacauagcaauacuaguguagaauugacaguucuuacuaaguaugggcuaagcuaauaccuauaucuucuucuauggaggaccuaaggaguaccuucuagacuagcuuuguauuaccauaggaagcaccuguauuuguagcaaaugcuuauugaauugcucaaaaaauaguguauugaugauauauucugggugacuccaaacuuuuuaagcuagaugcagagcuuugcuuccaguuuucugaguuuauuauaucuauugguaauguaggaauauaguacauuaguaaauugggaaauucaacaaguuuacaagauuuauauaauaaaaugaaauaaacugcaauaauaauaauaaagaacuucuuguaacuucuaaaauuuacuuguuuaauaauacuacuuuuuaaauacccaaauauuuuagccuacuuuuuuuuuucuuuuugguuuuuugagacaggguuucucuguauagccuuggcuguccuggaacucacuuuguagaccagagccuacuuuuuaaaaauuagauauuuucuuuauuuauauuucaaaugcuauccugaaaguucccuauacccuaucccccacccugcuccucuaccccacucacucccacuucuuggcccugacauuccccuguacuggggcauauaaaguuugcaagaccaaaggaccucucuucccagugauggccgacuaggccaucuucugcuauauauguagcuagagacaagagcucuggggguacugauuaauucauauuguuauuccaccuauaggguugcagaccccuucagcuccuuggguacuuucucuagcuccuccaucgggggcccuauguuccauccaauagaugacugugagcauccacuucuguauuugccaggcauuggcauagccucacgagagacagcuauaucaggguccuuucagcaaaaucuugcugauauauacaauagugucuggguggcugauuaugggauagaucccuggugggguagucucuggaugguccauccuuuugucuuagcuccaaacuuugucucuguaacuccuuccauggguguuuuguucccuauucuaagaaggaaugaaguauccauacuuuggucuuccuucuucuugauuuucuucuguuuugcaaauuguaucuuggguauucuaaguuucugggcuaauauccacuuaucagagagugcauaucaagugacuucuuuugugauuggguuaccucacucaggaugauauccuccagauacauccauuuacccaagaauuucauaaauucauugauuuuaauagcugaguaguacuccauuguguaaauguaccacauuuucuguaugcauuccucuguugagggacaucuggguucuuuccagcuucuggcuauuaauaaauaaggcugcuaugaacauaguggagcauguguccuuauuaccaguuggaacauuuuucuggguauauggccaggagagguauugcuggaucuuccgguaguauuauguccaauuuucugagcaaccaccagacugauuucuagagugguuguacaagcuuuuagccuacuuuuuaaugcugugaugaaauaccugaaagcuacuuuguaaaaagaagagguuuauuuaguuuaguuaguauuuuggaggcuuaagcguuugucaccuuuauguacucagcauucuuguaaguucccugucagguggcuggugauaacucugugggaauacaagccaucacauuugaggacaggagacagggagaggagaagaauggcaguaguugcucuuuuauaaguuuucucuuaugugaacuaaagugaucuuagaagaacuacucaugaggagcauggcaccgugacccuaaggacuuugagugucacucccaaaguuuuuaccauaucugcaagcugccuccaaaucuaacaucacaaaaagaugcuuguccuuaucacacuccaacuguagcacuaaguaguaauuuauuaauguggagagucaguucuuugauaaggauuaggaucuaaugucucaguagucaauucauaauaugacuugguaagucaauacgauuuaagagauaacuuacuguaaacauuuucauugauaaaaugauaccuguguaaauuuguuacaccuguauuguuuuuguaucuaacagauugaaccuuccuauuguuucucuguauuguaaccaguugugccuucaaaugaccauuuuucuuauuuauauuguauuuauaauaucaucauguuugucaauagaauacuugucuugcauuauaugaaaugguugaguuaaaguagauuugguaauguaacaguugugucuauaaauuguuucauaggagcuaaauccuguuaugcaaaauacacuguagcaacguaaggauugaaagcaggcuauauuguuauuugugcuauuguugaucuagaaaauuauauaauuuguuguggaaagcaaaacuuucuuuuuaggugcaaaagauugagagucuuucauuuuucuuuacuuuguauuuguguuucuuuguuuauguuuuacuuaugaaaucacuuuauagaaauaagcuauaaaguggauaagaagaaugaaagcaacaaugugauguccugauuacucccuagcacaguguuucuccauagagaguagauagcugugauggugacuguguaagccauguguucaauuagagaaguaugcugcaacuauugaaacagugaaaaguuuuguuuuuuuuuuccuuauuuuuugagacaguucucauguaaccaggacuggucuugaauuugcucuauggugaggcuagcuuugaacuucaauccuacugccucuacuuccugggauuacacauguguaccacaaccaauuuuagauuuauuuccuaauggcugugaaaauuagagauuuaauuaauauauuuguaauacggaauuuaguuuuuuauuuuuuauuuuuuuacaguuuucauacacuuauuuuaaaauuguaagcaagagaaccuaauagaauaccaucaagugauaagcuuucauaguuaaguuucauggaguuaagggauugugaaguugcugugacgcaggcauauacuuagguguuuccaauuaagagugaaguuguguguacugacuugcagcuucauucaguuuacuuaggaauguuaguuuguuuuuguauguacaagacaaauacuuuaccaggaaauacuuuaccaggaaaauaucucucucuucaaguuaucuuuaaagaaccaggauucuuuuuuucauuucuacaaaucaggcauagccaucuuguggcucaaggggugcuuguggccaagaauaguuguaaacacugcccaacauuuucuguuauuuaacuuguguaguuugugugugaacuuuguaaaugacaaaauuaugcugaaauaucuagagguugaacauuccugcaugccuuuuaauucucuuuuauggucauguuuuacugggaagggucucuaauacaguguuuaauaagagaauguguauuuuaacacaaguuuucaguuagcugucacauuuccacuucuaccauucaucagacugcaguccuucuuucugaugugcugaguuuuauguaaugguuuuucaguuuuucugaaauauuuuacuguuucuauugaaaugaccauucuuuucuuuuaauauauugaugugugaauugucauucuggaauaaauccucuuuaaucaacaugcacuuuaaaauguuccauuucuuuuaauuuuauuuuuuucccaaucuacuauauuuucuuuauuaauuuuccaauugagagacaucuagguuuucuucuaauuucugccuguuaugaauaaagcuacagugaauacaguuaaguaaauaucuuugcaguaggauggaauauccuuuguguauaugcacaggagggguacaacugggucuagagguagaucaaugccacuguauugauuuccaaagugauuguauaaguuuguaaucccaucaacaauagagaagggugucucuuauuucacauuuucaucagcauuauuuauuuauuuauuuauuuauuuuuaauuagguguuuuccucauuuacauuuccaaugcuaucccaaaagucccccauaccuucccucccacuccccuauccacccacucccaccuuuuggcccuggcguuccccuguacuggggcauauaaaauuugcaaguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggggcccugugaucauccaauagcugacuaugagcauccacuucuguguuugcuaggcccaggcauagucucacaagagacagcucuaucuggguccuuucagcaaaaucuugcuaguguaugcaauggugucagcguuuggaagcugauuaugggauggauccccggauauggcagucucuagaugguccauccuuuugucacagcuccaaacuuugucucuguaacuccuuccgugguucuuuuaauuuucuuuaaguagauuuuaaagaauuauuuuauacagaauuaaaaaucuuauauuuaaauggauuaguuugcuguuaauuagucuacuacugcuauacuagaaucugcuaggcauguguuucaaaauauagauauaaaauguaaguuuuguuauuugcucucuaauguaauucuuauaggaauuauuaguaccaaguuugggagguuggaacuguuagacaagaagacuuaaaacccccuaauaguggaaaaggugaaaguuguuuuuuuuuuuuuuucuuguggauuccucuuguuuuuuuuuuuuuuuuuuuuuuuuuuuuuuuuuuuugucagucacugcuuagauccuagugggaaauacagagcuguaccuguugagcucauaucuuuucuugagugacugucuuuacagcuucuauugucuuugcaucagaaaaaaauuuuuaauuacuuguuagcauucugaauuaugucuuaugcuaacuacacauuucugcaacuguauuuuuuuuucucuguauuuuaaccuaugcuaguuucugguuggcacugcuauauuuuucuuuuugucagugaaaaucuccuucaaggcuaaauuuuaguaucauuucaguacuuuuccauagcucacagucuuuucaaaguuagaauguuugcucuuguuuguuagauuccaacaauaccugaucuuugccuucuuauggcuuuguauuuggucauuauaaacaucuaucuauugaaaacuuuccaagauuaggagcuguucacuaguuacuucaacaugcagccuuuuaaucaguauuuaaugaaugacuaaagaaaaaaaaucucuagaaguucacagguagcacagauuucagggcugggaaagggcaagagcagaugaaagguaugcaaacaaucuguguucugcacagcgccagggcagggcuaggauucuugaaccaugcucucuguuaaguggguagcacaauggaaccaacgggagaggaauuaggagaauuuacugaauaaucuuuccuggccaaggagguugagcagaaugguucuagaaauggucaauauuauaaguuaggauagugggacacuagaaugggacuauaguaguguuuauaauuguggaggauugauauaaacacacagguagagagauaggcuagagacauugagauauauauauauauauauuuauuuauaaauauauauauauauguauguauauguguauauaugugugauuauaauuuguauguauguaugucauggauacuauugcgcuacuuauaacacuuacagugcacuucuaaguuucuaauaaguaaaugaucacauuucaaguuugagaguagguuuuucuccuacaauguggguccuggugagugaacuuagguugucaguucuuuauuuauugagccauuuugccagcucugcuucugauauuuuuaauucuaauauuacaagucuaagaagaaucuuuucuaguguuggauuauucauuucauauauuguaagugaaauaucauuacauaaaagagcaugguuuuggccggguggugguggcacacaccuuuaaucccagcacuugggaggcagaggcaggcggauuucugaggccagccuggucuacagagugaguuccaggacagccagggcuauacagagaaacccugucucgggggggugggggggugguggcagggguggagcaugguuuuaaucauuguaaauauguuuauauuagaauauuauaaucuauuauaaaauacauuaauacauuaaugauauuuuuauuuuaaaguuucauauaaaguaauguguuguaucauggcaguuuuauauguauauguuauuauacuucacuuuuaagucauucccuagccugccaccuaccuuuugacaucguuuauaucccuuucuuacuuauuccuuccccccaaauaguacucuauuuuacuuuaaggucauguguucuguuacuuacacuccucucuccucaaucucuuccuccccaaagcuucuucuauauucaauacacuaguccccuguucucugucccccaacugccuagaggggguggggggggggagagcacaguaaagaagcauguguugguaucuuuguguuuaaguuuuuacugcuuauauacaggaguuguguagcuggguuguaggguauaucuaauuauauguuuuauuaguuuuaaaaauuucaagcuuauuuacauauauauguauauacacacauacauauacguugaauauauuccuuugcauacaccacuuguucucuuuucucauauccuugcauuugguucccuuugcuuucugucuacaguguuaacuuguacauucaugucauauuuauuaauacacaaacacaauuuuauguaccuuguuuguuugguuuaaggaacuuccacaauagacuuucauagugguugugcaagcuggcagucucaucaguucuuuucccauguuguaacuauuuguuuucaguuuugaaaaauugacucauuuuacauauauuaguauauggucaccaugcaugugcagugccuguggaggccugaggagggcguuuagauuccccuuucuccaaauauuauuaaugauuguguuccucuuuuucuguagcuacaguagcuuuuucuguagcuucaguuaacagaaagcacguuuuuuuauucuuuaaaucaaugaccagggauucuaauguucucauucaaaaugucugguuugaauuccagaaaccaauccauccaccugcgccuuccucuuuccaucccucuccauccagcacucauuauguugcucaggcacuccuuuugccuaagccuucuaguaccugaccacuuaauuuauuuauuaauuagugaauguucauugaguucuauccuaucauauucuuauuacuguguguguaguuacuguuggaaugugucccaggugccuacucucuaaugggaagauagagauaauaaacaaguaauuaacaggaacauuucauguagugauaaguguuaugaaggaaguaagccaugauauguguuagaaaguuguggguaaagaagauaacugcaggggugaucuuugaugaaagagucuuugaauaggcaaguuuauauacauaaacauauauaauuugccuuuuuaaagugguuuaguucacugccauuuguuaguucuauuguagugcaaccauucccuaugacuuuauauaauuuaguugugggguuuuuuguuuuuuugcuuuugucuuagaaaacugaaaguuuguauucauuaauuaucagacucuuauucuucucccaguauacagcaaccacuguuuuuucuguaucuauguguagauagaaucugauggaagguuguggugcuguaauacuuugagggauuuucacucugguaaugagcccuacaaucuggauccugaucuuagaggugcauucuagcaggucugaauaacaguuagacauacaauaauaguaaacauuuaucuccuuuucuuucucccaucccuaucaaaauggaagaaaaagaaugagauaagaagagauuaccacagaagacagaaauaaauuucuaucuuuaaaaaaucaugcuaguggacaggcaaugauggacuccagugaguaaacauuauagucuguaaggcacagugcuagccauauaaaguacaguacuauguuuuucucaaguuuccaagaaccucagcauuugaagacuccagauacuaaggaagggaggagucagaaacuaacagguguaggccucuaguucuacucacuuuugagauggauagaugguuugaacucaauccauagauuuaggagaucaagguuuauucuuugcauagucauagagaacgugccuagguuaaaaaacaagguaguagauagcugauuagguuaaaacagggaaaccaaggugaaauauacaucugaacugaggaacuuugggcugucauuuucuacuuuuuucccagaacuucaucuacaccuguccugcccaccuucuguguacaacugaagauaaccagcaucuucauaugcugguagcuuaccacuggagcucccaguugccaagcccuuucuuuauauuaauauuucaaccauuucuuuucagugucuuacgauuaaauauaagcccaacaauccaaggccauuggacaugggggaaaucacaaacauaaaaacgaaaguuuaaaucaaccaaaccagagcugggagagagacucacugacaguuaagugcagcaggaacaaauagacaucguaagagagagggucaaaacacaaagcccccaaacaauaaaguggguuggcauagauaguucugccgauaaagcauuuaugcuaggcugauuugaguucacuugcuggagcucacaagaggacuguuggagagcaucaacuuuacaguugucuucugacccccauauauuacuccauaccugauugcacacaccauaugcacaauaauaauaaagaacuaaauuuaaaagaaagcuggaaaaaaaaccuuccaggauuguccaaaaagacacuuaaaugauauuaagagaacauaaauaaaugugugaacaucagcagaauuagagaacucaagaauguugcucacagaguggguaguugagcaacuaaacuuugauuuugcuuuaacuuaugcuguucuguguugucccccucccucucucucuuuggcuguccuccccaccccccagcccccgcaccuccccgccucacacacuuggucuugcuuggacuuggcugaacugguaauuaacaugaaauucaggcaaaccucaaacuccugccaauucugugucagccuucugagcgcuguaauucuacgucucaccauauccaccuucuggguaguuuuagagaaguugaaaccaucaguggacugucuacuaauggagaaaucagaacgcuugaaauguaggucucauuuucuucugguuauacauuauauacauuauacauuauacccuucauguugcuuauaugccaacauuuauuaggagaggauauauagugaauguuucuuuuuggaugguauugauagugaaauggaaaagaauacuugaaaagaaauuaccaucaguauuaaauuuauuaauguguucuaacuguuauuugucacauacuugucuaaaacuugauucuuccuuuuugacuuaauuuuagcuagauucuuagaccaaacuuugaaagaucagcaaugaaguaaagcuuuuugaauucuuagaaagaccuaauaacuuuguauuuuuuccuguagggggaaagaucuuucauuugugguuauuagauucauugauucaguuaccacuuuuguguugucacuuugguuaaauacuuuacauuuacugggucuuaguagaauauauguaauuagagaguaguagcugugaugauuaagugaaauuaaaguaguuuaaucacuccagcuagcuacuggaccugaaagaauauauacauuuuaaguuuuuguuuucauuuuuccuuuuuuguaguauguguuaguagggaauauacuguuuuccuagaucuuaaggcauguuguauaugacuugaugauauauauguauguauguauuaauauuuuuggaguggcaguuuugugcuuugaaauacuuucuuuuuuauuauucaugauacaacuguuauuuccuuauuuaucucuugucuuuuuaauuuuuuuuucaauuuuuuauuagauauuuucuucauuuacauuucaaauguucuccccuuuccugguuuccucucugaaaacccccuauccccucccaccucucccugcuuacccacccauccacccacuccugcuuccuggcccuggcauuccccuggcauagaaccuucacaggaccaagggccucuccucccauugaugaccgcaucccacugccccacacuaggccauccucugcugcauaugcagcuggagucaugagucccaccaugcuuucuuugauugguaguuuagucccagggaguucuggggaguacugguugguucauauuguuguuccuccuauugggcugcaaaccccuucaagcucuuugaguucuuucucuagcuccuucauuggggacccugugcucagcccaauggauggcugagaguauccacuucuguauuugucuggcacugguagugccucacaggagacagcuauaucaggguccugucagcaagcucuuguuggcauccacaauagugucuggguuuggugguuguuuaugggauggaucuccaggugggguagucucuggauggucauuccuucagucugugcuccauaguuugucuuuguaacuccuuccaugaguauuuuguucccccuuuuaagaggaucaaaguauccauacuuuggucuuccuuuuuacuuucuuaauuaucuaaccucuuauacuaugaacuagauguccauuuguuuacuauucuuguaguuuuuguagucacuccugauuugcuuuuacuuuuaaaaguuuuauucuaagauaauuucaaaacauuuguucugguguuuuuuguuuuuuguuugauuugaauccugaauuauaugacugugaugcauuuuauuuauuuauuuauuuauuuauugguuuuuuugagacaggguuucucuguauagcccuggcuguccugaaacucagaaauucgccugccucugccuccugagugcugggauuaaaggcuugcgccaccacgcccggcugauaugcuuauuuuuaaaaggauagcuuaauguguuuguaggauugagguuauuugacuguuugacuuuauuguuagaaaauggucugaguugugaaaucuaguucucagugaaaauaaaauaagaggugguggucauuaguuuucuucccacagagauaaaauggauuuccugaugucugcuugcuuuauucaagcuguugcuuuauuuuuagagccauaugaauuuuguccuuuucuguacuaacucuucuuuucucccauaguuuggccuuuuuauuucuggaaugauagaaaggaagguguguguguguguguguguguguguguguguguguguauacaauucugaguaaugugcuaaggauguagcucaggagguaaggugagugguuguucagugugcacaaggaucuagguccaguuuucagcauugccuaagccuagcauuguugcacaugcccauacuucuaguacucaguagguggaaagaagaggaugaaaaguugaaaaguaucuagcuacauacagcacgucagguuggaggcuaaccuugacuacaugagacuuagucugcaaagacccuucucauuuuaucauuaguagguugcaaagcuaguugucauuguucacuuuuguucacuuuuaucuuuuguaucuagcauauaauuaucauucaggacauuuuaauaaauuaacaauuucccacaaguaaaugaauagaaauauaaugacaaauaaaaggucaaacguuuccuuaggauuauaaucauagccuuugcuuuggccaacacugaguuucaaaggaaagacugaccaaggugguuauagaaauggcuuucauuauuguuuguccaagaacagugaccauucccuaguacaggaagugacuuucaaacacuuuuggcaaagcuaagaagcaguacuguccuugacccuuagaucaaauguuauagagccugaauuucuuuaaaucuucuucagucaaaaaaaagaaaaucaacauuuugauuaaguggaaaauuuauuucauguauaaagaaccugacuaaguuugcuaacaaaguaagauuuaauuuuuucuaguuccauuuuaaaaauguuuucuuucaaguauauaacacuguaaaaugagcucaacgguagauuagcagccaaacauguugauucagcccauagcuacugaguuaagucuggaggggcacaguuuauucuuuacccuguuccaugacaguguguauccuucuugucuguguugagggaaggagacugaaauaaguuacucuggacagcacugccugaacuguugagaggagcagggaaaagaauuuucaaccauuuguuuuuaauuuuuuuuuuuagcauaaagccaauguacacaucccauguuuauugugaaauacccauguugaauaauuacucacagcccuauuuugcucaugcuuuuguaaagcaauuuggcuuaaugcuuuguuuggaauagucuacauaaagauaugaguuagguguccuaugauguauuacauuuuuagggccuacuugaguugggaaacagaaugcacucugcuauaaucagcagaguuuuauauacucacauguagaaggcuaugguugggauuucauaaaguuuauauaaacuuguuuuaaugagccagaguaaggugauccuugguauuuaaaguagcuuuuaaaauauaaucgggauauguagcagcuaguauaacauagcccuauaugcuuuugcauauauuuugcugugaauuuaaaaugagaagagggaaauuuuacugaguacaagcuuacugaacuguaagcuguuugguaucauuuccuaaagggcauauuauuaauaaugccucuuuaagaauagauuguuuucugagaaauacuuagagcaaagaaaauaaaaguuuugagguacugaaauuaaaaaaaaaagauuauauaauagaauuuaaaaauauguuuuguuagguuuuacagacuuuauugauuuuuuuuuuucugugaaacuucuagaauggaaucugaugguggaugugggagagacaauggguaguaacauuuuuaguuagaacauaaugguuauauuuaauuauaauuuucauuaugcuaguagugauuauaauuuacugauuaauguucuuauucaaccuguuucucugucugauguuugcuguagaaucccuaugcuuaauuuuuuuauuggcaaaaugaggacucuuggaucucuugauugaauuauuaaauugaaacagauuaguaaauaggagauaggaacauugccucuacuuuagccugacucaaaaucaacuaaauuuuucagaaccauucuguguuggcugcucugucuugguguugcugguuuaucuucucuaggugccugggcuucaaaucaguuacuguuauuuuccucacucaacccugcucagcuuuggucaugaaauaccaaguaagguuucaucagugucccuucuauuuucugagcuagacauuuagcggaaaguuauaugaaggggugauuaguaagcauuaauauuuuucaaauuauuagaucuauauuaaauguuugugauaugugugcuuugaagcuacuaguucugaaccugugggucacaaccccuuaaagggucccauaucugcuaaucugaauaucagauguuugcaucacagucaaggacaguagcagaauuacagcugugaaguagcaacaaaauaguuuuaugguuggggucauuacaauaugaggaacuguuaaaggguugcaacauuaagaagguuaagacccauacagaaaaugugguacauuuacacaguggaguacuacuuagcuauuaaaaagaaugaauuuaugaauuuccuaggcaaauggauagaccuggagggcaucauccugagugagguaacccaaucacaaaggaacucucacaauauguacucacugauaaguggauauuagcccagaaauacccaagauauaagaaauaauuugcuaaacgcaugaaacucaagaagaacgaagaccaaaguguggacacuuugccccuucuuagaauugcgaacaaaacacccauggaaggaguuacagagacacaguuuggagcugagacgaaaggauggaccauccagagacugccauaucuggggaucuaucccauaaucagccuccaaacccugacaccauugcauacauuagcaagauuuugcugaaaggacccagauagagcugucucuugugagacuaugccggggccuagcaaacacagaaguagaugcucauaguuagcuauuggauggaucacagggccccccaguggaggcgcuagagaaaguacccaaggagcuaaaggggucugcaacccuauagguggaacaacauuaugaacuaaccaguaccccccuuuccccucccccccccaccccgauugugucucuaguagcauauauaucagaagauggccuagucagccaucaguggaaggagaggcccauugguugugcaaacuuuaucugccucaguacaggugaacgccagggccaagaaguggaagugggugggugggggagcaggugggggacuuuugggauagcauuggaaauguaaaugaaauaaauaccuaauuaaaaaaaaagaaccagugcucuagguuuuacuuaccuguaugaacuccuaaucccccugccucaacuuucccaguuuugugauuagagccaugagcuaccacauuuggcuaggcuuguccuauuguuuucuaucacuggauggcuuauauuaauuucuacuccauguucuugguagcgcucuuuuguuuaggaaagugauacaaauguccuaaccuggcacuagugagcagcaccaacuacuauucuagcuucagccuuccccauauuuuguuucauagcauggccucugaaugcuuuaguuguacauuaucaugaaauguuuacuuuuguagcuuuuguauaacccucagcaugauuuaaaucaagugcuaauauucuguaaucuuuccagcuuaaagugcuguuguuguuucuuaacauuauuuuaaacuauuuaguguagguauguauaauagguauuaauauaccugacuaaucuagucuaagaguuuauguuuuuugaggcaauagauuauugaaguuaacugcuuugaccuacaaucauuuagauagaguuauaaacacacacacgcauauaacuugaauuuauaucuugcugagcaaaguaaaaagcaaguguaggaaugguauacugguucuccauggucccacuucuucugcaaaugguuccugucagugcaugcuuaguugcaccaagccagaauaggaaaagacauagaagaccaccuagaacagauuuauuagugggccagccuaacagugguacuucuugccguccacauuuugucagcuacaacucaaauggccauauugacuacagugaauacagaguaauaugccuaggaagaggauaugguguauauauggaaauuuccagagggcuuaaaagcuuguaguuuucaaguuggauaaaucuguaucuuaauucuggauguauuucuuaucagagaugugauuaggaaauuuuaaguaacaaugcaaaauauuucacuuauaguaauuucucaguaacuauuggcuguuacuaucaucuucaguaacauaacuuuguucaacagucaucuugauauguauauauacauauuggggguuuuguuugcuuuuugaggcagcauuucauuauguagccugaguuuccauagaauucaaccuguaccuugggcugcucuaaaacucaugauucuccuguauuagccucccaugugcuuagcuuacagaucugagucaccaugaguagcuaguuguaugucaaucuaaaauggcugcauuguguuucuuguuucauaauuacuuuucucuaguuaauauuaugcugggaauaccagaagauuuauuuauaccagaaauuauaacauuuaauuauuagcauuucuuaaauauacuuuagaagaauggaaauuacuuuuggagaaguuuaaagauaaaggagaaagaacuucuaggagguaagaaagaaauguguacuggagauacgacuuagcuuauagagugccuaccaugcacaaaaaccaagcuuuuaucuaacuaauugagcauguaagugcacauuauaauguaggcacucaggagguggagauucauaauuaaaggugauccccuacuguauaaugagauuaaagcuagccuggaguacuugagauacugugccuuaaaacaaccaaccaagucacaucaacaaaaccaaagcgacauauaaacaaucuaaaagucauugucaugaugguguaguguacaccugugaucccagaacuugggagacugaugaaggaagauggagaucuggagaauagcuugaguuaauuuaaggugaagagagggaaaggaagagagcaagagcaagaggaagagaagcuaagaaaauuugaaaacaaauguuucuaacaucacaacggcagguuuuuggagagaagucagaagcagcagaaugagguaauuauuaaagaacuaggaacacacagagaaaaaccugucuuaaguaaaucaaucaaucaaucaaucaaucaaucaaucaaucuaaugaccagcacugaaaggcuucauuuguucaggcacauagaguauauuuuaaaaagaggaguaucuuuuagguuggcccaugccuguaauccuaccacuucacaggcugagucuagacaauuuccaggaguuuggagaccagaaugggguaguuagugaguccucaacagcuuuggcugcaguauaagguacugucucaaaaagugaagaaaaauaaauaugucuugcuacugugaauuaguagucuguuagcuuaugucuuuuuauaggugaguugaguccauuaauauugagaaauauuaaagacaguugacucucgguuccuguuauauuuguuuuuguagguggcuuuaugugauugugguucucuccuuuuggcuuuguugugaaaugcuuaauaucuugucuuuucuuugguuucuugucuuaccuuccuuguguuggagucuuuuuuucuaggaucuucuguagggcuggauugguaaauagauacuguuugaauuugguuuuguccuggaauauuuugguuucuccaucuauguugguugagaguuuugcuggcuauuugugcucucuuagagugugcaugcccucugaccaggcucuucuggcuuucauagucuguugaaaagucugguauaguucugauaggucuaccuuuguauguuacuuggcucuuuuucccuugcagcuaggauggccaaucggucuaaggugcuguguucagguugaggucucccguggaugcauggguucgaaucccgcuccucacauuuucauuuucuagcuaaaaagauaauaugagaugagauaauucuucauagcaauuauucugggauaaaguuaacaauaaucuaauccuacagugcuuuuguucugugucucccacucuuaaacuuaaacauucuauuuguauaugcuuucaaaucaauuuuuauuuuuaaaauugaauauuuuauuuguuuacauuucaaauguuaucaccuuucccaguuuccccucugcacucccucccagcccaucccuccuuacccuguuucuaugaggacgcucacccacccaccuacccacuccugccuagcauuccucuacacuggggggcaucauacuuucacaggaccaagggccuccccucccauuuaugacagauaaggccccuucaguuccaucaguccuuccccuagcucuuccauuggggucccugugcucagucugaugguugucugcgagcauccguauguauauuugucaggaucuggcagagccucucaagagacagcuguaacaggcuccugucagcaagcacuucuuggcauucacaauagcgucuggauuuguugucuacaugugggauggauccccagguggggcagucucugaauggucuuucuuucagucucugcucuacucuuugucccuguauuucuuuagacaggaacaauucuggguuaaaauuuuugagauggauggguggucccaucccucaacuggggggucaugcacaaccucuggauauggucucgacagguucuaccucccucuaugugggggauuuucagcuaaugucauccuuaugguguccugggaggcucuugcuuucuuggcaucugggacuuucugguuguuaucaucacccaguuccccauaccucauugcuauacaccucuguucaauuuccugacccucuguacaucuccuccuucucuucccauaccugauuuugucccucuuuuuccccucccccucuucccuuccucccaaguuccucccacccuguacuucccuugauuauuuuguucccccuucuaaguaggacugaagcaucugcucuucagucuucccuccucuggagcuucauguggucugugaguuguauuguggguauuucacacucuuugccuaauacccacuuagaagugaguacauaccauguauggucuuuugugacugaauuaccacacucaggaugauauuuucucuauccauccauuugucugcagauuuugugaagucauuguuuuaaauagcugaguaguaaauccauuugguucauaacuuguguuauuuucacaguguuucuguuuaguuucuguuuccaugaucuguccauuggugagaguggaguguugaaaucucccaccauuauugugugaggugcaaugugugcuuugagcauuagaaaaguuucuuuucugacugugggugaccuugcguuuggagccuagcuguacagaauugagaguucaucuugguagauuuuuccuuugaugaguacgaaguauccuuccuuaucuuuuuugauaacuucagguugaaagucaguuuuauucgauauuagaauggcuauuccagcuuguuucuugggaccauuuguuuggaaaguuguuuuugauccuuuuacucugagguagugucugucuuugucacugaggugcauuuccuguaugcaacaaaaugcuggguccuguuuacguauccaguuuguuggucuaugucuuuuuguuggggaauugaguccauugauguugagagauauuaagaaauagugauuguugcuuguguggaauuauguuuguguggcuaucuucuuuuggguuuguugaaagaagauuacuuucuugcuuuuucuaggguguaguuucccuccuuguauuggaguuuuccaucuauuacccuuuguaguggagagauauugcauaaauuuggcuuugucauagaauaucuuggcuucuccaucuauggcaauugagaguuuugcuggguauaguagccugggcuggcauuuguguucuauuagggucugugacaucuucccaggaucuucuagcuuucauaguugcuggugagaagucugguguaauucugauaggucugccuuuauauaauacuugaucuuuuuuccuuacugcuuuuaauauucuuaguuuguuuugugcacuugguguuuugacuguuaugugacaggaagaauuucuuuucugguccaaucuauuuggaguucuaucggcuucuuuuauguuuaugggcaucucuuucuuuagguuagagaaguuuucuauaauuuuguugaagauauuuacuggcucuuuaaguuugaauuuuuacucucuucuauaccuauuauccuuagauuugaucuucucagugugucaugcacuuucuggauguuuuugguuaggagcuuuuugcaauuugcauuuucuuuaacuguuguauuauuguuuccuaugguaucuucugcaccucuucugcacaagagauucucucuucaaucucuuguuuucuguuggugaugcuugaaucuauuacuccugaucauuuuccuaggcuucuuucuccaggguuugucucccuuugugauuucuuuauuguuucuauuucuauuuuuauaccuuagaugguuuuguucaauuucuuuaccuguuugguuguguuuuccuguaauucuuuaagggauuuuuguguuucuucuuuaagggcuucuaccuguuuaccuguguucuccuguacuuuuuaagggauuuauuuauguucuucuuaauguccucuaucaucaucaugagaugagauuuuaaaucagagucuugcuuuucugguguguugggguaaccaauguguuggcugaacuggguucuaaugaugccaaguagccuugguuucuguucguuauguucuugccauuaccucuugccaucuggcuaccugugguguuagcugaucuugcugucucugacuguggauugucccuccuguacgccuguaugucagcauucuugggagaucagcucucucuggguggaauuuggguauggagagcuguggcacagggucagcuccagggcacauacagaaaccagaaggauccuauaucucaggcuguucuuugguuucuguguccugauggcucugggcugguccuucuugggccaggaauuugagcagaagugguggucucaccugugcucucaggugugucagcacuccugggaaaccaacucucuucaugugggauuuggguauggagagcuguggcacagggucagcuccaggugcagauggaaacuggaagguuccucugauccacaucuugaggcuggaagacacaaauuucuggccuggaucuuaacauggagaucuugaggcauaguggcuaugaaacacuuucaaaucaaauggugucucuuucucccucucuuaguuucuuuucuuuagcauuuuaguaguaguggucauuuuauaaugagaugcuuuugugcuucucuauuauuugcuauuguauacuuaaacauuagguucaagguuauuaauuguuuguaaacaaaguguaccuuuuuguauuuugcuaauuuaaauagaaaugagacucauugaagguauuggccauucucuuaacaaaaggauacaauagacaauugauguuccggccauacagcuacaggaaguacuuagcuggugcacaguaacugaguauccugcuuuugaagguuacuguuuuuuauuacauuaauuagcucuuaugcucucuagugauaaacuuagagguuaggaaacuuacuacuuaugggaauuccugcucuggagguguugauacccaagauuuguacauuuuggaauuuaaaauugagacuauauaggaagagaucauauaaauuuucaggagauuaaagcauaucuuuguucuugaauaucccuuugugaggagaguuagaagacagccuuagaucaaugaauuccuuaauguguucauauuaaaucacgauucagaucccuugauuaaaauucuccauuagguucucaucuuauauacaagaaaaaaaauucaaacugaucuugauaaucauuaugguucagacuuaccuggucagagguagaaauucuaugaaacuaauaaggcuuuuugugggaaaggacuguuugcaagaugaaaagaauugguuaacucuaguuucacacacccuuuucucugucaucauuuccuccaucauuucaguuuguauuugaauggacauggggaauuuuguaauucuaaggaaagagugaauaaagaaauuuuguuuuauagucacucuuguuuacuguaauuuuugcuaguugguacuguauaagacuacuuucaggagcugcuuccaguuguccacucagcuggaacugucaaaugaggguacaggcucagagcacacauauagguauggacuuaggguggucacccaacaaauaaagaguuggguaauggaggagaaacaugcaguccuucuguacagagagaugggagauggaagcucucucugggaggcaguuuuuguuguuucuuuguuuugugauaguacugacuagaccacugugauuguuacuuugauuuuuuuucuugacccuugaaaaucucuacuauagaauggucacuauuauuaaaugcaaaagacaggauuggagagaugccucagcaguuaagaguacuggccacucuucuagaugaccuagguucuauuccaacuaccuccauaguggcucucaguuauuuguaacucaaguucaaggugauacaggguccucuuuuggcauuugugggucccagcauauacacgguacacaaacauacaggcaggcaaaccagccauauacaauaaaaaaacaugauagaaaacauuuuuuauacagucaguacuuugcaguuuagguaauuguuuugugugugcucuacaugcuucaauguaauaucugcuguuccaaguagaaaacuuuuaggagauuggaugugaucauuuuucacuuuuacuggguuuugaacauugcuuucuaaagugauuccuguuaguuuacuuucauaggcaguuauggaaauuaccaguuuuauuuucaugcauuuaccauuguauucuucaaccucuagcuguuuaauguguaaauuagcauuucucuaguuaauggugggauuucuuaauucuuuuuccuauuuauuaccacauaguuauucuuguaacugcccuuuugucauuuauacuccauucucacauguuguuauuacugaauaauuuguuguuuuaaaacuuauuuauuggaauccugguguucuagauauuaaccauuauauuacuugaaugguaaauaucuuucaguuugugguuuuucuuucauuguuacauauuuauuuucauaaugccaaauuuuuuacuuuaguauugacauuuuuaccugucuuaugguuuugauuauguuaucccuauuaugauaacuuauguugaauuuauaauuuauuauuuauugcuguguagcagauuauuaucaaaaucuauuuuaugaacagaaaaacaucauuuuuuuuucucuuucuuucuuucuuugagcaagaguauggaagcaacaaggcuggggaucccucuucagagccuggucucccuuagguugaaguuaaguugucaggcagguuaccuggaaaaguauuacuggaggauuugccuguaaagguaguucauuccucugcaagagcagugugucucuucacugccgaauuauuucaccaucucucuugcuaccauuuuuaucuaggugugguugauuaagucacuggcuguuaauucauaaucccuccuccccaaaggaugaggaugaggagggguugaaaguaacaaccuuuuuuggcagcaagucugcauuauggagcugucuagguagggaccccagccacugauaaccugauuaacauacaaaagucuuuucacuuggggaauuucagggauccuagagacuuuuguguuaguaauggggacuaauacaaauauaagaaaagguucuccuguucccaagggauuuacaaggguuuucugcuaggaacuuaugaacuagggaugaagauuauauauguauuuaguauuuaauaagaggcuucgagcaagagugugaagaucacuggaggccaccuacuagacccuaguaacuagagauuccuguuuuuuuuauaaucagucuguaguucuuucauauuuaggucuucuuuacuccaccuggauuggaguguauguguuugaugcuaaggugggaguccugucauacucuccuuucaaugguauaaauguuuauugaaaaucugcuaccauuguuuguuuaugcauggauauguuucagagguuucuauuuauguacuucucugcuaugaucuaaauauuugugcuauccuccaguuuguauguugaagccauguaauccugaugugacauaggacuuuauguucaauuuauuauagcuguccugacagacucacuucuuuagcucauuuucuuugcuccuuuuuguauauauaaauuauguauuuguuuguuuaguuagagacaaggucucuggaacucaauauguggaccaggcuggccuugaacucacagagauuggcuugccucugccucucaagugcugggaucaaaggugugugccaccacauaugccaguucuuaguagcaagcugugaucugaucuuccuuuuucauauuugacuugcugcucuuaucgcuaaaagucauccaaagaggaauaguuaaauacuaaauacaucuaucaauuuuuucugcauuuuaguuuucuagguccugugaaaaauacuguugcaaucuugcuuuuaaaagaauauggaucuugguccgggacccgccgaacuuaggaaauuagucugaacaggugagagggugcgccagagaaccugacagcuucuggaacagacagaagcacagaggcgcugaggcagcacccugugugggccggggacagccggccaccuuccggaccggaggacaggugcccacccagcuggggaggcggccuaagccacagcagcagcagucgccaucuugguccgggacccgccgaacuuaggaaauuagucugaacaggugagagggugcgccagagaaccugacagccucuggaacaggcagaagcacagaggggcugaggcagcacccugugugggccggggacagccggccaccuuccggaccggaggacaggugcccacccggcuggggaggcggccuaagccacagcagcagcggucgccaucuuggucccgggacuccaaggaacuuaggaauuuagucugcuuaggugagagucuguaccaccugggaacugccaaagcaacacacugucugagaaagguccuguuuugggccuucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccaaauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuacacucacuaaagggcacagggacaaaauccuaauuaacaaaaucagaaaugaaaagggagacauaacaacagauccugaagaaauccaaaacacaaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauucuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucauaauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggacggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauggcauuggaaauguaaaugagcuaaauaccuaauaaaaaaaaaugaaaaaaaaaaaaaagaauauguaaauaucucccuuucacuaagaaaguaaugggugaagauuugugaaauacaguuauauuuuaaagccaucugcauugccaucacccaaaugucacuguuguaagcaucugcaauucuuaaagauuuggaacuauaggaauaauuuuuuuguauguaaauaaggauagauaaauuauauaauuguauuuauauugcuguuaaaugcugggaaaaaaaccucaagaaaccaauacuuaaccuuaggaaaagaagcagguugugaacugagcaguuauuacacagggcucugaugcugaugguacuuuuuauuguagacaguuuuaauauuugaguugugacaaauggacauaugaccuguuuaaucauuuuaugauuuaagccauguuuuggcaccacacaaauuuagacuuuaaauuuuuaacuacuggccuacagcggaauaucucuaacauaguauacaaaaucauuacuuuucuuuauaggaucaucauuucccagacaagcuucauaauuuauauuuuagaaaguuguuguguaguucuucugcauacaacacuauuacauaguuuuauuucauguguaucuucuucauauuuaucucagagaaucaguuugugacuucucaaggaagcuaucuuaagauuuugcaagauuaaguuagguuuuugacuaucuuguguaguuuucuaucaucacucuuaccauacuguauucaaugauuuauuucuuuauugucauugcacauagccaccaaaaaaugccuuagucuaguguuuuggaaaauauuuuuuacauauagaagaggugucauauuauaaauagccuacaguguuuaauagagauagacaugcaggaaaacaguauaauaaaugaggugauauauaauaggcaaggguucuaaguuucaaaggaagucuuugauaugaguaguggugauggacuuggagccuaucuugauggaagcauuuuaacaggucuugcuuaaagcagcaaauacuguaagauguagagaauuuaugacuugugaacaugagagaaaaggaggaacagagacagauugugucaggucuacgugggaaaguuaaauauuaccgucuagggugaguuaggcuuucaaaugcuuuugaacaaagauucaauaugaucagcucagugcaaaaugauaacuuuuaugcuuugcguaguguuuauugggaaagagggagauaagagaugagggaccuguuaagauauuuuguaucaauaccuuauuaucuaaaauacucauuuugucuaggcauguuggcacaggcagaugggucucuguguguuugaggccaugcuggucuauauugugaauuccaggacagcuguguagguauguagagaaacccugucuuaaaaauaaacaaaaagauauuuugugcugaaaaguacaguguuaagguaucaaauauagaucagccagccauauuuuaaacauguuugucuauauauuucacuuagauuagauuuuguuguuacucuguuaauagaauuuuuaaucuuuugauaagguaauauauauauuaguggaauuauugacuaguucauuccaaguguaaaugacuaugucuuguucuagcugcauuggguuucuuuauuuuauaacuuuguucauacuuuccuaguuauacacccuugucuuuaacuugacaguugcuuccaccuggaaaucauugcuuuauacuguuugaucccucacauaauacuuacuauguuaucauugaucauuuucucuucucucucucucucucucucucucucucucucccuuucuucuuuccuuccuuuuguccuuccuuucuuucucucugucucuguccccccucucucugucucucucccucucccuuucccuucccuuuucccucucccucucccuccccccccucucauuuuaggccucaaggaacugauuguuuaucaguccugcuguuugucuauacuauaugauuaaauaaauuucauuggggcagauauuuaauuucuuauguguagcgaagcugguaauaucuuugaggcacugaguccuguaagagacaauaguggggcagcauggcaugaaagcuucauuuaaacucugguuuuugguuuuaguuucuuuaagcuauauuuuuaucuuuuauaaauugugaaaucucucaguauuuuuauguuuagauugucauaacaaaguauagacuagguguauaacagaagcuauuucucacaguucuggaagcugaaugcuugugaucgagauaccagcaggguagaguuugggggagaccauaguuccuugcuuuguuuucacacacugacaaaaacagaagagcacauuugguuguguuuaaucuuucacaggcccuacuucuaucacauggaccuuauucucaugaauaagguccucucccaaagacuuuccaaauauaucacacugaggauaaggacuucaauauauaaacuuugggacagacacauucauuguacaacacugucuuacguuaccuuuauaguaauuuauggaaaggauuccacacugugucucaaacagaaaaaguaauucaaucaguuuguuuuaauuauuucuccuuggcauaaauuuugcuucugugauacuggaagaaaaaaaaucuuuugauagugagucuguguagcauuaguuaagaaggggaauauuggaagaagagcaagguugcagauguggucuugagagguuuucuucauguaucaguugacuuacagauauguaucauguagauacaugucuacaaauauuguaaauuuauuuuaauggacuuagaacaguucuacauuagauauauuuagauuuuuuaaacuagcgcauaugaucuguuccuacuucuagucuuugcaucuauacuuucuguucucuaaguuagucaaaggcugauuuuauuagccucucuggaacugugaagaaucucuauucuuucauauuuggcaauaauugucuucacauuuacuuuauagagucuucuuugguggaaccuacaggcggagaggaagcacaggauucauaagauggcgggcgggugagugauugagaaauugggguagaacuugguagugguucuuuuuuauaauaguaggaguaaaacauuuggacauuaaaauugucugagugaaaacuaaaagaacaguagaugguauuaaggcuuuuaaaugcacguuuacauggaaaaccuaguuugcuacguaugcuaugauuuucuugcauuucguagugauuuagcauagagccaauaguuuggagcaucagugagcaaauacuauuuaccaaaguagauguucuguuggugaugguggucaaagauauaucauuuuauugggguuugggcuuuucuguuucaauaaaaauuuaguucuguagcaaaaauucaguucuuuuaagcaaauaaguuucuagaaccagaauucaagcuagacuaaaagaaaauacuaaagucuuuaauuuauaugaacauaaaauaaucaugauauuucauuuagaaggaaagugaucaacuuuucuauguuauacaauauauaaguugaaaagggauuuuggacaguaauccaaccuuagagcaauaauauaaacaaaggggaaaagacaguccuggaaggagagcccgcccaugggcuagagugacagcucuagcaggccagcugugguggauagucuaguaggccugcuuguucacauaacuugaaacacucccgguuuacucaugaguuucugcuuuguuuuuuguuuuuguuuuacuucacagggugguucuuuuguaaaauggagcugauuguaauacugaaaaagaaaauguuucuagccauuuuuccaaacuaaaccuugcuccuuuuuuuucuccucuuuuucuguuuuguuauaaacauaaacauccucccuuuuuuucuguuuuguuauaaacauaauagagcccuaguaacuuuguaaaggugaguaagcacacuagaacaugaaauuauuuuacauuuaauuggaguucuugaaaugcaaacaauuugcacacguaaaaucuaaacacugacuucucuugguuacuggguacauuauuuuagagaaguuuuuugaguauaacccuugacgcaaaccuauugccauguaggaaagaaauuaacauugcuauaguccucuuaaacauauuagugacuguaucucuaaaacuuuuuauucagagucagcuugugaguuucagcaucuuuuuaaauuuuuauuuuauuuuuuuacuuguucacuuuacauccuacucacugccuucccuccuggucauccccucccauaauccucccaucuucucuccucuucuucucagagcugguuagccaccccccuugcccuaguaucccucuaccuggcacuucaaguuucuuggaagcuaggcacuuccucucccacugaggccagacaaggccgcccagcuagaagaacauaucucacuugcagguaacagcuuuuaggauagccccuguucuaguuguuugagacccacauaaagaccaagccacacaccugcuacauauggucagggaggucuaugucuagcccguguauguucuuugguuggugcuucagacucugagagcuccagggguccagcuuaguugacucuuguuggucuuccuguggaguuccuauucccuuuggguccuacaauucuuccuccuauuuuuuuuucauuagaguccccaagcuccacccacuguuuggcuguggguguuugagcagcugcugggugguggagcggcucaaaagacagccaugguccugucugcaagcaguaucauuaauagugucagggauuggugcuugccaaugggaugggucucaaguugggccaguuauugguuggccauucccucaguaucugcuccauccccugggccuacauuucuuguagacaggauaaauuuuggguugcugcuugcuucuucccuccccuccccuccccucuccuccccuuuccccuccccuccccucucuuccccuccccuccccuccccucccccucccuccccucccccccuucccuccccuccccucuccucuccuuuuguucuuuugugcuuuuguucuucuuagaaggagaacaaaauacucacaggaacaaauauggagauaaaauguagagcagagacugaaggaaaggcuauccagaaaggacugaaggagcugaaggaagaauaauauuaucaaccaaccagaccccucagagcucccagggacuaagccaucaacaaaggaguacacauggcuccagcugcauauguagcaaaggauggccuuguccagcaucaauggaaggagagguccuugguccugugagggcuuucuagaugccccaguauaggagaauccagggcugggauguggguuugggugguuggguggaagaacaccuucauagaagcagggagagggaagaugggauagggggauuccaggagagggaaccaggaaagaggauaacauuugaaauguaaauaaaggaaauauacaauaaaaagcaaaaaauaagaaaagaaaauguuggugccuauauucauuuagaaaacuuaguaauuuucuuuucuuuuuuuuuuuuuuuuuguuccauccuucucugguuuggauaucuuuauaauacuuguuuuuagacugaguuugguaccauucuuccacuucuuguuuuauggaauagucugaagaagacuugggguuaguucuuuuaaagaucuugcagaauugacaauccaucuaguacugucuuucuuuuguggaagauguuauucaucuaguugcucauuauagauagaucugcuuucaaguuucugguuuaauuuuuguaaguuguguauauguagaaauuucuccauuuuuuucuuuuagauuuuccuguuuuggagauaggauuuugaacuauuuccuaaagaaccuuaagauuuaauuucaucuuguaauaugccuauuuucaccauuaguuuuauuaauuuaguuuuauuuguuucuuuuucauuguuuugguuagaggcuuguggaucucaaauguuuuaguaaguuauauuuugauuuuauucuggggauuucuaaauauuuucuuccuaacuuuaaaaaaugauuuauugauauaucagaauuauauuauucaaucuccauaucuuuguauacuuucuguaguuucuuucugauuucuaguuuuauuccauugugaucugauaugacccaggaaauauucugauuugcuuuauauuuguuuaaguuuguuucguccccuuaagauaauggucuguucuaguaaaggucauugggcuucugaaaaaaaauauauacuguaauuggauggaauauucuauagaugucaguuaagaccauuugaucuauaguauaguugaucucucaaguugcuuuguuaauuuguuuuguacaggugaacuaucuauugauuauaauuaaaauuaccugucauuacuguuucugaacuugucugucauguuaguuuugucuaguaguguuuguuuuaugcaguaggguguaccaaugacuguuguauacauacuugcaaucaguuuauuauuucuguauuaauguguaaugaccuuuauuuucuuauuuuuuccuuauuuuaaaaauguuguauccaugugcacauguaugcauggguacaugccuguggagaguagaggagagcgggcucuucuuccauggaucugccugauucccuuggugcagcaucucccacuagcucacagaguuuggcuagacugguaacuaguaagauccaguuucuccucacagcccacucuuccuccccagcacugacguuccagguuacguggaugcuagagaucucaacuuaggacaguugugcucauacaggaaucacuuuuagccacugagccaucucucuagccucuucuuuauuucuuuugacuaauuuugagauaacuuuugccagguaugaggauagucacccaugcuugucagcguccauuugcuugauauagugggauuuaguuuucuaccuucacucuugguauuucuuugccaauaaaguaugauuauuguaaacaauaaauagaaauaguuuuaagauacucuauuauuuuuaauuaauugauuauuauauuuuuuguguguuugugcaugcacacacaggugucuugcucaugcauguaugugcuaccacauaccagugggagacagggaaugggauuugggaguuuauuuucuccuuguacuguaugagccuugaauaucaaacucagaucaucaggcuaagugccaggaaccuuugccaccugaaccauuuugcuggccuggauuuuguuuuaauccagugaguuaauccagaaauaggcagcauuuauagguuauuguugagauguuugucaguucccucaauuuuuuuuugcgcucuucuuuuguucuauucuuucuccucuggucauauaagaaguuuucugguucagggaguugggcauuauucauuccuagugcucauuuacuauuccauuucuuucauuauuucauuuuuauucguuccuugcaucucuuuuggggaagggcugccuucucuauguauuggauucuuguauguguugucugagcuccuggcuuaguagcuuggaauugcuuuacuuuaagccuuuccucagaugaucuuuauuucaauuuuaaaggagaauuuugcuagauacaguaguucuggucaacaguuuacuuucaagacuugaaauaaaaaaguuauuuuuugauggcuuuuaggauauuugcugaaaaauugauguuauucugaugaguuugccuucauaagugaguucucauuuucgcaucgcuuuucauauuauaucuuugcuucaauauucuuagcauuguggagagguuuuuuagccgcagucucuuaagaguuaauaaaugcuucuugugcuuggaugcuauuucuuuuccuagacuuggugaacucucuauuacaaucucacugaagaguuuuuuaaagauagcuuuaguucuuauuuugauucuuuuugcaguuccauagauucuuagguaaaguucgcucugucagacaucugcuguauuucauugucuuuggauuggcuuauauugaaggccugugacuuuuucuuuuuaggacucaucuugccuugcuuuuucauguucccagugaugcugaguuggaauuuucacaucuguuggauggcuaucuucaguuuauuuugagaauauucuuauugaguaggcuucucuuaguggcucaguuccuuguaccacucacacacagaugagaaaacaauuuguaagagccucaucaucaaaucaaaacacauacagaaauauauauggagucaguugauuacagagggaaaacaacagaacuaaaguaagguauguuguugaugauuaauuuuuuuuuaaaggacagagguagggaaaaagaagaaggaagaucacacagaagggaaaaagaaaugagaaggaucuuagauaguuggugaaaaaggaggguugucuaaaacccccuaacugcccaauaaaguaaaccaaaccaaggaguguuaacaaggucagcauuccuguacucauucuaggaacuucucuuucagggugccaggagcugcugcuagccuugccucccuagagaaccugggcucuacagagauuguccccuucugcaggucccuauuacacucuggguggcuaauccuuaaaacagacugauguuauaccaguuugcagucccaccaacaauggaggaguguuucucuuuuuccacauccucaccauugucacccguguuuuugaacuuagcuguucugacuggugugagguggaauuucaggguuuugauuuucauuuuccugaugacuaaggauauguugaacauuucuuuaaaugccucucagccauucaagauuccucacuuguaggguugguaaagaucauuucccaaucgguugguugcgcuuuuguccuauuuacagggucucuugccucacagaagcuuuucaauuuugugagguccuuuuuuuuuuucuuccaguucugaccugucacagugaaggcauuguuacaccaccucucccagugggauuuaagccuugugcuaacuuugggccucucuuauggaaagagcuguuaggcucuucauuggauuaccucauauaagagguuugguuugacuucaaugcccuuucuguggaacuggggcucuguccuugggaaucuauuuuucuuucccucucccccaagccccaaucccucccuguauuccuguuuuacuuuguuucuccucccucccucuugcaaccugggcuggccuggaaauuugggcaaccuuccuucuccagccucucaagugcugaaguggaggccugagcuagcacacagccugccuuguccuuguguucauucuuucucauuguucuaucaccucucuugugaccuguacuucucuuuaucuagggagaggaugaaaaacucagaaaucaacggugguaauugcacaauuuugggaauguauuaaaaucaugaaugauuguauucuuuaaagaauguaaauugguucuuaaacagugauuuggaacuuaacucaaaacuacuuguaauagucuugugauagaacgaguucugugggaagacacagguuuacauucugcucuacaguuggguuugaaaggagauuucuugauauauauaauauuuaggcaaaaaacuguuaagaaugauuuggaguaacucaggugaauuaacugggacgaauacaauuauagguaccagcuaaaaugcagucagcucugacaggugcuuccuuuugucacuacauguaaagacuuugcuuagguaggccaguggguucucaaccuguggguugcggccccuuggggguguguuuaacagccuuuucacagggucaucuaagaccaugggaaaacagauauuugcauugugauucauaacaguagcaaaauuaaaguuaggaaguugcagugaaaaugauuuuaugguugaggucaucacaauacaggggacuuauuaaagggccacagcuuuaggaaaguugagaaccacugcuaaggacaauuaaaguaacacaauaacaguuauuauuaaaaaagccuaauuuuuguggggaaaagagauuuuuuuguauuucauaguuagauuauauauuuuuuuuauauuuuguauauaauauuuuauaauuuaaauauuucaugaaaccagaauuaaauucuauuacuuguuuacauagccuuuuuuuuuccugcuuauuuauuuuauaagucaguuuuucaacuuuucacuauguagagagucuuguguuuaauuccuuuuggcaaccugagguuaauaaccauagaacuuuguagauacuaucuguuguaucuguuuguuguuagguugaaaacccauuuacuaaaaaaacauucaaacaaauacuuuagaaaaagaggagaguagacccagagcccaugccgucacugccaguuuccuaacuaacauggguuaguuccuggccacucuuacuuuaucuucauagauucuuacuucuuuugccuauuuuccaucuaaucacugacacauauucauauggaaauuuuauuucucuucauaugacaaaaauuuuaaaaauaugcuacguugaucauucuuuaagcauuaaacuuuuaaaaugaaaauauuuuuuaaaagcuauagguaaaagugaaguuauuaaugaacuccuaauuuuuuacguauguauuucucuauauauuaaguaugcuuauagaauaaauuauguaacaucaauuauaauguaaacaaaaugcuagaagaaaauaguuuaugcauucuuuuucuuacuccaaauacucauuuuguaacuaauaauaauuuacuaggaccuuauaauuuuauguuuuuguuuacuuguucccuacugaaauauauaccuuacuugacuuccucauauuuuccauuccagaugcaucucuucauuggagugcuauuuuauugacuuucuuagcuacuauaagauaugaagagagcccuuucucacucaauucugagcugcuuuggcugucuguaaauucuuggcuuuucugcuguuugaauauacauuuugccuaugaaucagugaauuccaacuauuucuucaaguguaguguguuacuuuacaucacuguaacaaaauacaugaagcacuuacaaagagaaagaacuuaucauaaauccuauauaggaggaagguuguagugagacugaguuaaucacauucauuuucccaucugaucaggguguccuacaugaugaaaaaggcugcacaggaaacuguuuaccuggaaaaguagagaacaacgagaaugugacuagaauuccacagucuccugugagaacacauaccccauugaccuaaggacuugucauuaggcuccuagagcuugcuagcacuuaccaguagugccaccuggggacaagcccuguaaaacauggucuuuuguggcauucaguaaucaaacugcaguucccaauacagaaacuaacuucuuuaaguguucugguguaauauuuaaagcuuuuuuaugacugucucauggucauuauaaauuuacauccucaaaacagaaacugucuuuuuuugguuaauguauucuuuucugucuuuccugugauaagucgcuaggcuucuuuaggucacugugcuagaaaugcccagaucuucugauuucuaagcaugugguauucuuuugugcuguuaauuuuauaaaugugugugucuguuuguuuguuuguuuguuuuuaccaauucuaggaauuuuucucccaaggaaacuuacaaccucauguuggcuauauauuucucucucugauucuauaaacccauguauuuucugcagucaagacaagguaguuacuguuccuuucuuaaucuaaaccagauauucacuguaacacagcaggaucuuaauaaauacuuacuaaauuugaaugggcacuuguuuccuuccucaguugaaaacaguacacacacauacauacuauacagaucauuucugaacuguaaauuuugauucugcuauauugauagcuacuauacugauauuucugaaguuucacuuuugcuauugaaaauauaaucagauucuuuuuuuugccagacuugauagguucggggauuucaaagagaaauaaggcaucauuuucuaguuaaaagaauuguuuuauauuagguguauaaguguuucuugugggcaugcagugugcacaguggcuagguaagaacaucacaucuggaacgugggugguaggaacagagcucaggucuucuguaugugcucuuaacugcugagccuucuuucucucucauuuccccauuucuguauuuaaaagauggaauuaggaauuguaaagaagcagacaucuucuuuugcuuuuuggagaggccauuaaaaacuucauaaaggauaucugauauuucuaaaguucauuuuaaaauuuuaauuuggaaaaguuuauuuacugacuauaugugcauauguauauauauaugcauauuguagugugcaugugaagaccgucacaggacaacuaaugggaauagguucuuuccuucuaucauguggaucccugggggauggaccuuacgcugucaagcuuggcucagguguucuccacugagccaucuugcuaucccucuaagagucuucuccauuaaaaaauagugcauaucacuguacuuuuaccuggguagcugcacaaaggaagagaauuaucagcaaggaauuauugacaguuuaugaggcugucuuauucugauuaauuugaacauucacuuuagucagaauagugaaauuuaauuuuaauacuuuuuaaaguagaaauuauuuuuagauuauauauuacuuugcuaccugaaauaauugaaaggaacauucaguuauuuauuuauuuuuuuuuugugaggccuuacagaagauaaggcaaguuuuguagucuaugcccuucaauuuaaaggaaucaguggguguuagcaguuaacaguaaauauuuuauauaauuuaucauuuacuauaagagcaaagauuugugaaacacauucauugcucauauguacuuaauuacuagcaaacagugaaaauugauuagaaucccacagucuauaauacuuucagaaugaacucacaaggaacaauugauaggcuuaacaauguauuuuauauacauugauggaaaugaaagugacuuuacauguuugaugguagccuaacuuugguuuaggaucaaucaggauggaguguuuuuuuuuaguuugauggcuaauggguauauuaugaaaauacuuuuuucuuagacucuuaguucuuucuaucacugguaguuuauuauaaagucugucacauaccucauacauaguauaggguuuuucaaucuucauuuuaaaaucauugagaucauuauuacuguaagucaucuaaacugauauuacaggaauuuauuguuuuguuuaagagaacaugaacauuucugguuauuuucuucuuuacuacagcuguaaaaugaugguuuuuaaaccuuaguuuuacuuuguaaaaccaccaaauaaauaugugccaagaauagauauaaguguaaaugaauuuacauuauucaaaauucuagaauuagacaucugucuaaugaaugcuguucuaaauguugcuaaaugauuaauaguaauuaaaagguuaaauacaagcugaagaaagcuuugaauuuugaaauguuugcaacagcuagaaaucugacugaugcagacguuuuugucaaaguugaaaaaguuagagcuaauuaauuucuugggagacauaugaugaaauuguaggugugauagcauauuugaggaacauauggugguugggggcaccuuucuaaugacugagcagccaguuacauagagacuuugcucucucuuuucucucauuuccauucuuuguuuccauguguguuaaaacugcuuuuguuuuccagaggucaguuuucaggauuuaacaguuuguauuuaaaauguuuauuaugaacaucuauuccucuucuaaguggacauacauucuagcuacauuuuuaaaaaaauacauuuacuccaguguaugcauauauuuuaguuagugguuuuaaauaaaucaaaugaguggagacuuguacugaccaguucauccugaucacccuugagugagaacuaaaaaugguacccaagaaagacagcauagacauauugaucuuucuuaggcauuaacuuuuucccuuuaguguauaauaauuucauauguauguucuuuaagcauuacuaccuaagguucuugaauacuucuugauaaaccagauuuggggauugaaguuauuuugggcauuuguuuauugaaaugcuauucuauucuguuuauauuuuguagaauguauuuugaaacaagacuuaugcaauuaaagucuaccuaacagugacauauagcuuauauauauauauuuuuuauuuuuuaaagguuguauuuuuaccaaaauacuacauuuguaaaguggcauaugaauuuucuauuauucaaugaugccaaaaguaaaguaagaguuaagaguacaagaagucuauaggugcugcagagccagcuauuggaggauucuauucacuucucaauauuaugcugcuaagguugauaaaaugaaaaaggaagcaaagguuauaaacuucuaagucuucugaaaugaaucaaagcaaaaguagcauuuguauuuaaaauaaauaaaaaugaacagaaauaaaaauaaucuuaaacuuuaaaggaaagugauggguaaauucuauaauuaguacauauaaaacaauuucaguuuugcucaaaccuaauguuaaaauauuauuguauuuuaaaauauauuuaaaauauuugccuauaguuaugaaauucuagucaagucuagaagugcccccaauuggucuauuuuuuuguaccacauaauuguuuuuauuuaaauuuaauauccugucaagaauuuugauaugaacaucuauuguauucuauucuuauucuagauauguugcaagauauuccccugucaguugaugugcuuuuagccagugagguccuggugaaauaguguaaccuagcauggugugaacucaagucuguagauaaaugacauggcgaacuuucagauguaacuuucaguuacaguaaagcaucagcaguagucacuuagugauacaauuuguaaaguucagaucaucaauuaauaucugagaacucaguuuuaaauauagcagaauucucugauguaauagauuaucaguucaaaaauuaacuuuggagacuuauucuggagcugaagacuuuaaauaauuuuaaaaugauaagauugauaaugauaagaaucuucugagacaaaaaucuugaacaggcuuguuuauuuugcagaacuuaacaaguauuuaaauagagcaaaauagaacuauagagcuacaguagcuuucauuaucaagcuauaaguuggaucauuuuuuucccuuaaaguauggcauuuuuuccuuuugcauggcuaacagguggcauuaaaugaagaaugggagaugacuuuuauucauuaacauaguuuaauuuugaguuaguuuugaaauuuauaagucuugaaugaacuuaugccugaaaaauaaggauuugaaaaauaaaaaggguuugagaucaagugugcuugacugccuuacuaauagguggagaaguccauuuucuucccauggagcuuuauacauccugucacauagaaacaguuugucacauguguuuguagccaguuuuagacagaucauugauuauauaucauucaggcauaaaagauaauucugacauccuucuuuguuccuuaaauaccuugccucuauaaaauggcauauauauuagcuugaucagaucauuauaaacaagugccaaggaggcaauuaaaauuuaguaaacucacugucuaugauuucauuuuaauauuugugguugacaugaaaaguuuuaagaacagaugauccacagucuaguuugagaauaaaugauuauuuuucccucuaggaaugaaagauugauuugaauaaacauauuguagguuuauccauuucacaugauucaaaugcaugccagaauaucucaaaauucagauuuguuaugaagauacuaaauauucuuuagaaauauaggaguaaaauauaggagugacuaauugauuuuauucauuucuaguugccagguaaucugagauaaaauguuugauuuuauaaaaauuucuuaggguuguaauuuuuucuuuuucucuuccuucuuuugagagaggguguuacugugcagcccuggcugacuuggaacuugcuuuguagaccacauuggucuuguauucauagagauaaacaugucugccuccuaagcgcugacauuaaagacaugcaucaccacauccgucuguagaccuaguuucuuaaggaacaguuuugagauuuguauuaaagucaguaguugagucaacaagagagacuccaggauaaagaaauuaaaauucuccuaacuuuugcuuuaacaaaagaauacuuacuaguuucuuaaaaugcuuucauaauguauucuuuuaaggauuuuaauauuguuuuccaaaguagaugaaauaucuuuaagcuaacugauaccucuuccuagguagcauuuaguuuuuaauuguguaucaggcagagcuguaugcuuagcaugaaaaauuguauuuaagugguuacguugaaucagaguauuuuuccuuugguuguccuauauuuuauagguucauccaaaugugguguuuaugucagaaguucacuuuuagggcagaauggugguauguacauguacuguuuguuguuguuauucauucauucauucauucauucauucaugucuuagauuuacaugaaaaguuauuuauuuagcuugaauauuugaaguuucuuuuuucaaguagagaguucuaugacagucuuuacuuuguuaaucccacacaagcugucauuccuuuaccuuuguguuugcacugcaugacuaagaugcauguuagcguguccuguauuugggagauaauauccuauuccuuagcuucuuuaagauguucuuuguuuuuuuuuaaacuugaaguguguuuguguuucuuuuccuuuuuccucucuuucccuuuucauuucauuuagguuucguguuuguuagugauauuuauacaugucuuucauugauccaggaaauucuuugcuacuaacacuucugauguauucuuucugauauuguauaacgaggcaauuaaaaacuugggaaaaaaucuuuuguguauauacuuuacaauuuaugacuuaauguuguuguugaugauauuuuuaugcuucuuuaguuuuucucuuuuuucugguuguuugaugugguacuagaguucucugucaauucuuuacauguguuuuugaguucucaauuguuguugucuuucauauugcuuacuuauuugauuuguguguuuugggggacacaguuuacaugagcaauucagaggacaaauuuugguuaguaagaggaucuguucucuccugccaccuuguggguccuaaggaucagacucagguuuucagcccuguuccaaagugccuguaccugcugagcuguguugucagaccucauguuauuuacaguuuucucuuuuacugaugaaaacuccaaguuagaucuuuagcuucauuaacauaagauaagcacacucauguuuagcuuauacucugucugaugacugugacccucugaaaucuuugaaagugcacuguuuucaugguuuguuauuucuguuucucaucuugcuucugggguccuggcuccuaagguaccaguuuuaaaugcugcugauucuuguuacucauuuaucaguguuguaaaaacuccacaugcaugcugaagcauugcuucuagaaggaauuucaggggacagguuccuucagauuucuuuuuauguuuuugucaguugaucauauauaacauuacuaccuguuuguuuccuuuuaaagacuccuuauuuaguaaguauuauuuucaugacauugaauuuauagccaccaauacuuuaaagucaugacugaaugaagcuuuuuuuaaacauguauuuuauaacagcuuucuugcacagagaaacauuuuuauuacuuaaacuuguauuuguggggacucuuuuagacaauuaagucacugagagaaagcaaaacugugaagaguguggcacuaaccauacuucacaacagcauugguuauaguaaauaaaugaaagcaagccugagugauaccuuauccauccacaucugggaauacagggguuauuaugcuuucagaguauuugcuuuuuuacauguaaaagaugacucuuagaacagcuagaauguuacugaauuuuggauuauaaaacguuuuaauguguugaugacuuugcaaaugcagaauccuggaaagaagacuggcucugugugcuaggcaugguaauagaaaaccauauguagauuuauaugcuuugaguuagguuaccucccccuucucuccacacuuggaaagaagcuugauuuuauaucuuuauuauaacuugaaggcauuaaaauucuggaaacagaagcugaggggguuggguagauugggcaggcaugaggacuugaguucuauucucaaaacucacauaaaaugcugugugugaugguguucccuugcaauccaaaugcuggguuagcacacaugggaauaucucuggaucuugcuuuauuuaugagcuucaggccaacgagagucccuuucucucauuguguagguggauaguguuccuuagaaugauuuucagggguguucucuaacccucauaucacauuugcacauugacacagaaacacacacaaacacacacacacacacacacacacacacacacacacaauccuagaaguacuaaaauccaagcucaaggguugaugucuuugcuaacuuaaaugaugugaaauuuaugcuacaaaaucuuguuuauuuuuuguuuauuuuuagcgccaauaaaauacauuuguaauacuugugugggaguugguuugucagaaucaucuuaccuagcauuuuaaguugcucuuaguggacugugccucugaacagccuacugaaauacucuauaaaacuuguuauuuugauauauucuuuagacuuacacuaagauaugaccuuuugacucuguuacuaauaggagaaauaaauuugcugauuuuuaaaagaaacuuauucauccucauagagaccaugguacucuucccccucccccaucccaggucucuggcagauauccuagagauugccccucacuguuuuccauucuuucccuugcacuccauacaucaaacuucccucacagccuacuccccuccucagccccuuuccuacccagucccuuuauccacuucugauaucuauuucauaaauauauaaguguaaauaaacuuguguuuuuuuuaaguacaaaaaucguacuuaaaaaagcagacaucggacguguuucugcccucccuuuuuuucugacucuuugagccuuucuaccuguuucccucauucccuuucucccagccauaaccaccaugucacuuuggaaaaguaugaugcaauauaugcuugcuuuuuaaaauacaauuauuuagaagaauuauuuuauauauacaugaguacacaugaguaagggccugcagaagcuauagacuuugaaucuaccacagcuguaguggugagcuuccugauguagguauugggaacugaacuuagauccucugcaaaagcagaaugacucuuaaugcuuauaucaucaaaguugugagaaguaauaaugcaucuugaguuuugguuuauccacugucauauauagcaagcuauucugggaauauugugaauuaaaacagucaguauccuugcccuccggagggaguuccucaucuuccucccccuuuuaaugguuuauuuuauuuuauguguauugaguguuuugccugcauguaugucugucuguguauagugccauauguguacagagcccagaagagggcauccggucuccuuaaacuagagugagcaggugauuaugaacugccauguguuuccugggagcuaagcuccaguccccuguaagagcagcaaguguucuuaaccacugaaccauguauccagccccaugaaauaauuucuuaaucuuagcacuugaacagaauaaggaggcuguuuuguagacuuugauauaucucuguuuccuccuucguccagcugcagaaacaaaaauacauggaaauacugcuagcuguccauugagugugaaaagcaaaaucaucacucuuggccauguauugcucuugacaguacaaugaaaucagauacauaaauucaacaacuaauguaauucuuacuaauuauaauaauuaaaaauuugauaaaacuuaaaccaaaugaauuuggaauucaaauagauaaauuuuuuauugaauauacuuuaaauauuugauguuagaagaaauggaagaaauuauucccuuuaaggucaugcaagugauaauacacuauacagguuagcaccuucuuuauaguguaagacuucagcuuuaauaaauaccauuggacaauagucagaaauaaggcaauucuuacaaaaggaccuacauagucuauuucuauaauuccacugaaguggaagggucaagaacaacauauaaguacagagacaauaaaucaagacaaauuguaaauuaacuguuaugcuuuugacauaagaagacucauuguuacacugacauugauaaccccguggcaucuucaucuuaguuuuagagggucucuguagugccucagcauuccuguugugauagcacagucagcugccuaagccucuggcuguugaagagcuggagcuuguggaguggacagcagagucagugggguucuugagaagucggacugcauggcgaagcauucauacgcucuacaaggaaccauucacuucuguucaaucuuguuaacguaacaagauugguuuacaaaagaacaacaaucaaacacacaacguuaaauggcaugucucccucagaucuuuccccucagagcucaaggaacuccauagaaaguguuagagccagaggggauggaggaccccaggggaacacuucccucuuuugagagucaguacauccaggaaaagggaaggaaagaaauugcacagaagugaaaaguuacugcuuuugggucugcuucuguagaguuccuuccaguucaguguuuuacuuuguauucuugacuuucauuucaauaaaucuucuugaauuuauucaaguuaagcaagauauuuuauuuuuuaucuuuucacccauuccuuuaaagcaguuugcauucuuguugucugcugagaucagggaguaguaaguuuucacauguaugugcauuugggcaaauuaaggcugaccaaaguagcaugauaaaguggaagaaauaggaggaacuugaaacuggcauaaauaaaacauaauuuuaaagaggagauauauugaaggaucuguuggggaacaaggaagaaugccaaaggucccaccuugguuaguuaguaccuccuugauuguuaggccuagauauagagguaaguuagccaaccaugguuagaaauguuaaccgaguuuagugaaaguuugugacacugucuucaaauuucacaacaauuuagugcauaaugcuguggaacaaagcuuucagauuacccaggagcuaucagggaacuaaagaaacaugaacuaauuaaugugguucugacauuuaaaagguuacuguuuuauugagaaguuaaaaagcugaaaaugcugaaccugacuuguguugagguaauauuuagaaaauguggcaagugauuaauccuuaagaaauaauuguuuaggaauuaauuuaacagaucuaucacuuuaugaaauuuagauaaggaauguggguaguguaaaauuucuguaacauuuauaguaucgaucacaagaaagucuuacuuagugucaucaaauaaaaagacuguucauuucagugucaaagcuguuuagaaagcacaguucaugguuaccaaaguugaauuguuguuucagaaccuuuaaaaugucugugucauaacacuuuaccucucauugcauaaaugcucaauuuuagauguauucaguuauuuauguuuuuauauuuuccagaucuguuaauaaugugucaaccagugauuauugguauuguaccuaagguaaaagauaucuucagucauguuaaaucuuuuaaaaaacauccaaaaaguuuuuuuuuucagaccuauacacaguaccaagucaucucaacugugauaggcuaagcagacaccugucuucacuggaguuagugaaggguugguugggugaauuguagauugacuaaucaaagucaguuuauuacguaauacuagagcugaaguuucuggggccacauaaccucuggagauuccauaaaacagcuuuguuacugcuugagcuguuuccuuguccuugucucuacucuauagagaguaguguguucaaagucaggauuuucaaggaauagcaagauuuggaaaauaaggacaguaggcuugcucugcuucugaaauacuaugcguguauaggagaguuuggggaagguaauaagaggacuaagaaguuugcagacuauaaauuugggcuaaauggauagggaaauuaagugucacgcgcuaaaugagcuacuuucuuuaaaaaaggcaucaccuguaguuuacuaaaguauguauggauacuauauuugauucaggcuauguaaggagaaggcagaggagucuuuuuuuguuucuuguuuuuuuuuuguuuuucgagacaggguuucucuguauagcccuggcuguccuggaacucacuuuguagaccaggcuggccucgaacucagagauccacuugccucugccuccugagugcugggauuaaaggcgugcgccaccacgccuggcuaaggcagaggagucuuaaaggagcuagaaagaacaggaacaauuacugugcacuuucaaagccaagagagaaagaaaacaucucaauuugagaagaguguaaagagaacacuaaugauaaguuuauugguaacuucuaaccaaucauugucaauuaaauuguagugauaaaaagaaaauugucagugauucaagaaagaaggaguauuaaagaaaugguaaaagcauagauucaucuuugcacugauuuugguaagaggaaagaaaguagauugcaguaguucagagagauuuuuugagguggaaacauguugaacauguucauagauuauggagcaggcauccagauacagagggaaauuuugaauauucaagaaaaaaagauacaaguaaauuuagagaaagaaaaaaaaaaaaacuggauaccugaaagggcgcuagcucuugaaauggccuuugaucuaggcaaagauguauucugaauaggcuuucaaacagugagcugagaccuugaaccuugacguuaccuacauuuauuuauaaacauugcccuuguuuccuaauaguuaaggaggaugaaguaugggggagaagauaauaauuguauugugucaacuagaaaugauaaacaauuuaccagaguugcaugaauuacaguagacucauuuggcuuagguuucaugacuuaauagaguuaccuucagaagaaauauacagaaaauaguuuaugaaauagggcagagaaugauaaaauguguacagugaaagaaaagguaaauuauaaaauauggguugauccuagauucuguacagaacuagauaaauggaaaaaaacauaaagcuugaaaaaauaaagagaaaacagaauacuagagguguugagaaaaugaagcagaaguuuagaauucaugaagaaauaggaaugcuuaaaauaucaaaguagaauacauaaugaacaacauugcucuaucugcaaguaauguacuaccaguugccaauuuaccacuagaugucacucugacucauaugguuaagugcagccuggacuuaagaggcaggguguugaaaaucagacaaguacagugugcgcagauaccccugguggccuguaaggacuguucuacucaguuucucaugcgggcguuuuagucaaacagcugcuuuggagaggauagugucuuuauaacaaagcaaaccauuaaaucuggauauuuuguaugauuaaaugcugucuuuauguugauuuuuuuuuuguuuuacuguguuaaucacauuaauuuuuuugaccuguguacuuuaaaaaguuuaaaauuaugcaugaaaaucuauaaagauauuuucucucaauauuuaauuauuuguuugcuaaauuuuuuaugguuuuacauggaguaauagcuguuuauugguacuaacaaaaguguuuauuuguaaguggucaugauuaagcauguugacacuaagccugcaaauguaaaacuugaauucucucaauuuucuaguagaacaaacacuaauaaaacuaaaggagugauguuuagaaaguaugucagauuugucaccuacccacaacuuuuuucagcugcuucuuucaaagucucgaacuauuuggaaagcuuugcaauaugauuauuuucaaauauaaaaauacacaaaagcaaguauuaauauaucuccagaauaacaguauucagguacacuauguagauuauaaaauacauuuauguuguucuuuucugcuuauuaauauuuucccuuugauagagaguaguuauaaaauuauuuuacacuacuagaauugcugaauugcagaguauaugguagaaaauaaacugucacagguuuuugccugugauuuaccuaaugauauauuucauuguuuccuuacaguccucuuuuuauugguaagauaucacaguuacguaagaaauugugaucuguuacuauauuaaauaauuuuuagguguguuagcaaaacaacauuccuuguuguaaguaaggcaucuuauacuaucucucuuaaguuuuaguagguuuaguuuaucaggaaagcccuuugcacaaguacagacucuguggcagagauugguaagacacaaggaaagaaaaacauaccuucuuuagaguaacugagcugaaaauagacugaagauaccuuugauauucaacauaaaauugcuuauuauacucgcugauuaggaacuuaauuguaaauuguguguuaggacaaaauucuagguacuaguuuaguauugugcucuauggagauauccuccuuuaagcucuucauuuucucuggguugguggagaugauuuugccuuugggacugacugugagcuugcugcacugguugagcuaugagaguguaaugguaaagcaacaggacaaaagccaguugaacuuucccaccagcgcucugaauucugcuucuguaaaauuguguugaagcagucauuaugaaaucuaugauucugauuuuaaaagagcauuuucuauaucaauacucaguauugguaaauaagaugugaaagugcuuuuuaaauuaacucuugaaauuauucuaauaucuuuuuagccuuaaauucaucuugccauguaacuuucaaaaugacguuuuuguuauuguuuuuuuuuuuaacaaggaaaaaguauucguuuuauuucuuuagaauuuuacaguuaaacuauuauaucuuccuuuuuacaguauuuguccuuguugugccaggagcagugaguuagauaguacuagcugucuauguccucugucucucaucucuaagggcuuucaccuuuauuaggaacaaaucuagauuucuuuuuguuguuuguuuguuuguuugcuugcuugcuugcuugcuugcuugaaauggcuuccugggaauguaaaaaccccuuugacauuauuauuuagggccuccuauccucccagugcacuuauagucuuaacacaaaaacuuugcagcuggugaacucccgaagccccuuuugaugauuguuguuuaacucagcauggcagcuugcuauaguuccuguccuauacuggcucacuucaccucauguucagacuccucaugacaaagaagucuccagagguaaaacacagggcgagauuucagaugcugcuuugucacuguucucuggcucauuuucacuuuaacauuaagcauauucacaaaguuuacugacacagucaagggaaagagcacccucuccacuguucugauaaacuucucauauuuuuacaaaaccaaaucaaacuguugacaguccaaaaaaaaaaaaucaaauaugcagaaaugguaugguaccucaucuucauggagaguaugcuaguaguuuacuauaaacccaagccagagguucaacccacacuucugccucugaccuacuacuucaaauuuuggaauuuuucgucucuuauacuucguucucuaugaauaaaagugagaauaugucuaauacagauaauagaaauuauugaccuaguaacuuaacaaacugguugacaaguuuucuuugaauuuauuuauuuuaacuuuaguucuuuuuaaaaaucaaauauagguuugcuuuagucuuacuuacaugaaaacuauuucucaagauaaacauguuuauugaaaucuaaauauggaauccauuuucauuuaucagcuaaguaggauaugauauaauuggugcugcaugcuugcuuaauauaauagcuacaucuugauuuaauugaauuuaaaauuaaaaacacaauauaguacauuuuuuguaugguaaaacuugcauuuuuagagccaaagguuaaacggacagaagacucucuaaaaaagaauaauucucauucuagaguuuugagguacuaauauuccccauuaccagcuaguuuugugacccuggaagaauacuuaucuguuguuugcuuucuaaaaugagaaggucacuaaaaucucuuuaaguuuugguaagcaguauuguguuuaaauuaauauuuuaagggucauauuuuauuuucuguuuucucauuggaaauuuuuuuucacacaauacauucugauuaugguuccccuucuccugacucuucccagauccuccucacaguccucccaaaucucuaucaccucaaaggccagagagagaaaaagaauaagauaaaguuagaacaaacuucauaagauaaaacaaaugaacagaaaaacaaaggccaauaaaaagugcaagauacauacauacauaguuaguuacauagguacauacauagauacauaguuguagagauacauuuauuggcaugcauaaaaauccccuaaacacaaaacuggaaaccauaauaugaaagcaaaagacuuuuagggaaagaaaaaaaauauccaaaucauuauaugaccaaaaaccuucccaaaaagccauugaauucuuuuuguguuggccaucuacugcuuaagaauggugaggccagccuggucuacaaagugaguuccaggacagccaggacuucacagagaaacccugucuugaaaaacaaaaaacaacaacaacaaaaagaaugguguuuauucccaguaagauuccauuagagaaaaccaaauuuuucauuuguaagcaguuagggaacuuguguccacuuccacucugggagcugggaucacaucagguccagacgugucaggucuugagcacguugucacaguuucuuugaguuacguguguugauccuguuuagaaggcuuuguuucuuugguguucuccauucccguugguucuuacaauuuuucugucucuuuuucagcagaguucccugagggaaggguuuugauagagagauccuauuuaggaccaaguuucccaagguaucuugcucucugcacccugugcaauuaucucuugauuuauucccauuuacugcaggaggaagcucuugcagugcaagacauugaucucuaaguauagaagaauaucagaaguuauuuugucgcuguguucuuuuaagaacaguaguguuugguuuucuccuagguucucgaccuaucuacucucagguuuagccacccaaacaguguccaguauggauucuaucuuagggaguaggccuuagaucaaaucagauauugguugguuacuccuauaguuuugaaucauuauugcacaguaucuugcaugcaggacaccauuguaacucaaaggauuuguaacuggguugauguuuacaguuuuucccuuuuguugcagaauacguuccaguuccaugaacacuacuagucaguaaggaugacggcuguguguguaggaaucagcuuuacuucuccauguucauugaguuuuuaccucuucuucaauaguaggguuuuacuaucaguuuguagauagcaaccaauagucuugucaguagccuggguuguuuaggguuucccaugggaccauuuugacaacaccuugauuagauguaaccuauuacuggguuugguagcuucauuuguugauaguagaugcccuguuagggcucugucucccccauuauuugauuggcgaguccauucagauaacauuuguauauguauauauuuuaggaagcuucuaauauauuagguugccauacacucacucucucaaaugguucuuaguuuuagcuguuccuuccuauauucccuccuuuuuacccugacuuaccuuccacuucaguuugaugcucucacuccagucccagugucuuccaucuacaacuauccuauuuuccuuccuagggugaucuuguucuaccccaaauccuuuaaccuauaccuaacaaccuagcugcuuaucaaagauagaacagcuuguauccauauauaagcaaauauaugucauauuuguuuuucauaauuuauuuucuuaggaacugaugugcuucacacuuuucagaacuaaauaacuguugacaaauaacacaaguauuaagagucaaguuguagacgguugguacacugcuuccuaagcauacauaaggcccuccauuccauccuaugugcuaucaucuccuuguaggauaggggugggaggcaugaaauuuaaaacuuccugcuauaugcaaaagaacauccuuuugaggaauuuuuuaaaaaauuuauuaaauauuuucuucauuuacauuucaaaugcuaucccaaaaguuuccuauacccucucccugcccugcuccccuacccacucacucccacuucuuggcccuggcauuccccuguacuggggcguguaaaguuugcaagaccaagggaccucucuucccaaugauggccaacuaggccaucuucugcuacauaugcagcuagagacacgagcucuggggguacugguuaguucauauuguuguuccaccuauaggguugcagaccccuucagcuccuuggguacuuucucuagcuccuccauugggggcccuauguuccauccaauagaugacugugagcauccacuucuguauuugccaggcacuggcauagccucacaagagacagcuauaucaggguccuuucagcaaaaucuugcugauauaugcaauagugucugcauuuggcugauuaugggauggaccccuggguggggcagucucuggaugguccauccuuucguccuuugaggaauuuauaaaggcacacuuugugcugggcauugguggcauacagcuuuaaucccaggacuugggaggcagaggcagguggauuucugaguucgagggcagccugcucuacagagugaguuccaggacagccagggcgacacagagaaacccuguccugaaaaaccaaaaauaaaauaaaauaaaauaaaauaaaauaaaauaaaauaaaggcacacuuuuguuuaagcaaggguagugaguaccuuauuauaaaugauguauuuugaauuuuuuuguuuuaaggugguguaguucaggauugccuagaucccaauauuauccugccuuagcauuuuaggagcuggaauugcaggugcaugguucauugauacugucuuuuuaaaccuacauucaccuuaugacuaauaaaauugagcauguuuucauucauuuaguacuuccuugguguguugacaauuguaugacaauugaaauaaacaugaacaaucuugggcuggguguguagcacugugauaguauguuacacacacacacacacacacacacacacacacacacacacacuuacacacacacacacacacacacacacacacacauucacgcaugcguggacacacauacucacaccuuucucaugaucagaaagaagauuuuaaauaaaggcccauuggacuugcaaaauaugccccaguacaggggaacgccagggccaaaaagggggaguggguggguagagaaguggggggguggguaugggggacuuuugggauagcauugggaaauguaaaugaggaaaauaccuaauaaaaauaaagauauuaucuaaaccauuugacauaucuucuagagcuauauuugaugaauucugaaauauuuuuuauacuuuuuauuuuuaauuuuuguauuuuauuuauuuauuuacauuccagauuuuaacccccccccccuccaguccacccuccaaguguuccaccaucucauaucuccuccccaaugccuugucuccucgaggaugcccucacccaaccagaucucuaaacucccuggggccuccagucuuuugagaguuaggugcuucuucucugauugaacccagacucugcaguccucugcuggauauguguugggugaccucauaucaucuggugaauacugccuguuuugugguccaguaucugagagaucucagggguccagguuaauugagacugcugguccuccuacaggguccccuccuccucagcuucuuacagccauaggggucuguagcuucuguccauuggucugcugcaaauaucagacucagcuguuuguuggguucuuuggagggcagucgugauaggucucucuuugugaacgcuucauagccucaguaauagugucaggccuuggaccuccccuugagcuggaucccacuuugggccugucucuggaccuucuuuuccucaggcuccucugcauuuccaucccugcaguucuuucagacaggaacaauuaugggucagaguuuugacugugggauagcaacccccucccucacuugauguacugucuuccugcuggagguggacucuauaaguucccucucccuacuguuugacauuucaucuaaggucccucccuuugaguccugagagucucucaucucccaggucucuugcauucuggaggguccucccaaccuccuaccuccugaaguugccuguuuccauucuuucugcuggcccucagggcuucaguccuuuucucucccucccuccuccuugugauuguuuucuucccccucccauuugggacugagguguccugacuugggcccuucagcuauuugaccuuugugaguucuguggacuauauauuagguguucuguacuucuuuuuucucucuucuuucuuucuuucuuucuuucuuucuuucuuucuuucuuucuuucuuccuuuuuuucuaauaucuacuuauuagugaguacauaugaugcguguccuuuugggucugaguuaccucagucaggaugauauuuucuaguuccaucuauuagccugcaaagcucaggauguucacguucuucauagcugaguacuauuccgcuguguaaaugaaccaccuuuucuguauccauucuucugucaugggacaucuggguuguuuccagcuucuggcuaucacaaacaaggucgcugugaacauaguggaacaugugcccauguggcauggugggacaucuguuggguauauuccuaagagugguauagcuggaucuucagguagaucuauuuccauuuuucgaggaacuuccagauugauuuccagagugguugugcaaguuugcaaucucaccagcaauggaggagaauuccucuuuuuuccacauccucaccaacauguguugucaccugaggguuuaaucuuagccauucugaaugcagcuauucuuuauauuucaaacaguauuaaugucaaugaccuuaugugcuacuaagauuagguauucauaugugauuugaagaaaagcuaacaauguauuuuaaacaaaugacaacucuuuuccuacuagaaaaaaauagacauuguagaucauguuuuaaaagaugaugugccuaacuaauuuauugguucuggucaauuucaaacguaugucuuaacaguuucagauuuccuugggcagcauuguugaccuauguuucugguguaaaagcucacauucccauuugcucuuaucuuuucuagcuucuuauguaauggagcaugaaugguagcacuagcuucugaucaagggcugugugaauacacauaucguguggcacuuggcagcauuuaaagcugguguaccuucucccugacaucuugcacagugaacuuguuaguauuccagcagucaugacuaagugaccuacuauaguuucauuucuuuaaaggaucuaugauauauuuuugaaaggauacccuagagcccuuaaaauuauguugugcccaugauuucuugugauuagaguccuuaagggguaggguuugaagaauauccuuaggaggaggaguagaucugugaaaauaagaaaaaggucagcaguuugauugcuauauuagcuaaagagaaauauccaauauguaucugauuauuaaagauuauauuuagucuuuaugaaaucucauaguuuucauaacuaauguaguuuuaacugugaauuugccuuuuaauuauucuugguuuagaagauuaucaguuucagugaggcaugugacguagacuucagaggauuauuaaguaacaauaauuuaccaaauuguguugguaaauauuuuuugaacauugagaccgagaguucagcccaauugacaugaaagauacuuaagaaagggaaguuccuuuuauuuuacaauuucucuuuuuaguacuuuuucuaaaauauuaguguuuaaaaauuuaauuuguguuuuuucuugucuuaauuuuguucuagaaagaaaugacagaaccuaaaauaaacugaguuaguaauaaaguaagaaguagcuuauguugcaucauagcugcuacuucccuuauacuaaggcauuuaaccaacuguaguagaaaacauugaaaugugagauuguuagcauuuaaaacggugacugaauagggcaaaauugguuaagaaguugaaauaaacaugaauauaugaugaguacgggggauacuggcugugggugauuugcaaagccccaaaaauuauugaugaaaguaauaugcagcaccuucauuuucugucuauuguacgaauugguugguuggguuauuaacuucccugucauuauuaacaagugguuauuuacuuguaaguuuuucuuguuguugguuuuuugcuuguuuguuucuguuuugaguuaagggcugacuaggcagcccaggcuggccugaaacucaagaucuuguuuccucauaaugcucaguacagguaugugccaccaugcccaguuugagucuuauuuuuagggaaaaauaauugaaguauaugucauagaauuaucacuauuuaaaaaaaucagagaauuuuaauguaagaaaaaagaauguauuuuaguaaauauuaaauucaugcuuguguaaaugguugauccgguacauuugcauaauauugguucauuuguuuugagggaaagauacagaaacauaaaagaaacaaauauugguuucaaagacuaacaacacuucuacaaguaugcaaguuuauguuauacaguagaccaacaugaaauacuaagucucugaagaacuaagcuggaguuuaucgugcucguucucuuuaggacuauuagaaacauguaguuagauaugugauaaaguuaacauuauugauagaaauuucucugaugaagagauaagauuugcuuuaagaacacauuuuuagagcuggaacaggcauuugacugagacgguuucucuugaauuuuguaucuuagaacuuaacauuaaacaugcacagagggcauucauagaaguauugggguucccgaaagauugcuggccuucuaaaagacuauuaaguacaauaugaagaguaaagauggagcucagaaggcauuugcccucucuuugcucugcaugccugaaaaagcauauagucuagaacccuauaugguuuauauuugcuuccauacuuaccuaccaucaaguuuaacuaugaaauuuagaauaguaaaagaguagugacgguaacgaaaacuagaccauuucuaauaauguacagugguauguaaacauggugucuuucccauaaaauacccacuuaaagugucuaucaauguuccugugauaaugggaugcgucugaugagauaaauuuaaaguaaaaugacuauuagagaaauuacaagcauuaggcuauugaaggauuacuugaauacagguacucugauaccacagcaauguaacuaccaacugagacagcuaccaaguaucugaugggucuauagugugaauacaauggggaaagaaaaggacgguucauauccuggguuucugaagcagaugguggaagauuucaucaugcuaaucagaacagaacaaaauuuaucaacucuuuauuucuuuuugauaugccagacuguuacugaccaugggccacugaaacugcauggaacgugaaaccauguguaagggcaucagcuguacuucaauaacaguuaaauuggagguuuuagugugagagccaagucaccuguugaauugcagaauuaggcagucucuccagcacauuucaggcuauucgagcaggguaauagaauagaguacaaagauugguaauuaccuuugcaaauaauaugguuuuuaaaugaaauugcagcuacucgucucucugacugcugugcaagaaaauagccauggacaguaugcagaguaaaggugugucuguguuccaguaagacuuuaccuagaaagaaguuuccagguucuagcaguuuacugugcccuucauacuggaggaauggcaauuuuuuuccuacaauucauuccuuucaaaaggaagaaaagacuuucauaucaagauauuuuuuuccaaauuuauuccccagaauuagaaugaguaaaggcauaggaaucuggaaugaaacgacucuucuuauguagaguagggagagagcuuuccuuaguaguuacugaggaaguuucucugaucaucaucaagagcacggauuaugcucuuccuguggccuguaggaguaggagcauaaugcuauuuuuguacugaacauuucaacuuugaguuucaaugcugugguaauuuggcaguuucccuuguguguaguuuauuuuuaguuaagugauaguaaaacauauagugaacuuuuaggaagaaauuacaagaaggaaaaauugaaccuccaaacucuaaagcagaguuaaagcauaguaaacaaauccauagaaguugaauugacauugggcaugucaacaagagacagauuaauucucagugacaaugcuucucuuccugguacuuguggucacauguucagcacacuaaaagaagcugagaucauuuguaagauugauucaguuaugaguaccuagagaaugcuuuuccccacucucauaaaagcauggaugugguacugagcaagaauaacauaguuccugaccuuccaaagagauaacuaguauguuaucuaucuaagagagugguuucuaaacuaagagcuaaagaaugagcuggcucuggccuguugauagagacagguaagaggagaguuauguggaaccgacaguaaaaaagggcaggguggacagagcucaucaugacccagcucuggaagaaacauuguauaaagaggaaaugugcagcuauugaagcuggaaaaggaagauuuccuaugcuaggagaucuuaaguguuugaauuuugccaggagauuaauggaaaguagugaaaaaucuuuuaaguuguaagguaauguaaguaauguuuacuuguaaguauguugagacugguuuggaagaggaguauuaaagagccauauuguccagcaagggaguuaugagcuaaccaguguggcuaagaaauaauuuuagauuuuauuuuaaaauuuucuaauuuaaaaauuggaacaaguuaaaaauauauuuccauuugaauaguuuuugaguagguugacauguuucaucggaugcuggaaauuuucuaucugagguaggcugugcuguaaguguaaaaggcacaauagauuuugaguucauugugugaaaaaaguaaaauauuuuucugugagugcuuguugaagucauauuuuguauauauuugauuaaacaugacucaauuuaaucucaucugacaccuuuugcuagcucaaauaucucuggcuuuuagaagcuuugaaauuauguuuaucuuugacaguauauauugguagccagcagucaucuuagaagcuuucccaagaggccaguaagguagcauuauguuccaugcaggggcuguggcagcuggguaaggaagauuucuaagagaaccaucaaggaacuaaaauugauaagaugugacauuuaaguaagagaauuacugcucaauuggugguauggaagaaaacagcagccucaguucucuaaaauaugaggaaaugaauaguaacugaauagaaaauucaaauguguaagcaaaaguuauaaacaucacauuucauugacaauuugugcucagaaguucaauaauuauacaacuggacuuuauuuugaguuuuguucacaauugcuauguggaaguacuuucuauuacuugguucuuuaguuauguaauuuuccauuuuuuuagauuguaggugaucagcagauuuacaauuuaaugguuuauugucuguuucuuugucacuauuuauucaccuccuuuaaguaaauaguaggguuggaggucuuuaauaauaugggaucuauaucuaccuauauuuuuauuugagauuaaacuuauuucuguuuaaaagagaggguacucuguuuuuauaugauuuauuagauccuuauuuaaaguugaaucucugagguaucugaugcugguugaauguuuaguacuuuguguugucaaccuaagaaaugagaugcuucacucucugcaauuucuagucuuuuaagcuuauaaaaguagucaagacaguuuguugacccccaaggagaccuuuuagucuuuggcuuguuagacaacaaggccuguacucuucauuggcauucagaucacaggcagccauugggcucaguucacagccaagcacagcuuugggauuuagacaaagccacccuggcaaaggaacccaguugucaggguagcuggcuggauuguaaggacuguugcauaauggagagaccaaguagaacuauuaggaugcaaaugugaaaaaaaugguggugcuaaccugcaaaaacaaacauuucuuuuuuuuggugaagaguauucauuguugcuuucuucuguuuaacuucucugggccuuagauguaguuggaguguauuaguuuaucuuaaucucuguccauaaugcuaaucuacauuuagaaucaacagcuaauuugugugaagagaccaaaggacuucacuguuuguguucuuuucauaauauacaaauauguccugggccaguuuuauauguuguuuauucuagguugggaaaagaaaucaauccuuuuugcuguugauauuguuauauuuauaacaaguuauuuguaucauuuccaccuuguaauuucugaugguggccucuuaguugucuuauacauaguguagcaucaugauagauguuaggaauaaugcuauuaaauucuuaguacaguaagacaauuuuauuuuaauacuauuugaaggaaauaugcccuuucucacuucucaguuuuguuccuuucuguauugauugccagcuuugcuuuccuuuuuuuuccucccuaccucuuuaucuucaggaaaauauaaugcuaucugugcuuugguaaaugcuguguuagaaaauugggaaugugaaaaaugggaaagguguuuuuuaaagccagagucagagaacagcaguaguggccaugcuuuauugaauaguuguguguuacuuuguaaauuuucucauuugacuccuaagcacugccuuaugagguauagaucgagcccccauuuuacaaaugaguauacugagucaaagagaagcaaaaugguuuguucaagcuuacaguuuuguuuacaagaaaaccaagaaaaacuuugaggaucuuggaauguuaaucugauugaaaggaaauagucuuggagaaaugugaaugagagcaggaccaaaggacaggacagcacaaagggaaucccacaccugccugaaagacuggggaggccacugcuguguguucagauaguuuccauaugcuguucaguuguucauaaguucauugacuuggcucaucuaaagggucuuggagguugauuuaaaaguagaugaauuuuuaguauuugauaccucuuugguuucagguggucagaucuuugacguucuuuuagaaguuacacuucuauuucuuugucuuagcuuuuaugcuuuucaaggcuucuaccuuauuaaaaguugucuuguauuacuguuuuuucuuuuuuuuaaguugaaauugugguuauuuuuauuauauguacaguuucugagucacuggaacauuuuuaucccuccaauuaucuccuuuauaccuauuuuucauaucccuuccacagcgucggccccagagagccucuuaugucuuacucuuaugucuguaguuuucgauccucugaaaguuccauacucacauaaccacacccacugugugaucuuauacacugcacacuugcaggaaucgcuuuuuuucuucuucugagugauaggccauauuacugguauaccacuuacuguuuuuucuauccuuguucugcuuagcugucaaaacaccuuugaccaaaaaaugcuaucacuguugguuuuccagaaagucaaauacuagcugcuauuugaagcuuuuuguuuuguuugguuuuucuuugacaugaguuuauugaaagcugauucaggugauaugaaagaaaaauggggaggagcuugaguuuguguguguggggucaaaacaugauagaaagaaaagagggauaaauaaugcugaagauauuugaaaaagccacagugaaucauaugauuuuauguuuaucaagaauuacauauaauauauguguuuauuuaugcauauaguuuaaaugaaguuauaauacauggaugaugauaucacacccaagggucauagguuaucuaacaaacucaggaccaggaaugggaaaucuccuuucgaguuguuggucagaggaguccaagagccacugugagcaauauaggcuguugcuguuacccaugauugcuucccaaaaauuggaggugcuuuccuauuacugaagacaacauacacuuuguacacaggacucagaggaauuaagcuggggaucuuaccuuaaggugcuaugcaagcuaccaaggauggaaagcaaucacuaccuaguugugguacccuugaaucacaaaagugaccccgcauggcaagauaucccuaaagguacaauaaugacacucauaucuuggugguaacuugugguaauuaaugggauucaaggccagcucaacagaaggaaaucaugguacuggaaauuuagacaacuauucaugccuagugagauuauagauuucauaggagaaccuacuugggagaaaagguggaaagagcgcaagagccagaggaccaggaaaucugcugugagacuguuucuugaauaaacaacaaggacacuguacccaugaggccucaagaacauagcugccuaaaccagaccugaauaaggacaccauuaacagaaaugcuaacauggaagagagcacucucauggacuccuccccagaugaggagcuacaggcauuagcuacagacuguucagagaaggaaaauaaguuuucuuuauggaugagccucccaauuacuuaucuaauaccaaguggucagcccuggaauaauauaauuagguacacacaagugacacuaaauggacucagcaaguuuuguguguguguauguauguauguauguguauguguguguacaauauggagcaauaagggucauuaggaguuagaggaaagggaagugacaaagauguaauuauauuuuaauuuaaaaauugcaaauauauaaaaaguuugauauuuaaaaauguuuuuaagugauugaauaacaugaucuuuuuuuaaaagaacuugcuaaguucuuuuuuuggguaaauaauaauauaggguuuugguuuacuuaugaucuuuguuguauaugccuucagucacuuauguauucaugaauauuuuuguugauaaaauacucucaagugcuggcuagguacagaugauacaguggcacacagagcugacaaaguccuggucuuagggucuugacaguaugucugucacuggauuggauucaugaguuucaauucugcuguauuuuacagauauuuauacuuuuuagguuguauauuaaugcauuagaaaaucuuugugguagaauuuauguuuguggucauauagaaaauucauuuggguacuuauauuuguuuguuaugguuagcuguuauacuuaaguguucuaaaauaaaccuuuauuucauucagcaguaugcuuucugcccuauccaugcuauguaauuauagugauaguuacugacaugccaugccuuuuaauugcuauaucuuguuucguuugauaaccaguaccucauuuacucaauacuauagaacuuaaacauauuuuuccuucaauucagucaacuacaauaauuucugucucuuccaaggcuauauaaaaccaauucuagaaaagcuuuaucuuuugacucaucaaugcaugguuuaaaaucaaaggucccaguuuuuccuucgguaauuuugauuugacuguuugcagaagguucuuguugaauuagaguugaguuggcuguuuucuuuugucauaccauaagauguaagucccaaccuggucauuuuacuuggaguguguggcuuggcauagcacaguagugaacagguaaaagcaaacaaaaguguaggaaagcagcuaauuauaguaauugcagcugguuucagaguacuccuaacaguuugugcaugcugcuugcuugaaagcaucaaaugggugcuaguugugaaauagaacaccuguuuguuguugagcauguguuuaugcagaugauuguuguugucaaagcaccuugauguagaguaguccuguuuacauuuacauucuccccaaaggauuaacaguguucucucaauaaauuugcagucuauucuccucucaaaggcugcuguuuggaggguggugugaaagaggcaacaagugcuugcuaaucacuugaauauacauaauuagcuacagucuggugcacuggagucuuuguaggacuccauaacaauauugauuggcaaaugcacagaacaauagcuguggcaucauauaguuguugagaguagugauugucuucuuauugguauuuauucuuuaauucauuugaacuuacauuuauuucauuauaagccccuuuuaugcuuuuuaaugaaccagcgugagauaucuagcaacucuguaaagucaccguuaauaauaauguuucauauuuauuuacuagggucugagauuguuauucaaaaacauauuugacauauuugguaauuccaaauaucgagagcuaucaaacuuguuggauaauucaacuuaauuccuagugaaaacuugcuuccuuucucacucugaccacacccauccauucaggcagcugucuugcucccauuaaaguuucaggcugaugguuccuaacuuacuugacuuucuacaaguuuaagugugguuuucuguuuucugaaaaacacccugauugcacugucagaccucagaaauucugaaauggcaguguuaguagagaggacaguuucuauacauagaaaaaaagccuguuuccuuuagcuuccaguauugcugacuaguuugccugagaauucugcaugaggcuggccacauucuuguuuauaaaacccaggugcagugugguauuuaucagaaugugacauuuaucagaaugugacauuugagauucuauaggacacaugaggggacaaauaaauggacaugacaugggguauaguuugugacugccaaguucaauaacauuguauucucucucuuuuuuuuuugaaaacugacucauauuuaaaugacgacugcuuuuuaucacaacuuuucuuuuccuuuuuauuuguuauuuauuuauuuuuauucuuuacucuuuuuuuuuuuuuuucaguucagacuuuauuccccuccagguccacacuccaacuguuccacauaccauaccuccccccaccuccaagaggauguccucacccccaccagaccuccccacuuccuggggccccaagucucuugaggguuaggugcaucuucucugacugaguccagaccaggcaguccucugcuguauauguguugggggcuucauaucagcugauguaugcuucaugguugguggcuuagugucugagagaucacagggguacagguuaguugagacugcuagucuuccuaugggcucgcccuccuccucagcuucuuucaacuuuuuccuaauucaaccauggaggacggagggcugucaccaguuucuguccauugguugguuguaaauaucugcaucugacguuuucagcugcuuguugggccuuauuuuuaugcauuagaggagaaaucuacacagaccaccaaaacgacagucuguucagagcuugcauagggcagguaucaggaaacagcuuucccuauauuugaguuucagaaguccacagaugagaaagcuugacuguguggcaagggaauaccucauauguacucugugauuggaggcugugggcauggggcaggagaaauccuuaacuuucucucugaugaguucugaguugaaagcaugagcaagaucuaggaaagcuggcaguuuugcuuaggccuccaucaguuuaaacccuuugcucucuagugcuuguacuuugacugguucccagcugguugaguuuaaagggaugagugccugaaacaagcacuagcugcuugcuaggacauaggacaggugcacucuugugcuuucauuuuggcuugcaguggguaguuuuuaauguucugaagacuuaaauauaaaaauguaugcuaucaaaagaaauaauaccaagauguuuuuauuucucagacaaaucuguaaugcucucauucucacugagaaaacugaaaauaucuaugaagaaaauuauguuuuacauucaggauaagucauuaaugauuuuauuucuccaacuuuaguguguguauauaguuuugcauuuuugaaaucaaauauuuuguacugagaaccgaagucugguuuaaggucuaucauuacuuugugugugcauguguguguacauuuauauuugcuugaagaucauguugcaguucaggagucaaagaauuuuauaaacucuugauaauguucaggaaauguuugauggauguuuccagaaguuucuacaaugaacagucaaaucauuugcugggguuauauguucugaaacaguaaaguuguauugauauauacaguaaguuguucagggauuuaauaguuucagucuaccguguucaaacugugauuucccuuaaacuguugauauuauagaaugauauaucaccauguuaagauggaauuucacaacuuuuauuaaagaaauugaguugaguuccaugaccuagauuaacuuuguggcuaacaaauccguauuggaauuuuuaaaauuucguuugugugucuaugguuguuggaguagggauguauucacaugccuauauacaugaagugauggagccagaaaaggauguuggguauuuauuaauuuagucauacuccuuugagacagggucucucacugaaccuagaguguauguaguggccagaaaacuaguagucacucuaucuccagacuugggguuauaggcaaauauggucaggccccccuuuuauuaacauaggugaguggcauccaaacucagggccuccugcuuguguaacuuuuuucuccaccacucuagccccaucgcauucauucucuccuuacaccagaugcggauagauuuugaguuugauauuuauacauuucuuaggauauauuuuuuuaauuuucuaaaaauaccaugaaauacaaggguagcaguucuuuuuuuuuuuguggaugaaaaagaaguugagagcuucauaaguucugaauauuucuacacuguucuuugaagaauagaguuuucaaauuuaaucuuuugauguauguuauaaauaaaucacgaauacuuauacuaauaaaccuaauguuacaaucuugccuugauuugauauugguagaauguguugaagaauguuaaauguuuggguaaagcagauucuuuuuaaauucuguuucuaugucuaaugcauauuuaucccuauuuucauaaggauuucccagcggauuuccuaccuuuaagagcugggugaaauaucauuauauaaaagagcaugguuuuggccgggugaugguggcacacaccuuuaaucccagcacaugggaggcagaggcaggcggauuucugaguucgaggccagccuggucuacagagugaguuccaggacagucagagcuauacagagaaacccugucucgaaaaaauaaaaaaacaaaaaagaaaagaaaugaaacgaaaaagaaaagaaagagcugagugaauaacaagggaggacuaauaagacuuuuuagaccuugcccccuaguuuuuuuucuucucauuuauuuugguaacucuuuggcuauaggauuguuaggcuuggguugagaaagagaauauugguugauaagacuggaaaaccacaguauguuucuuaauaaauugaagcucauuauuuugagaaauuauacuuguaaauuauaaaaauugaacuuagauagaacuaaguaaccauauugaauaaaugacauauuuuuagguugcuauauguuuuuuuuaaacuucuuuuucuuuuuaaaguuuuauuuauauuuauuuauuuauuauauguaaguacauuguagcugucuucagacacaccagaagagggcaucagaucucauuacgggugguugugagccaccaugugcuugcugagauuugaacuucagaccuucggaagagcagucgggugcucuuacccacugagccaucucaccagccccagguugcuauauguguugaguuuauauuuguaaaacauuucuagguuuaguacuuguuugaaaugauuuuaaaaauuauacacaguuuuuaaaaauuauuauauuuaacuuaauuaucaucuaauaugaacauaaucaguaccugccugauauugcucuguuuaaucacacauaaccaccuuucuuuuugcauugauccuaagacuuugaaaauuauauacuuacggguuuuuaguauuuguaaaauuauuuaaauaaaauaagccaaauuuuuagguaaacauauacuuaaaaauauuuaaauaagaaaagcuuuucauaauaaauagguacugccucuucacauucuuuaaaccaguuuugaaauauuucuuuuagcuguauuauauggucccuuuuauuaauauugcuaaaucauauaggucaguuacuuauuuauauuacuuuuaaaaaggggacuuuggaagaauuacauauauuugagcuucauauucagaaaugcacaaugcucuucaaaaggaaggcacagauacaugaucucuucacugucucauuuaguugucauggaauacccagcuucuuuggucaugucuucacucguaacccuuagaaauuccaugugcuguuaguaauguccuugcuguagggugucauucuucucucugaaguguagauaaaacuaacugagguucacugagcuguuaaucuaauaggcacaucaccuuuucucaaagaauggcauggcacuucuuuccccuaucccuucaaaaguagcacuaugcguccauggauuuaacugauagaguauucuuucccaucuucagaagguaguucacuaguuuugauuuguccccucaggaaaagaagaguucccuauggaacauuguuagcauuuuaucagaaguuuucuuagcacuccaguuuugcgacuuguguccaugacugccuuuccuguuauaaaaauaacuuagaguaguacuuguuucucaucccgcuccaagcaugaccagagcauaguugaaugaguuuuaucuugaacccucuagaauauuauuagcuaauauuuucagcucgggauaauggaaggugagcauaaguaaucuuagucauuuauauaaaaauuugucucaauuuauuauagaaaugaguaaugauguauuuuaguugagaggaauuuauuuauaauuguuaaaaauagaauaauuuuucauaaaauauagaaaaguauccauuucuauaucaagacugauaaccucugaaaauuaccauauugauuuucauuuuuuuuuuuuuuuuugcuugauuacugaucgguuuaaauaagaauuuucuaugcauuaggccuacaaaacuaagaaauacaaucagcaggacuuguaacuuuuuuguaaaguauaaagaaguaguaaucugcauauucaauaaaggguuagauuuauuguuguuugaauuuccuccccuuccucaauuuuuucuugaaauuucuugucguuuguauugccuuagguuuugcuucuucccaguccuacugagaugcugaguacaaaccaaaagccuugcauauauuaggcaaauacucuuccacugucuuacuugcuuuguuuaccguguguaaaucugugguggguaucagggcccaauuucccucuccugucugacugagcaguaucacaaugaugcagaaaaauguucuuacauacaauaauguuuagaauuacuuacauguuuuaaaacuguuuuggauacuuggaaaauaagggauuauuuuacucuuucuauaaguguugaugagucucuacuuuuaaguauagggaucaaauccuuaaguuaauagaauuucaagaugagauauuuaaugcaauauagugaaugaguaagaauuucuguagaaaauuuaaucuggauucuucgaucuggagauggggggggcacugacugccuucuauuaaaacauagaaaagauaggcuuaaaucgaccuacaaccccuccuuccuuucuuugucaagaugugacagccaucuaugaauacugaugaauucaagaaaacuccuaagcuagacauuaucuugacaguugguggacagaugcuccuuauuugagugugagacugagguauucaaaaagcacuucaaaacacuccuaugccagccaacauuauuuucccuauauuaggauuuuuaagcuacuguguaauaguaauuauugauaaagcaccuaguuauagcuggauaaauuauuuagggcauuuuuuuguguguaugucuuuuuuuuuauuacaaauuuucuuuauuuacauuucaaaugucauuuccuucccuaguuuccccucugaaaaacccugucccuuccccccaaccccuugcucaccaacccacccagucccacuuccugaaccuucacaggaccaagggccucuccucccauugaugagagacuaggccauccucugcuacauaugcagcuggagcuaugaguccuaccauguguuuucuuugauuggugguuuagucccagggagcucuggggguacugguuaguucauauuauuguuccuccuauggggcugcaaaccccuucagccccuuggauacuuucucuaguuccaucauugggggcacugugcucuguccaauggauggcuaugagccuccacuucuguauuugucaggcacuggcagagccucucaggagacagcuguaucaggcuacugucagcagucucuuguuggcauccacaguauugucuggguuuggugguuguauaugagaugaauacccagguggggcagucucuggauggucauuccuucagucucugcuccacacuuugucucuguaacuccuuccauggguauuuuguucccccuucuaagaaggaccgacuuauccacacuuuagucuuccuuuuucuugaguuucauguguuuugcaaauuguaucuuggguauucugagcuucugggcugucuuagucaggguuucuauuccugcacaaacaucaugaccaagaaacaaguuggggaggaaagggauuauucaagcuugcauugccauacugcuauucaacaccaaggaagucaggacuggaacucaagcaggucagaaagcaggagcugaugcagaggccauggagggauguucuuuacugacuugcuuccccuggcuuucucagccugcuuucuuacagaaccaagacuaccagcccagggauggucccacccacaaggggccauucccccuugaucacuaauugagaaaaugccuuacagcuggaucucguggaggcauuuccucaagggaggcuccuuucucugugauaacuccagcuugugucaaguugacacaaaaccagccaguacaugggcuaauauccacuuaucagugagugcauaucauguguguucuuuugugauugggaugcucacucaagaugauauccuccagaucuauccauuugucuaagaauuucauaaauucauuguuuuuaauagcuguguaguacuccauuguguaaauauaccacguuuucuguauccauuccucuguugagggacaucuggguucuuuccagcuucuggcuauuauaaauaagauugcucugaacuuaguggagcauguguccuuauuacauguuggagcaucuucuggguauaugcccaggaauaaugguauugcuggauccuccaguaguacuauauccaauuuucugaggaacugccaaacugauuuucagaguggcuguaccagcuugcaaucccaucagcaauggaggaguguuccucuuucuccacacccuugccagcauuugcugucacuugaguuuuugaucuuagccauucugacugguuguuuugauuugcauuucucugaucacuaaggacuuuaacauuucuuuagguguuucucagccauucaggauucuucuguugggaauucuuggcuuaguucuauaccccauuuuugauuggguuguuugguuauuuguugguuagcuucuugaguuguuuguguauauuggauauuagcccccuauuggauuuaugauugguaaagaucuuuucucaaucuuuugguugccuuuuugucuuauugacaguguccuuugccuuacagaagcuucacaauuuuaugaggucuuauuuguuaauucuugaucuuacaguacaagucauugguauucuguucaggauuuuuuccccuguguccauccauaucuuagaggcucuuccccacuuucuccucuauacauuucagugucucugguuuuauguggaguuccuugauccacuuagauccgagcuuuguacaaggagauaagaaugaaucaauucgaauuuuucuauaagcuagccaccaguugagccagcaccauuuguugaauaugcugguuccccuuuuagcuccuuugucaaagaucaagugaccauagguguguggguucauuucugggucuucaauucuauuccauugaucuaccugucugucacuguaccaguaccauguaguuuuuaucacaauugcucuguaguacagcuugaggucagggauggugauuccaccagagguucuuuuauccuugagaauaguuuuugcuauucuagguuuuuuguuauuccaaaugaaucugcaaauugcccuuucuaaaucugugaagaauugaguuggaauuuugauggggauugcauucaaucuguuuauugcuuucagcaagauagccauuuuuacuauaauuaauccugccaauccaugagcaugggagaucuuuccaccuucugagaucuucuucgauuucuuucuucagagacuggaccaacauguaguuaccuuugaaaaguuucuuuagaucuuaaaacuaagaaacuaauaguuuacuuuuuaagaaaauagagggaauauauaucuuaaauauuuuccaauacauacuuuaaaugaaaauaacaaauguugaauaaaaaguaguuuugauaauuuugaaaauaguuacccaaggcuugggauguaggucccaugguaguauacuuggccagcauguaagaaacccugggcucaauuccguguaccauauuagugauggcauacaacuaugaucccugcacuugggagguacaagaugcaggaagaucccaaguucaaggucaucuucagcuauauagcauauucaaggcuagguuguaguacaggaaacacuuauuucuuucuuuuccauaugagaggacaaugaaaacaguuguccaaauuuaaucuuuucuacuacuuaggauauuuccucuuuaacuuagguuauaaacaauuccuuuauuauugcucacaucuaauguaauaagauauuagagguggcuugccauauuugucugucuguauaucugucuuucuuuuuuucuuuuucauuuuucgagacaggguuucucuguguaguccugacuguccuggaacucacucugcagaccaggcuggccuugaauuuagaaauccaccuaccucugccucccaagugcuaggauuaaaggcgugcaccaccacugccuggcccauacuugucugucuuagucaaagguuuauugaaggaaaaaaaucuuuacauaauauuucuauauuuagaaagauaguuuucuagugagauugggaaggucuucuaggguuguccauuuuguaauaucucugugugugggggggugagugugggugcgcgcaugugcgcguaagcgcacauguucccacauuguuuuacugaagugguuuguuauuacuguuuguaguaugaagacuuucuuugccuuuauugcauuucuuuauaugcacauguugugucaugugucuacaaagggacaugucugccacauuguguauauggaggucagaggacagcuuguagcauuuaauucucuccuuccaccacgugguuucugggaaucaauuucaagcugagaggccuggugacaaguacucuucccuccugggccaugcuuggcuguagguucuagucuaggaacauugcaaguuccugaaacuauuuaacauuacagguuuugagaggauauuuucuguaaaccaaauuuugguaauuauguuguaacaugaauauagacagaaaaugugccaaaauauaauaaaguucuuaauguuaaacauuuggcucaugagaauaacauaagaccugaccuuuuaaacuaugaaaauuuaaugacuagaaaauuaaaauuauuaauuauaaaaauguguuuagaaauuaguuaaaauguuuaauguuuagcuucuuagugauuuuaaguugaaaauugaaauuuauagacugccaagguuaccuuugucuggaaucuuuuuuuaaucauucauucauucauuuauuuauuuucacuaaagguuauauuccucucacugucuacccucugacaauuccacauccuauaccucuccugcuuccccccacauuuccaugaagauguccccagcccccacccaacuagaccucuaaaagccuuggggccuccagucucuuaagggguuaggugcaucuuuucugacugaacccagaccuggcaguucucugcuggauauguguugggggccucauaucaucagcugguguaugcuaccuguuugguggugcagugucugagagaucucagggguccagguuaauugagacuacugguccuccuacaggguccccuccuccucagcuucuuccagccuuucccuaauacagccauaggggucagcagcuucuguccauugguugggugcaaauaucagacucuuucagcugcuuguuggguccuuuggagggcagucgugauaggucccuuuuugugagugucccauagccucaguaauagugucaggccuuucgaccuccccuugagcuggaucccacuuugagccugucacuggaucuucuuuuccucaggcuccucugcauuuccaucccugcaguucuuucagacaggcacaauuaugggucagaguuuugacuaugggauggcaacccccucccucacuugaugcccugucuuccugcuggagguagacucuauaaauuuccucucccuacuguugggcauuucaucuaaggucccucccuuuguguccugagaguuucucaccucccaggucucugguguauucuagagaguuucccccaacacccuaccuccugaaguugccuguuuccauucuuucugcuagcccucagggcuuuaguccuuuugucuccccccuuccccaugugauuguuuucuucucccucccaugugggacugaguaauccugacuuggacccuucugcugguugaccuuugagaguucuguggacuguauaauggguauucugucuuuuuuuuuuuuuucuaauaucuacuuaugagugaguauauaugaugcauguccuuuugguucugaguuaccucagucaggaugauauuuucuaguuccaucuauuugccugcaaaacuuaugauguccuaguucuucauagcuggguacuauuccacuguguaaaugaacuacauguucuuuauccauucuucugucaugggacaucuagguuguuuccuccucugguuauaacaaacaaggcugcuaugaacauaguggaacaugugccccuguguccugguggggaaucuguaaucuuauuuuugauuuucuuuguccaacaucaacugaauauuuauguaauauuauacuaauaucuaugacuguaucauauaacucuaauacuauuugauucuaugaauauagauguaguuauagaaugucaucaaacggauacaacuagaauaauacaauuuacaagacuauucucuuacucuaauuugaggaauaauaaaaaguucaaauuauaagaguauugcuuaugagaauauuguugguaauuguauccauuuuaauagauuauuguaaauaccuuacgaauuuauaugcucacuuucugagauauagaccaauguuuuagaaauggcugaaacaacugggagguuauaaaaaguaaagaaggaaugacaggggcuauuagcaguuugauugguuccaaaucgccuuacccugucauguuuaucuguguuguaacuuucaaggauauucauacuuagaaauaguaucucuuuaguugguuucauuuuuaaauuaaggcaguuuuaugauuauuuccaaauccguaguuuuacgucaaguccgauugggacucuaggauaaaaauauuguuaaauuuuauguaauauuguaaaaaaugauuauauuuaauuuuauaucuguuuugacauuaaugauuuaauacuuauauugaaauuucuuuuuaauaguuacuuuauguauaaauuuugucuguaguagaaauauuuagaagagacuguucuuucucucucucucccugcuucccuccuaaauaugcguaacacaaaauauaucauuuuaguauguuuuaaacauacagcugcuuuuauuucuuauuugucauaaagaaauuaagaaugagucuagagacuuacaguuuauauuaguauagccaggauugccuagucauucacuaaguccauuuguaucaacuauuuuacuuuaaaaccuuacuuuuucacaguuuaugcuaucuuccaggcauugggaaguuauaguuguuaugcugaguuguagcuacugaaaauugagcaaagauaauagauauuuccucuaaucuuggcucauaggcaacucccauguuuaauucucuuuguauuuuucccuucugaaugcaaucagaaaacuaaggagauguuggagccucuaagaaggucaaguguauguacucugagucauuaugugggguacaugauggcucacugaacaggaugaucuguuuucaccucaccugagccaaaaauuugugcuaaaccacuaagguguuuuguuagucagacuuugucacuguaacacuuaccugaaagaacaacuuagcggguaaaacauuuaauauaucucacuuuuuaagaggcuuucuuaguccauggcuaaaugaaugcauugcucuuggccccaugugaaacagaauacuauggcaggagcaugaaguagaggguguuucuucaugacacauauacagguagcaaggagaagaaaggacacuuauaagauagacuuuuucaguguauaccgcaaggcuuguuuaaguagccccaccucuuaaggcucaaauucugccaguaaugaaugccauuauaauauauauauuuugaaaagaauuagaccauugauaaagucugagccacucacuuccuaagacccaucacguggcagccaaguccacuguacuugaucuucuuuaaacacauuuaauauucaaucauaauacucaugauuuaacuccuuuagcagcuggcauucacuucauuaauucauucaacaguacuuagaaaaaaaauacauuacucaaaaguaguuuuuacauguuuagaauggaauguagaauugagaaaacaaauuugaauuaggaaguaagaaauuguguguggccccauuaauaggaggagucaaguggaaguuaaugacaaaaaaugaaggauagugagaaaaaguuguaugcugugcugaagaauugguuuuagaaaaccuuagaaguaaugagugcuguacacucauaggagaacaauauuuuagaguugauaaggugggauauuaugaauaaaaaucuagucucuaagaauuauauagauuuuauacacuuggcucuuaaauuuggaauuugucauauucuacauaaaauuugcaagaauaaguuuugcuuauuaugaugacaaugagcacauuugugauacucggaaaauauggaauggcugauggguaaaggaacagagcuguaaucccggaguguaggcugaaauuucgucucauuacuagaguuauuucucuauucagcuauucuucaagguaaaugaaugaguuccaauuacuguuuuauauguauauaaaguagaauagcuugcauucuuaugccauaacauaggcaguauuuaucuuguauuuugaauauauaaaauauucaaaagaguauuuaaaaauuaaucagcuuauuuugcuaguauuauuauugaaguuuauagaauuuaaacuuuugggccucagaauuggauuuuaucaaauauuaaaaguggaaaaauaaaacguuguauguuagguugcuuuuaagaaaaaaagcaaauuuguaaauuuggguuuguaauuuuguaaacucagaaguuuugaugcaauaaugauggaauaauuuugcuaaccaaaauuuaaauacuuggcaaaauuauuguaaaucaaguauaugugaacguuugggauugcuauuuuuugucagguggagucauucuucccacuuccaguauucuaauaggcuuuuuucuuugaaaauugaaauucauacauacuuuuaaggucuccagugggucccauaccucgccugagcagcacaguagagcugacccugguauguguuaggcaaggugagccaaccccacagcacacuggauagcuggcucccuccuguccuuccuagugugagagagugcaggauaaugagagugcuggccccaccacucaccugggcaaagcuagagagcugccucugcugccacaggcauaggaaaguuggccagcugaccaacucagcuuccaccuaggcccagauucaggucucugaguagguccaccucuauacuuaccccaucucugaacugcuagagcacauaaagggacuaguccuacagauccaaagcugcaguaacuccaugacacagggcaacaggacauccaaggugaguuccagugauaaucaaguauugaaaguguguuagaaucaauaugaacuaaccaguaccaccagagcucccugggacuaaaccaccaaccaaagaaaacacauggagggacucacggcucuagcugcauauguagcggaggauggccuaguuggucaucaaugggaggagaggcccuugguccuaugaugguucuaugccccaguguaggggaaugccaggggccaggaagcgggaguguguggguuggggagcagggggaggaagaggggauaggagauuuuuggaggggaaacuaggaaagggguuaacauuuaaaauguaaauaaagaaaauaucuuaaaaaaaaaaaaagaaaggaaagaaagaaaauguuagaagccagaggccucaaacaggagcaaugacucauugcaauaaacauuugcaauaaggcuguuuggguaaaaaaaaggauacugugugggacacugcaacauaccacagcuuccauggaaaaauuuauuuuuuauuuuuaauuuuuugguuuuuuuagggggauugcaaggaccaaggauggauauaaaggaccagauagacgagugagauuggggauaugaugugaaauucacaaaaaucaauaaaaaguuaaacaaauagaccagauucuucuuacaaauguauaguacuguuaacaguaagauuauaaaauaaauuguaauuauauugcaaucacuuguauacuacuucuacaauauuaauguuuuuuucugaacauuuuaugugaagaacucagaaguacaaaagacauguuauauuuuagaauaaugaaugauauacucaaauuuguccugcuuggaugcuuuaguaguucucaugaaacacauauaguugggccuuuguuacuaauacaguuaaugauuuauguggcaaagccuuuuuauuaguaguaaauuuuccaacugcuaagaugaacccaauaacacaacuagaaaucuguucaaucccuuuucccauaauuuuuacauuucuucuaauuccaacugucccaccccuuuucuuuuuuucuuuuuuuuuucuuuuuuucuuagauauuuuuuucauuuacauuucaaaugcuauccugaaaguccccuauacucucccccugcccugcuccccaaccuacccacuccugcuuccuggcccuggcauuccccuguacuggggcauaugaucuucccaagaccaaggacgucuccucccauugauauccgacuaggccauccucugcuacauaugcaacuagagacacaguucugugggguacugguuaguucagauuguugauccuucuaugggguugccgaccccuucagcuccuuggguauuuucucuagcugcuucuuuaggggcccuguguuucauccaauagaugacugugagccuccacuucuguauuugccaggcacuggcauagccucagaagagagggcuauaucaggaucuggucagcaaaaucuugcugacauaaguaauagugucuggguuugucccaucccuuuucuuaccuguguaucuuugauuugucagugauuauugcuucauucaagcuuagcccuuucuaggggaaguuggcuaacuuacuaguccugugauuuagguagauuugucugucccuagacaaacugaaccauagacaauugacccaacaacucucggaaggacggguguguagaacacuaaaguagcuuagagaagaaguaaaacuagcauuuuggguaggauuuccagaagggucagacaaucauuuaaugauggaauaaaaaccucagagcaaguuuggaguugguggugaagagcuugugacuagagaauucauggacagaugcaacuggccugggggacgaaugagagacagacaaggaaagugauggacaucagaucucacagagccccagagaagacaaugggaucuuuucuaucacuuuccauaucucacuuacaggaaguuggcucuauacugccacauagugcaucccauuccuugaguaguguguuuccuuacaaugaauagcucaucauugcuaucuguggucaucaucaguagcuauuguuguuaguccacauccuccuccuccucaugaucaaaaguacugaaagagcaguaagguuaaaggcaaaacaggguagaucucugauaagaggccggccagcuuugggcacuguuuacguuggacuuuuuucuucucguuaguuuaugucauauuauacuaagcuuuuuuuugacuucugagucuuucaguaugagaguuugugauagauaugcuaauugcuuaauuugccucuuaauaaaagguaaacauuuuuaguauacugguaccuuguucaaaauucuacucuggaagucagugugaauguuaacuuucuugcauuacaaagccuuacauaugcauuuaucaauauuguuaacaaaccaauagaccacugcauucuuaccuaaguacuuugucacagugaggaacaaauauuuuaagaguaguaccccacauauuauaaauuguguuuggauuuguacaccacaugaagacuuuauuuauauuuaauaugagcucuuagguauacauuaagguaagucaaaauuaaaauguuuuuuauaguuauguccuuugaaaauuucucucaacauuguucuuuauaauguuuguccuccuuuaucccugugguaaagggugucacacauuucuuacaugaagggcacauucuccuuaaaauguuaucuggucucuugacaaacauuuagcaaaagcuuugaaaguagacaaugaaauuuggaaguuuuugucauucucaaaauguaaaacagcuuuagguaguuuagaaauggauagauuuaccuacaaaccuuugaucagauucuggagccucaguguuucagaagccauacucaucauuaucccauuaaaauuucagagcuggcuuucaauuuagguuuuauaccuaauuggagcuuucagccuuuaaauauacuccuaaccugacuuuuuuuaaaaaaaaaguuaagccaaacucuugcuuuuuaucucuaugugggugaugagaucagucacuuuuuauuacaaggauauuuuuauuauggaaaauggacaaaauuacgucguaugucucuuucauauauacaaagauaaacuugggcuagugagaugaccuagugaguuaaagagcuuaccaccaaaccugauagccugugaaaacagaacuuauuauuuauuuccacauguuguuuucuguccaccacacgcuaccccaaaguaaauaaguauaagauaaauuaaacaaacaaaaaagccuuuacaaaaaaaauguaaccucaaaacaaaaugcuuucaacuuauauaguagaagauauuuuuuaauuauuuauuuacuuuuuuuuucuuuuuuacacuccagauuauauuccucucccgauccacccgguccacccucucccacuguugcacaucucauaccuccucccaccacccccugucucuucaaggauguccacacccuccagcccucucugaaccgaaccagaccucuaaaacucccuggggccuccagucucuugaggguuaggugcaucuucucugacugaacccaaacucugcaguccucugcugaauauguguugagggcuucauaucagcugguauauauugccuguuuggugguccaguguuugagagaucucagggguccagguuaauugagacugcugguccuccuacaggguccccuccuucucagcuucuuccagcauuucccuaauacagccauaggggucagcagcuucuguccauugguugaaugcaaauaucagacucuuucagcugcuuauugaguccuucagagggcaguugugauaggucucuuuuugugagcacuccauaaccucaguaauagugucaggccuuggaccuccccgugagcuagaucccacuuugggccuguugcuggaucuucuuuuacucagacucuucuccauuuccaucccugcaguucuuucagacaggcacaauuaugggucagaguuuugacugugggauggcaacccccucccuuacccgaugugcugucuuccugcuggaagugagcucuauaaguuccuucuacccacuguagggcauuuaacauguuuuuuaaaacaagguuauucauuuuucugacauucaauuauacuagauuaguuauuauauaauguuucuuuguauauuuuuagaaaggaagucauuuuaucccuuuaguggauuuauaccuuuuuuguauaauaccaaauacugucuugaucuuguuacuguaauuguauuuaccaauauagaaaauauacaggaucacaaauguugcuggugaguauuuuccaaacaaaacaacaaaccagugguaauccaacauaaugaacuuuuaagauuuauucauauuugacaguguuuaauaaacuguaaagcaauauacagagaugauuguaugacccaguaauaguaucauuaagggaagcuacuauacaguaguaaaggauaaauuuuaugucuuuuaagccaagguagaaaugcauuauagaaauugauuguugguauuugcuggauggaguuccuuguuucuucugacuauaauuaugucuaauuucuagaauaggccaaaucuucuagaguguugggauaguauuaucacugauaaauauauuucaaaguguagucuaguuagaguuuuuuggggaggagguuuguuggaauaauguuucuuuaaaaauuuuacuuuaaaugucccccacauugaucagaaggauacuugcagcaaauuguagucgcuuagacggcugcuuuuacuucccuagaaacuuugaggauucccaugaguucuaguugaauaguauguguuuagaacauagaugauaguaguuagguaaacacacuaucugaagaggaacauugaucccauuaaaguaaauuuaccaguguuuaaaccaguaaacuaauggaacauaauuuucuagguuuuuauuuuuuuugucaaaagaaaaguuggauguuagagcuugauaacaguuuauuaaugcuguuaaagucuuuuuuuuuuaagcagugagauguuaaagaauuuugaaguggacaaaaauauuagaguguaucuauaucuaagcauaaauaugcuuauuuauauuuuuauaguuuauacauaucaagcauaaauuauauauguauuugugugugugugugugagugagugagugagugagugagugagugagaaaacuauucuauacuguauuuugucagucuagaacagugcuuggcacaguacuauguaauagcagaauuucuaacaaaacaaaacaguucuagggcacauagaaggaaguguuucuucuagguuuacuaauauguaugagugagaguucuaugugcauuaaugaaauuaaacagaugagauuaguaaaaggucauucucauggaggccuuaucucugagguugcuguagaaaucuuauccacuaucauacuuuauuuuguuggaauuuucugaauuacuaacaacuuaaaaacacuucaaugaacuuguauuuguuaaguuuuuuuuuuuuaagaguuaagaaagacacuuuacaaaguggacucauuguuuaauuuuguuuugcauuuuacuagauugcugugcuaggccaauaaauuaaaccuaggcaguucuguugcuaauuacacaaaacuucucuugguaucagauauucaaauccauuuuaugaauaugguagagagaauaacaacuguaaaacaaagcaguaugcauguaagugacuguuagcgugcauuucagaaaggauaaaugcucaccauaugguacaauuacuguguccaaguuuucaaauuagcuucucucauccuccuuauuacugucuuuaaaaagagaggaaaaaaacccaacaugauuuaucuacucugcaacagaacucuugacgcaaaacagcagcccaguucuguccaguuuuuuuuuuuccuuagcauaauagaggcugucggacuuuuuuuuuauacuaauuacugugugagccucagaugaaccccuucaauucacagggcuuuguuaagggaggagcugucaaugugucugcccguuugcagcugugcuguggcuuuagcuugcuuaacauuaugcugcuuuuuagacuugacagaagggauuuuuuuuuuuuauuaaggcaaagcagccuuguaacgaaaugguuuaagcagcugcauuguagggaagcacaaagaaguuauuauugugucuguuuuggggggggggcgguaaagggggagauauucggcugcuguugaugccgauuguugacuugccaucugccagauagggagaagaaaaaaaugacagcuccagcaggguguucaagagguuguuuggagagacgcauaaacaugugcagaugucgaacugaauaauagcuagagcuggagacgguuuaugaugcugcugauguuugugcauauacagaaugaauguaugugugcauuugguuaaccaaggguacauacuaauuaucauuguuuuccugcaugucccccuccucugauuuuguuaauuaguuuaggaguguaauacuuccucuuccuucucuuguucacgucuaagcuuuaaaaaaaaacuuucuuaaauggcaauauaaacuuucuuacuuuucuacaaagacaguagaaaacccaguucauuaauguuugaugugaauuucuaacugguaacaaaaacuuuugauuaguaaucuuuuaguucaguuaccaucuucuuaaugauuccacugacaauuuaacugggcagcacuuaaaacuaucauuugaaaguggguugauuuauucuauaguuuacuacuagaguaacuuaauuaacuuaauaucacauuuauuuucuugaguaauucuauaaaacuuuaaacccagauguucccugugcugcaagaaagagagagagagagagagagagagagagagagagagagaggcagagagacagagagagaggaggugugaguuacauuggccuuauuuuuaaaaauaauauucuuucucuuuguuuuugugucuuuuaauggcuggaauccucaucaagcauuaaugaguugauuuuuuuuccccccuuggccuuuuguggcauuaggucuuagauuuuugaauaucuagaauccucuuagguacauauguagaaguaaguguauuuauucaaauguuuuccuuucaucucagauaauugaaugauacagugauguuauauagagguuuuccaaguuuuuuuuuuuuuuuuaagaauacuucaguuuuugguaaaaguugaauagcaguaugaaugaaaugacuaaaagagagagccucaguuuuuaaauuuccccuuuaaaacucuguaggaauuuuuaauuaaaaaagaaacugcuagaagaauuaauaagaaagauugcuuauuuugaguuuugguauacucucgccauuuuaaacauguaaggucuuguugcauauuuguuaaguaaaaaugccugaagugugguugaaaggccggcauccugauagcuuuagguccaugauaauguuuuucugaaaggguuauuuucuacuccucauaaagaagucaagucuggucuuucuagggggaaaauguauuuuauuuucaguuucuucuccaacaacucuaaucugugcuugcugagaaagcauagucacccguuucacuggaccucuccuuugccuuuguauuucauuaggaaauguagaauuaugcacauauuauuuguaguuucacacucaguccugagacccuuccuaacuuugggacaagcaacugacauuuuucacauagaguuuuuguuaaauugagagugugauuugccagaggucaguauguuaaugagcagcugacuaaagcaagcuugaggaaagcaaacuugucuguccaugcuguaguagucacuuauuugcucauuucuucagagccauguaacaaaccuuaauacaggccaguacacauagagacgugauugaaauaguaaaggcagauuaauuuugaaguuaaagggacuagauuuaaauaucacuuagauaugugagcuuauaaaagucacuuaaacuguuugaauuuagucuacaaaggaaacaauagcugucauugcaggaacuugaaaagacuaagugaaauaguacaguuagcauuucgggaacaaauucaggaguggcuguuaguaugauuuuauuuucauuagguguuaaugaaagucuagagaucauagauacagcagucaaaguauuaaaguguuuuaugggaaguaaguacacaaauuucuagaggcuauguuaagggaguagucacagguaggagauuuuuaucuuggaauccaguguuuagugacuuauuguuguuccauaaaucuggagggaaauaaucuguuuaaagagaauguggagaaaacuguuaaacguaauauuuuagagauguauuguucacugauaguuucauaauuuauauauuauagucacuugccuauuuaaaaauaaguaugcauuuguuaaaauacauuaaauuacaacgucuuuaauaguaaucuuaaauuauuuuggggguauguuuuugucugcuauugcaaauacuagaacugaacaaauaacacuaacaauauuguuuuaucuccugaggaaguuuaaaacauuauuugauuguccaaacuuuuuauuuuguaaaugaaaaaagcugucagcccccacuccccccuugaacagaaguguuuccuuggaggaauuaagaagaaaugcuuuuauugagcuaauggagucagugaauucccuagaguaugaguaauccccacacagauguaggugguguuuuuaagcuuuucuuuucaaaauguuguuuuucuuaagcuuauagucuauaaaguaugagugaguaaaauuggaugaugacugaagcaaggugugaugugcucuggagacugccuuaaucagcagagauuaagauuagagauugcuucauaggaguagagaaguugagaguggagaauuucaaacaagaaauugguugcacuaggaaaaguggcauaugccauuaauccucauaaucaggacggugaggcagaagcagguugauacuaugaguuugaggccagccugggcugcauagcaaguuccaggacagccagagcuacaaagagagacccuguuucuaaaacccauuaauuaauuaauuaauuaauuaauuauuaauaauaaugacuaugaugaugcuuuacugacaugacacuuguuuaaaaugcuaguuacuugaaguaauuuacauaaaaagaaaugggacugcccacgugugcgaacuguuguauaacagaugaagaagaauccacuuaaaaauaacaguauuuuuauaaaugaguauaauuguacuuuguaaugguuuauuuugagaacaacuaaaagaagauuuaggaucuucuagcguauuugauuuaugaauguauuugaauuacaccuuaagaaaaugcuacaugaauaguaauuuuuuaaaauauuggccaguauguugaaaacaauauuucacuaucugacauacucuuuaagguaucuugcaaaauguuuuggcuuaaaauuuuuaaugaguuuuuacucucaagaauaucugauaaaagauguugcuaaguaagcuugaugaugcauuagaacagaggauguuuacauuaaaguaggaaaggcaucaacuuauaaguaguuugauggccugccggccugccugccugccugcuuuccuuccuuccuuuuuccuuccuuccuuuuuuccuuccuuccuuuuuuuccuuccuuccuuuuuuccuuccuuccuuccuuccuuccuuccuuccuuccuuccuuccuuccuuccuuccuuccuuccguuuguuuauugacuaugcgagucacuuauuugagacuggaauauaacacauggaauagcagcuguugcuuccucgcaucuuuaugaaaagauguuagcgugugcaugugugugugcuuguguguauguugguguacaugugcacaggcccaugaguauaugugugugugcacauguguguauguguucaagugugugugcauguguguauauguuuguguguauguguguacaugugugcaugcaagugugugugcaugcacauggguguguaugcacauguguguaggccaugagaguguuugugugcaugcucauuuguguguguauguaugugcgugugcaugugugugugugagagagaaagacagacagagagagagagagagagagagagagagagagagagagagagaauauuauaaaaugaccauuauuuccuucuuucuauuugccauguauucaacauacaagguagucacacaauucaaucucaggcuacuuuucauuuuaguuaaaagguauuggaauuuaauuuuaacuuuuuuauuuacccuaaaacauucauagaauuguguaguuucaaggcaauguaauuguuuaauuuuacuuauauaacuguuaaaaccuaguuuuuuucaaauuuagaaaaaaaaagauaguuccuaauugagaauuauaccuuaaguuacagggaaaaaaaggggcuuuucuuacaaguacauguaaaaucuacauaaaaacccacuucuuuuuuauuugagcauauaacaacugauuggcuguauaaaauaaauuuucuguuacccgcuguaguaauuuuuaucucccuucaguacgccaguuuuuaaaagcuaggauuuuuccacuuuauguaguguguguguguguguguguguguguguguguguauucauguuaguggugugaaguuuaggcauggauaauaaucaauuaccucauacaucaagcagugauaguaagauuagcacuuuuauuaagcuaaauaaaagcucuuucacaccauuggaauuuucaggguuaagucuuuuaucaaagugaucaguaaauaaaugaucacauaauauacuuuguaaggaaaaguggagcaucuguagugugacgaccucguguauuagaggcauuuuacacuucuagcauuaguuaugaaaauucugagcuuugauucuacacuauuaacuuaccuuuguauuauauuuuauuauuauugagugauuuuuaacaaaagcuuauugacugcuguuuucaagaaaucaagagauuuggggauuuaucuuaguuguuaaucugugaauuaguuuauuccuuugaauguauguugacucuuaauuuaaaaaauauuauaaaaccacugaucuacagagaauagcaugauaggauauacauguuuacauaguacugagccauuauauuauuuuaaaaauauuuuuggugacuuuuauaugagacuugcaaacauuuuucuuacugguaucaugguuuuguaaaaaguuaaaacaagcauuucaaaacaaucauuuugaugucuaaguauagaugaugauaaagauaaaauuacuaauaugugaugagcaaaauuugcucauuucuaaauuuuaaauuagauauuuauuagaaugguauguaauugcucuuuccugaaauuucugacuuuguguuauguaauacugcccucagagggccaagguaaguaaauucauuuuuaauauugagaaguggcuuuccugguauuuauucaauguuacaagcuugauuuaugaaggggaauaagucuauuugaauaguugagugguguuuuauuucucauugcauuucuuugauuuguucuuucuuuuuaaacauguuaaagauaucugggcauuucaauuugaugaccacauuuaagcacaguucucucuugaaaaaguauuuaacaguugaccgaauacaaauugcuauauuaauauauauauaaauaggauaagaaaaucacccaccuggaaaagucaaagugauuuuacuuguguguguuacuuuuuuauguauuuaacuauagcuauuaaaguauuuaaauuauuuguauuuauaguaauuugcaucccuacauuuggaucuguauauauaacauuauacauugaaauggaagcauauuucucucucaaucaaaacuauaaacauauuuaaaauuuuaaucaaauaaauauaagauaaaaauaacacacacacacacacacacacacacacacacauauauauauauaauaucagcaguuagaaauguacuuuuuuccaaguaauuuuaaaagccaaguaugacagguaguuuaauguguuucagaauucagagugggaauagacuguccuguaacagaggaagcacaggaaaggaauaaugucaaaggaaugagguacagccuuuccuuuguacuuucuaaugacauuagaaagaaaugaaauguuuaauaauauauccaauuuauugccuuuucagggucuugcgauauugaauuuaaaaaggauuucuaugagaguauuggcagcaauuuuuuguuauuuuuuauuagauauuuucuuuauauacauuucaaauuucaaaugcuaucccgaaaguuccccauaccgcccccccccacuccccuacccacccacucccacuucuuggcccuugcauuccccuguacugaggcauauaaaauuugcaagaccaaugggccucucuucccaaugauggccgacuaggccaucuucugauacauaugcagcuagagacacaugcuccgggguuacugguuaguucauaauguuguuccaccuauaggguugcagaccccuucagcuccuuggguacuuucucuagcuccucuauugggggcccugugauccauccaauagcugacugugagcauccacuucuguguuugccaggaacuggcauagccucacaagagacagcuguaucaggguccuuucagcaaaaucuugcuaguguaugcaauggugucagcguuuggaagcugauuaugggauggaucccuggauauggcagucucuagaugguucauccuuuugaaacagcuccaaauuuugucucuguaacuccuuccauggguguuuuuucccaauucuaagaaggggcaaaguguccacacuuuggucuucguucuucuugaguuucaugcguuuagcaaauuguaccuuauaucuuggguauucuaaauuuucaaaaucauuguuagugaggaugguagaucaaaacaggaccaaguacaguaaauaaugaaauggaaguuuuuuucauauaucguguugugugaauguguggaugucagggggucuuuguccaucacucuccaugauguuaauuuuugaggucuagguaacucauugggaguucacaugauuagcuagguugacuggucugugagccccagggaucacuugucucugcuucccaaggacuggaacaccagcuuguacauccugcccagcuuuugugaagguuuugggaauuguaccuaagucuucauguuucuguggcaaaaacuuuaucacuaucauccuaaucccuaaauuuuuuuauuugccuuuauaaagaauugaagacaugacuaucauguaucuucauauccuucccuuuccuaaguuuuuuugcauugguuuucuuuuuuuauaccauaagccauuuuaguuuauuagcaaacaauuuuauuuuuguuucuguuuuugguuuuuuuuuuguggguuuuuuuguguguguguguguguguguguguguguguguuuugguuuuucgagacaggguuucucuguguaguccuggcuguaauggaacuuuguagaccaggcuggccucgaacacagaaaucagccugccucugccucccaagugcagggauuaaaggcgugugccaccaccacccggcagcaaacaauuuuauaauucuuacugugagcagauguucuguguguauuauaaauauuaaucuauuuuucuauuacugcuguccccauuuuacagaagagggaacuaaggcaugaagggugauaugcccaguuugucacucccauacuuaguguaauaaguagcauaacugucacuugaaucugaacaguuguauucacauccacugugaggaagaagauaaaaggauguuauuuguguagcugucuguucaagcaucaucuauguccucuacaggcuucccucuguguggcucaguuuccuguuagcugucugugcagugaggagacugcagugcucaucccuuguuugugugaagggaucccuuggagugaaaccuaaauacagacagggcuuagcugaggauuuuuaagcaaagucaagcuuucuuguaaccugaucacaauggacauaauagauuauuguuuaaggaaagcaagaauuuugaagggcaugaauuuacccuuaaaaugauuagaugucuugaguuuagugauauguccuuuucagggucccacaccacuagagguugaucauuggagagaucuuuaggugaagggguaagauaaagugcuauacuucccacuaauuuuauaaagcagaggugaaaugacagcaggauaaacuaguuugacagugcacccuguccuugcccagcacagacuuccugauuagcaagcucuccaguuguguaguacuuaaacaguagagaccaaagggguggaagggagugaucucaggguuuuuuuuuuuuuuuuuuauucugagauauucuaaguuuuuaugccaugaguguggcgggauagugauaaguuguguacuuauacaauuaauaguucuuccuuugccugaucuguucuagguguugaacagacauggugaguagguuugcauuaugcuuacauugcuuccauauuugauuuuauuaaggcuauuuccuaaaauuauauguaagauuuaaauaugcagagaguaugaggugcuaaaaauagaaaauguuacaguauggauguuaauuuuuucuaaugaaacuauauguuuaaauaagucaguuucuuugcagaaguuuuuucuuauuguguuguuuugaggcaaggucucuuuuuguagcccuggcuguccuggaacucauuauguaguccaggcuggccuugaacucacagagaucugcuuuccucugcauuugcaguacuucuagcauuuccacauuauuaaaauaguauguaaaugacuucauauuuaaaugagguaugguguagaaauggagaauuuuugcaguaauguagaaaaagacagcucugcuuucacaauguacaagggcguaagugaaagcaaaauaauaauuuagcucacauuuaacccagcaggaagcuuaguacagauugaguaauucuccacaacauaucuucuucuauguaaacuaaucucaugguuuauucuucauuaaauugccaggaugcuauuuucuguuggcgagauugugugcagcauugaguguucuccacucccccuugauuuuucugaauuagauuugauacuauaauaccguuaggauguuguuuuguuuaaaagaaugauuaaauguauuauuucuugguguaaaguugccugaaaaccauagguuucaggguuuaauaagcuggguaucauuaaacaaauaccagaaugcuuaaagguaaggugguaauuguuaacgauuauggaacauuuuaaauaaaaugcugauaaugcacuuccuuagagaaguuaaaguugcccuucuaacaucuuacaacaguagccuuaacauucuaaguaaugcagccuuuacuauaguuccacauauugugguggccuccaaccacaaaauuauuuuuauugguacuucauaacuaguuuuguuacuguuaugaaucauaauuuaaauaucuguguuuucugauggccuucagagauccaugugaaaggguuguucauccucacccacaagggucacaacccacagguugagaaacacugcuuuacaguauuuggugcauagguuguuuuuuuuuuaauuucuucauggagucuaaccuuccuuaggaagcaggcaugaaaacuauacuuaaacgacaaguucaugcauuaugcaguggaaggaaaauuucuugacuauaauauauuucucaaaauaaucaugaaggaacauauggaaaagcagaaauguggguacaucuggaaagcuuuuaaggcaucuugaucauacauugcagguuuaccaaaauuguaaacaacuucugugucgccaguugcauugguaauauugucaguccaggauuagacugaccucugaaagaggagagcaggcagucccuccucauuuuagaaucuacagagaagcaacagaaucuugaaauguugaaagauuguguauugaauaugccacagacaacaaauaguaauuacuacccuuucucuaggagcauguauagguauuuggaaaugacagagagucacagauguuguauuacauaauaugguuaaggacauugcguugauacccuaguucagcacugauuaguuaaaggacauuacuuauuugaaggaaucaauaaaggaaaaugauacaaccaucguucaucagaagugaguaaagacaauuuuauuuagaaaacuagauuuugcguaugucuguauccuaaacuguuauguccaagcugauuucaagguucuggaaucaagggauccucuuucuuccgccuccugaauaucugggacugcagauaugugccaguguucagguuuauauaucccuaaaauuuucucaccucuucagauucgauauuucauuccucacacuucuuacuauguaggcuuauauuucuuaaaacuuacuuuuaauaaagguucucaaauacuuugacguccccucacccaccgccuccuucuagcccacuguccaaagguaggggagaaaagaugguaaauaggacaaggggauaugaaccuguuuagaagacguugcguggggcuauuccaaucucuguuagucaggacaccaguaguccaguccaguaaugucaggauagcaaacaggaaucagagguggcuagaucuaacagaaacugccaggccucugacacaucgugucuguugucuccuauuuauacuuucuccaaacaucacauguccucccaugggucuugccucagcaauacaccacgugagucgaccucaccaugugagucuguaucagcaagacacgguuugagucuguauuacuugacauauccagaaacuuccacuucuuuucuagaauuaauauuuuaugaggguuggauuauaccugcauaauccauuuauauuuuaaguacuuguauguauuucaacacuaaauuauuuaaaaaguuuuaagacuuuauuuucuguguuuuggugcuuugucugcauguaugucuguccaucucaaguacagaggucaaaagagggcauuaaauugucuaaaaguggaguuuaguugugagguacugcaaaguguugggaucugaaccuggguucuuuggaagaacagucagcacucuuaaccacugagccaucaucccuccagccucaagugcacaaguaugaauaugggcacacauguaugcaggugaacauacauuaugugcauaugaguguguaugaauaugggcacacauguaugcaggugaacauacauuaugugcauaugaguguguaugaauaugggcacacauguaugcaggugaacauacauuaugugcauaugaguguguaugaauaugggcacagauguaugcaggugaacauacauuaugugcauaugaguguggaggcaaagguugaagucaggugccuucauuuaucgcuguccaccuuauuuacugaggcaggauuuuucacuugaacccagagccuuacauuguacuggcuuagccauaucauuccagggaucuacugucuuugccuugccuguauugggaucacaggcuagcauuuuuuguggguucuuuggaucugacucugauggucagguuugcagaacaagugcuuuugcuugcagagccaucuccucagcuccuagaaauucuuaaauucauaauaauuguucauaaacuaggugagaugugacuagugccugggggggcuaaagccuaagggauuacuugagcucaguuccagaugaaucuggacaguacacggacaucccaucaauagaagaaaagaaguucuaaaagcucugagacuucuguuuacuuuucuguaccuuuauauuugucuuaaagauagcauaugauuuuaacuaaugcuguauuuagauauugcauaauuuuuacauuucuuuaguaaaaacaaguauuuccaggcuacagagagcggaguacuguggugaaaagcaaguacugcucuucaaaggacucaagugugguuuccagcacccaugucaugauguucacaacuuuuguuuuucacuccagggaaccuaaacucucuucuagacucugggcguaccugcaauaacuauguagugcccucuccacauauguauuaaaauaauacaaauaaauauuaaaaagaaaaguuucaaaggccucucuccagcuuaaaagacuguuuuugauuuaugauacacauuuauuguuuucuaauuauauaaauauuccuagauaaguacaauguugauuauaaauugcauuaauuagcaaugguuccauuuaauaacaaaaucuaguaccuaauauuaugccaugcagaauuuuuaagagcuucuauauuguguccguacauaauuuguguaggcacuaugauaauucucauuuucuaguugggguguggaggagggcaaguuccuuuaguuaagcaguggcauaaucaugauucacauauaagcuuugugccccagagucuugcuccaagccaucacauuacauuguaauguaacucagaauggaaucaaacacacaauccugccucagccuccaggguaugaucugcaggugugugccaccaugccuggccacugagagaauuaugaaguagaguauuuaaaaaaaaauucaaaaaaaccccaucaaaccuaguuugcaaagguuggguaucuuuuuaaaucuguaagacaucaacuaggagucgcuacugguaacuuaaacaucaguaucaugauuauaucuuaauaauuuaaguuuauuuacuguuacuaaucagggucuuuaauuuucuauggggaaauaggaaucuaaucucaugugcuauccuauguuauaggagcauauuuuaguaugauuuuuauaauuguguucuaaauaguugauuuaugagauuugugaaaauuagugcuauaucaaaucaguugaacuagguugugucuguguuaauaaggccaaauuuauuuuaccuauuuguuauugcuauauauuuuuagccuagcccauguuagcauaagggugaggguagguuucuaguuuaugaguaugaaugcaguguucuccacugguucaucuuucaucuugcuucuaacuuuaucuuuuuuucuuuuuuuuuaaagauaaagcuucuuccauaagacuuaacuuuaagacagaauuggauauuuagcaccacaauucaccuuuaagaguagaagccuggauuguuuaagcauauuuucuaguuagauaucugaagaaauguggacauauccagucaaauacagaucagagccuguugggacauuuaaucugcauuuggucuagacauauaggccccuaauucuuacuaugguacuuuuugaugucuucaucagaaaguuuuaaaaacuauagugucaauucuuaaugaaguauuaaugaauaauggaauaaaguuuuuauauguagacugacuuaaaaugaagacauuaaacaacguaauuugacccgagaugaacaacuucaggagacccggaguugacugucuaucacuccacucccgauaugauccacuugaauaggcugggaaacauuuuaggcuuuagccaaaacaaaauuaucauuugugacuuuuucuguaauaguaguaaucuccucagaaccauugggauuguuuguuguaauauaggaagugaauuauuaauuaaaaggaaaguuggccaagaccccaacucuagaauuauaaccuaguagagcucagaacugauagaaagaaaacauuuucuuacaaaccuacaguucacaaauagauucucuacugcuuauuaaaacgguuugacguuuuuccuucgcauuuacaagaaauugacugaguacagcuguaucuauccuuuucucucaugcuaaaugauaauggaucauuagauuuauuuuugugguuguuguauaaauaagucuuugggagcuggagagauggcucagugguuaagagcacugacugcucauccagaggcccugaguucaauucccagugaccacaugguggcucacaaccaucuguaaugggauucaaugcccuauacugaugugucugaagacagcgacaguauacucauacaugaaauaaauaaaugaauaaaucuuugaauaagucuuugauaacaguauauauaaaagcugucuuucauuucuuaggguggguauaguaaacaacuacaaugaugccuuauagcaacuaauauaucacagucauggcaaccacaacagaaaacaagacaugagcaagguuacucuuccuucaaaagcuuucagagaaaaucuguucuuuauucuuauuugugguagaucaaguuuuuuuuuaguuuguacuaaaucuucugccauuguuuccaugguuaccugcuuccuuccuuucuucauaugucauguuuacuuuuuuaucaaaucuacuauuuuaaguguauuuuaaauuuauauggggcuagcuguucuaaaaucagugaccuccuugccucucuugcaaacugugaugauacucucuuuuauaggauaagcugauuccagagagugggguuuguacuucuuuugaaggucuaucauuuaguaauuacuuuacuccaaaaugccagaauccuuuuggggaaaguaaaagaccauacauggagugguggucccauaauaauugauuauagagcugagaaauuauauagucauuauaaaauucauuacuuaugugguuguggugauuuuaauguaaacaaauuuuuagagcugguugugcaaagauaugucauaauuauauagugaauaguacuugauaaugauuugauugguauuggcuuacauauuuucuauacgaugcuuucagucauuauuuagagucacuucuacuuaauuaaaaaauguacacgguaagauagugcccuuuguuuggacacuaguaacuuguguuuauuuaucuugguuuuugguuacaucauuucuccuuggucuugauuuaaucuuaauauuguucauuguaacccuaggagcaauagguuauacacauacacuacagacacaggcaaggggauuaccuaugugguggcuguaugaucuagauuuauucaguaauguuugcauagugacaggauugccuaaggacauacaacuggggacaacucugacaauaagcaaagccugacuauucauuuuggaaacacuggauuuuauaguguauauaccuucucaucaaagaggguaaggaagaagaaacgcaaguuauaguagaugauaaguuaggaaaagguugugcuggccacuuuauccaguuguuccuacaaugauuguugaaauuuaauauuagcuuugaugcaaguacuaucuuuaaaaauagaauuaugggggcuguggaauggcuuagucucuacaauacuugaugcacaaguauaagaacuugagaucagauccucagcacccauguuaaaagcugggugcagugguucagaccugaaaucucaguauuugagaugcagaaagaucccaaagcuccucuacucugcucaugugcaugugcaugagcacauugcagcaucacaacuaaaagcaacauggcugguuguuauugguuuaucuuaaugacugauuguuugaauuuuucuuguuauucugggcauauaggcccauaaaaucuaggauuuuuuuuuuguuuguuucuacucauagaacagacuuaugacaucaucuuuucuugagcucucauugcuggaauuacugcauuaguggcagaacuauuuagauaauuuuucaugaucacuuggaaaaggcccaguugggacuucuuaaucuauagagacaguucuacccuagcagugcuuaguauucacuguccucagugccaugccagggaguuagucaugaaaaaguuauguucuacguaguuucaggcuaggaaaguuuaccccuauauugggccuagggaaacaacaagagacaccaccauuucuguuguucacucacuugcagccuuuaugcccuauguaaggaucauucuucagaggcaaacacauucauuccaucuguggaaauggaaaagguauauuuaauaaagccagcacaccaugcugaaauauuuuuuuucuucagaauuuuuguagaaacauauaaaaagguucuuuguccucugccccccacuuucaccugaagaaaauauuuaguaccuuucuccagaugcuaacuaggcauaucugaacucuggaggaauacuggaaaaagcuccaugaaguuagagauuuggucuuuuuuauuuugguugguggggaagggguuacaacuuguguucccagcaccuuuaacuaagugacugacugacugacagacugacugacuaaaugacugaaugacugacugaaugaaugaauauauugcaagguccuuuauguuguagauguuaaaugacaaaaaaacaaaaacaaaaucuucauugaaaaauugacacucaguuuaacugugcugaccaacucaauugcugaguauaugaaucaauucaaaauuauuaaaaauauauucaauaauauugcuaauuuuucauuuaguggaacagaaauuuucuguuucuccuuuuuuuuuuccuuuggaggaaauaaguucaccccugucugguuguugugcauuuuucuuaagggauauauaauagacuaauuuucacagaacuuuugacagcucuaauuuuuaauucacuaucaaucugaacauggaaauauuuaagaugcuaaagaaaaauucgguuuagaaauuaaauuuugauuuuaauuuuacauuuucugaaagaauguguucacuucuauuuacauaagaaaaauauucuaauuaugauguggucuuuauacuuuucaagugaguuuguuucauuuuaucuuuauaugauugugaaauuaucacuugcuguucaucuugacagacauguaacuguaucaguauaaaucugcucuuguuaacaacagccuuuggaaccuaaaugcuaccucauugauuagauauuggcaccuaacaauauaaaauuauauaguaacacauaauuaaauaggaaagaauuaaauaauaauggcagucaacacaggaacaaaguuuuggaguugaauaagaacugugaacuuaaguaaauauuaugugauugccaagaaugaauuuugucuuaauaaaaguagauaaggcaucagguauauguguguugaaauuuaucuaccuauaugcacgugugaaauauuuacauuugcuuaucucuuuuauuuauuuacuaugacuaucaaucaagugauaggcaguuuaaguacaggguacuagaguauuucgaugcaagucaacaaagaaugucaguaguugcugagaugauaaaaaaugagcuccaaggacaaagaguagaaguuuggaaaccauguuugcuaucauagcuuuacaagcuucucaguacuuuaaaagaguuuuuuuuuaaaugaaauugauuaauuauaacaaaacuauguaaaguguuucagcugugagaguugaacuguuuaaucaguaaaccaguaucuguaugacuaauacaugauuuuuaaaacuguguacaguaugcaagauuuauucaagauacaaucugaguaagcuaacagcuauuugaauaggcguccuucuucaguuauccacuugaguuuuauucucuucuuauauuucaaucuucuaauaauucaguuucaauacucuaauagauugaauguauuaacagaaaagaaaguccagcuauuuguguuuagguguagguagaaaugcuauacaaugaugcugcuuuuuuacuaagaggucagguguaguauuaacuugucguccuuugccuuugccuuccuagugcuaggguuacaugccaccaugcugcucaggaaaaaacuauguaugcauauaucauguauaaacaugauacauauauguaaauauauguuacauuaaauguaguaaguuugcuuuuuugguuuuguuuguuuguuuguuuguuuucugagacaggaucuuaccuuguagccuuggccggccuagaguucacucuauagaccaagauuggccuugaauucagagggauccaccugucucuguccccugagaguugcugcacaugcccaucagguuguuuuaguguaaaaauauguuagagcaggaugaggggaaaagcaauggagucuacacucugauaagauuaaucuggaggugauuuguuaguagaagcuguggugagguuuggggaaagcaauugagaacauuaacaggcuggauguaaagcaguaaugggucaguuagguaaggcugucagggagcuacuaaggaaguucugacuuacuacuaguaguauaaggcaugccagaagucaagugcuagguugaaacuuggccgaaagaaaagcugcuuuguaucaaauguaaaaauuucagauuuuuguaguucuaaaauucagcacuuccuaauagcagaagaccacaugguucccuccuccccuucagcauuuuuuucuuuuucuuccacccuucuuccuuccucccuugcuaaugcacuuacuccaaaacccuccauccccaaaucuugguuuggagcucagcaugaccuggcauucauggcggcuccugcuuuagccuccucuaguccugagaaagcaggugugaacugcuaugccucgcuugccauugagcuauuaaggcgcugcugguucaaauugggucuauuuugguaguuagguggagcucauauggaaaucuaauaaaaugcauauuuauacagaguuagucaugcuuuauaacuauacuguauugcauuuuuuucuguauguaacuguggugugcuuuugagcuuuauuaacucauguucuuucaguuuugugacuggucacagcauugugugaaagguuauuuuccuagaaagaggaaguuaaggucaagauuaacaaggaaauacguccuauaauaauccuagaggcugaggcuagacgauugaguuugagguaauccugugagaccuugucuuacaaaaagguaaaggaguuagcuucuuuccccuuguuuggaaaacaaaagccaaaaaggaguauuauugaucaugaaaguggaacauguauuucacacucugcuuaugaucuguuuucccugcaauucauaaauacuguucauggaauuacuagggccuuauaaaauggccaaaaauaugcuuuaacagucaacugauaaauuggaaaacugaagaaaauguguguucagaagaaugauucucugaaggaauaacaguccaaaugaauaaucaaaguauggaaucauuaaaaacaaagugucugggguuuauuaaauuuaauuguagacuuauuuucuuuuguaagucaaguuaaaagaaaauuacaucauuaaaauuuugcaggucaguguuaaugggauguguuauaccauaauuucuuuucuuaccuaaacauuacuucguuuuuggcauuaacauguguguucuuccauguaggagaauauauaaaaaacuggaggccaagauacuuccuuuugaagacagauggcucauucauaggcuauaaggagaaaccucaagauguggacuuaccuuauccccucaacaacuucucaguggcaaguaagugauuaacaauuguuaauucacuguggguucauuuaucugcaugauguuauguggcagguguguguauggaucugagaaaccagcaugaaaguuuaucuacacuugauggaaagaaaugaucaacucuguaagaaauuucaacuccuuaugacagggacuuauaaucuuaugcagugcaauauaguuuacuguuuuucguauuuagaguugaauguaauauauuaaauauaauugcccacguacacaacuuaaguuuuuuuauauaaaauguaaauaaggaccuaugaucuggguuguaagauguuauccuccuuucugcauuaucucacaggauucccugucacaguguuugguuguuugucuuauuauauaaauguuugucuauuagaaaucauuuccugagauuauuuuauauuuuuaguuauauucauauuucuuaagacuaucuaaaaaaugcucauaguuuacuuagaaauguugucuuuguugaauuugcuuaauuaaaagguguccuugaugauaauaacgauuauuuucauuuucauauuugaccaagcuuuaaaugguuuauaccuacuuaucuaaguaaaagauccuccuguguuuauccagaacuagagcaguuucaaguucaaauuggcauagagaagaacuaggugcagucuguucuauggggucaaaauuugucauuagaugacucuuuuaguuggaugagauauguuggagaaagaagggagggggaauugaugcuugugaacauaauuaaauaaccaaaagauccaggaaagaaaacauuucuuaaguauuauaaaauucauuuuaucacaaaagaauuucaaacuuuauuuucaguuuuuaaaguaaagcuaaaagaauauggaauuacaaauaaucgaggaaggauacuauuuuucuaaaauuuuauccaaauuuuuaucaaaacaaauuuuauaugcaacauauuuugaucuuuaccauccuggauacuucucugagaacuuccuugggaacuaauuuaaaaaccuucugcauucauaucuguuauuucuuguguagagaacuuuuauuuuugaaaugaaaacuucuuaucauuauauguuauaaauacauauaugugcauacauauguguguauuaagaaaaacaguuuuucucuaucaaaacauguucauuauauauuagugguucuuguaaguaagaaauuaaucacuuugacaacaggaauacuauauuaaauuuuuaaauugcuuuaagacauuucaggcuaaaggaauugugguugaacauuugcuuauuaacgugguagaaauuaccuuuuaaacaguugucauguccuacuaaagaaauguccauuuuaccagcaauucuauugguuuuucugaaauaauuuauaaaagaacagaaaaaucucuaucugcugaucaaaaugcagcauuuuuugaccuuaugaaauuucacaccccaacaaguuuuaaagacauacuguaugucacagucugccaacaucugcucuaacacuuccacuggcagaggcugaaauaaauguguacuuguggagagagauccuauuuagugacugacagcuucuccauaagauaaauagcaguugacaucuguaauuuuuacuugcauaaccaaauacuuacugguacuugccucuugcagguaaaguaguaguugaauaccuaauuuucaggaguauuaccuuagauccuaccaugaguccauuaaguaaauaggaagcuaauucaaacaaaggaggagguauuauaggcagaagaugacaaugcuuauaugagggaucaauggaagaaaccggcauggccuguuuucuucgucuggcaguuagucccccacuugccuuggcccccuauggaauauuauucuuuaagaggcuggcgagauggcucagcaguuuacugcuaauggugguuuacagcauggguaauccugguuccaggggaucugacacccucuucuggccucucuggguaucuucaugcacauguuacacauauggacaagcagaugcacacacauauauauacauaaaaauaaaauuuaaaaauuaaaagaauuugaauagccuuuaaaauuacuacaagguuauguuaaauauuauauaucccauugauagcuacaauuugaggccucuauuuuucugcuaauuaaaaauguuccuauaucggcuggcuucuaagauugcuccauuuggcucucugcuuccuguggugauacaaguucuugaguuuggcuguccagcaaccauauaaaauaagugcaggagaucaugacuuuauuccuagucucuaguagcagagaaagacuaaaucacggagcucauggcuuagccagcacaguauaaucuguaaacucuagguucauugagagccuaccucacagggcaggguggagagugauugaggaaggugacaccuggcuucacacacaugugcacauauaaguacuaauguguauauguguguggucauacaugaacaguauacuuguauauggacuuuaauaaaauuuccaagagauagccuuuuuacucauuuggaaaaauuaugauaugaaccagaaggauuuuaaaauuuauuucccaauauucauuauauugauuuuucuucacuucuuaauaacauuguccaggcuagggguagaguauaugcuuagcaugcaugguuucagacugcaguaccagggagggaaaaaaaacccaaagcuuuuuauacucacuaaauauaccacuuaacuacuauuugauugaaacuacuuuugaugauuucucuaguggccaccucauauuuaguggugauggaaagucaacauuuuuuucuuccuaugucagcaucauggcuaaggacauuauaaacaaaagaaaauauauguagacaucugucuagcauuaauuuuauuuaauuuagacuuuggaaacuaagacucaaagacuuacauguuuuugugcuguagguacucccaccaaaguuucauuuuauaguccugagugaccuggaacaugucauauaggcuggcuucaaccuaacagagaccuuccuacuucaucaucccccaugaugacauuuaugacauguguauuaauguaaaaguagauaaucaugggaaaauaugauagguaauauggguaauauaaugguaauaggcuggaaaggacugaacauggccuguuaguugagaacuuucucuugaaaccuucagaguucaagauuguuucagaaauaggaaagacauuugucaaaggagagacuaagaccugcuuuaaaggaaagucagaaagucuuuacuagauuuaguccuggcucaggggaaacaagcaagaaaacauugaaaauggccuucuugcuuuuacguuuuccucaaaugccaagguaacacauuuggcuaaaauccuuuguuaagcucagcuuuaauuuguuuucuggauuggcuuugaguugcauuucauucuacugaccaaacuuuuggaaugguguugcccucugugcugucagguuccucuguguucuuauuugcaggaaguauaauuugguauuuaauaaacaucuagccaaggacuucacacuuuguacauuacgccugaaucuacaggauuauauuguuuauaaaaccuuaguuacaaacugugugccuuauucccacuuuuucauguauucagaccaggcugcucuccugagaauugugucauauuaauuucacugaaaauuauugccacccuauguguuuuuuagccuuuacuuuuccuaggcugaccucaagacaguugccuauuuuccuuuguucaguguuugaguucugucucugcuugaguagaaaucuuggucuguucccucucuuuugcuuuccuuuacaucuuuaccacacucucaauccauuccuaguucugcugauuuuauucuuauguucgaaccuauuauguaugccucgaacuauuuuccuggaaugacucacucucuuagucuuugaugcauacucuuaacuagauuucugcgucucgucugugccacucauguucuuucacuugucugucagaaggaucuuucuaaaauuacaucuuaacuaugccauucuccccaggaaaacucugccuuggaucuucauugccuacuggauggcauccagcuuccuuaauguuucauacuaggaucucuucaaucuggccgcuccuuucagcuccugcuccaugucucuucggcucugcaguucugcuucggcagugcugagcuguuuauaacuccgugaaaacuuugcugcucuucugcucuuugucuuggcuucugguuggcagguccucaucuucuauuugccuguguaauuuucuuuugucuaauuaauuuuaaaauuucuuuuccucauugauucauuuaaaacuauucuucugcuuuccucaaacugggguuuggugcauauguguguauguuuaucaccuuguuucuugguuaucugguucaugaauaauaugucuuacuuauucgucugaguuauucaagguaaaauaguuuaaucuuauagagucuacauguuaugacuuuaauaauuauucuugaauaucugaacgcauacuauguaaauuucuccuuuuuagauaagaaaaugaagccuuuggagucggugauuuguuuaagguuaucuuccuagauaaugguauuuaaauaccaggauuaaaacuaugugauucaaggcugaagagauggcucaguauuuaagacugcauacauacugaccugaguucaacuccaagcaccuaugucaggugacucauuccugcuuauaacuccaacucagggagagugacacaucuggcauccaugaguacuugcauucacuggaacauacccuccauacacauaauuaaaaagaaugauucuuuuauauaaaaaaaaaaucuugcaguacucugcugucauuuaaauguuauucuuuucccucccaucauacuaggaucuuauguuagucagugcauuauauacuuguccuguugugaaaacaugcauaaaagaagccacugaaggcagaaagauuuauuuuugcuccuaguuugagggguuuccugcauuagagguuaaucuuuuugcuuugagcucauagugagguacugguuuauggugaaaaaguagcacaguaaaauguuuuuucucaugaccagggaacaaaaggagaaaggaccagguucuuauaacaaucuucagggauaugguaccaauaaccaaaagacacaggucacaucucaugaaguuucuaccaucucccaagagcuccagacuaaaugccaaacauuuaaaaugugucuuuggagaauauuuaaaaucuaugcaagcauaccguuuucaucuucaauuuucauugauuuagaauauaaaaaucauuacuuacauuguugaguagccauugcauguagaauggaaauuuauaaaguacuaagggauguggauaacaacauuugaccuuuauucuaauuuguguuuaucagaucaaauauggacucugaaugaaguuaucuucaaaaagcagugaaauagaaauguaauuuaggaauuauuuuuaaggaugguauaaccauaacuaaaaauuaaaaguuaccaugacucauuucuguuagucauagauugagaagacauuguugagaaauacaugcacauugaguugaaaaauaccacuacaaacacauacugucacaugguacuuugaguaaaguaguuuuucuguccauuagccauggucucugauauuuuauaucuuuuuacugaauucuuagauuauuaaacuucaaagagggaaaaauucuucuauggaagagugaauaacugcccagaugucuuuagguucauccuguguuugcaaggucccuacuuauucuguauggugagaagcaggguaugccagcaccugucucaagaaacuccuccuacaagucugccuuaugugcugcaaauauuggucuauccugaaauugucucuuuuccaaaacuuuucuuuauucucuuuuauaaaugauaggauuucuacacuccuagcugccccucuuuuaaaugaauguuuccuaucuaaccuauuuuuuacucacauugaaaauagaaaauuaugguucuuaaaaccacccaaaugaucuuuauggcugaaguuagagucagauuucagauuuggagacaaauaaguucauggguuaaaucaaaacauauggagagagaaauuuagauuuagcauuuaucuuauauaucuagaagggucauuaacugucuagauagauaugaauuaugaaaauucagaauaauuaaauuuuaaaagucuguugaucauuuaguaucuaacaugguaccuagaggauuauaucauaguuuuuuuauauaggaauuugacauagacacuguauaguaucauuggauacauaguagaugaagagaaaaauggguuuaguggccaaaaugaauauuuuauuagauaguuucuuuauuuacauuucaaauguuauccccuuuccuggcuuccccuuugaaaaccuucuaucccaucucuauccuccugcuucuaugaggguguucucccucccacccauuccucccucccugcccuggcauuccccuacacuggagcauugaaccuucacaggaccaagggcuucuucucccauugauacccgacaaugccauccucugcuacauauguggcuggagccaaggguccauccauguguaaucuuugguuggugguuuaggucccugggagcucuagggggucugguugguugauauuguuguucuuucuaugggguuguaaaccccuucagcuccuucagucauuucucuaacuccuccauuggggaccccaugcucaguccaauaguugguuccaagcauccaccucucuauuugucaggcucuggcagagccucucaggagacaacuauaucaggcuccugucagcaugcacuuauuagcauucacaguaauguccauguuuggccacuguauaugggauuggauccccagguggggcagucucuggauggccauuccuucagccucugcucuuuacuuuauccccauauuugcuccugugaguauuuuggucuucuuucuugagcuucauguggucugugaauuuuaucuuguguauucuaagcuuuuaggcuaauauccacuuaucaaugagugcauaccauguguguucuuuugugauuggguucggaugauauuuuuuuaguuccauccauuugccuaaaaauuucaugaauucauuguuuuuaauagcugaguaguccuuuguguaaauguaccacauuuucuauauccaucccucuauuaaaggacaucugauucuuuccagcuucuggcuauuauaauuaaggcugcuaugaauacaguagagcauguguccuuguuauauguuggagcaucuuuugaguaugugcccagaaguaccugggucuucagguagugcuauauccaauuuucugaggaaucaccagacugauuuucagagugguuauaccagcuucaaaucccaccaacaauggaggaguguuccucuuuuuacacauccucaccagcaucugcugucuccugaguuuuugauauuagccauucugacuggugugaaguagaaucucaagguuguuuugauuugcauuucccugaugacuaaggauguugaauauuucuuuagguacuucuugaccauuugauauucuucaguugagaauuuuuuguuuagcucuauaccccauuuuuaacaggguuauuugauucucuggagucuucuugaguucuuuguauauauuggauauuagcccuuuauuggauugauaaagaucuuugcccacucuguugguugccguuuuguccuauugacaguguccuuugccuuauagaagcuuugcaauuuuaugagaucccauuugucuauuguuaucuuagagcauaagccauuggucuucuguucaggaaaauuccuccauaugaggcucuuccccacucucucuuauuaguuucacuguaucugguuuuuuauguggagguccuugauccacuuggacuugagcuuuguacaaagagauaagaauggaucaauuuguauucuucuacaugcuaaccucugguugaaccagugccauuuguugaaagugcugucuuuuuuccucuggaagaauuuuuauagaaaguaaaugccauggaacuuguacaagaagcaguauguaauaguuaucugguuauauucuguggugguagguguauaucuucaaacaaacaagcuaucagucagcucuuccugauaccagcuagcucaggucuucauuaauucuuccuggauuauguuaacagucuccuaauugguuucuuauguucagaaauucuuuucucugaaauacuuggaauaaaugcauauauaugucaaaaccaaguuguccaaauaccauuccuuuucucagacaaagaaaucuuagaguugaucuaucauuuuuaauauggggaagcggaauuauuuuuuuuuacuuauccauaaacauuuguacaaaauuuaaaaauuauaucuauguucguauauguacaccucauaucuuuucaguauuucuuuguauggcuuaauauucuauauuuuuguuuugguaguguuagagauggaaaccuugaugacgagcuacaccuaacucuccgugauguuuuauguaaauugcuacauucuguuaaguucaguacuaugcacauuuauaaguguuuuugcucugaguaacuuccuagaauacuuuauauacuuaaucuuuugaagauuggaugcauuuuuacuuguaguucugaggaaaauuuuagauagaugggaaauuaagucuaauaauagguuuaucucacuauaaguaguagaugccuauuugaaaauaaaacagaaaaugacaguguaaauuuagucaaauggcuuuugaagaagcaagucucuguuggauaaggacugugcauguuuuaacuguugcccuguauagucagaaguuccccuuuucuuuuuauaaucuuccagugucuuucugaagaaacucuugcuuacuauccauuggggagauacaaaaguaaguuguguuuuaaaucaccacuucuuaaaaaggggagacaaugugguaagaguuuuaagagaaagcaggccaggauugauaagcuccaggagcuuaugaucaaacauaccagaauggaagcaaacccuagcagaaguaguuuccuguauaccugcucuucucuaccacugagcuaggucgaucaaguacgaccaucuauugccugucuauaauagauggucugucuauaauuguucugaauuacuuucaaguacuuuuuaaaaaaauuauugguuauuuuauuuauuuacauuuuaaauguuauuccccuucccgguuuccccuccacaaaccuccuauccuauucccccuacccccugcuucuaugagggugccccucuugccucacugcccuagcauucccauaugcuggggcaucgaaccuucacaggaccaagggccucccauucaguugaugccagacaaggccauccuuugcuacuuauggggcugaagccaugggucccuccauguguacuauuugguuggugcuuuaguuccugugagcucucgggcugucugguugguuauuguuguucuuccuauggggcugcaaacaucauucaauccuucaguccuucuaauuucuccauuguggucccugugcucaguuugaugguuggcugcaagaaucugcaucuuuauugguaaggcccuggcagagccucucaggagaaaacuauaucaggcucuuguucucaagcauuucuuggcaucagcaauagugucuggguuuugugucugcacauggcauggauccccaggaggggcaaucucuggaugaccuuucuuucagucucugcuccacucuuugucccuguauuuuuuuuacacaggaauaauucugaguuaauauuuuugagauggguggguagacccaucccucauccaggggcugugccuaaccuuuggauauggucucuacagguucucucuccccuuuguuggguauuucagcuaaugucaucccuguuagguucugaggccucuugcuucccuggcuucugggacuuucuggugacuacccccaguuuaacuuaacuuuuuccuuguuuucucuucuuguguuccuagauagcaaccugguauauauacucuuugaaagugccuaucaugugugauaacauaauugacuuauauaugaaguuaaguuuaucauguguaguuagucuuuauagaaacagaaccgagagauugaaaaaaauauguguguguguguguguauacacacauauaaauaaauauuagaguagcuuucaggcuuuaauccagguagucauuagaacaauagcugacucacaauggauagccaaaaaucugguaguuguucaguacaugagacuggaugucucagguucccaaucuguugcaggagucccagagaaauccuagagaauugcaaggucuucagucuacauugaaaucuugaaccagagaaggagugucucagcaacaagaaagaugaacuuccuagugaaagugacggcaagcaggcccccccccccaaaaaaaagcuucuuuuuuccauggccuuuucugugggugucacuaaaaguuguggcccagguuuaggguagaucuuuccaccuuaaaugguccaguuaagaaaaaucccuccuaugugugcccagcugcucaguuuacuugauuucaaauguagacaaguugaaaaaucaagauuagccauaauccuuaagcucuagugaauauuuagaaaguuuuuauugagaguauuauauucucaacauuguaccuaguacccaaagaauuaaaaauggaagaaaccaaucuuuaaaaaguuguuaguaugugccauacccuuucagauacuguuaucucauucacuuguuacaggaaugcugugaguuaaauauuuuguuuccuauuuugaaaaggcucagaaaauugugugauauguuucuugguaguuguuagagccagaaauuaacuauaugaguagcaauacaaacaacaaauuauuuucauuuuaucauuccacagauaauagucaguggaucugaagaauuuguaauauaguagcaaaaauacuuugugacacuuggaauugguacuugacauguuucaugauuaaauucuggaguaaguuuuacaauuaaaauacaaauuuuaggaaaggggagauucauuagaaacuagaguaucgagaaaauccucucuggagauucagauucuuuagagaaauaguaauauuuuaaaagacaggcuggauucuaggcaaaaauacuauucuuuuuuuuuuuuuuuuugguacuuucuucauucacaucuccagugcuaucccaaaagucccccacacccuuccccccacccacucccacuucucggcucuggcgguccccugcacugaggcauauaaagucugcacgaccaaugggccucucuuuccacugauggcugaccaggccauccuaugauacauaugcagcuagagacacgagcgcggggggcacugguuaguucauauuguuguuccacccauaggguugcaguuccccucagcuccuuggguacuuucucuaccuccuccauugggggcccugugauccauccaauagcugacugugagcauccacuucuguguuugccaggccccagcguagucucauaagagacagcuauaucaggguccuuucagcaaaaucccgcuaguguaugcaauggugucagcguuuggaggcugauuaugggauggauucccggauauggcagucucuagacgguccaccccuucgucucagcuccaaacuucgucucugcaacuaaaaaauuaucagaaacucgggcugaauaucuucccuuuugaauaaauagguaugaaauucucaggaaugaaucagagcucaaugguaugucauuuccuguaaucuauuggaaaacuauuggagaaaaguguaucuuaguacaguuucuguguugaagcauaaugaccaaaagcaacuuggggaggaaaggcaucauuucacucacaguuacaggucaaaagcagugaggcaggagcucaaucagggcuggaaucaacacaggagcugaugcagaggcuauggaggaaugcugccuauuggcuugcuccucauggcuuguucagcuugcuuucuucuagaacccaggacuaagaucccaggaguggcacuacucacaaaaagcugggcccucccacaucaaccauuaauuaagaaaaugccuuauaggcuugccuacagaccagccuuaugggggcauuuucucaauuggguuucccucuucucagguuacucuagacugugucaaguagacauaaaauuagcccucacagaggaauaccugaaagaaagaaacgugccccuugaaaauaguuaaaggacugcuucagucaucccagauauuuguuuucccaaagucaguauuaggcccuaggaauuccauuaguuuaucuuguggauuuuguuuguuuauuuguuuguuucuguaaugucauugcuauuuauugugucauuuauuaacuuauaaaauaauuuuauugacacagauaaauguugcauuucaaaucccaccauaaagguagugcuuuuagaguaagcacuauuuuucagguguaguuuuuagcuuggaacagauauguaucucuugaaauguuucauuaauaaaacaaagcaaaucuuuuucuguaggguggugcuguaacauggguagagagaggaugggcguuguucaucaucuaaacugauauauaaaccaccagauaccaagucaacuuugauguauagcuaaggguccugguucuauuuucuuaucuuacuacuaauccuugucuugucuucugugaugcccuuucauauuugaaugcaaaaccgauucugcuuguugcuuuccaucucuaaucaguuaugaucugauaaaauuuauagaaaauguuugguugaacauauauacuuuuacaugauuuagucuuugaccauuucuuuucuguaaauuacuuugcaacuuaaaauuuuaguuucuagauaguagaggacuguguaugguuuuaaaaaugauaauuagagucuugauuagaugcccauuguaauuggugcuuuaaucccauuuuaaaauuuaauaauagggaacugggagauugaugggaguaaggaaagagcugacauuuaaaaaccuacuauguaucaauuguuuuacuuuuuauaauuauauuuaccauaagaaacaugacuuaaauauuauucucccccuaggagauaauaauaaagcagaucuauagagauuaaaauguucuuagaguuucaaagcaaguaacuguggucuaaugcuuagcuugaaaucaucuugauuauauauugaguuaagauuccucagguaaagaguagucaauacacacagaaaaauaugaucuugcagaucugauacaugguacauucacacauacauguucucaaaguauauuuugaguauggugagccuguuuaggauauauaagguaaaugccaauauaacaaucaggucuauugauuuuauauauauauauauauagcuuaauuugagcaaaugauauaacuguccugcaucagaauuuugacacaugcagaauaaagcagaggcuuuaaguccagugcuuguucuagucuuccuccuuacuucagcuugucuacugcuuagggcuucagggugacagcuuuuuccaguggggaauucaggaaagaagugcuuacaaucuucuuaacuaguuugucaguguuauugaucaauucuuagcauucucaucuaguauauaaagauacaucucagaguuggggaccacuucuaccugaggaaagaguaauggugaagaaaaguuacuaguuuguacagcuuucagcauugaucuucaaauuauaauggaagccacagcacagacaauaaguuuuagaggaaauaucaccuggauauucuugauaaauuauauaguucaacauuuuggcaaauuguauuugaguuucacauguuuguugcuucuccugaacuauuagugcuaaaucacugccuuagugucccccaaucccauaucugucuugauuugaaagaauuuguuauauuucuaguaauguuaaaugaggccuaaggccagagugaaaggaggggccuuucaaccucaggauuuagaaauaauauagagcaauuguuuuggguuggaaauaauacauaaucaagcagaugcuaaugggaaaaugcaaugcaggggaagagaaaagagauuggggugcuguuuggaaguuccauagaggagaguacauugccccuuuauuauaacaauguuucugcacuauaauaaggccuuucacugcaaguucagccuuuuucauucauuuguuuugugcucugcuuccucuguuacuaauugucagcacaauagucuuccaacuaugaagucucaguguccuuuuggaccaauuugucauugucuuuuucucucaccccaacccaugcacucagaaucuauuaccauaguugcauuuuuagauauuuuguauguuuuaaaauggcagugcuuuugaaacaugccaaaauaguucaugguaauugaaucaucgaacuagcaacaguuacugcuuccaaaugcauacugauagauucucuuucuauaggcuauucuuauaacuuaaaauaugcauauaauacauuuaaagcaauauuuaagucauuuugaacuucauuauagucuauauuauuugcagauuuaucguuuacauuauaaaucagucuauguuuuuguuacuuuacaaaauuuuaugucauuucaccaucaauaauuuuauuguuauagauaauuuuauuuugacaaaggaauaaacaaaauugucauagacugacagagcugaauagauucuucuauaaauuuuaaaaguaguuuauuugguagacuucuauccuagaauucacaaagccugagguucagccccaaaaccuuauaaaacugaguaugaugguacagggcuauauucucaacacucaagaugaucagaaguucaaggucauuuucagcuaaaaacuguuugaggccagccugggguacaugagaccuuauuguaaggaggaaaaaaagauauuaaacagaaaaaguacugaagguacuaaguugcauuuuguuauaucaucaaacuauacacuuaaacucauuguagauuacuuguuauauauauuaccacauuuuaaaguccagagcuaguauauuaaaaugaauaaauacagaguuauuguucccaauuccuuauuuuguaucuauuaaaugcuuguaacuauauuaaaauucuuucaguaaaggguugcacuuuacuuuuguguuugaauuauuauuucacaguaaauacaguucauuuuuauuagcaauuucaugugugcagaaaaagguuacuguggaacaccuaauacauguauuuauuucaugaaagguaggauauggugaaaaaauguuaguggugaaaaugcugccucucaaaauaugcuuugaguaaauagugauuuccauggcaaccauauacauuaaaaaauauuuggagagguuuaugauuuaaagcuucaaauagugucgguaccaaaguaguauucuaaaaugucagauuuugaaauacagaucauaaaagugaagaacaucuacaagaauagaaaaauuauauuaguauccugaucauaggcuccuaauuauuaacuuuguuaagcaauaaagaaugagaauuuauuuuauuuucuauuucuuugcauggaaaaauguauguugcuuuuguguaauguuuuuggcucaggaacaguaacuagaaaugugguucuggguguaggccauuuugggaaucaguuauucaucauuaguaaauaaacauguuuauuaugcaacguuauucaucauaaguaaacauguuuauuauguaauguaauuguuaauguauagcaugaauuccagcccugagaagaauccagagaggcugagucuuucuccuuggcuggaccuaaccugagaaacaaucaguaccaucaaccaagauucugcaagagaauguuccuucucuauucuuaccugugcagggcuagagccaggagcagauauccaaccucucuuuucugcaguaagguuagcaggcaaaaguucuuuucuuuguaaugaaaagguaucauagauggagagcaaccaagcucagagaaggaguaggaggggcaacaaaauggacuagaucuagucuuguuuucacauauuacucaguuuucauagacaaauuuucuagcacuuuuuuuuuuuucagaagaucuuagaauuuggauucagauacuauugagguauguguucaaacaguuucacgcaagcugugcauuuugaacaaauuuuuagauaguuugagccuuauagaugugcucauuuacaaaauggaggguaauuauacuguuuauguuuuugcuuuaagguggaaacauuuuagaaaccagacugcaacauuuggcacaauggucauuuaaugguuguucuggaauugauaucuauuggccacagacuuuaccuaucuucaguauauuacaacaaguacuuuuagaaugggauuguaauuagacaucauuucuuuauuuauuuaguggagagagguggugucaauauauagcccuggguauccugcaacuccuuauguagaccaagcuagccucaaacucauagagccccaacuaccacugguucuugaguaauagagguaaagauaugugccaccaugccaagccuuaguagaauauuuuuaaaaggauaaaaguaguauuuaaagauuaaaaagguugaaauacaauuuuaaaccuuuaaauaaaaacugaacagaugauuuauuguaauucccuuuggaaauauguacauauacauguuaauuggcuuucaaguuugcagaaaaauuagaauuucgaacaaacucaaucaucugugggucagaaugguguccaguaagcagaguguuugaaauucagcuuguaguugguuacucuggagagcuucacuaauguaguguaacugcuuaauguaagagccaguuuaacagagauuugaaaguggacgcucccugucuugggagaguacgauggacagugcuaaggaggacacccagugaccauuucugugcugcccagaucacagaggcacagucuaaugcaugugucauauauaccaugcauccacagugcuggccacaaaaauaaucugaaaaguuaguauuuuauggcauaagauuguuauuuuacagagcucugggagugcugcuuucauuuagguuaaauuuguuuuagguaggaugacuugucuauagauuggacaucuccauauauuuauuaguauuucaggaccuaugugaccuuuuauguuggucaguauuucaugaaauuaggaggccuaacauuuuauauguucauauuuauaauuauuuuaucuucuugauaaauuauucuuauuuaauguauaguggcuuucucuuuaucuuuuuugucuauuuuuaccaugaaguauacuucauccagcuaucagaauagcuauggcagcuugguuuuuuuuuucuguuugcuugguagauugucuuuuaccuuuugacucagucuuuggguccuuuuaccaguaagauguauuucuuggaaacaacagauagcuagauuuaguuuuucaauccugucuaccaaacugugucucuuuauugaugaguugagauuauuuauauuuuaaauuaauauuaagagauauuuauucauugugauaauuuugucaguuguuuuucugauuaguuggacuguuccuugaccuuuucucucccuuguuaauaaugggauguguugguuuacugcacugaacaugaugaugaguucuuuucuguugugaacuuugcuuuuuccaugcucuuaugauugagauggucuuucuguguuccauauucaugugaaaaccuccaguaguuucugcuggcuuaguggccaugaacugcucucagguguuugucuuuaaaugucucuucgucaaucuucacagcuaucuuugcugaauauagcaacauuccaugguucuuaacuuuuaaggauacuaauaagagaucugauauuauucuaaauucuaacauguuugugaguuggagguuuuuucccauaaagauuuuaauauuuuuuucuugaauugggauuuuuuuuuucucauuuugacuuuauuguguucugaagagauagauacccaugucugucugggguuuuaaacauuacucguauuuggauaucugucucuauagacuuacgaaaaacauuuuuaauuucuuaaauguuuaucucagagcuuucuuguucugaguuaauagauuugccccuugcuuacuucucaggauucugugaagcugugguguuuccguuuguuuaccuuuccuuauugacuuuaguuguaguucuuuguugacuuagcugcuuauaucuaauuugucuuacucugucuuuggcuugguuaggucuauuauugauagugcuuucugcucuuucuuucuuucuuucuuucuuucuuucuuucuuucuuucuuucuuucuuccuuuuuuccuuccuuccuuccuuccuuccuuccuuccuuccuuccuuccuuccugaauguuuuuaaaaccaguauuguugauuauuucccuccauuuuccuguucuuuuuguuuuuauuuuuauuuuucuuccuauguugcugacuuuacuuucugguuucaaaguuggauuugucugcuuguuuuuaauccucuuucauguuuuuauuuuuacugauaaucuuuuaaaaauuucauguuauauuuuuauauuuuaauauaguuugguaguugguguguuucuaauuguguugaggaaucuugauaccuuaagauuuuucauauuucuuauaauuugcuugucucuugguauggcuuucuguuaccuuuuuggggggcaaggagccgccccccccccccaaaaaaaagaggcagauacuggaaaugaugcaagcuuuugaaaccaaaagcccagcucuagcacaccucuuccaacaaggccauaccuucuaagucuucccaacugaggaccaagcauucuaagaagugaacauauggggacuaugcucaucaaaccaaucaggaacaggaugggcagaaacaggaaaagcaagauuaaauaaauucacaggggauugaaaagaauguuaugaagggauagaaaugaggagagauuaaaguugaaaaaaaaaaaggaaagaguaacgagugaugacauuuucauaaacaagauuauuuaaaugaacgauaggaaauaaagaagaaauuaaaaauguguuuguuaaucuaaugcauuaaaacaguauuaaaugggaaguggaagaauccugagaaagcaaaagaaaagaaggaaaaaaagagugaccaccaaugaauacauaaaaauuagauuaacauauaaaaaggaaugacaaauaacaugauauaaaauccacuagaaguauuauuaaaaguuuaguaaaaaugaaaaguaguauacaaagauuaaaagaaaaggugaaguauuggauggagcuccucucuguguagugagccaggugcauauauugggaggguuuguugaacuugaagacuuuugucuuuuucucuuguugaugcuguugcugauacuggaaaaguaucugaugucugcuagaacuaucuucacuucacuagcauccauccuuguucacgcacuaggaccucugcauaccguacuuaagugcagucuguggggcuaggcagguaauccuuuuauggagauacuaccugcuuccugguuuguaugcuucagggguggcuaauuaucuagcuagugaaugauuuauaaauguguuauaacuugaaaucugcucuaauacuggccuguguacaggcagaaugccugcuuuuguacuuucuagauagguggcuugugaguucucucugccugcugaccugcagccuggagcucuuaggcucucuagggugauucucaguuuaggagaucuggccagcacuuccucauuugauuagagcccuugcugcaucugcccuucuaauugccaguguugacauucacugcucaguacaacagcuuuaggccuuacccugggguuaaggccagucaaauuaagacucccuggucuauguuugcuuccuguguguugucucccuagaggaacucaacuuuuugguuuuaugcuuuguuuugccgaucuuuuaacaauuuauucucuuucaugaugguucuuuguuacugcccuucuagucauacagagcaauacaauggcacuucucucucccucugacccaucaccugaagaaaucacugucuuaucaagcccauaauugaauuuucacuugugagggaggguuacaggaucuuacuaagggcacccaugucuuacuuagcuuauuacuguuuacaaguggcuucugauuccuuucccuugugagagagacauugaacucuaauucauaccaucaaaauuagacaugugcuuugacaucuucauagauauucccuaacagaaucuaaucagguccuggcugacugauucuagugacuguguuuacuuaagaauuacaaacaguuuguugcuugagaagaucucacagugauaaaagcuacccuuuaaagauguuugauacuauaaaacaaugucuggugaacaagaaggggcauacuaauaaauaagugaaacuauagacauggaaaaaacaagucugugcucaaaaguaaacaaaacauuuauggaaugauuaugauuugauuuagacuuuaaaggauugguauugcuaugacaguuggugcuuuaaaauauaaaggguuaaaauaaauagguguuucugauaguaaaaguagagaagcaaaaguuaaagauacaggaaggaacaaggcuuguuuggggaaaacugaagagucugguuuagcagguugaaccagucagacugaagaugggcuccaaagaaauacugaggucagguugugaauaaccuugaacacauauuuguggaaagcuauuaaguugcuauguauuuuguuuagaauaauacuguguaguugucaacuauuuauuuaauaguuuaaguacuuguguauuuaaagagauacuuaauuuuauuuauagaaugucaguuaaugaaaacagaacgaccaaagccaaauacauuuauuaucagaugucuucaguggaccacuguuauagagagaacauuucauguagauacaccagaggaaagguaagagacuuguucauucuuauuauguuaaaacaauaguguaaagauguauuuguaucuggauucauuauuuguaauuagauauaaauauauuugcaauguguuacacuuuauuguucuguuucuguugucuugcauguuuaacuagggcuggaaaaugauaaaucacccuuggacuacuuuaaaauaaaguucuucugagaaaacgguacacaaauauuuuuuuaauugaacacauuuuauauacaagcuauauugugcuuaugugugaaauucaggauagaaugugguaguaaaauguuuccaguaaacugccuguaugcauguuaguuucagauaccaaaugggaaggguucugagauuuuugucuaaacuuuagaauauuaguaaauaauaggauugauuaguguaacuaaucaaucuucugugacucaugaacaacauuaugauacugaucagcucugugacauccaugaggcuauauuuccagucuugauaggcuguuuuuguaccuauuuugccacuuucuacuucuaucuuaauauucuuuuaucugauggccugguaaugaguuaggucuauuauuuuccuacagauguuauuauauuuuaucauaaucaacaacuuaguagaauauuaauagccuucuuuucuaaaugaauaacuuauucuaucaugcuucucuaagacuuuaaugaaagcaaaauaauccuuuaaaauccgaauaaaaugaacaaacacaaaaguuuuuguuuuauuuugaaauacucucuagggcuuuuuacaugcuaggcgagugcucuaucacugagcugcagaccuagcccucgccuuuuuaauccuaaaauauuauuuuaauaauacuuuugaucaauaaauugugauguauuuuaggaauauagaaaaaaauaacaguguggcauuaauaauauuuuauuuucuauacuugcaguauucuuuguuuugaaguguauacaggcuaguguguacaccuuucucaugccuaacucucauucaucuacccuaggcuuucggcacacugaguucuucauucacaacggagaccucaaccuagagcuguggucauaauagcucuugugucuuugaggucucagugucaaacagcaaguucccccaguacuuacccugauuuugauaggcuagguagauccucuggcuacacauuuauauagcuuuauuccuuuuuuuuuuucauuuuauguauauguauguuuugccagcauguuauauccauguaccguguuguauacuucccauagaaaucugaagaaaauuucagaucuccuggaacuugauuuagagacagaagguuguuagauccccuaggaguucuaggaaucaaaccuggguucucuggaagagcaggcccugcccuuaccacugagcaaucccuccagccccuuccccccagcuuuugaaauaaguguaucauuucuauuacuuuuguuugcuuuuuguaaacuucuugacagcaaagaucaauaucuuguuuuguuuuguuuuguuuuaaaaucuugaguucacaguccaggaugugaugacaagguguuuauuaggugauagauuaaugcagcgcucccugucguuggauuucuuugaagaauguuauuauaaauggauuuuuaacauuuacugaagcuugauugaguuugcccauuuuuacucccaaaguuggauauaagccauaucuuuuugauacgagguagaagggcuuagacaguaucucgcucugcaguccagguuggccugacacuuacuaugucacucuuguguccguccuucugcuuugacuccugagggcugagaugaaucugagaugugugguagacgacaucuacgccagcucuugagccucuaaaggccuuugacuuuccuucccuaacugucuacucaucugaagaaucaauuuucucucauuuauuuuuuuuuuaauuuuuuuauuuuuuuuaagaaaauggaaauuaacccauugaguuuacuguuagaguauguguuucuggagacuucauagagcucccaucuagugucaguaaggacuuagaggugucucaauucaaauccucucuaauguucuggccccgcucugaaauuuuuuugugugauaaacuagauggauucuuccuaugugugcuacuuuauuugaauggauaauuuaagauugggacauuuuuaaaaaguggugagucuaaugucucagaucguacuaacuuguuuuuccuucacaaucauuaaauuaugaaugugugggugugcaugcauaugugcuuguucauguguaugccugggugugcgugugcuuaugcaugcaugugugugugcaugccuguaugugcucaugugugugcacguguguguguaggauuuuagauuuuuauuuuguuuuuugacuuuauauuuucuauuguucuuaauaguaauacugguuuuaauuagaaaaacuuuauuaaauuuuuaacuugaagcaguuuccuguauuaccuuuuuuaaaaaaaaauguguuuagauauuuuacugcauuuguuuuuaaaauuaaauuuauguuaacuuauaguugaaaacauaaaauacacauauuaguggauaccaugucauauuuuaauauauguauaaauuauauuuaucuccucaaacuuuuauuuaagguaauuauuacaauugcauaguauguugcuaucuguggucuccugacuguacaguagcacaauguaauuuuuugcucccauccaauuguacucauauucacuaaucagucuuuaacuauccauuucuccccucuuacagucucuguagccuuuggccaucacugucuucuucaaacuuagaagaucaacacuuauauuccccauaugcaugagauaguaugguucuuucugugccuagcuuucuuagcauaaugaucucuaguuccuuucauguuguccuaaaugacagaguucuuuucuuuuuuaagagugagaaagauucuacuguguguauauguuacauauucuuuauucauucaucaguugauaaauacuucuguuauuucuaccucuagacugugugaauaguacuacaauagacauggucaaguuauugccuuuuugaaugguuaauuuaauucuuuuggguacaugcccagaaaugggauggcuggaucgugggguaguuuuaaaauuuuugaaagaucugccauacuccuuuucacagcaccuacuacugguaguaucauuaacaccugccaucaucuguuuucuuuuuuaauuggauauuuucuuuauuuacauuucaaauauuauccccuuuccugguuucucucccuccuacaggcacccuaucacauccucccuccccuugcuucuaugaagguguuccucuacccccgcacucccacauccccgcccucgauuccccuacacuggggcaucuauagagccuucauaggaccaaguaccucuccuuccauugaugcaugaacaucauuuauuuucuaaugucuuuaguagcuaggagugagguguugccucacuguggucugugacuuucauuugccugaguauggaaaugcugagaacaaucuuuuguucauuuuuaauuggauugcuugguuguauguuuuuugguuauugaguuguagugguuccuuaucacaaauuaggaacuaacuucuuuuacauccuuugugggggaagggugcauaaagauacagagcuucauuuugucaggguguauuucuagcuagccauugaacucuuaaggacuuugagagaaugagggaaaaauuuaaauuaaugguuucugaaauuuuucuaaauaucuaaagauacaaaacccaauaucagaaguucuauaacuugcaagugggaaaaguacaaaaaaaauuucuaugccaguaagauuguuaaauaucaaaagugaaugaaaaaaauaaagcuuuuuuucucaagggagcaacagacagagcaaaagguaacauaauagaaaaaaaaugauaugagaaaacauugaguaaaauaauaauuggggguaauggacuaauguacuuaacaugcugaaaccaaguaagugccacaaaacaagaauauguuccaagaauaaaaguacaauuaaauuuauuuuuaguuugaggcaucauugagauggcucaguagguaaaguuauuaaaaauacuuccuuaaaaaaaggaggcaucaaauuuuagggaaauaauuuuauccauagguaggaugugugcaaauaaaauuuaauugugguuucaauagcuuuuaacugaauuuuuauuuuuccauauuuucuuuuuauaaaauuuuauuuauuuauuuauuuauuuaacacuccagauuucauuccccucccgguccacccuccaacuguuccacaucccauaucuccuccccagcccaucuccacaaggauguuccagcaaucccgcagccccuaugccaccauaccuuuccacucucuggugccuccagauucuugaggguuaggagcaucuuuuuugauugaacccagaaccaacaguccucugcuggauauguguugggggcuucaugucagcugguguaugcugccuggcccaaugucugagagaucucagggguccacguuaaugagacugcuuuucccaaauucaaccacaggggucagcagcuucuguccauugguugggugcaaauagcuacaucugacucuuugggcuguuuguugggucuuccugacagaaguuaugauaggucccuguuagugaguacuacauggccucaguaacagugucaggccuccagagcucccuuugagcuggagcuggaucccacugugggccugucgcugaaccuucuuuuccucaggcuccucucuauuuccaucccugcaguucuuucagacaggagugcuccucuuucuucacauccucuccaacauguguugucuccugagguuuugaucuuagccuuucugauugauguaagguggaaucucaggguuguuuuguuuuguauuuuucugaucacuaaggacuuugaacauuucuuuagaugcuucucagccauucgagauuccucuguugugaauucuugguuuaguucuauaccccauuuuuugauuggguuguuugguuuuuuuggugguuaguuucuugcguucuuuauauauuuuguauaucagccccuaauguaugggggguuagugaaguuuuuucccaaucuguagguugcugauaucauuaauauuuuuaagauaauaguuuaauuauauuuaugagaauuuaguauauauauuuuaaucuuuugcuuuuuauucccaaucuguaaguugcugauaucauuaauauuuuaagauaauaguuuaauuauauuuaugagaauuuaguauauauauuuuaaucuuuugcuuuuuauucaucuacauaacuccucucagaucuaaucucccucuuccauacucaccucuauuuuguguacccucuuuucuuuagaagauaguauauagcaguaaauguccugauccucuggcuccuauagucauccaccuccuuuuuccaugauucccccugagccuauguagaaggguuguguugaaaauguauuaauugggguugggcacacacugauucguuuucuggauuuugacugauuguggcuuucauuaauagucuuuaucuguugcaaauggaaguguuuuugauaagggagacgugagagcacacuuaccuguuauuuuuaaggaugacuguuuagaaugcaguagaaguuauacugguuuaggaaaguaacaguaguagauucucuuguaagguucaggaccucaccagccacaaguaguuuguugaguuuacaauaccaggcacaaacuuaacuccuaaugaaugaaacuuaugucaauugguugucuguugguaaccacuacacugcuacuauuacaccuuucagaauauauucuucugguuguuauuguggaccguaggcauuacagcuagauaggaccauugcuuucuugcuuggcagcucacguagcuccuucuaguucugugggagguaguucucagggggugggcuuucauggcagaaugugaucgauuaccccaaacacuaugucuuaaguguguggugucuucacuaugguuuuaccuuccgcuguuguugggaugucucuuggacucuccuaccaauaguucaaaggagcuuuuccaugucuggcauucaagguuuuuguugauagucuaugggguuuuuuuggggggaggguuauuguuaccccaaaacagcuucaauuaaauuauguggguguguuuauuugaguguguagacaaacacauuaugugcauuauuaagugagcauaaaauaauacaguucccguguaaaugcuacuucugacacuaggauuuuagauuaucuuuagggauguuggaagagacuguggcuaugcaguagacauuauuugcauucaucccaaauuuuuugacagguuuaaaguaacuuguugucuucuguuaaugagaaauugaacucauuuuuauagagaagaguggacggaagcuauccaagccguagccgaccgauugcagaggcaagaggaggagaggaugaauuguagcccaaccucacagauugauaauauaggagaagaagagauggaugcgucuacaacccaucauaaaagaaagguagauaauaaugaugacuuguucucccaaguaaacucuuauaugcugaaagccauguuugagagagacaucagccaacuuucauauuguauguauaacuuugugaaccuaaagugccuguugcuuacaacagaguaauugaccagcacuuugguccaggauguuugugggacuuaggaaggagugguaacugauguacuuuauuaaauaacauuuuaccuuguugguaacagcauuuuggaaacuuggaaaucuuugcaaccccauaggaagaacaacaauaucaacgaacuagaccccucagagcucccagggacuaaaccaccaaccaaacaguacacauggagcgaaccauggcuccagcugcauauguagcagaggauggccuuauugggcauaaugggaggaggaggcccuuuuuccugugaaggcuccaugacccaguauaggggaaugccaaggcagggaggcaggaguggaugguugggugggugggggagcacccucauagaaacaggggggagggagaugggguaggggguuucugaagggggaacugggaaaggggauaacauuugaaauguaaauaaagaaaauauccaauaaaauaaaagaaaaaagcaagcaaaaaagaaaaacuucaucuaaacuacaaaacuuccuuaagggagacaguguaagaaaaucaggaccuuguuacuugguucuccuuugugaaaaauaauuuacguacaugacuacaaagaucacuuggcugguguaauucaaacuuguaaauaaaaggacuuuaaaaaaaaaaaggaaaaauggcucugugauuucugaccugugcuuucaaccuuaacgaaagcuaccuagaaagugagaagucuauaaauaccuuuucuuuuaauugcugcucaugagccaaugaagaagacaaacauaaccuuuuuccccucagugcucuagauuaguauauaauuuuauaggaauuguaaauaauauuuuucauuauuacaaaguuuuaaaauaauuuuuauguaauauaugauauuuaaaacuagucuaagggguugcguauuugaaaauucugacauaauaagaaaaaauggccagaagcugcccagucuguaaccugauaauugguaguaagucacaacaucauugacaugugcguguugaauauauauuugcuauuuacuuaguaguuuauauucagguaggggguaaaaacuugcuuaaaaaguauuaucaauuauguuuugugaguuuuguuuaauuaguuaauuuugcaguauuggaauuuugaauuuaggaguauguuaaaugcuccuaugccgccaaauuccaccacuugauguuaguguaguggucagaauuccuuucaaguuaaauugccuggguucaaaaccuuucucuuuuuauuaaucauuuuauucauuuacauuucauaugauauccuccuuuccaguuaccccuucuccaacccccaucccauccaccuuucccccccuccccuuugccucaaugagggugcuccucuacugcucuagcaucuccuaugcuggggcaucaagccuccacaggaccaagggccucccccacauugauaaggccauccucugcuacauauguaucuggauuccuggcucccuccauguauacuacucugguuggugguuuagucccuggaagcucuagguuguccaguuaauugauaucguauaugggguugcaauucccuucagcuccuuucguccuuccccuaucucuuccauuggggcccgguugccugugaguaucugcaucuguauugguccagugcugguagaaccucucagggaacagccauuccagcaaaugcuaucuugacaucagcaauaguguggggguuuggugucugcagacaggaugaaucccuaggugggguggucucuggauggccuuuccuucggucucuguuccauucuuugccccugucuuucuuuuagacaggaacauuucuggguuaaaauuuuugagauguguguucuucacaugcugucagugguuuuagugaaaugauauagucacaacuuugagaauuaauucacuaugugaaguuuuuucuuuaauuaaaauaucauucuguacuugaugcuuaugaacacuuucugucuuuuuauuuuuaauuuuccugcacuuuauuuuguaugcaauauauauauaucuccuuugaauagauacaucuucucucuuguggugguugauuggaguagcugagucauuauuaauugcuuucucagucaggaagaugaacauaaccuaucuuuacccauuuauucacaugagaaauuuucuuuugcauagauaauaucuaacuugaagauugagugugauaguaaauaugaaucaaauuccccuuuaucucauccuuuagguggaacaacaauaugaacuacccaguaccccccagagcuugugucucuagcugcauauguagcagaagauggccuaguuggccaucaguggaaagagaggccucuuggucuugcaaaacuuuauaugccccaguacaggggaacaccagggccaagaagugggaguggguggguaggggagugguggggaggguauggggaacuuuugggauagcauuggaaauguaaaugaagaaaauaccuaauaaaaaaaaagauaaaaaaauaaauaaauaaaaggcaagcuauaccagcucuguucugucuaauuuucuggaauucuaaauauaugcuuaacagaucaguaagauauuguuaaaccaggaguugaaaaugguauguuaguaacauuguaacuuaaucuacuacaucugauggaugggaggauauuaaauauaaguauagacauuaaucaucaaaaagaaugaauagagaugcauuuuagcaauauacaauagugaaaauauauaaaccuauuuuuuuguaaagacugauuauaaauguuaauaacugaaucauauuuuuccuuuuuauaauuacuaaguugaaaguaauucaucauuaucacuaauugccauuaguaagcaucuauuuuaugcuuuuuuaugguagacuuugagcaguacuuuugcacuuaccauuuaaaagucaucugagguaugucuacuaaugugcacuuuuauaguugagugaucugauaaaguuaaauaucuuacucaaauauccaagucuuuuaauuguacauuauguauaacuucacuguguacacuauguaguauuucuuuaguucauauaucaguagaagguuaacauuguaaaauaguaguagaaugugaaauuccugaguuaauaccuggguagaauuucugacucauccuuuagcuuccucauuaccaaaauggggauaauuacaguaucuaacucauaggguugugaguccuaaacugaggggcauauuuuguauuuauguauacuaaauauagaaucaguuuugaugguuauaguuagcauccugcuuugucccauaaaacuaacuaagcaucuuucuacagguugucuuagaauuauuuacuaaaacuugauuuuaaaaauaaaguuuaggaccucacacuuguuaugugaauccucaacuuaguccccaucaaaauuuuagauauguucgaaguugucucgaguauccuugaacccaugcuguuauccauauuggcuuuaacucagaaaacuccugacuuagcuucacaaguacuugagaguacaugucuccauuacagacugaucugauagaaauauuuucaauauauuugugauuugaggucuuaaccauauauaauuuccauacgugugugugugugugugugugugugugugugugugugugugugugugaauaauuuuagauguaugugguaauugaaaauacuuuuaaauuacaggaguauauagaagguguuuauaccaagggcugcucuauaaugauuccagugauuuaaagugguucaguauaaaguggucuuuguaugugacaaccacauuuagaacauuuuggguaugugacaugucauuuuuagugcuuuuagauaaaaaauaaagaggguacuuauauauaccauguugaacaagaaaaucaauuuauggccuaauuaugagccuuuuaccuauuuauuguuauagaaguacuagaaacaauagcagcaugcuauuucuuaugguuuuguugcuagcuguacuauucugcaguucuuacauagaucuucaaauacauuauuuuaggcugcccauguucuggcccugaaaaauccaaagaaaacuuucuguuaugucucaggguuugguguuuucuuuugcacuugguaccuaucuaugugguucugcacaguuucucugugcaugugauuuauuugccagggucucaguacauagucuuucccucccacaagguagccuuagcuuccacacagaaagaaagcugucucuugagaguuccuaagagagagaaaacauuaauccccaggccuaaaggguaguucuauagacauuuaaucaaagacaauuuaagaauugugcaucugaaagaaaauggaagauugagauaagguacuaggaagaagaaagggaauggggaaaauuauguauuuauaaucuuucuuuaaaauuuauuaaaaaugccacccagauagaaauugagagugggggagggagaaagggagagaaaggguaggugugagacagacuacuacuuacugggaaucagacagccaucuuuggagucucuuacguugguccuuaacaucugaguuuuuaaagcuguuaguggaauuaaaugucuaguuaucuauuauuuuucuaaauuacuguauuuguaacucuucuacaugugggcagcuauaugccugaauuuuaguugaauuaauaaguauacauuacuuauaucuuuuugacauuuacuuuuuccuuugaacuacauauguuaagauguuauaauuugacauuuggauaaauuaucaaaauuuuuggcaagagguauuaaaauuucauguaggcauucauuuaugaaauauuuaaaauuuuguaaguagguacaugaagggcaauuaacuguaguuuuacugcaauaucuuugucugguuuuaauaucauagugugaauugaacaguauuucucccauuucaguuuucaggaagagcuuguguagaauuggugccuuuuuucucgaaaugguauaggcuuuuccuuauuguaaaaauguaauauaaauucagcucuuacacggagcuguucagcuuacuuaauacuuccucagagagcuuuuguaguuugaggguugcucauuucaucucaguguuccucacuaccauagagcuguuuguucucucauggucucuuuaaugccuguagauucuguacugaugucaccuuucucaguucacguugauaaguuuuaucuuuguguuuaucuuccugaccaguuuaccugcauguuuacagguuuuucuuguuguuagguugauuuauuuuuacuccuuucuccuauuuuuucgaaaacuuuuuuaguuauauuuaaaacuguguuuuugaauaucacuuuuucugagguagcaccacuuaaagcaagaaaaccugagaacuugaaaauauuguaauuuuaaaaaaaaucuccugucacuuuacuaauaguguaacugauggagaaauucuagguucaaaauaaauucuauaaacucugaaaauuacauaaauuauuuuugguaucccagauugcugaagagacagucaauggaaguauguuuugguuuguuuugguuuuuuucucauuggaaauuggucuagaaauugguaggaacaguaucaaguguauggugcaaguuuauacagcaaguaauauucaacuauuucaucaugguuuucuaauuuauauuuuucagacgaugaaugauuuugacuauuugaaacuacuagguaaaggcacuuuugggaaaguuauuuugguucgagagaaggcaaguggaaaauacuaugcuaugaagauucugaagaaagaagucauuauugcaaagguaacugauuguaaaagccagugaauuaauuuuucuguagugugaaccugcauucauucuuauaaguggcgguauagguauuccaugaaauaaucaagguauugauuauaaacuaucaauuuuaagguuuucaguauaguguuauguaaauuauggugaaacuguuauucucuugugaaaauauuuucauuguaaauuuagaggaguuuuuaaacgauacauuugugauccacauuacuauuuuuucauaguguauaugugccauauuuucauuaucuguucauaaguugaaggauauuuagcuguuuccauuuccaggcuguuaugaauagaacagaaaaugaaccuggcugaagaauaucuguggaaugggcuguugaguccuuuguacacauaauaagaaaugguuuauguggaucauaugguagguuaguuaauuuuuagcuuucugaggacucucccauaaugauuuccaaagaggcucuguccauuuacaaucccaccaacuaugagugucuccccuaugcucauguucccuccagaauuuaucuguuggcuuguugaucuuugccauuuugauugggguuccaugaaaucucaaaacuguuuagauuugucuuucccuaauugauagggacugacaaaauaucuuaacauuuugaaccaucuuagacacuuuugucuuauuuugagaacacuuuuuuagaggucagguccauuuuucuuuugaauggaucauuuguuuuuggauagauugauuuuuauuucuuuaugcauucuaguuauuaauccucugucagcuguauagcuagcaaagauuccaauuuguggcccccucuuaaccugauugauuguuucuuuaguuaugcagcagcuucucaauuuaaugaacucccacuuauuaauugauggcuuuaauucuuggauagagggaguccuauucaggaaguccuuuccuguaccuguaucuacauuuaccuuuuucuuauaccaguuucauuguuucagguuucacauuuaaguuugugaaccauuuggagauaguuuuuguacuaauugcaaucuucugcguguggacauccaguuuccccagcaauauuuaaugaagauuuauuauuuccuagagcauguauuugucaucuuugucaaaauuaaaugacugaauuuacacauacucaucuguuuguguucuuaauccuguuucaaugaucuauauauuuguuuuugugccagaagcguauugcuuuuaaauauuuuauuuccuuugaggcugcugugagaguauauccaugaccuuguucucuguauacuugugguugguguacagaaaagcaauugaucuguacaaguugauucuuuauccuucaucauugcugaacuuguuuauuauuucuaguggguuucugguagaauuuuugguauuucuuauacaguauuaugcugugugcaaagaagaauguauuagacauuuuuuuuuaauuuuggaucuuuaauuuucuuuucuugccuuacugcugcagcuaauacuucaagcauaguguugagaaagaguggggcaaguucauaucucagugucauuccugccuguagugguguaaccucaaauuugucuccacuuaggacauuauuggcuguggguuuuuuauuuacagcucucuuagucggaguuacuauugcuaugaugaaaugccauggccaaauugcagauuggggggaagaacagaauggggaaacaucauaguccauccaugaacaaaaucaggacaggaacuccagcaagacuggaaccuggagacaagggcugauggagaggccauggaggauggcugccuuauugguuuuuccacauggcugcucagccugcuuccuuuuagaccccagcacuauauauagcggaaggguggccucacccacagugggcugggcccucucacaaaaaucacuaauuaagaaaaugcucuacaggcuugccuacugccugaucuuagggaagcauuuucucaaucgucucugaugacuaacuuauaucagauugacacaaaacuaagccaggacaguagcuuuuauuauuauguugaaguacguuaccucagguccuaguuuuucuaggacuuuaauuauggagucauguuggauuugaugagaggccuuuuugcaucuuuugagauaauuguggauguguuuuuguccuuaaguccauuuaugagguuuuuaaauuuccuuuuuaaaaaaaaaaaaaauugguguuuuuagacaagguuucucuuuguuagccuuggcuguccuggauuuuacuuuguagaucuugaacucagagaucuaccucacuagucguguaccugugucuauugacuacauuuauugacuuguguuacgugcaacuaucccuacuucucaaaggcaacgugcuaauaguugauaaucuucuugacuuucaaguguguauuugguuuguaaauagauuauugagcuuuuuaaaaaucuauucauuagggauguuggucucuaguguuugcggggauuugcugauauuuuucuuugcuugguuuugauacuagagucauauggucacauagaagaagcuuggaguguuccuucuguuucuauguguuuuaauaauuuaaggauuccuuauauaucuuugauaguagaucuauauaauagaauuccucuauccgugaauccgggccugggccuagacauuuuuaguugaaagccuuuuuguuacuauuuuaaucuucucauguguuguggauuuguuuagguuguuuacuucuugcuuuaauuuuggugguuugguugaaucuagaaagucauccauuucuuuuagguuuuccaacuuaaugaaaugcuguuuuuaaaaauauucccuuaucuuauuaaauuccuugguaacucuuuaauguuuucauguucauuuuugauucuauuaauuuggguuuccuuccuuccuucuuuccuuccuuccuuccuuccuuccuuccuuccuuccuuccuuccuuccuuccuuccuuugguuaguugguccagaggucuguccauuuuuccuaucuucucaaagaaccgguuuuuagauucauugauucuuuguauuauguuauuucuauuuuuaaguuucuccuuuuuuucucccuuauuucugauugucuacugcguuuugauuugguuugguuuuguuuuucuaaauuacugaguuguauccuuacgucauuguuuucugagcucugacuuuuuaauguuggcccuuuugggcuauuucucugacaggguugcuucuagugaguacuagagguauccuguuguauuuucacuuucuuuuaggucccgaauaauuuuuuucuuccuugauuuuuccuuauuggaucauuuuaucuuucaguaauugguuguuuaaucucugaguuuguguauagagauuuguuugguguaugucacacaagauacauggaguuaguccaguuuuucugaguauauaaauacuuguuuuguacaucaguguguagucugucuuagagaagcuucugugugcugcugaggagaauucauauucuuuaaucucuuucuuuauuucuuccuugaucaaaguaucauugagcagaguguuauucagcuuucucgagaauguuggcuuucuauauuuauguuauugaagaucagccuuaguccauggugaucugauaggauacaugagacaauuucaauauuuuuguaucucuagaggccuguuuugugaccaauuauauggucaguuuuggagaagguacugagaagaagguauauccuuuugcuuuaggauaaaauguucuguagauaucuguuaaauccauuucucucauaacuuguguuaguuucaaugugucuauguuuaguuuuuguuuccaggaucuguccaaugaugagaguggagugcucaagucucccacuauuauugugugaggugcaauaugugcuuugagcuuuacuaaaguuucuuuaauaacuguggcugcccuugcuuuuggagcauagauauucagaauugagaguucaucuugggagauuuuaccuuugaugagcaugaagugugccccuccuugucuuuuuugauaacuuugaguuggaagucgauuuuauucgauauuagaaucgcuacuccagcuuuuuucuucggaccaugugcuuggaaaauuguuuuccagccuuuuacucugagguagugucugucuuugucccugagguggguuuccuguguacagcaaaauauuggguccuguuuguguagccggucuauuagucuaugucuuuuuauuggggaauugaguccauugauauuaagagauauuaaggaaaaguaaucauugcuuccuguuauuuuuguuguuagaguugggguucuguucuugcggcugucuucuuuuagguuuguugaagaauuauuuucuugcuuuuucuagggcguaauuucuguccuuguguuggaauuuucccuuuauuguucuuugaagggcuagauucguggaaagauguugugugaauuugguuuugucauggaauaccuugguuucuccaucuaugguaauugagaguuuugcugguauaguagccugggcuggcauuuguguucucuuagggucuguauaacaucuguccaggcucuucuggcuuucauagucucuggugagaagucugguguaauucuaguaggucugccuuuauauguuacuugaccuuuuccccuuacugcuuuuaauauucugucuuuauuuagugcauuuguuguucugauuauuaugugucaggaggaauuucuuuucugguccagucuauuuggaguccuguaggcuucuuguauguucaugggcaucucuuucuuuagguuagggaaguuuucuucuauaauuuuguugaagauauuuacuggccccugaaguugaaaaucuucauucucaucuacuccuauuaucuguagguuuggucuucucauuguguccuggacuuccuggauguuuugaguuaggaucuuuuuuggauuuugcacuuucuuucuuuguuguguccaugcuuucuauggaaucuucugcaucugagauucucucguccauuaucccgagcuuuuguccccgcuggcaagaacacacucaggacaaccggaaucuucuguggcaaagcuuuauugcuuacuucucaggaagaccccaaccccagaaaauggagucgcuuauauagccgccaacgugacguuucagcaccugauguggcgugacagcuccugauucguugcucgcccaucaccccauuacuacgcccugagaugggcagugacuaggagugaguucacacucacaccugcguacaaggcuuguuuacuaguuaggcacagcugaggcuagcgccaucuuauaauggugauugcucacggcucgcaauugcuugcagcacggcucuccacagucuaucuguuauauucuguugcugaugcucgcaucuaugguuccugauuucuuuccuaggauuucuaucuccagaguugucucccuuuggguuuucuuuauuguuucuacuuccauauuuagaucuuggauaguuuuguucaauuccauuaccuguuugguuguguuuuccuuuaauucuuuaagggauuuuuguguuuccucuuuaaggacuucuacuuguuuagcaguguuuuccuguaauucuuuaaaggcuuccaccuguuucgcaguguucuccuguguuucuuuaagugaguuauuaaaauaacuccuaaagucuucugccaccaucaugagauaugauuuuaaaucugagucuugcuuuuuggguguguuggcauauucaggacuugcugugguggccguacugaguucugauggugcccaguggucuugguuucuguuaguaauauucucacgcuugccuuucacugucugguaaucucugguguuagaugaucgagcugucucuggcuggagcuuguuccuccugugauucuguguaucagcacuacugggaguccgacucucaccugggucccaguggucagagcacucucugcaggaaagcucuccucuugcagggaagguaaccagaagucuggagcucagauccacuuuuugaguacugggcucaaagcccucccuguaggccgacucuccuuugucaaggaaggugcccuggggucugggucucagcucugccuccuggcugaggaugaaggucagaagggauccuguccaagaagcucuguugcuucugccaccuacgugcucucaagggauccaaagguccuggguaugcuaggggcccugagguguggagaguccucuggggaccuuggacccuccgcuggguuugcucugaagauggcuuggggcuggcccugacuggaaugaauccuagccucugcucaggcaggguuccuuuguccauguuccuacuggcacaagacccuccgggauucuuuggaacuaugauccggaggcccuggguguguuagagguccugugguguggagaguccuuuguggaccuugggagccuccaccagguucgggccuccuuugaguuuucuaguugguuuacuaggcuuuucuagcccaucuuuauuacagcauaaguccucuucaauguuucuguaguuuuauuaaauuuccuuuaaaaagucuggauuguuuuuguguuuucuaccagccuucuauuuguguuuuccugggcaucacucauguauucuuuaaguucuuucucuuuaaauucauugagcuacuucuuuguaucuucuguaaguuccuuaaauauuuaaauaaguguaugacuguucuuuuaaguucuguguccuccagguaagccucauugagacauacauaaccuuuuuauuuaaaaaaaaaaacaaaaaacaacaaaaaaaaaaaccuccuaaaguagguuuaaaaaaucuugagaggaggaauuaagaauuaauaaaaaaaagagaaagggaagaaauauuacaaauuggauuggaaucuaguuccuuacccaaacuuucaggagggugagguuagggccaugguuuaagagcuguaaaaguauaauacgccuacaucagaagcaagcaggcaagugggacuagguugcuaauacauggcauguggagaugauaaucuuuggaaguuacugugcuuuauuuaaaacugugugaguucugcccuccugcucuuccguccauacuuacuucaucuccuucagucucauuugcugccgugcugggaaagaggaaguaaaugcuuucagacacuguauaucuuuuuuuugggggugggggggaguucaagacagggcuucucuguguagccuagacacuguauaucuuaaugccggcuagaugugauagaauuaaucaccagaccuauugucaauaugcagaaaaccaugaauagaacaaggagcuauuugaugauagaaggcagucuugugaaauagaaaugacaauuauuauuggagcuagauaugaauuauuaauacucuuucaucugugcuugagaaauuauauucugugaacuucaauuuacuaagauaauucauaauccuaaacccaagugucaccuuugggucuuuguuaauaguguaaacauguuuuccuguuuuguuuuuacuuaaugugcuauuuuuguuuuucuauuucucaguagaaacagaacugucauaaaacagugagcaaauuaaggcagaagguuaggucauauaucuuggagggugagugauaagauuagagagaaugauugcccuccccccacccccgcccgacuucaggaaauagucuaccucugaagcuucuuugaacggaauuugacuuaaagaguccuuaguuaguauuucaggguggcugaauauauggaagucuauauuucaaaggcaauuuuaucagaacguuauucuucagaaucuuaggauuucuaaaauucuccauuuguaaucaucauuagcaaauaauuuuuaaauaagcauuucauuguuuuagccauaaaauuuucucacuguuauuuuuaauuucuuguuuugacaugcuauuuuuaacuguaauuaaaaauuauuggcaucuguguuuauuucuuagcuuauauguaccauaucuucauagaaaaacuaauuaguaugugaaguacaauaccauuaaauuugcauuaauggaaaauuuucugaccuuaaauauaaauuaugauagaaaauacauuuuaauguauuaaagauugaucuagcuuauuaccucuuauuuauaugaucauaacaaauaauuuucuuaccucuuaucucuauauuucuuugcuuggcucuguacauguuaaauugauugaagaauuuaaaggagggaaagucacaaaauuucauaaaauuuacaaauuuauguaauacuauguggaauauuacgugaaauauuauguggaauguggcuauaguaccaaaacagaaugaaauauuacccauuuuccuaaaguaccagauuauaauuuuccaauguuaaauugguuugcuguuugcuacuguuuuaauauuuuucuaguuacagacucagauuacuuacccacagcagguguuugcccuucaggaaauaucuuucuugcugcauauaaagacauauuucuuuugauuuaccuuuuuaauuaaggcauguaauuuuuagaauauuucaguuccuuuuaaaccuaaaaauaucucaaaucaccccauuggucaauggcaucuugacuuuaucuuggguccuuugaugguccucuaagguuucuuuguguuuuacuguacauaccaggggaguacuaguaaacuggacaggucagguuccaucaugugaaccaccauucccugccaaacuuacauuuuucaguagcauugauuuuuuuuuuuccuuuucugucucauuuauaauagcauauaaccccaaauugguuaguuauuuaucuucuucacuagccugugaaaucugugaacaaagaaaucuuuuuguaauaaagcagccuuauaccuguaauaucauuagcuuuuuuucuuuuaaaaauuauuuauuuauguuccagccauugcacucuccucccagaccucccacccccaucccacaauccucaucccacuccucugcccccuugccucugagaggguguucccaucaccagaguucccccuucccuggggccucaagucucuuaaggauuaugcucaucuuguccuacugaggcuagaccaggcaguucucugcuauauaugugccagggagccucaaaccagcccaugugagcuccuggguauucucuagggcucagucucugggagcucccugugguccagguuaauugagacugcuggucuucccaaggggucgcccuccccuucagcuucuucaauccuuucccuaauuaagccauagguguccccgacuucaguucagugguugaguguagauaucugcuuuugucucagucagcggcuggcugagccucucagaggacagucaugcuaggcuccugucuucauucuauucuccauuuuuguuccuguaguucuuuuagacaggaacaguucuaggucagaaauuuugaccauggguugguaacccugucuuuccucaggaggcccugucuauccuagguauuuuguacuuuuuggcuaauauccauuuaucagugaguacauaccaugcauguccuuuuuggucuggguuaccucguucaggaugauauuuuguagguccauccauuugccugcaaaaaucauggugucuuuuuuuuuuuuuuuuuaaauagcugaauaguauuccauuguguaaaugaacuacauuuucuguauccauugagguugagggacaucuggguuguuuccaguuucugacuauuacagauacagcuguaaugagcauaguggagcacuuguccuuguguuauggugguauacucuuuuuuggguauaugcccaagagugguauaguucgaccuucagguagaacuaugucuagcuuucugaggaaccaucagauugauuuccagagugguuuucaccaguuugcaaucucacccaaaauggaggaguguuacucuuucuccacauucuugccagcauguguuguuaucugagggucauuuugauuugcauuucccugaugacuaaggacuaaaguguuucuuggccauucgagauucuucuguuguaaauucuuuguuuagcucuauaccccauuuuuaauuguuuuuuuuaauuuggagguuaacuucuugaauucuuuaauaucuuuaauguuagcccucuguuggauauaggguuagugaaugauuuucccaaucuguagguugccaguuuguucuauugguggugucuuuugccuuacguaaguuuuuuuaguuuccaugaggucccauuuaucaguuguugauaguaagauccugagccauugguauucugcauaggaaacuucguucugugccaaagagucccaggcucuuuuccacuuucucuucuguuaguuucaguguaucuggcuuuauguugagguccuugauccacuuauacuuuguggaaggccauaaauauggaucuauuuucauucuucuauauaaagacagccacuuagaccagcaccauuuauugaagaugcuuucuuuuuuccacuguauguuuuuggcuucuuugucaaagaucaaguauccguagguguguggguuuauuucugaaucuucgauucuauuccauugguugaccugucuuucucuguaccaauaccaugcagucuuuaucacuguugcucuguagaacagcuuuacaucagggacggagauuccccccagcauaucuuuuauuguugagaauuguuucacgauccuguauuuuuuuguuuucccauaugaaguugaaaauugcucuuuccaugucugugaagaauuguguuggaauuuugauggguauuauauugaaucuguggauugcuuuuugguaagauggccauuuuuacuauguuagucauaccaauccaugaucaugggagaacuuuccaucuacugaggucuuuuuaauuucuuucuucaggaauuugaaguucuugucauacagaucuuucacuuguuugguaagauauuuuauacuguuugugacuauuguugaaggguguuguuucucuaauuuauuucucagccuguuuauuauuuguauaaaggaaggcuacugauuuguuugaguuaaauuuauauccugccacuuugucagcuguagcaguucucugguggaauuuugugggguugcuuauguauacuaucauaccauucaaauagugacguuuugacuucuuccuuuccaauuuguaucuguuugaucuccuuuuguguuuuaauugcucuagcagaacuucaaguacugcauugaauagaugguuugagagugggcaacuuugucuuguacccaauuuuagugugauuucuucuaguuugucucccuuuaauuugaugugggcuguugguuugcuauauaauacuuuuauuauguuuaguuauguguaugugccaugaauuccugaucucuccaagacuuuuaacaugaagggguguaauguuuugucaaugacuuuuuuuucagcaucuaaugagaugaucaugugauuuuuuuucuuggaguuuguuuauauaguugauuauguuaaugaauuuucauauauuguaucaaucuuguaucccugggaugaagccuacuuggcuguggugaaugauaguuugauguguucuuggacucaguuugcaagaauuuuauugaguauuuuugcaucaauauucauaagugaaauugaccugaaggucucuuucucuuucggcguauuugcaugguuuauguaucagaauaacugauaacuguggcuucauagaaugaauuagguaauguuuguucuguuucuauuucauagaguaguuugaggaguauugguauuagcucuucuuugaaggucugcuagaauucugcacuaaaaccaucuggcuccugagcuuuuuuuuuuuuuuugguugggagguuuuuuuuaaugccuauuuccuuagggguuauuagacuguuuagauaguuuaccugaucuugagauucauccauuucaucuagauuuuccaguuguguugagcuuaggcuuuuguaguagguuuugaugauuuguugaauuuccuuaguuucuguuguuauaucucccuuuucauuucuguuguuauuaauuugcauaaucucucuguuccuuguuguuagauuggcuaaggguuuaucuaucuuguuuauuuucucaaagaauugggucuugguuuuguugauucuuuggaucauucucuuuguuuaaaacuggauguuuuccacccugaguuugacuauuuuuuuuccaucuauuccuuuuggguguguuuguuucuuucuguuauacagcuuuugugggugcugcuaaguugccuguguggaaucucuccaauaucuuuaugcaaguacucagugcugugaauuuuccucaacuuucauugugucccguaaguuuggguauguugaaucuucauuuuuauugaauucuaaaaagucuuugauuucuuucuuuauuucuuccuuaaguuauuguugagcagauuuuuauuucaguuugcauaacuaugcgggcuuucuguuguuucuguuguugaagucuagcauuagucuguggcgaucugauagaaugaaugggauuauuucaaucuucuuguaucuguugagucuuguuuuguguacaauuuuaugcuaaaauuuggagaaaguuccaugaggugcugagaagaaugcauauucucuuguuuuggggugaaguguucuguagauauuuguuaaauccauuugguuccaugccuuuguuuaauuuuuguuucaaggaccuguccauuggugagagugguauguugaagucucccacaauuaaugugugaguuucaauauguguuuuaagauuuaguagaguuucuuuuacaaauauggguucccuugcauguucagaauugagacuuccucuugguggauuuuuuuccuuugaugaauaugaaauguccuuccccaucuguuuugauucuuuuuggguaaaggucuauuuuauuguauauuagaauggcaacugcugcuuguuucuugggaccauuuguuugaaaaacuuuuuuccagccguuuacaaugagguagugucugucuuugccacugaaguauguuucuugcuaugcagcaagaugcuggaucuaguuuacauauccugucuguuagccugugucuuuuuauuggggaguuuuuaguccauuaauguugagaaauauuaaagacagaugauuguucauuccuguuauuguuauuuuuguuacugaagaugguaguguguguguguucgcgcgcacgugugugugccugcauuucucuucuuauggguuuacuuuaggauguuuaauuucuugguugcugucgcccuccuuguguuggaguuuucuuuccaguaucuucuguagggcugaauuacuagagagauacuguuuaaauuuagguuuuuuuucauggaauaucuugguuucucauucaauggugaaugagaguuuugcugaguauaguagccugggcugccauuugugcucucuuuggucugaaugacuucuguccagggucuucuggcuuuuagagucuccguggaaaagccugguauaauucugauauaucugccuacauaucuuacuuggccuuuuucccuuccagcuuuuaauauucuuucuuugcucugugcauuuaauguuuugauuauuaugugacaguagauuuucuuuucuguccaauuuauuugcuguuucggcuucuugaauauuuauggccaucucuuuauuuagguuagggaacuucuaugauuuuguugaagaugcuuucuggccauuugagcugggacucuugccccucuucuauuccuauuauucuuagauuugaucuucucacuguuucuugaauuuccugguauuugacguuaggagcuuuuuacacuuuuguugguaaugcuugcaucuguaucuccugaucuuuuuccuagguuuuccaucucuagaguugccucuaucuguguuuucuuuauuguuuauacuuucgguuuuaagucucaggccuuuuuguucaguuccuucaccugcuuuuuuguauuuuuaauuuguuuaaaagauuuauuuguuuccuuuuucagggcuucuaauugcccguguuuuccuguauuucuuuaacggaguuacuuauauuaagggccucuuuuaucuucaugagaugggauuuuaguuuagaaucuuguuuuucagauguguuaggguauccaggacaugcucugauaggagaacuggguucugaugauggcaaauugcauuuggaucuguuacuuauuuucuugagcuugcauaugguucucucugguguugacuggccugggugccucugacuggaacuggccucuggaggcagguagagcucugugaccuggguuagagccagucuucuggaaggcagucagugcugucucugguuaggaggggccuccuguaucucugguuagagcagaacuccuguguuccuagucagggcaaaccuccugggagacaaggaggcucagggcuucaggggcaggaucuaacccauuuguagauggagguacaaacuggaaggacuaugacccugguuaaggcagaccuucugugucucugguuacugcagaccuccugugucucugauuacugcagaccuccugggagucagaaacauuguagggugugggaggguaucaugcuccugaucuggucuggguggggaaagaccagaaagaagguggagcuuaucagggcagacagguccuuugucagcugggcucuguggaugucccagcuggcuugggcaggagggacuuucaccuguguugcugguuucuauggaccuccugagaggcagacaggcuguaggguaugggaguguaucaagccacugaucuggcucggguugggaaacugccauggacauuuuuuaagugcacuguguggaauuuuuaaaugaauugguuuaguucuauguuaucacuugcuuaauuauguauuucauguaauucauauuuuauaugaugcuuauuaucgaauaccuauauggcuuuguccauuaauacugaucacuguuugacugauuagaaugaaaguuccaugagaacagagaaauucucuauuucuuuauccaaggcccugucuccaguguguaaauuagaccuagauaauucugcauaguuguugcaguaaugguugaaagaaugagcuuuugacuuuaugacauccaguucaaacauuaaguacuuguuguaugguaaccguuaugcuauguacuaauggguauaaaaucuauaaguuuuuguguuauuucugcuuuuauuuacuaaaguguuaauuaugauugacugagacauaacaguguacuguagcaaugacuuuaaaauuguuugaacaguaaaacuuggcuucuauaaaauaagacugaaaugauuugcuuauccuuagcuuaauuugcauuaaaugcuacauuguuaauucacuuuucuuuuuguucauaaucaguugguagccgcuugccaaaauggccuuagaauauuagcuucuuugauaaaucuguuucucauuuuucuucuagguauaaacuaaagucaaauauuuuuguaagauaauaaauacaauucaaagcacugauguuauauucuccaccucuuugguaaugaccuaacuuuuauuugccaacaguguuguugauguagcaaggcauuugugguaaacaaacaauagagauuccauuaucuuccucccuccaucuuuaagaugauggccuuugaaguuugaaacauguuccaagauuuuuauaaguuaaaagaaaaucccuuuuagcuaguucacuuucuacaaaucaagaugagauuuaugaguaaaauuagggaaauacauucuuuuaaugagaugcacucacauuuuaaaacucauuugaagcuagcagcuuaaggcaugcuuuugcacacucuugcuuucuguuuugaaauguuuaauuuagaacaaacgugugugcuuugugguuccucuuaaaauaacucacuguggagaguuuauuuuacggccaucaguaaauuguaucuuuauaucucccugaauaaaauauauuauaacuaugaagauaccaacuaaauugugcuuuaguguuagaugauaaguuguuuguuuuaaggggaaaggccuuaauuauuuuccaucuuaaauacuucuuuuuaaguuuauuuauuuuauguaugugacuacacugucuucagacacaccagaagacauuacagauagggaagccacauggugacuauugggaauugaacucaggaccucuggaagaacagucacugcucuuaaccauggagccaucucucuagcacuuuaaauacuuuucauuguuaauuuuaugucauuauugauaaacuuagaucaaauaugagugaguuacuuaauuuauaucuucuaccgcucagagcuaaacuuguaacuugauuuuuggguguagugauggaggggaagcuaagcaacauaggagguguaccaguguauuuuaaugcccuuuucuaucuguaagcacuguucucugauuucugaaaaauggugaaauuuuuguauuauuaguacuuacaacauguaguuauaguuugucuuuucuuuuuaggaugaaguggcacacacucuuacugaaagcagaguacuaaagaacaccagacauccauuuuuaacaguaagugcuuagaggacugcuauuaggacauuuuaaauuuagugggguuuuagcauagaaugaaacaaugacuguuucaaguaacauuuacuugucauuuuuauggcagacuguaacugacagacuguaacugacagacuguaacugacagacuguucaguuucuuugaacuguugagaguuguauauucuuuaugauauguauuuauaaucccccuauuaucuauguacaacuuuuuagaaaucuuucucuuuccucccauguaucucccugacuuuaaauauguccacagugcaagaaggccauuucuggaauuuuaaggaauucauuaauaaaaugguagacauuuaaaguuuauuuuuauuguucagcuaauaaugccguacaggcauaauguuucaugauuguguuacaguauugaggagucugugacaggaggcucuccgcauguuugaggccaaccuggguucucuagugaauccuagagcuaccugaauuacagugucagaauuaucugaaaggaaaaaagugaauggccacacagcuucaguuucgaaggucaaaauuuuaaaugaacagacuucauaaaaacaagaacuuucaugauggaaauacaggaauguaaaauuguuaagugcagaaguccuucuaucuuuuuaucauuacaaaaaguauaaacagugacuuaauguaugcgaaauguuuucagacaggcuauuuuccauccagucugguuaucugugugcuagauaguaauuauaaaguuuauuuuucuuguuuguaccaagcauauuaagauuaaaaagaacuacaguuuaagauuggaauccuuuauuaauagucuacgauuaucuagacauuuucggaaccaucaguauauaccuggucuuuguuaaagugcuuuaugucuauuuuacaggguaauaagaacauuuuaguaucuucuugagacuugaaaacacacuagggccuaccucauugagucuugcuguuuuagccuuaguauauacaaaguaacacugaaacuauuuuagacauaguuaauaagagcaacuaugcuccugaggaacuuugacuauaauucccuguagagauugcagaaauuaaaacuagcacacuggguacugguagucagucucaggugacgcaguauauugaaagugcucaucacaacuaccaaauauacuuuuguuuaucauauucuuagaaagccuacuaugaaguaaauguaaucauauggaacaguuucauuuuaucauuuauguuaacuguuucuaaguguuuuauuuuugguaccauuauauaaucuuuuaagaauauaggauuauaauuaacauugcuuucuuuuucauuucaaguccuugaaauauuccuuccagacaaaagaccguuuguguuuugugauggaauauguuaauggcggagaggugagucaggaagucaauccagcauuugcauggacuauuucaaugaaaguauuacauguagugugcguuaugauacuucucagcuccacagcaggucugcauaguucuuccuguugaguagacaaagauggcuaauagaguguuuuuaucauauauuagcaaaucauauucucuauuuuacuuuacuuuugaaagauaaacaugguuuaucacaauuugauuuuuagagggaauauaauccccuuuacuuacugauuuuuuguuuguuuguuuguuuugguuugauuuuuugagacaggguuucucuguguaccccuggcuguccuggaacucacucuguagaccaggcuggccucgaacucagaaauccaccugccucugccuuccaagugcugggauuacaggcaugcaacaccacuacccggcucugaauuuuuuuuuuaagauuuauuuuauguaugcguguuuugccuucgugugugccugaguagcaugugugugcuugcuguccaauaaggucagcaaagggcaucaaaucuucuggaacuagagugaaagauguuuuuaggcagucuuugagugcugggaaaugaacuugaguucuguaaaaacaaguucucuuaaacauuaaaacauuucuccaguucccacaguaugauuucugaaauuaguuaauuauauuucagauaacuuuucaaacaaguuuucugugaaccuuguaaaacuuuuuuacaucccauaccucuucacgaccccaccccaucuccauguggauuccccccaccccaccugaccuuuaaacucccuggggccuccagucucuugaggguuaggugcaucaucucugaaugaacacagacccggaaguccucuacuguguguguguugggggcucauaucugcugguguaugcugucuguuuggugguccaguguuugcaagaucuuggggguccagauuaauuaagaccacugguccuccuacaggauuucccuucuccucagcuuccuucagucuucccuaauucaacaacaggcgucagcugcuucuguccauugguugggugcaaauaacugcaucugacucuuucagcugcuuguugggucuuucgaagcagacaugauugaucccuuuuugugagggcuccauagccucaguaauagacuuugggaccuccccuugggaggaugggugugaaggggcaaggaauggaauauggacugcaaaaaaugaauuacaaaauuaaauuuacaaaaacuuuuuagaaccuauuuugaacucagccaaccgucuucuauagauauauuuuagcugaugcauuguuugcccuuccuuguauauauuaguagugaaggagaagauaaugaagaaauuuaagagaucuuaaagcuuugaauagaaauuaaaucacuucuaguauuuuuccuuuaucuuuuuccuauuuugaacaaaaucaaugugaaauagaaauguaauguauagaaauagcaaccggaaauacuuuaaauaucuaacuuucugaaauguacaauguagaagcuugaauuucauagacuuuuaaauauucuuauuuuccaaucuaaauauauaacugauauugaauauuuuugaaaaagguaucugauauuuagaaauuauguuaucuaaaauuuccuucacucaugugauauuuguaucuugaauguagagguaguacagcuuuuuuugaguguauuaaaacaucgccucugcuacaaaggaguauguuguuucuauugugagcauauuacauuuagaaugucuaauccucaaauaaaaauaaauuaauaaaagacaauucuucauuaaagauagauuuuugaguccacuuuuauuaguguacugaguaauuuaaaguggcaguucaaauagagaugauagugugcaaccaguggaugagcacaaaacaaagaaaacuugagcauuagaagaagaauauccuaagcauagagaaugaugagcuucagucagauguucauggauaugaagaugauggauugcuuggcacuguggaacugacaucuuaagagcugguuuguuuauauggguaaaaaaagacuauugcaaagauucacacguagcuuauuguugaucaugugaaauuauuggauauacucaaguuaugaaaaaaauuuuucagagcaagacuauaguguuaauuuuuaugaaguuuuuacuaucauuuugaagaacuauguguugaauuagaauaguaaaggagaacagauuugggagauauucaccuaaagauuauaaauuuguccauagagaugaaaaugaaauuaauggaauuuccauguugguaccugucagaauuuaaaauacacauuuucuuggaaucuguucucaacuugaugagauguagaaucuugagagaugggcuucuggacaugucuguggaaguuaucuaagguaacugagguggcaagacauacccucuauaaguagcacugucccugaaaacaugagugacuagaagcauucaucagcuuugacauggaacugugguuguagugugaccagcagcuucaggcucauguaacuuccccaccaugccugguucuaaccuugaacugugagccagaauaaacccucuauaucuuuagucgcuuuuguuggcauuuuuaucccagcaacaggaaagcacucagcaauuuuuuuccaguaauuauaaucccaugaaauaaaaguauauggccaaauaguauauggauaaacacauuuuuauacaaguaugguaccuugagugaacauucaguaagugucugcuuuaauauauaaaaugcuguaagaugagagaguacaaagcauguuaguuacuauuaugcugagagagauauaaaucaugaacacaugcacaugccuuucucuguuagagaauuucucauugucuacuggaauuuagaaugggcuuugugacucaguacaggguggaagaaaagcuuuccaccuguguauucuuuuuuagguuguggauugcaugcagauauuuuauacuuuauauuuagaaauaagcaaauggaaggaugacuagggaagagaauuauagagaugaaauagaacucuauagccaaaacuuagaugaucauugaaugccgugcaggccacaaaucaagaucuauauaauuaacuuguaaagucuaaaaauguaagaaaucacauuguuacuaauaugcuaaagucaugaucaguaauuuaggugauauuaaauuuaauaagaaguggaaaaguauugcagaaauguaauaucugaaaacuaaaauaauuucaaauuugguugaagaagucuccucuuaaaccuuuugccaaauugucuucagcucuauacauuuuaaaacguacaaauugaccuucugugaucucucacaggcucaaauuucaugaaagauuucaugauaugguagaaugcugugaaucugacccauucuuacuguuccuucuguagguacuaaguagccuaccaugucuagaauugacuacucagguuuguuaguacugcacacaguuguauuaaugucuuugauaaaauucauuuuaguuuuugcauaugacuuucaguuacaugucauucuugaaauccucucuuacuuauucaaauuucucauuauuuggcuggcauuuucucuuccgugaacuaaaaucaucucauuuuaaauucacauaagacagaagugcaggcagucagcauuugaauucuacuuacuaauuuguggaggugugauuugggugauuuuuaaguuaaaaguauuucagauucaugggggugcuuuuaaaacuugauauuuuacuaaauuugugguucuauaaauaucuuuauuaccagaaaucugaguuauuaagcuuuauguagguuauuucagaauucuauugcuuucacucaagucuuuuuuuaaaauucucaagccaagaaaacuacauuauaauaaucauauuaacaucuaaaguucaaggcaaaaugagcuuuauuuuauauuccauuuuaugauauaauuuuauaguauuucaaggcuaguuuuguaaauuaucguaggacugcaguuaaaguuaagagaagacaugucucauugucuaauacagugagcugcuuagaacuaugagcagugaccaggcagcucucaauugucaugauuucugugcagggggcuacagugcugauuggcaauuucauggaaacuagacuuguuaacaguugcuuaccccagagugauccuacuaagaaacuucaaauaggacuaugcacaaacacgagcacgugcacacacacucucacacacugaaaaaaaaaacaaaaacaaaaaaacaggaagaugacaaaaauaauagguaaauauuuaaaaccaugaucccaaaacaguacauaaucuuuuguauuauuuuguaucuuuuauguacuaaaauaauuuuacaauucuuuaugaugcuugaguuauuccauugcaaucauguuucucaguguuuguagcuagcuguaagauauacaucagaguucuuuuuaguuuggaguuauuagauauuguacauagcauagcuuggguaauauagccauuuaaaauauuaauucuguuuauucacaaauucuguuuauucucuucuaaugucuuuaauuuauucagcuuuuuaaaguuuucauuguacaaauguuuacuuccugucuggauuuauuauuccuaggaaauguucuuguuuuggcuuuugagaaugacauuauuuucuggucaacauuuuuguuacuuguguauuagaaagcuagugauuuuuguuuguugauuuggaucccgcucgaaguauuuaucagacuuaagaguauuuuaauuggguuuuauaguuuuguaaguauagucuagaaacagauaaauaguguucuuuucugcucauaucuguuauuuauuuguacugccuuauugcucuaggugagaaaucaaagacuacauaaauaugagaauagugaauagacagucuuauucuuuauuuuaaaggaaauauuauaauucuugcacauuugauguacaguugcauauacauuuguuuugaauugccuuuuuaugugaugguauuauacuuuauuccuaauuucuccaggauucacaucauaaugggauauugaacuuugucaaagcuuuuucugccuguguugaaaugauugugugauuuccacuuuuucuucucuuuaugcaucuuuuaauauucuuugcauaucuugaacuugaacuuauguaucacuuuuuauuuauugauuuggauauguugaacuauccuugaauaucuggaauaaaaccugcuucaucauaauguagaauuucuuuaauauguuuucaaauacuuuauuaagcacuuuugcaucuuuauucauuagggauggcauauaacuuucuguguuuuucuauucuauuuuguauuuuugaugaagguaacgcugguuuaccagauggauuuuguuagcauuccuuuucuauuuuguagaaccuuucaagaauauuacuguugucucuggaaaaugugauagaauuuggaaguaaauuguuuugggcuggagcuuugggggggggggggaaauguuaccuauuuucuagaaguuuuuauggcuagccaaaaacauguguuucacagcaguugauuggaauaucauacagauaauaucuuuuuaagugugaaguuucuugcuuccuuuuuuuuuuuuuuuuuuuuuuguggagguagguuuaaaaaggaugucugcauuucuuacuuuugcaacauuuggaccuagcuuuaauacccaguacuauuugcuuugugaaauugaucauguccaugaggucucuuuuuauuauugugcaguaacuccuuauaucucuuaagacuaaguugaaccugaaucuacauuguuagaaguauaguugcucuugcuugccccuguuucaauuaacuugguauccauuggugguuuuuguuuuguuuucucuuuguuuauuuguuuuuuaacauucauacacuuuuaguauuuguuuuacuuuuauugaaaugucuuucuugaagacauccagcaguuggcucuugcuuuauaaucuagccugcuugucugccucuuuugauuggacauuuaagaccacuaacauuuaacauaaugauugagagauauuugccauaauuuaaaaauauauauuuguuacuuuucuucuuuucuguguacguuccccuuuacauaucaugaaaaugcuggcuuaucaguuguuaauuauuucacuuuguauauuuuuggaauaucuuuaauuuucauuaaguaaaacagacauuacuauauuaaucuucauugguaguuguaguaguuugaauuauauugcugugauaagcugcaugaccaaaaccaucagagagaugaaagaguuauuuaacuuggaaguuguaauuauuguuggggaagucagggcaugaagucaggucaggaacuuggcggcaggaauugaaacacaggcuguggagggguguugauuacugccuugcuuucgauggccuggucagccuauauucuuauacaaucuaagaucauuugcuaaaguguggcuggguucuuccacaucaauaauuaaucaggaaaauguuccccccaaauuuuucuaccuauaggccaaucuaguggaggcaguuuuucaucugauguucccuauucccagauuaaccuaacuuguguuaagacacaaaacuacaaaaacaacagcaacaaaacuccaaccaaccaaugaaacuagcuaguagucguuuacugccacagcuugaaaugauguuuucauguuuuccuggcuuuuacagcuuuuccuaagacauuauuuuauauagguuagauuuuuuucuugucucuuuuaauauugucucuuuguuugguguucauagucauguuuauuauagauauagauacguguguguauacauauauuauauauaaugcuuuuugagauaauuagccuuuuccucauuucccuuuucuguuuucucuuuccaagccuccuugcuguugaaaaaauucaugaccucuuuuuaauuaauuguuguuccacacacacacacacacacacacacacacacacacacacacacacaacuauguaagcaccaccugcucagucugcacgaugcugcuuguguguguguuuucaggcugacccuggugugcucuuuccugggaaugacuguuucuccuguucucagccuuccgaguugccuaucguucuuuguguagguuugaacauugcaaaaggagcacaaagacuguaagagccaaaagacgagggaguuugcugugagaugaugucuccuagacacaccagaagcuacucccaagacuuucgcaaacaugacagcccaaauacaagaagagcaaggacaagagcaauauuuguagucuuauagcaggauguggaaaaggucuuuuuuuuuuuaauccacuuuaguuuuaagugccucccaugcucuaaugccugugucuuuuucugauuugggaaucuugugcuccaacuucauuggauagauuuuuuaauaccauugcuccugugucccuaucaccaauuuuuuuccucuauauuguuuucagcaacaucuacucagccagccacaagaaaaccucaacaucauugaucucucccuugguccaaauuccucuggaguacugauucuucugaagggugcuuauggucuccuuagcuguuggcccucagaagcacucgucgagauccaacauaccuucugguguucccaaacacacacauucuuccaaagccuuuuauaguacuugccaugucucagcacagugucauguccuguggguuagugcuuuuccuuucaugucugaaaguuucuauaguaggcaguacuaauaggugaugaguaacuuuuguggaauuuuagaaauuauuuaccugagcauaucuucagauucuuuuauuacuuacuugucuaucuaauaauaguuuuaagaguaugaucuuuuugugugcaaaauuuuuaacacuccuuaucuacauaauagaauccagcuauaccaagguagacaacaucauuaacaucauaaauaagcugggccucucuccaucucucccuucaucccaucccaucccaucccaucccaucccaucccaucccaucccaucccaucccaucccaucucaucucucuucucucuuuucuccucuuuucuuuucccucccucccucccuccccuccauccuucccucugucccuccuuuucucugucuuuccuucauucuaaauguauauuauucuuuagccacauaacuccauguucucugcuaauauuuguauuuugugggaacuuguggauuuuguaaagggaaauuggagaauaacaaggagauccaggaaugcgagggaagaugaggaugguugggaaugaucaaaagcacacguaacuauaaaaaaaucacagugcaaagccauuguucuauauaguggguaugcaccauaaaaaaugacugcuuucuacaaaugauuaauuuucccuuacuguguauggugcugugcuagguuacaaagaaauacaaagauggauacauucuaaguaguaaccuuuuauuucucuugaguuuuccuuuggugaaaaguccuaucuuucacaauuuaggugaacuuuaucuguggcauaucccuaaacauccuauguaccaauguguuguuaauaaccauaucacaaaauauauuacugccggcuguuucugugaauauacaugcaucuuccucauuaagguagaauuccuuaacaguggggauuaugucugcuuucugucauuuuguugagguuugauugcuacauggaagguuauagguaguuacugaguuuagagaagagcccauagguagagcuguaaauaagggaguaugcguguugccccagcgaagauggauacuagagggcugaggcaggaugggggagcaccuuccuagagguaaagaggagggggcauaggauagggggcuuguagaggggagaucaggaaggggacaacauuuggaauguaaauaaauaaaauaauguuuuuaaaaagaaagaguuauuauaucgcucuuuuuucuuguccuagugcacuacaguuacuuucuauuaauugauggucauuaaugaauauuagaucaacauguugguuuaacagcaggguagacaaugauaaucuagaaaguuagggcauuggugaagaaagcuguuaaaccacagccaagaaagagaauaaaggcaguguacuaaccucuaaaacaagacggggaauaaauuauaaauagaccauuggauuuugcaauuguagaucacugcuugucuuuacacgagugaauuccauaaagaagcaaaaguagacaucauauggcaaugaguucuaaaauacagaguucuuccucuuaauuauaaaacuugagcugauauuuuuauggaagcuggcuggcagacaaacuguagcuguaucaucuauauaaagaccuagaauccugaauacauuauauuaauuuagagagccucuauaucucuuuugucaguagauagccagugguagaauugauuuuuuuuuuucuaaagaaaccuaaagacuuaaaggacuauugcagcaacauugugaccauagcagccgucaacaccauuggcauguuagacucagcuuggcagauaccauauuuuucauaauuuuuuuugauuaucuguucuucagaaauaaaacaucaaugccaucucagcauggugucccagauuugacaaaacaugguaacaaaguagggagcaucguaguuuauauaugucucccaaauuguuugcuacuaauauaaguaauuuuuuuuuuaguaagauuuagcaauaucaaaauucuucccugucuuuacuugacucagugaucacagaguugucuuaaaagugauuuaaguagagauagguguaggaagaaggagugaaggcaugauaauucuagguuacucagcaucacuguuuuauguugaacaagccuugguaaggcauaacucuuagcaguucauuaugaguuagugaucuuuauggaaauaucuauauucugaccuuacaguugaaggcguauuuuuucugauugaguuuucuuaaucccagguguguuuugcgugcccauugugacaucuuaguaguuuuuucgggacuaaacagccuuucauucuugccacauuacuucuuuuccuccauuugguauuuguccuucauuucuacagaaauccuuugaauuuuguaaacuauauacugauguuuaucaccagcacuacauaauuugacuuuaugagcacauauauuuuauuauaauucauauuuuaaucucuuaauuguauuaaauauguauuguacaaacacaaaaaucaaacuuguugugcuuauauuuauauaggauggagcuauuuuagauuagcaauuuggcagauuuccuaauguauauuaguucaacaaagauugacuaucaguuacagauccucagacugguuucuugaugccuguuguucuaagaaauuagauguuuuuaugauuugcuuaguguuguuuguuuagcuuuuugugguacugggaauggaacacagggccuugcaaauguuaggccaacacugucacucugaacuguucccucugcugagaaauaagauauagauguuaauuacugagugauaggacuuagaguuucauaaagcuagaauugaguuuguggugacaguaagagcccaauagauauuuuuugacuauuggcauaccuuuaaucaauuaggaaaugaauggguuuauaccuacaagaucacagauuacaguuaaaaaugaaaauaaaaggauuauacuuuacaaaccauaucaggggugauggaggccucuuagcccaguuuuagcacuguaaacauaaaacuuuaaagucuugaaaauucuuauuucagcaaguguuauuucaaacuuugaaagcauuucuagaaauauggaaaauaacaauuuagacuaugacuagcuuauauaauugaguuugaguaaguccauacauauuuuuccuugaaaucaaauauaacuuaaauaaaaacaccaaucugugcuuguauuaauuuauuuugauaaugucaauauauauuccuuguaagaguggaacaacaguauacuuagaaggaaaugcaaucuaaugaugcauacuuuuuccucugguaccugaagguuaaauggguagcaagcagaaugccuuaaacaagauugguauauugauuaaaacgcugauuuaacagcucgcaguuuccccuuggaaaccugcaaaagauaagccagcugcugucuuagagugcucaguguccacugagaguacacuaucuaucaucacaauauggugaugagagguguuuuauguuuguguuaauuucccccacuaaaucaguaauuauuacaauccugucccugcuguuuacccugcagcuguuuuuccauuugucgagagagcgaguguucucugaggaccgcacacguuucuauggugcagaaauugucucugcuuuggacuaucuacauucuggaaagauuguguaccgugaucucaagguaaaaaaaaaaaguaaugaaaauugguuuuuugcagagacuguagggacaaacgaaguaauuacaaaguuacacaguuuugagacaaguacuuaggaauguuguuugcuguaguuggucugaaauuucacucacuuauacguaaguggcuuuuuaaugauugugguuuuugcuauauaaaaguucucuugacuauguaacacaaauuuaccaagaguaguuuuuuuucuguaaaugcccuaauuauagaaauggagucauuauuauaugagaaaugcaagcucauuauuauuugcaaacauuauaaaauguuuauggaaaagcuucaauaacaagguuauugggaggaaaauaucuauuuucauuguaguguuaccuuuuugaugggaucguuuuccucaauuauuuaucuauaaacuugguaguuugcuuaguuuuucguuugucagaacccaguauugguuguauugguaaaagaagccuggccaucucugagcucuugugaguaccccuuaggagagccagaauccccugaaaggccacgugauaaacacuuuagucuguucugccugucgagguauuuauuggaaccauacugcucugccauugaaagguaaaggcagcccuagucauuauguaagccaauauguguggcuuaugucuacaaaucuuuacuuaagaagcagucagugguuuagauuugguuuauauacuauaguuuacugcucccuucaggagauccuguaagcaaaucguaauucucaugauacagucaugaguaagguugacuuuguuaaggauucugaucauggcauauuuucaaaaacagauucuuauuauagcaucuucuuuaaaauguaaauucuagggcugggaacacagcucagugacaggcacuugcccaguuuaagucugacacccaguuccaucucaggacauaggcagcuaguucugggguuaggauagggaagcuugaaguggcaguccaccugucuucccacccacuugaaacagucagcauauuuguuuuuuauuagguucuuauaucucugucuccuuccuaauccuuaucccacccugaucucuuccaacacucagcauuacauaggagggaaaggauagaguggaaaggggauguagaccucuguaggccugccccacucccagcaucucauuggcucucagguagccagaugugaugcugucuuuuucucauuggcucacuccauugccugauccagcuucaguggucucuggccaugcaggcagauucuagguuggcuaagggaggaaguagcaguagugcauugcagcugggcuacuuggcuaaguuccuccuacagaaaccaaaacucucacuauagaacacugaaguauaaucacagaugugaggcugcccuaggcaauguagugagacucugccucaaaauauaaauauagaacuggaagcuagcucuauggauaaagugcuugcugugcaagcaagagaacuugaguucugacuucaguaacacauaaaauccaaggguggucacagaugucuguacaucuagcacucacagugaagacaagugggcccugggggguuucuggccggcaguuuaacccaaauggcaagguuuaaguucagugaugucucauaaaguagguuggagaagugauugagguagaaaucccaguaucagucagucucuggcuucaacauguucucacagguacacuaaguacaaauuaaccaagugauuauauuuagauugguuacucuuagaccuugaaaugguagaauucagcuucuuaauaggagucuccccauaacaaacauguguucauacauauacugcaugcaaauaccaaauguaugacuuuuaaccuaguuggcuugcuuacuauggguugaaacaucaguacuuauggaaaaauuaaaaucauaugguaaugcucaccuguuaaaauuugaugauugccauauugaucacauaccuaguucuuuuaaaauauaauuugauuauuaaaaaaucaaguaauuaaaauuuuuauggaauuccauuuuauaugaaauuagauauauaucuaagaaaucaugauuauccccuuauuccugucuuauucauaugaaaccauuuguaacucuuaauuuuuaucuaauuauguaagcagguaccuagcuuguuuaaaaauguuccuaucacucuuuuuuuuauuuuuuaaacaguccaguuguuaccuaccucccagucuacccucuggcuuuuccucaucccaugccucuuuucucccaccccugucuccaagaggauguccccaucccacuagaccuccccacucccuggggccucaagucucuucucucacugaggccagacuaggcaguccucugcuauauauauauguugggggccuuauaucagcugguguaugcugucuaauugucuagaugugucugagggaucuaggcgguccagguuaguugagacugcuggucuuccuaugggaucaccccccuccucagcuucuuccagcuuuucucuaauucaaccacaggggucccaggcuuuaguccauugguugguuguaaguaucuguaucugacucuuucagcugcuuguugggccucucagagggcauccaugcuaggcuccugucuauaagcacaccauagcaaauagugucaggccuuggagccuccccuugaacugaauuccaauuugggccagucacugaaccuucuuuuccauuagucugcucuuuucuuuucuuuucuuuucuuuucuuuucuuuucuuuucuuuucucuuuucuuuucuuuucuuuucuuuucuuuucuuucucucucuuucucuucuuucucucuccccccucucuucccccucuuucucccccaucucccuccucccccucuucccucucuccucccccucuccccucccaucucccccucuucccucuccucuccccugucccccucuccccucucccucucccuaucuccucuucuucucccuccccucuccccucuccuucucuccccucucccucucuccucucucccucucuccucuuucccucucuccuuucucccucucuccucucucccucucuccucucccucuccucucccuuuuccucuccccucccucuccucuccccccucuccccucuccucuccucccccuccccucucccccucuccucucccccucuccucucuccucuccucucuccucuccucucucucccucuccucucccuccccccuccccccuacccccuacccccucuccucucccucccucuccucucucccucuccucuccuccucucucucccuccccuccccccuuuccuucucucccccgccccuccccuccucuccucucccucccccaugcaugucccuuugggucugaguuaccucacucaggaugauacauucuaguuccauucauuugccugcaaaacucaugauguccuuauuccuaauagcugaguaguauucuauuauguaacugaaccauauuuucuguauccauucuuccauugugggacaucuggguuguuuccagcuuuugacuauuacaaguaaggucacuaagaacauaauggaacacacaccccugugguaugauagggcaucuuuuggauauaugcccaagaauggucuagcuguaucacucuuguauauguuuaaguaaauguuuuaaagaauaacuuuuauaaaauauuauuucauacaauaaugauaaaauguauauauuuuuguauagucaauuaaguuacaaaugaaggauuagaguacuauacuuaaaaauaaugagcuauucagcuauaaaacaucuacuucagggaugauuaaaugucugagugccaaaaugaauacaacucaaccaaaugauuauauuuagcuuauuuuggaauuacaaauuugacauaauucaucaucuuuacaucuaucucuauauugaguauagaugcuuuaaaaagucuaauuagauggcauuauuauaaauacuaauuuucuaaauauacuuagaaauuguuaacuaucucuccugagugugcucaugcuucugaauccugcaugaggaaguaagaaggcagacgcccggaggaaagggaaggagcggagucuugaaauuccuagguaaaucccuguuaguggggauacauagaauuacucauuuauagagaucuaaagaagacucuucauuugaaugaugcuaucgauguuaaauauaacagucaaaagggucuuguuuaguauugucuccaaacauuuugaaucaaaugaauuauuauuaaaguuuuguucccauauaauuggugaggaaauuagaucuaacucauugaaauguaagcaaauacuuuaugugugaauguccauaauguagucaugauacaaagucucuuaacuuuaccagacauuuaaauguucuggguacucucaaauuuuacuccccuuuaaauguugcauuaauuuaaacuuugaaauacauguauaguauaugauagaaagcauaugacuauauaucacaagauacauauaauuaagaaagcaaaauuuaaaauugauaugcguguuauuugcaucugcaguucauaaaguggugcgugacagaauggggucauuaagguaggaucacaauaauucaaagcugggguauauauuugagacaauguucugcaagccuaaaaacauuaccuccuuaagguaacagacuaaauugacacaaguaagauuauuggaacauggauauguuagucauuuuucugauaaugauaauauacuaaagagaaaagggauuuauuuuagcccauaguuuuagugacuccauuccuuuccaagaccagguggacccuuugcuuuuagacacacucugauuugaagaugucacauagcaauacaggaagcacgugguagaagacccugauuuaauucaucagugaaaaagcaaagaagaaaaaggccacuccugccuuccacuagggcucucaccagaccccaauuuccuaaaggcccuauaaguguauacaagcaacuuuuauucaucagauauaauugucaucucagaggcuuacugcugauaaacucacccuuuugaguucuuucugaacucucccuggcugauucgacucagcuuuucuggcucaauccccucuccaagcugacugauucgaucugacuucucugagcuucucauugaauugcuuggcuuggccucaaaccagcccugguaacauguucuaaucuucugacucagcuuauucuuuggguucaacugccuugcugacaagcacugaacugcaagaaaucacuuacaaacuccacuccacugcacaguacucacacccaauugacucucucccugcacugcccuuuaagucagcucuauuuccuguccuuucucuggagaguuggguguaugcuaucugacucacuuugucagcucuuccucugauuugucuuuuuuuuuucugccccucaguuaaaugucauuuucagauacagcuacuucccucaacaaauuuacuuuaccuucauuguuugggauuaaagguguguacugagggugugugugcauuucagucagaucacacagaccuagaucuuuggauguuauuucuugcuagagcagccacaaguacccuuucucuucucuccuagcagcaccauucugaacaugaagccuuuaaaagucagcuaaggugcaaaguacaguaccacaaucauauuuccuagucuaaugugcuuuugcuuauaacauucuuccuagagucaaaaugacaucuagaugagaaaaugcaaaugcauugaauuaugccuaguuauuuaaaaaaucucugugauguguguauguggauuuaguguaucuauguacaugugugcaugucaugguauaccuuuggaagucagagcacaucaccugugugucaguccucaccuuccaccuuuuuugagacaaggucuccuuuuauuacugccugugccaggcuagauggcucuugugauuccacagauuuuguuugcacuucccauaguaguguggggccccugagauuauacuuuccuuggaucccugggauccacacuuggauuccaagccuuguaccaacuaaaccauuuucccagcccuuguauuuauuuuuaaauuuaauuuuuuuauuugugugugucugucuauuucugugccugugaaugcccacaaagaccagaaacugaacuucaagcguuuaaaagaauaguggguacugcuaaauucugagccaucucuccaguccccaaacccuuagauuuuuauaaaucuaaaaguuuaaaaucuaaaacaaucugaaauaaaugaaaaucuaaaauaaaucuaaaauauuugaaugacuguuuuagguaccaaauaguuuaaaaauugcaucaucaaaaccugauuuaggaccaaguguggcgcacaccuguaauccaggaggguuugauuucauucaggaggcagaguccaguggaucucugaguuuagugucagcccugcucuccauaguaaguucuaggccaggcagagcuacaaagagagacccuauuuuuaaaaagaccuacccuucuccccacgauuuagguacucauuuugaucaguuugaguagacucugaucuuauaaugaauuuguaaacuuuuauaugcaaauuaaucugagacaccuacaguagcuggacuucuuuuuaaaaaauuaagauucauuuagaaagugauugcagggaaagagagaaggugaguguuggcauccuguggaaaucagaagacaccuugugggaaucaguucuuucucucuaccucaagagcuccagcaaucaagugccuuuacacacuugcugucucuguuccuggagucccuucuuaaacagggcugacaccaguuuguagugucucauucagcacugggaacaaagccugauggcacauuaauuuagaaaguuuuauugauucuuguuugguuucauugucacaaauaauuauugaagcuuuuguuauguuuucagaaaguaacuuuguucaaauuauuaauauaagucauuauaugaaauuccauuuuauuaaggaucuccuuaauaaauacauguauugcuuaauaaaaauugauauaauuucaguauaccauaaaaauuuaaagauaucucuuucaagacucuuacagugcucucaaauacaauauuuauuuguaaugaucgucguuguccauguccagacacccuuacucuauacucuucuaaccuuugcccuaugcuucauuucauucuucaucuauuaauaugugauaugaaucucagaugagauauaaaggcauaaaauuuggugcaauucaaaaaauuuaaaaauagauuuuacccaugauuuauaagaauguuuauuuuauuuuuguaccuagcaauucagaauacuuuuucaaaugcagagaaauaauguuauauuucucuuuuucagacaacuuucugaugcauauaaaucacaugaacaaaauugguguaauauacaaaaauauaaauuauagugggguuuauaguauggaauauuuauccaguguuuucuuauuguuauuauuauuugagcuuuuacagaaaccauacaguuuacaugugaguguauagaauauguaaagauugauaaucuguuaacuacaaccacgucucuuuccaguacccgauuaaucacuuuucaaaacuguucucuuguuaaagcuuauagaauaaauuaugcuguuuucacacacaguuggagaauuugaugcuagauaaggauggccauauaaaaauuacggauuuugggcuuugcaaagaagggaucacagaugcagcuaccaugaagacauucuguggcacaccagaguaccuggcaccagagguaggcccaaggaaaaauaacaccaguguuucccaaaacuuugcaauauuuuugucauguagcaacauucacuauuuuuuaaacaagauuucaaccagaauaauuuaauugcuuuuaacuuagaugauggguauuuuaagaccacacacauaugaaaauauuuugcaguuuguaagcauguguuuuaauaaaguagauuggaucauacuuuuucuuucuauauauuuuauuuucugguucauugguuaaaauaggauaauggaguaacuucuguaagcauauuuauaguuuuauaaacuaucuuggacuuuaucuacaagcagagauuauagugacuguugguauuugauccuugacuacgggaaauuguuuuguugaagaaccugaaaaaaauuacuuacuuacauuuugaaguucauaagaaaggaugaagaggagguuucaaacccuuauucaaguauuuguuguguaucuucucuauguugaggguuuuguaauaugccaauauaggaauaagauggaaaugacuguacucucaaggaaauucuguuggagagagucuauguauguauaaaauauauauauguucuaucuguguguauaaacauuuauguguggguauaaaaaauguauaacauauauguauguauguauauguguauauauguauauauauguguauacauguauguauauguguauauauguguacauguguuuauauguguauacacauacacacaucauaaugcucuaagaaaaaugaaaguaagauaaaggaaaagauguccuuugguguaguaguuuucuuaaguauaccauuaagcauugcuguguaacaaccuacucagauauucagugaugaaacaauuuccuguaacccuuggcgcucuuuacaucaagaaugcacauguggccaaacaggugaauucuuucuguucuguucacaucugugaccuuagccaaaagacauaucaacaagauaacugcuuagagacuaaaguuaucuagaagugucuucgcuugucugugugcacugcugcuaggugcccagugaaagcuauucaaguuguugacagaagcacuuacagccucccuguggcuuaggugucuucaaaauggccaggguucuuuggccuagcaaguguccucggaacaaaugagaagcaaccuugugcucacucccuccuccccucucucccuuuuauuuucaauuuaguuaacuguuuaaaauucuauuuaaaaauuuauuuauauuuuaucauuuggauauaguucacaugucauauaaaauuuuaagucaacauuuacuuuuucaaauguuuaaaguugugcaacuaucgcuuguaauucuaacauguuuuaaucauuccaauuaugacuucacuuuuauuagcuucucauucuuucuuucuagcuauuguaaauuaucuuucucuuugaagcauuuucugaccauuucauguaaauaaaauuauaugauaaggagcuuuguagguccggcucuuucccuuagcagauuauaacucucaccuauauuguuguaccuauggcuugguuuucaugaaaaauacugcuaagaucauucauaugucaucucauuuccuggccuuuuuucauaagcuccacaucgcuuuggucauaugcuuauuucuugaaacagauguaacccuucccagguuaaacuagcucuggcauagaguauuccucccacuguaaagaagugugugagauuggagucacugcagaagaauuugaguagcagaaucuuccacagagaggugauugaggaaagggacaauugcucagaucugagugcuaaggacgaggaaaccaacauggagaguuuugcacgcaaggcagccagaaggaacaggagccagacuaauggggcaccccucagagugaagcaaggcacugugguugauguuauugagagccuucuuagaugagcaggacuucugucaucaagcaucacuuuguuuguuccugugguauuugggauaauaauaugaaacagugaaauucauuuucauuuuaauaauccauauacaguuagaaggugauaugggguacaguagugcagcauucugucuuugucucucucugucucucucucugucucucucugucucucucucccucucugucucugucucucucucaauuauucuuugagaguuucaucuauguaaauaauauguugugauaugauacuacuccucuguacucccuaggaauauuaagauucuaauuaggguuugguagcucauaaagccuaccucuucaucuauaaucguaugaacgauggcccaacaggaaacaguaaucaaagaaauuagaaacuagaauaaauuauguauguauuaucauguugccuuacaguguuuuuuaaacuaggaguuaaauuaacauuucaaaaggcuuaguaauuauaaauaagugcuaauauuuaaaguauauuuccaaguauuguugucuugccaaacauguaauuuucucuguuauagaugcuagaguuuaaaauucucuguuuucauuacagaguacauaaaauuuuagaaauuauguuuuauuuauucaaauauaagaucauauuuucuggacaaguuuuguuuuuuugugaaugucgugguaaacaaugucuuuguuucucuggcauucaguugcccuugcuauacauuuguaaugaaugauggcauuccauauuuagaauacccaaauuaguuauaucacaauuagaaggaauuauucugaagaggauaaaaacacauuccagaagcagaugaucuucuaagaaacaaagauacuguuuucugugcagacauuaucaacugaaugacaaacuaggcacugaaugcaaagacuucugucauuucuaagaguuuacaguauucaagagauuauccauuuuuuaaaacucauuaagcagucauuuuuacauauuuaaaaauguauuccauuuaauuauuguauguauauauauuggugaauauaagcauugugagugcauuuguacacaaugccaugugcauguguggcagucagugaacagccuuguuggaaugcagagguuugaauucugugggaaaaggggucccugugaauugcaagccagagguuauaauagagugggauuuacaagcucaguuagugagagauuaucucacgcugaaacuacccuuuuucuuuacuuucagaagauguuugucccuuuuugaaccuuucauuucugcucuguaccauuaucaguguugauauuuccuugauaagaggucagacaucagucagaccuaggaugcauccuugacuacugcucuuguguaugacucgcaucacugugcuuccuucugcucuuugaacacuuucugaacagacuggaguguggagcagccuccauucccacuagcuugcucuuucaccucucuuuuacuuuuguuuacagugguuuguuauuuaaagggagaugcuauacauauugaagauuccucagaaaggauaugagaugucaucuaaaaccaguuuauuaaauguccuauauguccuauaugucagacuuaugguuuauuuuuaaaugcuuacauuuacauggacuccccuuauuuugugguaaauaccaccagaaaauuuacuucucaguaaaauaacauuagcugaaaaaaagaacaucaaaauaaauuuuaucucuuuaccugcuuuaugaauaaugaaaaaguguaauaccuuuaguggcaguuuacugauaggaaaaaaaauauuuuagguuaaguuuugauggaccuguaaacuagacauuucacgugcagcaucucugaaaccgcauugauuuguacagcuuuaagugaguucauguuucuuguuguaauucaaggaaauaaaaccaauccauuaaaaaauuauggaccagaagaugucuugaacuuucuauuuuuguagucugugcuuuguuuuaacaccuuuaacuuauagaagaauuuaaaaauuacauagaaacucuuuuaaauuugauuauuuaguuuggauccuauuaaauccagaugauuuuaugcagugcuaauuauuuggagucucagcuuugcuuuugaguuagcaguaccugcucaacuuuccaacuguaaaacaguuugaaaaucaaauguagcuuacaugcaagacccaacaaaauuaaaaguguuaagugcguuuuggcaguucacuuuuauugugcccaguccucaaaugcaccggcagauaaucaucugaauguuaguuaucuuucacaugcuuaugugaucacacaaaaaguacaugcuaaaaagaagcagauggugacagaugggcaagguugaggaaggugguuugggaaacccauagaaauacacuucuguaauagcauaaaaauaaaacuauuugauaaccaacuuacaaaaaaacauuuagauuauagaaugaguugguuuuugagaaauauauuauaucagccgugguuacuguugaaaauggaaguauucacguuuauuuuaucuaaaugcaaaaagugggcccuggugacaaaaagugcaguuaauucucucuucuugguuuucagagcccauuucuaaagcauuuauuguuagaacucuauauaauuguuuuugaaaucuguuuaauaucugaaauaacuuuuaaaaaauaucugaaaugcauuugaauauugguaacuuuugguaaagaaaucuuuuauugugauaaaucaauacaaaugaaaauuuaacuacauaaaaauuuaaaaucagaaauauacacuaacuuaauaagaaguagguagagucaugggaguagaugaguaugagguaauuaauguaggugaagggaacagauagaaauaacccugaugaaauuuugauuaaugaggauuaaaugugaggauagcauccagucgacucuuuaaguauugucuuuaggagcucaucgugaaaaugaauguggcccguuacaugugcaucuauagucugcaggcaaaaccaguaauguccauagucacguucaaaguagcccuugaauaaaaucugcuguauuucuacaaauugugaaauuagucuuagacuccuaagcuucaugaaaaagaguuacuuagcuaacauuguuuugaacgcuaacauuuuauuuaauuacgaauaauuuuucaacaccugcccuuuucucuuucugguagucugaaaauaugucauccuaguauuaaagggaaguuaaguaaauuuaagucucaucaggggcacaguaauuaguucuaguuguugucugccucauaguuagaauucauauuuaagaaccucuaucagauggguugccuuguuacuugauuuaauuuauuucuuuacuaugcaccuauuaugaguaacauuaacaguuaucacaauuuguccaauaauugaauauuguuuaaaagugaaguaaaacagaauaaaugcccuccaacuuuuacaccuagugccauuuacuaguuuagaaguugugaguuuuuaugcuagcuauauuucauguaagcuucuucuuaaugugaugaaucagacuauuugguaggauuuuaauugaagcacaaaauauaauuguaaauccucugaaugcugaggauauaaaacaauaaccuugagugggaauacuaacgaugccgauuuuuacuugaaucacauggcccaguuuuuuagaauuccuuaaugucuguugcuguaugauaaacaggcaguauagagaacuauaggaagauauauucaugcaugaugaauuucugauauuguauaugcuuagauuuuuuucuuaagggauuuuccuguucugacuuugguuugcuuuuggaauugugauguuagcugcauuccgucaauuuuacaugaaaggagguaacaaaaaacauaaaacagaaaaaauugcauauuauaucuacagauauuguaucuuaagaauuaaaauaguaggucaauaauuauaauguuauauaaaauagcaauaugaaaaauauugacaaaccauggaucauaugaauuauaugcuccucuuuaaacuauaaucucuuaaaaucuuaauaagaaaacuugucauuuuaucaaauaccauugaugugaacauauaaaaagucuuuauaaagaaugaauuauagauacauaucucuauauaacauauauauuaguuaccugaaaagugaggauaccaaaaaaauugaaaaaguaguaaauugguucauccaaguucacaguuuacuuucacaacauagguguguagacaguuuguuuagauguuugauuuuucucccaucuguucugucaggauuauugauugagcagcagccacugcagggcaugccuugcuuucuuauagcugcuagccuugggugcaaacugauaaagguaugcuuucacucuuccaaguccuucuugguaaaguaagacuggagugaaaugccuuugaaaauuucuauuauauuaauauggaaacacuuaauagauguugucauucagaauuaccaguuacuuaaugucaucuuucaaaauuaguaauuaagagcauauuuguagauuaaaaauugggauugauguuguuguuugcuuguuuguuuacuuaccaggcuuuuaaaaaugagugcaaguauuuucaucagauguuaccgaauguuugauguuaauuuaccuguuugaauauuagggguuuuuuuguuuuugcuuuuguuuuuguuuucuaaugucugcguguucuuuccugaaguuugagcuguuugaguuguacuugauguggucuuuccccacuuaguggacugcuuucgucccuuguaucugggaauuuuguggaguggauaggcuaucgaacuuuacuaaggugaggauguaagucagcacuagaugucuucauuccugcuuguguuuggaauuuuggguaaaggucuauauugcuuuaagguaaaagacacuuaggucauuuucaagauuacucuuuuacugauuucuucucucagaguauguucucaucugcaguuacaaacuaauaguaugauagaugaaguugaaugagguagaauuagguugcccuaucaguuugccuuuagaccacugucugugauaccuucucaccuccacagugaucaugaaauugaugagcugguuugcuauggaaagccuucauuagaagaaauggagagauuuuuuaacaauuagguuaaaaagcacaaauuuuacuagaauuuuagaaaaagaaguacuuugaguaagaaagaaaauuuuuguccaaaaaauaauacaaaggacuuauauuuuagaauaaugaacuugauuuugaaaauugagacuguuucacagaacugcauuuuaaaaucauucuauauaagagagaaaauaggugaauagugaacguguuugacauugugugucugugcauauaaugcaacggucauuuuuauuucuacuucuuguacaucucaccucauaacuuauauaaaauguuuguaguugauagaaaagccucuuacgacuggcugugcuuuuacauucucagcaaugcaaagucugcauguuaguaacagagugcauuacgucaguauuguugaccacaaagaaauaccgcagacaguccaaguuucguccaaauguaucucucugucagugacgguccacgcgucagacgcaaaacugucuguauugaggaucaguguuuauuguacagagcuaacaaaaauuauuuaguuuuaucacauagauuuucuuacaguccaguucugauuuguaguugccuuuucucuucagaugaaaaccuucauuuuauguacuccuacccgucuggcugaaaaccaggcauuuaaacaaaaauaaaggauugccaguuuugccagcuggggaugagaacccggcuggugaaauguggguucagaaggcaguuaauccagcuuuuaugcuuuuuaugguuuuaugaaaaaaagagguuaaaaaccacauuuggcuccuuuucauguaugccacuguuuuguugguguuguaggaaugcaguuaaagauuaguuagaguuuuguuuuauuauuggguaaaauucuguauagguuagguaacuguccaggaaacaauacaccucacuaaugagcuauucaacagucaguguuacuuuaaaagguacaggcuguauuuccucuaagaaaugagaggguuccuuacgcuuccugacccuauuccuuaguuuucuucucuucucuuuucguuuuuucuuuuuucuuuuuguccccacucauauuacuuacucagauacaaaaauaugugaaugcuuuuucuauuuaaaauucuccaaauguuucucuuccagagaauauuuucuuuacucacaguaacuagauuugugaucuuagguuacagaguauuuucuuagguucuuggaugcaauaaaacaaugauuugauuugaguuuuugaaauucucuccauaaucuuuaaauauucaugccugucauaguauuuauagguaacuuuaaugugacugucagaaauaucuaaaaaaaucuacaaaauauuugauuaauucaaaauaugaauuuuaauugaugaaauucauaugcuagaacagguuuccucaaagcugaggaaagggucaaauaaacugagguuuaguaucaacucuaauguaguuauguaauuaaaguaggaugaggaauauuccaucaagcaagaaucacauuugcauuugagggugugguuuaguggcaaaacacgugcauaaggccuuggguucuaguugcagcuccauagguugucauuggugauaguaaauuuacuucuuuugaauaaugcuuuaaaaguuaauguacauggguuggacauggcaguccagaggcauacagacagaucucuaugaauucaaagccaggcuagucuacauagcaaguuccaggccagucaagaauauauaguaaagcuagaugaugaugauaagaauauauaguaaagcuaucugaugaugacgaugacgacaagggggaggagcgagaggaggaggaggaagaagaagagccaagacuauaauagugaaguugcugcugcugcugcugcuguuguguuguuguaaaaauuugucauuuuucugguuuuacuucuagguauuagaagauaaugacuauggccgagccguggacugguggggcuuagguguugucauguaugaaaugauguguggaagguugccuuucuacaaccaggaucaugagaaacucuuugaauuaauacuaauggaagacauuaaauucccccgaacacucucuucagaugcaaaaucauugcuuucagggcucuugauaaaggauccaaauaaacgguaagcuucaaugaugguccauaaguuacugaugaauugguuagagugauuugugaaauuaauucaaauaugccugauuucuggaagcauuguauuugguauaaacauuuuuccacugagaaacuugucuuauuuaugaaugcauaguacaaaacaguuuaaaaauucaucagcucuuuuuuaacuugaaaguauuauacaaacuuaccauauuagaggguuuuuuuaaauagaaauucuuuauuuguacuaugaaaaaacaauuuuuucauuaucuuaaaucuugcuccuuugggauaggaaguucccuuuucuccuuugagucucuagggcuuccuauuccuacugacucacaucaaagaaagaaaagucguuuccacucuccuccucccacuaaacuguuaacauuccuaucuuuuguuauuuaaaauuuaaccuaauacggauaaaaaauugauuuuaaaagcaagauaaccauaauuuuuucuuaaagaaagcauuuacugcccagucacucuauuuuguucaguuuaucaauucuuaauauacucacagguuacaugucaaaugucuucugaauacaaaguaccccauaaugucagagagacauauuuuauauauuuuuuucaaugagggguggagggaaggauggagaaagggagggagggggaaggagagaagaagagaggagaggagaggagaggagaggagaggagaggagaggagaggagaggagagggaaauucuuucacucuuucccccuaaguaucagaacuuuuuugaaaguucauuaaaauccaggcaucuagaggauagacaacuucauauguuuuugauugucaagaauaccuuaccuaauguuuugauacaguguauugugguucauguuuaacauauauuugagagauucaguuagugagugaaagaaauacgugaauucuuagaauuagacuuugucuauuuuaguaguaguugccacuguagguaucuaauuuuaaauuguuaagaaaggaacuguagcgaugguguaagugguucagugacuagcugcuuuggcagaggaucuggauuuggcacacacacacacacacacacacacacacacacacacacacuccaguuuccaaggcuccugcaccuucuucugaccuccugagacaccaaacaugcacaugauaaacaugcaugugugcagguaaaacacucauacacauaacauaaaaaguaaguuuaaagacaauauguuuuuaagagugugucacugcuuucagcagaauuacucacauuguuuagccuuuacuagcucuugguguugucaggaaccauucaaaaaucauacugagcauucuuagugacucuuauguuuccuuagacuuauaaaaugucucugaccaucccccugcauccagguacuuucuugugauuugcuuugcucuuucagugcuuuccagaguagaucaaguagauaauacaagcauuucauguacacaagugauuuguccauggucucacugaaaauccauguggaauaaggaauagaaaaccaauuucccggugugugcauuauguuuuuuuaugcaucuuauguacaccaacuucucagaauagguuuuucauuuaagaugauucugucaccguuauguaaugagcagcauuugcuggaaaguuguauuuaagcagagcuaugccuaccaguucaucuuuuugacuuggggagaaucuagucuuugacuuguuuucaagggcaaugaauuuuuauccuaucuuauucuaacucuuccaucuaucuuuagucacucuuucuuaugugguugucucuauaagugacgaaauaaaguuuugcuuguguuuucuaugucucauucauuuagcuacuauggggcauucccauucuacagauaacacauaguugggaacuuuugaauauauguuagauacauuucaagaauguaggggcccugguacauacuuucuccuuucugagauugaaaacaugauacaggcuuaugaagccccuuuguguaaaguacagagcagucagaccucugugcugcuauguuacaucaaaguaucaagagcucaaagauaaauaauaacaugaacaagucuuuuuagacacuuauagacaaagggcacaaaacuuacacuucauauucucaggccaaacuauauacaaaugcucuagaaaucauagccuugacuaggagacguugagagccugagcuggcucuuggaggccucgagaucugcagugccauuuaggcaucuuuugccugggaauauagcuagaaucucaccugaacauggucucugagaaguucagugacuaggcugcagaauaugagcaggugacauugaaagaugaagcaggugcauuagaucauaaggaucauauguuucuuagaaaauaaacuuuagucagggaaggaugagaagccaggcaaaugcuguaaagagagagauggugucaugagaugcaugugguaaggagacaacacuggcaguuguggauuagaagaguaaagggcagcaaggcagaacacuuuacaaagccuccauggcaaauacauaacuuaggaugcugaggcaggaggauuuaagauuugaggccagccugagcaacauagagagucguaucuuuaaaauaaguaacacaaaaaauucuagauagcaaaguagguucuuuuugagccaagguuuuaaacaauguauacaguuuugagaguaaguagaaacaguaaggaaguugauguauggaaucugacauauggagcaggagcaaaggcagaggcuuguagugauggaugcugagaguaaccaaauaaaccaaaucuggguuucucugggaaaccuagauagaaaugucaaguaaggaucaggaggaaaugaaaccagugcuuaagagccacaggagccagcuguggauuuguguguccauugacaucaagcggaagcuagaggcagaaaaauagcaagaaaaaacgugagaagaggagggcccaggacagaaagcugggaaaccuaacagucuaggaagcaaauaaagucagccucagacuccagaacacauaagcagacagugugacuuccuccguucauugauggaggcuacuucaagugaugccuaaaguuuuccuuuaccgaacugcuuugaguuccuccaaaggaucagccaucacugggcuugauuucuuucucuguuacucugcauggcuuacuuuuaucccugugugcaaauuacauaaaaagcaucacuucauggugggugcagcucuauaggaaauggcacuucugugauguuccucauaguuaagaacacauggaagcuaaagguuuauuuggcauucugauguugggaguuuaguaauuguaagcauaaauaagucaguucagagcauauuuugacaucauuuugaagucuuuaaguuguauauuaaggagccauugacauugaaauuuuugacagcuucacacuuugaagaagcuugugcuaauagauuucagcuucuaaaauucacccuacaacuguaaucucaggcauagcgugaguucacaggcaguauauaauguauuuugacaaacaugguagcuacauccuaagccaaccuauugcaaaaguacugagauuuuacccaaaaaugaauaacugaaucuggauugauauauauauuuuuaaacuuguagaauggcugcuucucuccuuuauauauccucucaaguauacauccagugcaaacaguauuguaaacuauaaacuaaacuguguaggaaaauagaguucugauuuuuaugcauauugguuuuauuuguacuuugaaauaucaaauucuuuucagcaaaaaaacauuuugguguuuucugcuuuucuugucucuuaagcaaagcuuagaaugacuguugauccaguacugaucucugcccuccugugaguuggcagccuaccaggggaaagcugcauaauuggaagaacagugagugugggggucagagguuaaaccuuaaauaaaaucaccagacugaagguuccagauaugaacucugcuacaauauuauacaaccuaguguccaucucuggaguggaguuuaagaguuuauuuaaagaauccuguguagauucuagagaaagcuuucuugcaauuaacaccaaagcuaaucauguauuuacugauuacuucaggguucauccugacuaugucggaagagcuagguccaucuuagacaugaauuccuuacaucugguagccaguauuccaaagauuugguccuuauguacuuucucuagcuauuuguuuuguuuuuucuuuaccuagugacauguuaauauugguaugcgucaaaucaccagaacuagcuguuaaauuuccacagauguugagcuauacauuuuauuagucacucauuuuuaucaaauuaugcaaaucaagaauagugaaagcaaaguacgaagucacacuuuaucacucuaaugauuuuguuccaugucauuguuauuuuguuuuucugaguuguguccauguggaaacaauauauagugauuugauuuucaacuauguuauuuugaaauugggccuuaaggguaucauuccuacuaccaaaguuggccaguccucgaagucaguguuugauuggugcuuugauucuuuagaauuaagaaaauguagggggagccgggcagugguggcgcacaccuuuaauccuagcacuugggaggcagaggcaggcggauuucugaguuugaggacagccagggcuauacacagaaaccuugucucggaaaaaaaagaaaggaaggaaagaaagagaaagaaaaaagaaagaaaauaaaugugggggaaagguuaauaguguaaacucauuugaagagcuuuugguuucuguggcauugcaaaagcagcgagguagguaaggugguguucacuguacaaagucucucagcagucagugcucacuguugcuguuucucaggucauuuucuucucugccuuaacagaaacaaaacaaacauuccacaacuaauuaguaaucauagucauuuauaguugaauuuggaauugagcauacauuaauguuuacugugagaauuuuguaucugauuaauaauauaaacauucuauacuuuuuguauauauuauacuuuacaucccuuauaaaaguaaaaacuauaauaagcucaaucauguauaugcaccuaugcaugacuaaguccaaagaaaauucccuguguuagauccaauuucaguguguuccuucauuuuuuucucuuuuuuuguuacccuccuuccauucuuauuuuucauauguauuuucuuuuaaauaaauauauacuaaauugaaccauagaagccagaaaacacuuguuuuuucuuaucaagucacauuguuuagauaaaaacaacuuuuaacuuaggguguaauuuuaacuuuuaguuuuauauucugaauuguauaguaaauuggacuaugaggauauuucauagauaauaauacuguuucuguaucauucuuuugaaauacaaauacaaccugugagauuuuuauaugggauggugaugucagagagaguuuuauuguuuuucuuugugggacacucauggucuuggucuuuuucuguagcccuggcuguucuggaacucacuuuguagaccagguugucuuugaacuuacuguguagaccaggcugccuucaaacucagauaugugccugccucgaccuccccaguauugugaauaacuacacuagacucagaucauuuucuaaccauuuauuuacuucagaauuuacauuaacaaaagaacauuuucacugacuaaaaaaggagcagugguagaagcaccccuugcuuauacguggugcugccauguauuaaaucuuggcgcccacaaaggggugcagugucuaccaugcaguuggagcugcucgccuguugcuuacccagucccucucucaaaggccaaagucccuugccucuucaggccucucucuaaagccuuugucucuuaccuucgucuaaggguaguauuacguaguagcauuauuuaauuuuuauuuucauggcuaugcauuucaaaaauuauuuaaacacacuaaauuuuaccuacauaaaacuuauuguuugacuuauauaacuuauauaaauguuuuauacuuguuuaauguuuuuucuuauccuuacagccuugguggagggccagaugaugcaaaagaaaucaugaggcauaguuuuuuuucuggaguaaacuggcaagauguauaugacaaaaagguaagcugucucuaagguucucuacaccuuagaaauuuaccucaguaaacuugaaugauacgacgauauuuucuguuuugcuuuggaauugaaguuauguuuaaaaaaauuaaagaaaaaauuuuguuauuuaacaaacaaaucuaugauucuauuuaucucuauuacuuguaaaauauuauuucccauagaaugauugcuaccaauuauguuuccucacucuuuuuuuuuuuuugguuuuucgagacaggguuucucuguguagcccuggcuguccuggaauucacucuguaaaccaggcuggccucgaacucagaaaucugucugccucugccucccaagugcugagauuaaaggcguucgccgccgccaccgcccggcuuguuuccucacuuuuguuguacaguguguuuuucuugugggcguuuguucauuuuuuuuuuuuuuuagacugaguuacacuuaguucagccuguuucuggaauuugcuguguguucuugggccacccucaggcauaaugguucucuaaugugggucacagcacuggacuccagauuaccgcauaagccugccuuuuccaguuuuguacucuacuuugccuuuggacauucuucauacaaauauugauuuagauuuuuaaaugcuugcauaauuuuuaugugugcauguauagggggugggggcauggaauugaagucagauguauacuaccaucucuuucccugaaccuggagcucacagaucaggcugaucuggccgggcagagagcuccagggaucugcuugucucucucccuuagcugagaggaaccgcauguagcuuuuuacauagguucuggaaauaugaacucacauucugauguuuaugagccauguacuuugccuaaugagauagcucuccugcccuuucuauaaaauuuuaaugugaaaaguugaugaaauacaguaauuuacuuagaaauuuuaucuaauuauuuugucuaaucuagccauuuuacauguccuuauuuuuaucugaaacauuauuuguuuuguuccaaguauuuuuuuucuuugagccccuuuggaguaucacaguacaaaugauaugggagaugacugguauuucauuuuuauauaauauuguugccagugggaaauaugauuuuucuccccaguccuguaacuaagcaauaaaauaauuguccauuuaaacacuuuguucaaagcuccccuuccacccuccucacauauagaguuucucacgugugaaagcacuguggugugugcuagguccuucccagccucugugaggcucaggggcauucugaaaugcuguaauagauaauugcguccacuuuauaucgauggugguguuccucaugagagcaugugugccuaaaaaggcuucuguaagcucugcccugccuuuaucacaacucuccaccacgaaagaacuggaaguagugcauggucagggacucuccuugacauaaaaugcuauacagugcaacuucauaucccucgaacagcugggcgugguggcgcacaccuuucaucccagcacucaggagguagaggcaggcagauuucugaguucgagaccagccuggucuacaaagugaguuccaggacagccagggcuauacagagaaacccugucuugaaaaagaaaaaaaaaaaaaaaucccuccaacauacccuguccaugaaguacucuuucauaagaacaagagggcagggugugugguucaguggcagggcucuugcuuggcaugugugggugccugcauuccaucccuugcaccauacacacaaagugaguaaaaauaauuggcacuagaaagaagaaaggaaauauuccuuuaaaagacaaugguaaggaugcauuauuacacuucuaaccuacagaaggagagcauggcuuuccuuaguguuuagauggucacacgaaauggcuguuggcgauacugaagaaagauaaaaggguucauauagcacaaauaaguaaaacacuaacucucagaucuucugauaacaguagcaauuuuaacaaaguuaguaagaagucuggaauuuuggaaauaugaaucaugaaauaaacugugaaauuggaaaauuugcagggucuuuauauuuuuaaaauguguaacuuugacuagugagauggcucagugaguaaaaggcacuuguccccaagccugggagccucauucugucccuaugaugcacauggugaaaggggacgaccuacuccugaagguuguccuucacaugugagcugugccacaugcagacccuucugcacaugcucaaauaaguaaauguaauaaaauauuaaaacggguuggcauuuuguuacuugccaauaaacuuuguguguuuauuauuucauaaauuaguccuuaauuaaugccuguuuucuaauuaauuucuuuucagacagggucucacuguguaucccuggguaaccuagaacggacugugaaaaucagacuggccuugaacucauaaagauccaccucacucuuuuucuaaauuuuugugguaaaauagagaugacauauuuaguaucuuuaaacuacaucuaaaccauucucuguaaaagaaaaaauagaaaauuaacuaauuuuagaggaauacaaaaacaaaguuagaagagcuggucaucuauucuggacucuuaucuugcccccuuuuguagaaagggacaagccacaugaaucauagaagacugauaaucuuaggacccuuaagccgggagacuuuucuggaaggguguuugcuaguaugacuuugucgacacacccuuuccuccuguuuaagacagggucuuccugugcaugcucuccucccucagacucaaaauccucccuccucagccuccuggguaauuguuuauagguauuuuacuuuauuuacguauuuuaauuuuuuaagaaucauuuuuucuaugcauuuauugcuugcauguguuuguacuguguguguguguguguguguguguguguguguggugugugugugguguguguguguguguggugugugugagugugugugugugguguguguauguguguguguguaugugugguguguguauguguguguguguguguguguguguguguguguaugugugugugugugugugugugguguguguguguguguguguguguggugugugugugugugugugagugugugugugugguguguguguguguguguguggugugugugugugugugugugugugugugugugugugugguguguguguguguggugugugugugugugugugugguguguguggugguuacagagguuauaaugcuacaugccauguggcuucuggagccugggaaucaaacuucaguucucucuaagaacagcuucagauuuuaaaggaugaaauuaauuuggauuuuuauugauuucuguuucuggguuugugaucuuacuuguuuacugcacaugugucuccaucugucuguaugguggcgggcaggccuucugugcucggccacugcugcacuacuagccucauuuaucauucaucagucaacuguucugaguuuacuucgaugcucuccccagaguuucuuuaaguugaaacaauaauuauuguugugagacaguguuguuauuguugcuguucuuaccaacucaccacucaguuggguccagagcuuuucucuagggcagugguucuuagccguggggugccaccccuuuggggguugaacaacucuuucacagaggugacucuuucacagaggucacguacaaccauuggaagacaaagauaucuacauuacaauucaaaacaauagcaaaauuucaguuacgaaguagcaaugaaauaauuuuaugguuggggucagcacuauaacagaaaaucuauaaaaggaucacagcauugcaagguugagagccacugcaccagggacuguucagccgguuucuuugguuuuaaaaugcagucuaauuuaaaaauauuuuaaauauuuuauuuauauaauguggggaaaagagagaaagaacaacuaaauaauaggagccgaggaagaaccaaaugacuguucugaauuuaaaaguuuauugagcuuucuuugcaucuugguuaauuucuauugugugacuuuuuuuaauaauaaaguuuuuuuauaaaaugaaaaguuuaaauuaucagggacagaggggggaggaggagaaaacacagauucugcuuuuccucuauaacauguuuuuaccaagaugcgucuauggauaugggacacauguucugugaagauggcagauggugugguucaugucgucagcauccuucuguguacugguacuaucaguuacugacaagcaguuguugaaaucuucagccacgaguguaaacaucuuuuuaauuuugcauuucuuuuuugguuuuguuuacuuuuucauuuuuuucagugauccuccuccucaagcucagugcuuuauacaugcgaggccggggcucugcagcuuguugcagucgagcccccacucucuguauuuugagcuguuggcuguauguacacuugaauuuaagauuguuucaucuuggggaauuuaccccuuagcccuuagguuauuuauugauuuucuuuuauuaaguauacaaucuguguguguguguguguaauaugucuuuucucaucauuuuuauucaaauuauaaauaaguagauucuguuuuaacauacaauucauucuuuuuuuucuuauucacuggauaacaugagaauaaaaugugauguauagcuaucuucauuuaauucauuuauugacauaguuaucugucugauuuuuagauuauccuuuuuugccuuucucuuugcacaccucuuuugugauuuguucaguauuucugguuccauuuuuuuuuucuguuauaaucuuacuagcuguaucuguuguucucuuggaagucguauguagacugcaaugucuggcucacucccggucugcucucagcuggaguuaugucauguagagcagcagacuuuuccucccuuugccauuucugugcugccauuuuguaagaguuuuuuucuuucauacaauaaauauuacaguauaugguaaguauacuuuuugcuuauagauaacuguucugaucuuugcagcucuagggauuaaacucaggcugcaugcuugcuagguaagcucuucaccacagggcugcagcacugaacucucaauaauacugucuaaaaguggucacaaaggcucucaauucauuuccuucagauccacgugucaaccugauggugugucuccugugcguuuuucuuuagucaacacucuaaggcugacuuuggugcuacacuucaggcacugaccuuucuugcuuugaaaacauucauaggcagaaagauuaaaggaaauauaauacugaaaaucauggaaauaccacauuuaagaaagggaagcgguaaagggauaaagcaguaaagcauggcaggccugaccucagaggccaacagcggcgaggggccugcuaacgugcugcaugcuccgaacaggguugcuucuggguuugguggaaggaaauaggguguguagugcgaagaccuuccuaagucuucuugguauagcaguagggagaagaaucuagaaaagaauccaguuacaagucugcuucacugaucugugcuaacuuucaggggccucauagaacagauugaaggcaccaaggaagcaaaagggaguguggagugagucugucugucugucugucugccugucugucuauagauaaccuaaagaaauaggcagugguuuuagacuaaaaauacaaagagaaagacaauagaggacuuuucauuuuaauucaaaaagaaauuguccaaggaaccgauauuugagugagagcaggaaagaaugcaagugucuggagucagaggcuggagcuggaggauggucuccucuccagaaaacaaggaugauaacguuggugggaaaugcaaguuuggaguguaguauaagaauauagaugagugguucuaaacauugagaacaugcaugaucgggaguggaguuugauuggagaacacguaauugccacaucuaccuaacugguggaaugucauacaaauguuauugugcagcuuuucauucugagucaggcagggacagucuacuaccccauuagaaucuucacuugaaaaguugagggauugauagcaguuguacagauguuacuggcuaugauuggcuucagguaagcuaaagauaggucucuagguauugucaaguugguguuuuucuuaccacacuuauuuuaaaauguuauucaaagaaagauguauuccaaaugugugcuagacauucugacauucugauggcuaacaucacaguugcugcugucuuuugaucaugaggcauuuuacauaggauaugaaagaccagacaguuaucaaaauuaacauugguuauuucauaagauauagcuuaagcuuuaagaaauguucauagauagauagauagauucauucuuaaaagaaacucaccuaaaaaucugggggaaaaaaucauagugaauagaagcauuuagugaccaaguauuagagcagcaccaaagguagucuugcuguggcucucaguagaugugacaaaugacuugugucagauagaaaugccaggaguacaaucuucagugaaaacauacuuugcacuaaauuacagcaucuuuaucacaagaaacacuuaaaauacaauagacgugcauuuauuuaacacacauaaaaauauccuguuucauuauuuaaaagauucagcuuugcuuuuacuuucuugguugucuauuuuauaguucauugauuucugcuauaauuuuuuuuuguucuaucuugauuuuaacuugugugcaaugccuacuuuggugguuuuaauuuauggcauauaaauauuuaugguguauaaauaugguauagaccuugauuccuuuuauauguuuuacauaggauugaggucagauauguaaacuucaauuaaauuauaugguuacagaaaaaaaauagacuuauuucaaauuucuaguucuaugucaagaaugcauugaaagcaucgauauaauuuacauauaaagcuuuacauauaacauaguuaaacaguauaugacauuguuggauucauuuuauguauacauuuuauauauuccuucuauuuccaguauauauacacauguguguauauacauauauauguguguauauauauguguguguguauauauauauguauauauacacauauacauauauacauauauauacacagaacauuaagaguuuuuaaaaugaaaaacggggauaaaauaaaccagaauuccacauaagaguaacuacuagauccuguugauuuaaagagauaaauuuauaguaccagauuacugaaucuaaggguacuaaacauucuuuugcaaaugucuauguccuaguguuuugauucuuauauacuaacacauaauaauugagauuggcacagguuguaaggcaacuaagacacuauaaucacagccugucacaggaagagccaacaaauacucuguuucuuaaacaucucagcuuuaaaauagaaaacaaaacaaacaaacaaaaaacuaaacuuacaggucauaagugauucggcugauuagggaagucuaggaagacuuacuuucaaagaucuuaguacuacauucauguugcauucccagccguaauagaaauauggauugugauuuacucuugggaauuuaagaaaaccaucuuucuguauuccuguacuuaauacuguaaacaaauauuucucuuuagaaagauagugaauauuaguauaugaugauuugaugaaagggcaauguggaaggaauaugaggaauuguaauuuuuccuacuugaaaggugauuuuugcacaaguagaccuaauuuuaaacaugccuuuucgaucaacugaaguuaauaucuugaacaggcuagcucacuaucacaauagcaaaauaaucaagauaauccacacagaaagaggacaggauuauuugacacaccauuuuagaaguuuuuacauaugacuggcugauuccauuccuguugggcuuguggugugacagauggcacagccugguaggaagcucauggucgaacaagcugcucacuuauagcagcaaaggagaaacaaaaggaaggaaccuuaguuucauggucaccuucaagaucacagucuucagugauaucaaacaaagcuaggcccaucucuuaaaagucaccaccuuucugaaaucaaguuuaucauaugacuucaguggacauucuagaguuauacuguaguagcccagaaucuuaauugacuguuucagucauuuagaacauuuucuaaaaucacaauuacuuucaaagaaaguucuguuugaagugaaaggcauuaguuaagaaaauauaucaaguuuacacuuaaugauacaguugcuauuuauugaguuagcacauaaaggcuaacagauguauaguuagguauuccugauuugcuaguaccugcccuuuuuuaagggggggggcgucuauacuguuacaccugauacaggaaugccuuaaaagaggugucuagagaaaaauaaagauggugugauaauauuggcuaaaggcauuuuuuuaaauuuuuuuaaaaauuuauuuacucacuuuacauaccaauaucagccccccuccucccaguacccccucaaauagauccucccccaaccccuuuuuacuuuuuuacuaauuauuuuauguauuuauauucuaaauguuuccacccuuccugguuuccccuccaagaguucuuuaccugauccuucuucccuggggcaucaaguuucuacaggauaaaguacauccuuucccacugagcccagacaaggcaagcacccacuacaucuggagcaagcccacagaccagcccauguaugcucuucaguugguagcuuagccucuggaaacucaggggucuggguuagucgauacuguuguuaaaguugauaugggguugcaaucgaugucaacucuuucaguccuuccccuaacucuuccauggggguucugaccucaguccagugcuuggcuguaguuaucugcaucuaucucagccagcuacugguagagccucucagaggacagccaugccaggcuccuaucugcaagcacaacaguaauaguguuggguuuuggugccugugaaugggauggaucacaaguggagcugcucccugacccuuccuucugucucugcuucguuuuugucccugcauuuccuuuacacaggaacaguucugggucaagaauuuugaagauggguggguagccccaugccucaaauggggauuaugucuaucuacuggagguggucucgccagguuccaucuucccacuguugggcauuucagccaaggucauccccauuagguccugggagacuugcacaucccugguaucugggacuuuccagagcccccaccccaccaccgcgcgcaugcacacacacacauacacacacacacacacacacacacacacacacacacacacacacacacacacacacacacugcugcauauuuccauucacucuccuggccauccgggccuguccccugucucccugcguaccuugucuccccuuuucuuacuccucucccacccagguccaccucuccaucccucuguucucccuucuaagugggauugaaguauccacuggggccuuccuuccugucaugcugcauauggucucugaauuguaucacggcuaauauccacuuaucagugaauauauaccuaacucacucaggauauuuucuaguucuauccauuuguaaagacaaaaaauuaaaacaucauauaguacuacuauacuaggguuaccauaacaaaaugccacagaauaggagggugugugucucuccucucccucucccucucccucucccucucuccccucucucccaccucucuguucccccucugccucuuucccccccuucccuccucccccuccccuccccucuccucucuccucuuuuuuuuuuuuuuuuuuugcugguguuggaagucaaagaucaaagcuuaguucuuugguaucuuucuuuggcucacaauugguccucuuucccuagguuuuauagugucuuucuuuuaaguucauguauuucguuguuugucucucuuuuuauagacacuccggagugggugaaaggcacuuuuuaauguuuuuaacucucugaaagcucuauuuaaauacagucaaauaagauccccauauguguguguguguguguguguguauacacacacacacauauauguaggggaagaauaaaauuuauuucuuaauaauaaagaauuaaaauuuauuccacugucuuuuuuuuuuuuuuuugagacaaguuuucucuguguaacccuggcuguccuggaacucacuuuguagaccaggcuggccucgaacucagaaauccgccugccucugccuuccgagugcuaggauuaaaggugugugccaccacgccuggcuccacugucuuuuaaaguaaaugaaaauacugaauauuuguaaucaacuccagagacuuagcuuuacugcugauugcuguggaaguacaucugaugaaauauuguagcaaaauuuuauaaguccagccuuccccauauacaugaugugaagcuugcuucuccccagauguuuauauuucacuguauuuuuccugauaccacggugagguggggugccaugccucuuauugugaaugucuugacuuugauuuuugacuaauauugguuaagacuacuuauuuauuuuuauuucuuugagauagauagggugucucugcauagcuaagaauggccuggaacuugcuuuguagcccagacuggccuuaggcucacaguccuccugcuucugucuccagaugcugggauuauaggugugcaccacuaaaucuguucagauggucauuguguuauuuacuuuugcugugcuugagaacagauuccauuuuccaacuuuuaaaaauagaaucugucuagagaauaaacauuuuaacauagauuuagugccagugagaagggggaaacauauuucuauuaauccaagaauccaaguguguuucuuucuguuagauuuuggcaaaacaugccaauuucuucauccuguuuguuauuuucuuaucccuguaaaacuuauauucuguucugaugagaaucacaaguccuggggcugagcaucuuuuauucaaaaggaaacccaugugucucucuccuacccucaacucaaggcuaguaugaggcuucccucccacccugcucuugcuuugagccacuccagcccucagcccagcauaauuaauugagccuccuucaggacacgucccccugugagggagggagggagggaaagcuguggaugcaguuugucacaaacuucaaggauugcugagaauucugauucuaaggcaagagcagacauugguacuuguucaccaaaacagaauaaaacagauuuuuuuguuguuguguuuuacaauaaaggugcaguguggucugugguuacagagcagguguauuaaguugccuuuagcuuuucuuuguugguuucugaagucccacugggccaaggagcauugugauccuccuguaucaaccuucugagugcugaaaucagaucaugggagugcaucaccauucccugcuaaguuauauauuuaauauuaaccauugagccagguaccaggaaagagggagaagaaaacaagcaagcuuagauuguugcugccauaagaagaaccacauucucgcuugguauccagccugugguggucccucuacuccugcuaucauuuuauguuuaucagaaagccgugcacccugucugccuuacacaggacgcaccuucuaguuguugggaccauucauuucacuauuugcuugcuaauuaaucuuaaaagguaaguuuuccugaguugaaauccauugacacuauuauuuucuucuuauagcuuguaccuccuuuuaagccucaaguaacaucugaaacagacacccgauauuuugaugaagaauuuacagcucagacuauuacaauaacaccaccugaaaaguguaagugaacaugcagcaguugauggcacucugaaggaguugggcacagucuucuacagagugauugacggcaucacagaugacauuguccugggauucuuacuccauuucugugagaauuugcacugccuaugagggcagagcugagcagcaggaacagacuuuucuggguagaacuugaggccacauuccagccuugcugcaccccacugcugucuuagcagcucugugcuaccugugggcaugucucaaguaggagcauucccuagucccagacucuuguucccacucaucacagcuucagagccucacuagcucugccuccuccuuauguagucauuuaacuuuacuuuuaaaauagcuuuuccuuaaauaguaguaucuuuaagggcaauugaguuugcuauuaauuuucauguauauacuuuccauuaagaaugcacuaggcuguguguucacacaccaucucaugucauuucauaugcacuaauacaugccucauacuccaagagaugucauacauaaguagguuuugaugaaggaggauaggguacaauuuugaggugauauuuggaaagcucaaagaauuccaaguauaggugugcacuguccuuuagcaucucuucccuucuuuuccuuguuuuaacauuuucucuacuguuguugauacugcuuauacacacugaauaucugugagacaaaaaaagaaaaugaaaugcuaucccuguaguggucaugguuacguaauuuuauuguugaaaccuaagcugggacucaucuggagucaguggcccugcauccgagagagugcaugcccccagggaaaaugucuguguacauguaugcacuucuuguucuuuuaugccuucacauugacaagaagugcuuaauuuuuauaaggaaagauguugaagcccgguaucacauacagcuagagcagggucaccagcacagcugggauaccagccaggcucugagaugccugaaugccaaagggagcugcauauauuauugguagacuuucaguaucacuaagaaguuagagacuguuaaaacuccuguggaguugugggcaaguaguuaaaggguuaucugaauagaaauuaugggcauagauaggccuuggccucuggucucagcagaaaagguagcuacugggaauacugggaaaugccagugaguagcugaacagaccaagaaaggugccuaccccaaguucuugcugggcucugucgcuuggaucaaaggcugguugcaugccaaccauccuuccaggguacagcucuccagugguuuccauuuuuaguauauauccauguucucacccagagaaccaccauugauguccaaggaauagugcagucugaccacacuccguucuacugugacacuucuguauugacgaugcuuuaacuugcuauuuuuugucagauaacaugauauuacugaaucucaugacauaaugacucuuugucuuagucccugauagauacugucucgacaaguauuuauuaaaugagugaacauaaaaggugaccagagccugggaggguuugggucaggaggaagcccugcucuuagcacagcacagcuguccuugggagucuggacugccuuuauguguuggaccuccacccaggcauccauaguacacuuuaggauggaagaucuugggaucuuuuuggaaaauagguuggagggacucuuauuagccuagcuucuucuggacucacaggauccuuuaugccauaaccuccugaauguagaaauaacacaucugagucuucucacccagcuugauucaugacaugccucuguccccagggucagccucuuuaauaugauuccuugaacacaaguuuugacauuugauucuucuuaagagagcugaaugcaugauuuuggaaacaaaauagaauagguagagcuuaggaacaaagagucaccucagaaagguaaaagugaaauccugauuuucaggauagaaaauagaaaagcacagauugcaagccuggagccugcuucaugcuucaucucuggcacuuaguuguucugagacauggugccucaacugccugccagggaggcacagggacucugggauaaucucaagcccaugcuucucuagggugugcuuaacaggccagcuccuaaagaaagguuccagagcauucuaagcuugaguggccugauuagcugguccuuaggauugacaugaaaagugagcuauauaauauaaauagcuccaguauaaaaguccccagcuaaguggaaugagcaugaaagucaguagcauaaacaguuuaagacucuaccaagucucaaacaagugaaguuagaagcuauuaaacguacucuugugguuauucagcugcuguuucaugauuagcuuacacuccuagccucgggagucaaggaccaggaaggacauccucacuucuccugucuuccuauuugugacucagacuuauggcagcuguccugagaauuuuuaugacuauuucucaguuccuaagaccucugaaaugauacuaagaugaugacuaggagauucuucauguacauuuaaguuuaauuucuuuccuuaucugcauuaaucaacacaagugggucagguugcauaaggcucagugucuuugaaagaugacagguucauuucuggaguuacacagcaucuauaaagcaagcccuuagguuagcauaauuaccaaaguaggagcuaucagccugugggaaucugacuucuguggacaucagaaguacaguaugaccuugcucugcggcugggcccuagacaguacagcaccaagaguccaaccagucugguauaugcccuacagggugugccacagacuagaacuaaggauagucuacagcuugggcuccucucuccuugcucaggaucucuuggauggaaaggcaagugaaagggucucuguccuagcuucuguugaaggggagaagucacaggaaaugcaguucuugguuucuaagaccaagggaagggcuuuugcuucagcaguucacagauucuaaguuuacccuaugggaagagaaaagaggcaacgaaccauuacuauacugagaguagcuuuuuucugguagccuugaaaacauuguuacucaaaacccaggcaucaagauuugauuccaaagugcacaggaugacauuuguuggcaguugucuuccuaguugccaccuugguuuuauaaaucaaaaauuuuaaauuauuuuuuaaagaauaaaucaguacuuaagaaagaaagcaaaauguuccauuuucugcaaacagcugcagcaauguuccagauuguccuaacugguguuaauuaauugagcagauuuuagaauguguugucuuucacuaccuccaucaauggcccuaugcuuuccucucacagaaaggaaauuuucuuugagagcgagcugaucauuuuugcuacugucuaauuacaucuguuaaauguucugagacaagcaggcaccaggggcugugugaugcagagauucaaauacagagcuguagucuguaauuuugggucauguaaauguauauucacaacugcugucauugugccugcaugguccuccagaggacgaccagauucacagauagugacuagguacccuguuuccuaguucccuucgcugcagccccugccaggauagcagugaaguacccaaguacccagggagcugcugcccucaauuggacauagucagagaacaagccccauuguaaccaacccugaggagguagucaagagcuggagugggcggcuuugaggaaagauaggccugugugggccucauaaccagacuguagauucagauuuguuccuguucagaauuguggugcuauugaagcaacaguggaggcugucuuaauucucuggagacucccacaaguucacccucucucuccaaggcaagacuaagaccugucauguaaagcccuucuaggucuaggacaaggucugguuacagccaggagccagagcagucccugucaucucucugggguagaaaaagcacacaacuuucuuacguagagcaucuggacucgcuguagguuugcugcacagaaacacucagaggaaccaagcucuuaaugggaaaguguuucugagagguaauugacaugugucagaguuggaacauuacuacuucaauugacuuuucuauagagaguuuaugcugugugacucaaugguggauaccucaaacgcaucccagcuagagaauuugaucuauaagauguaugcuguuggcuuaguucugaacucauauuuucucaggaggcugaaauuuccaucugccucagcacuaccuaggauuccugcucagcugcugccaaggcagcugucucucuguagagggaaauuuguguaguguccuaugcuaacuguguguggauggagugugucuaccuaccgcaccaauaguuuuugaugcauuugagcugaaaaaguuagguaaugccaauacagccucacuucugaggucccugugaauuaagaagagaauauggaaaagauuuuaaaaaaucguuuuucagaugaaggcaaagccuuuucuauucaugaaauuaauccucccaacagaaccugggaaacaaaacaaaacaaaaaggaacuaccccacuuaauggauuuaaggaaauggaaauauuuugcuugaaaaaaaaaaagauuguaaagcuacagagagaugauggcuuaguaauuaaggacugcugcucuuauagggaaccuugguucaguuccuggccucacauuguggggcuuauaauguguaacuccaguuuccaagguguuuuaguuuguuuauauugcugugauuaaaaaccaugaugagaaguaacuuggagaagauuuauuugauuuacagcauccugaucacaguccaucaucaaagcaaguuaggagcuuaagacaggaaccuggaggcaggcucugauguagaggucaugcuugcuggauagcucccaauggcuugcucagccugccuuuuuauagaauccaggacccaggggugagaacacccagagugugauagaccuucucauaucagucauucaccuagaaaaauaccccugcagacuugccuacagugcagccugauagaggcauguucucaguuggagguccccucuucccagaugacugcaguuuacaucaagucuaugaaugugcaguguaaccagcacucaggggaucugaggccuccuccagacucugagggcacugacccucauagguuuuaaauaaacacacagacacacccucccucccucacacacacacacacacagacacacccuuccucucucucucucucucucucucucucacacacacacacacacacacacacacacacacacacacacaaauaaaaaaugaaaagaaaucauguuuuagaagguuguacugacuaguguaucccgauuauaggauagugugcaguggacuuuguagaugagcaagagugucuuggauggcucuuuauagugcuuggccacacccaaggaagagcuuuauaauugugaacugcagucauagaacacuuagggaagaaggggcuugguucauugugacccuucacauacaggggaaaagagauaagagagggcauuuauauauguuguccuacccucacagcuugcaaauucuuucuuguuuuccugaugaaccaggucuucaaaucugcccauugguuuuucaucuuuuuucuugauuucucuauucuagcuuaaauuuuuacuauaagaaaauaaaaaauagugagcuagucaauaguaaauguugacuaaaauugcuuaagaagaugaguuugcagucauaccuaggucaccaggaagaaaaacuacaagcacuguggaguccuaauggguucuguagaauucaaugacuuacaguuuagaacuuuaugcuuuccugaagugcaagauccuugaaaguaguauucugguuuuuuuuuuuuuucaguaacaguuuuccuaaaauauugaauaaugaaauuuugauuucuuagagaugguuuuauaauauucuuuguuuguagacagaccauguguauauagaaaucacaguccuuuaaacucaguuuuacugagaaguuaacgagauguacuguuucugaguguaggcagaguaacaguagaaacagaaaugacagcgcuguuugcugcccacagaugacgacgacggcauggacggcauggacaacgagcggcggccacacuucccucaguucuccuacucugcaagcggacgggaauaaguuccuuucagucuguuucuacacugucaucuuagacuuugccugagacugauuccuggacaucucuaccaguccucgcucuuacaguuagcaggggcaccuucugacaucccugaccagccaagggucuucacccucaccaccuuucacucacaugaaaccauauacacagacacuccaguuuuguuuuugcaugaaauuguaucucagucuaaggucucaugcuguugcugcuacugucuuacuauuauagcaaccuucagaaguaauuucacaaucuuugggagucaugagcccauuguucauuugugcaucaagugucaucuuuugguuuuugguuuucccuagcagugaaggcuaaaugagauacacugauucuagguacauuguuaacuuucuaggagauaaaucaagaacuaauuagacuaagaagauuuaguuuauauuucugaacaagcaauuguugaaggguggugguguguguauguaagaguuuagcaguguaugucugaccagcacaugaaguguguaucacugacauuuggcuggaaaaucuuaggaaacauugagaggacugaagggccaaugagauacacauuuuuuuuuuuuaaauccugcuggcuauuguggaggaagcccagugccacccauggaugcccagguuucaagggcaaauggacauuguucaaccaaguacugacggugcagaguccccuagagagucuuaggaucuacuuuguaccagagaguauuuuccccugggcuuggcaaccuuuuucccuucuuuauauuuaucaccucugauggcugaagaauguagacaguauaaugauccugcugucgccaaaaucuauacaccaaggugaacagguguuugccuuaccaguuuuggaguuuuuacuuucaguuauagguaaauuagcuuuuucucagauguuaaaaccuugaauguccuuuaugguuuuguuuauauuacaguaguauuuauuuuuuagugguaagaauuguguugucauguuagcaagcgcagcuccaauucacagaucauugccugcguuuucuuuugacccaugugcaaggaauguacacacccauuagaaucaugcacuuuuucuccuauguuaaaaacaaugguaaggcucugggacuguaucuguugguuagaaucuggcuagaaucucugggagaagagaugcugugauuuaaccccuuggagcugaaaugagagcauccccaacuacccagugccaagggauggaugugagaggauagucuggcagaaaguaauggagaaagcugagacccaaaugaugaugagaaaugaacucuacucggcaaaaugaacacaucacaaguauucacacaauaggaaguaaaggauaagaagcugauguguuuauucuuaucaagguacauucauuacugaaucaagccaucagggaaaacaacaaaacaaaacaccucuagcuuuuauuuuucuguacauauucaugucucccaacccaaacauuucucacugagaggggacauguaugcaaaccucaucuuucuccuucauuaaugaugaucuucagauuaacccuuuggugcuaggagcugacacuuuccaaagcagacuaugacguccaaggaucaaagccucucuugcagcaagcaagagcaacugcugcuccaaggcgugaucauggaaguggaagaccacagugugacacagugguacugcauugucuuuuucaguaggaagucauguucucaugcaagugucuuggccucuaggcucagacuuagagaagcagagccgcugcuggcaguggcuggccgcugggacugcugggguguaaagggcauuuuccuaaggcagcuaagacagacucagacauagauuuuuguccuaauuuuucauguuucuaccugggugaguuuacccucagugggaaguaggaaguuaaacagguguauucuuacaucugcugucuucuguuuuccuacauagaaguauguugaauguugcacauugacaaggaaguagauuagaugguaaguccuuuuaaguuacccugcauccauucuguaagaaaggaggaggagaggaagaaaagcaagcugagccuggccgauguucagaacauuuacucccucagagggagcagacacuguacacuaagcacacagcuucuuuuguuuugucucuccuuccaagucuuaagguaauuucaugaccuuggccaaggauacuuugugaagauuaaugaggggacauugacaaugccucaggcuggccacuccucacacuggcccuugguccccagccauucaagggguuacucaucccaucccugacuaccugagugucacuacagguggguucuuggcuuugaguucaagaauucuuuccuuacacccuccaccagaugucaguggaaaggcagaaguagaaccgaggugugggaggagauucuaaaagcuuguguugcccaggccucuagcuuaggguucuggcaauugagacggccugaaaccugacagcaucauguccgggcagcucuggcuuugugaguccagcuccuaccaacuccaccuugaccucuugucuccaugcagggcugucugggaggaaacuggccacuucugcucagacugcugccagcgcucucacagcuuugcucucuacacuaaugacauagauuauuccaguauuguucccauuucccaccugaccuccagcuucucggagcugacuucuugcaggggccacaugcuucuuucccucacuaacugcagggucuccaccacaccucaguguacacacuuugcugcuaccgucuguacugucuacaucacgguucccuuagcuugcuccugguagugcauuacaggcaagcaugaaauguaaaguauuuauuuaaauaaaaaggaaaccucugaauuggucaucgagucaccucccuguagauuuguagucugugacauauuucgacuuucuaguccugcuagauccauauaagaucuggucaucugguuaaggguuugaagcagacauagcuaugaacccggaugguaucaucacugucacggcuggccacacuacagauguuuauguccuuacguuuaugacccacagggugugaaguaacuuccaagaaccugauuuuguacacuguccacucucaguaucucacacucucugauagggacacacauuacuuccuucguacagacagcuuaaauaaagcccuaugucaaucugcug

SEQ ID NO: 12065 - RNA, 79527 nt, Mus musculus
cgcgggcgcugagggaaggaaguugaggccugagcggccugagcuguguuugaaaggccgcggguggcagcggcagcgccagcagcagcuacuugaacacccugaaggcggcacgaugggagacgagauggaugccaugaucccugagcgggagaugaagguuagagccuggccggggccuccccgccugcguaguccuggaguugccuuggagccucgccucugccggcugcuccugcaguucgcagggucgcgaucgcucgccccacagagcguccgcagcucugcgugucgcgggccugaguucccugcaagugcagguaccuguccuugcguggguuuguccacgccuucugaguuaccccagguacucugaugggcuggucgccuuacuggugacagcgauucuuguuuauugagugagacguacugucgccaccgucgcugcagcccuuacgaccagcuuagaaagaggagcgcauugaagccuugaaagcaaaugauccaaagucacguggcaaaagccuuacaucucucuuacgauuuaggcauggucucuuguagcucaagguggcuucuggucuugggcucuugucucugccuccaccucccaaguggugggauuauuggugugcauuaccacaguuggcuuagacgcucaguucuuauuagcucucuauacuugagggugguccaaacuaccuaaaguggagccaagaaacacuaucugccuucaaaaccccuaguuaguaggaacaggaagucaaguuuggcacuggaaaucagcuugaacucaugagacuaaaggaaaagcaagcgaacccuaagugauccccaugcuacaacuucuggauacuguguuaauaguuggcuuauauacucugacagaauggaaaggcaggggaccguagacaguuggaaaugagugaguugcaggaagguguuagccauuugugugaccggugagucgcuaaaaugcacaugggucgagugcuccauaucaugcuuagaaacaguggcucuuccuugagucagcacaugugcugagcccgguaaugggcaagcuucauguuccucagauauguucggguagagaauuuagaaccacagggcuaauagcaguauuuuaauuccugccaaaagcagaaaggagagguuuggguuuuggguuugucuguuguguuuguuuuguuuuguuuuguuuuguuucuuuuguguugcuucaucacacuggcccaccacaaaaaaagccaccaagccccagugguacagucaugacuauuaggaugauaauaucaaaaaagauagaugauuuguuucuuuaugaauggccaguguggccucauggggaaauuugugugaacuuuuacccaccguauucaacugggauuaagaguacugcucuuccagagcuccugaguccaauucccaacaccuacagggcagcacacaauugucuguagcucuaauucucacacagacacaugcaggcagaacaccaaugcucauaaaaaucuuccaguaaauauguauuaaacauggacugcaagaaaauuaguaugugugggugugcuagacacccuuuaugaagcauuucauaagguucuguagaaauacauuuucucuuguagcugucauauucuuuucacuaaaaucccuagcuggagaguuaggaggugugguggaggauacagauagagcuuaacaaagugauuacagauuaacacuuuuugaggguauuagauccccaggaacuggaguuacagacaguugugagcugcuauguggguucugggaauugaaccuagauccccugaaagagcagccaguguucuuaaccauugcuuccucucuccagcccucucuauuuauuucauucagcaaauguuaaugaguauuauaccaagcaccaccaaauacagagucuaaaaacaaaauugguggccucaagguaauaaguauauuuuuguuauccugaaauugcauuuauggacuaugauaauagacaugauuuaauuucuuccuugaucuuguuuccuauucuaaaacaggacuuucaguuuagagcacugaagaaagugaggaucuuugacucuccugaagaguugcccaaggagcgcucgagugugcuuaccauauccaauaaguaugguaugcucuucgcugguggcaccaauggcuugaauguuuuuccuacuaaaagccuucuuauccaaaauaaaccuggagaugaucccaauaaaauugguaagcacguucuuugauuuauagugugcagcagagccagggcugcaguagcauacuagucaguguauuuccuuacuaagacacgauucugaugucaaaauugugauuucuuuuggccuugcagggagcuuccacuuagggugccaaaggccuuucugaguuuucuuuucagcucucugcuauuguuucugugagccacuucucuaagaugagagggaagaagaccuuacuguugugcucaguugaacgugggcucugggaagccauccagaagaaggcauggcuguaucacccugcagacggaaacgugugucugcagcauugagcagaaguguuuucagcaagggccauagcaagagucuugggauauuuaaagcagcauuaccuauguacaggagaguuaagcuuaguuccuguaacuagauauccaagguauuguuacucuguauccaucgugcaucaggaggaaguggggagagugcaccagugggcuggugagacagcaaaaucuucuauguuaauacacauaagcagaguugcugaugaucaagacugccagacaagaacuccaggagucuuguuccuucuggcagcucugauuggggacugaaucagcaggguuuauaagcauaaaaaaauguaagcaacugggacaaguuacaguuacaguuuucaccagucaggacucugggauuagggacucucccaaguguuucauuguugucagcugacauugaguguaaguguuuuugcucaaccaaucaaauuugucuguucuuucuguuaggaacaacauuauguuuuggggaacuauuguugcuuagagagggaguuggugagcuuguagagaguccucaguuccccagggccuaggaacuugaacuuuguucauccaauaggaaaaauggagucugaauguagaaugucaguccuuaagaccagcucuuuaucuaugcccaacagguguauuuuuauauaggugaaaauguggguuuguauugacuugaguaaaggauuaugacugugugccuguuacaugcuguauuuuucugcuuuguguuuuuauaguugacacaauucaaggcuugaauguuccuaugaaauucccaguccaucaccuagcacugagcugugauagucuuacacucucugccugcaugaugucuagugaauacggcuccauuauagcuuuuuuugauguucgcacauuuucaaaucagguaagcuacuauauggaagcagagacuugcucguagacguucuaacuuggaagcuguauaaagggugacguggcugcuccauggucugguaaggggguauucauuguagcuauaagaaagcaaacacuagaggaacuuggaagaguccagagcagagaaagaaguagacugaacauggccagcagagugaauauagccagggcucuggggacgaggggagauggagaauagaaacaacgccgugaggcaggcuaugaggagagugaguagcuggaggagggacgcucaugagcuguaggggaaaaaguauggacucugaaguguguggcaggcacuugugauacugaaggagccugagugcuccaugucacgcugauagacugugucccuucagagguaagggcuaggacuccugggagauuggaauuagcucacaaguucucaaggaaggcuggcuuuuaucugauaaccagcaguacuccuauaguacagucugaccucaauucugcauauauaagacugucuuuuggaguuuggggaauuggagcuaacuuuggaccuaaaagauaaaucucagguuaacaugugaaguuuuucuggauuacaauagagguuacaaaaaugcuccuuaaauacagaauacagacucauaagcuguuuuaguaaauuauaauccuuccuguaccaaguuaacauuucucauuuacacacaaggcuaucaagugacgagacuucuuagagauuugcuuugugagaaaccauggcgcuaauggagagggucaagggucugcuugcuugcuugcuugcuugaggcucuccugauguuggauucuuugauccaggcaggcuauugagaagcaguauagaacacuggcuagcugcuugggauuagcuaccccccccccccccccaauaggguuucucugacgcucuggcuuuucuggaacucacucuguagaccaggcugaccucgaacucagaaaucugccugccucugccucccgagugcugggauuaaaggcgugcgccaccaaugcccagcuuggaucugcuucuuaauaaccugagcuaggcuuuuugauuucuuucuuugguuuuugguggggugaauuuuauuccguuuuuugaaacaaguucugguuuacauagccuggccuggcuuuaagcucacucuuuuucugcuccagucuauggacuacuggcgugugccagcaugcuuggccaguguuaaccucuuugaaaucugccuuuccagcuguaaaaugaagacaacugucucuacuauagguagcauggagaaaaacaagccauacaaacagcuaaucccagccgagugugguggcacacuccuuuaaucccagcacucgggaggcagaggcaggugguucugaguucgaggccagccuggucuacagagugaguuccaggacagccagggcuacacagagaaacccugucucgaaaagccaaaaaaaaaaaaaaaaaaaaaaaaaaaaaaaccagauccaagaauuuaguguucucucagcuauuuauugacucuuuuauuugcauaucccugccagcagucccccugugguggaauacuuaacagccauuucuaaguuucauugaauuguuuguaacaaauagauugguauggagacuugguuaugaagaaauauagagcuggguuuaagaaagaaugcauauuuagucauuuccucugaauccuaaaugccuuuguauuuauuaauuuauuaauuuauuuugcauuuuucucuuauuuuaacaggcuaaaccauugaaacguccauuuaccuaucacaagguuucaaacgaugccagcggaauggugaaugauaugaaguggaaccccacugucccuuccaugguggcaguuugucuggcugauggcaguauuucugucuugcaaguuacagauguggugaaaguaugcgccacacuuccuccuuccacaggagucacaugugguggguaauaaaggcuucccacccauaaaguacgggcauggcaggcaauuaaaaauuuauuuuuggaaguaaaguggaaggcuuuuaauuuuguguggacugcuggggaaggggaguggguagaaauugagaauauucuuuauaucuauaguuaguggucuugaagcccaacagcaugcaugaguucguuugaauguguuggggcuauugagauaaaaaauauuuuggcacagcucauuuaaaacuggauuuuugagaauaauuguuucuaagucuaaaagaguggccaucugaaagccauuuguaccccguguaaagcacuagaaguaacaaaugggaacaacacagugauuccuugacccuuuaaagaccuccacucuccuugucuugcaaaauuuuucuggaaaagcauucuuggcucucaguuaauggccugggaugaaguccuaauuugcuugucuugcuaagaugguuguacucucucugcucugccuggggacggucuccuggccuuccaugguggugguggugguggugguggugguggugguguagcugucuagaucuuggggcucgcuuucuuuucuuugguuuuuuuaauuggcagcauuuucuuuccaguaugcuggagccccaaaggaaagcagcuggcaguaggaaagcagaauggaacugugguccaguaccuuccugugagugacugcucugcacuggagaacucuuccuacuucaccacucgugggggugguuugggaacaucuuugugacuucuuuucuuuuuugguauuaauaagcaguuugugauuaggaaugccuguguuagagugcuugccuagcauguguggggccuucuguucaauccuuagcaguacacaauaaguaaaaaguuauuuauagucaucauacugagucucucugugaauggagaagauggacccccuuuguucugucccucagugugucccuccagaguugccacuguuguguguagucuggucuccucccuuucauggacgcucaugcagaucacccauguggacaugcacuguuccugguuuuccuuuaaaguuaaauguggcccuucacuaugcuguauuucuuucacuucacaaucaguuuauuuucuccuuuaaaaagaaagaaguuuuaauccuaccauuuagaaaccaugauauuuuaguagaaaaauuucuagucccuccucuuccuuccacucuaucuuuuugagaugugaucucaguauguguccaguucaucuucaaauuuaguccugccuucgccuccuaagugcuaggccacugcagugugcgauggguguuuguuuguuuguuuguuuuuuugagacaggguuucucuguauaguccuggcuguccuggaauucacucuauagaccagggugaccuugaacucagagauccaugccucugccuccugagugcuggauuaaaggugucucaucacuguuucagccuuguugggggguucuuaacaucaagaaauguuaaaauaaaacagcaggagguauuuccccucacagcugugcucuguuacuuggcuuuguuggcagucuuccaugucugaaggagauggguuccaucgagcagcuuagagagaggagugcaugagguuaauggacaguuugugguuuucagugugggcaacaaacagaacagaugcuccugcuccugcauccucuccucuccuuauguuuuguuuuguuuuaaugagacagggucccauuguguagaccaggguaggcuugaacucacagaggucugccugccucuggauugcuggguguaugcaccauuaugcccaggggcaacacacacacgcauuuuaugguccugaguguuuugugugcauguauguaugugaaccacaugcaugcauuguaccuuuggaaguuggaagagagcauuagaucuccuggaacuuaggaaugguugggagccaccauguggguuuggggaaucaaacucagguccuuugcaagagcagcaagaacucuuaaccuaugagccucuuuagcaacugggaguguaggcaaccacuuuugcuuguuguugucaaacauuguuaugugaaguugagugcagacucuuuugggugguauuagcaucuaaaaugauaacgcaguuuauugacuuauauuguuuugcuuuuuccuaauuugauuguuuguuuguuuguuuguuuguuuugagacaaggucucuauuuaaucuugucuguccuggaacuugcuguguagaccagucuggccuccaacucacagagaucugcuugccucuugucuccaugguugggcuagaauuaaagauauggguccccaggucugaccuuccccuuuuauuuuuaacaacuuaguagacugaggucaucuuuccagcucugugugaggagcaacucucucuucaguggcuccauaguagccuacuguguagaagggcccguaugcucuuacugauggucaugcaucagcacuacuagcuguggcacugugagugcugcugcacugagccuucucgucaguugcaucugaaggggucugggcauuucccuggguaggcugcugggaaaugaugcuguucuucucuuggggggcuugggguggaggcgggaggauggagcaccuguuucuaggggcucugauuggauuggauuguuuugcuggcugaagcauuauuguuuccuuugacauuucucaaaucucuuucagacuuugcaggaaaaaaaggucauuccauguccuccauuuuaugagucagaucauccugucagagguaacaacugcuuugcuuauucucuggacucuacugcagccauucuagccaugugagauccucugucccuacucaggagagugugggagccagucucacacuuaaugugaguuauuuaguuauuuagcuugaaauggaucuuacauuuuuacaagaauuccucaccauuucccuaguaauaauccuguagagaacccacuacuuuuaagaaauugggccaauuaauuguugcaucugugaauuauuguuauucaucacaggauagaccuuugguaaagccauaguacuuuguuuuauuugauugguugguuguuuuuuguuuguuuguuucuuucuuuuuuucuuuucccuagguagcucuuguagcacaugguggcuauuccaaaugaaugcugcuuuuugcuugcugacauugguuauuuaggaauuagggaugugugucuuucaguucuggaugugcuauggauugguacauaugucuucacgauagucuaugcuggugcagauggaaccuuggagaccuguccagauguggugauggcucuacucccgguaagcaugugaaagauuaucuuguuuucuggacucacagaagucuuguacucaugcugcuuagaacuaaauuccuuuccuuaguagcugugaugguagacucagggguaagguuucaauguuacaccauuguccuggaaccaaaaaucugguguccauuuauaaaguauuuauuugggggcuugcuuacacaguuuuacaggauuaguccaugaucaucauagcuuacagguauggcacuggagcaguagcugagaacuugacauccugaguggagcagcagauagcgaaagagacacuuggcccagugugggcuuuugaaaucuuacaaccccccacccaguggcucaccuccaacaaagccauaccucuuaauccuucccaaacaguuccauuaacugggggaccaagcauucaagcauaugaaccuaugggggccacucauucaauccaccaaaagaaugauugaauuaugaaguuuuaaaaaaauggauaaaauguguuuacuuaugcuguaauuuagaaaagcaaggaaauaacuugauuuuuaaaaauuauuuauuucaugugaaugaguguuugccugaauguauuauauguguauuuugugugugcccagugcccacagaggucggaaauugucaugagauucucagaaacuggacugugauuguaagccaccauuuaggugcuaggaacuuaacccaaguccucuuggguuuagaccaguaagugcucuaaacuacugagcugccucuccagcuccuaucuuauuuuuaguauucauuuauuuaucaaauaucuaagagaugcaggaaguauguggggcacugcuuuaaagcugagcauacagaggugaccaggucaaaguccuggcuuuuaaggauccuacaugcugacaagugggguaguugauaauuuguagucagaaagaaaugggguuuggggguggagagaggaaagcagacagggcaggugaugacuagggcagccauugcagacagggucagugaaggcuuucccgaaggcuucugcugagcagaacuaaguggagcccacgggugaagaacaacaacaugagcuacaaagcguugccaagcugagggcauugaaaguagaggaugcugagcuugccuuuuccuguuggaguucggcugcuuugcugugccugagauggggucuuacacuagccaggcuguggucuguuuagccucagaugcacacugucuuuaugccucagcuccugagaguuggaauuacaagugagcuucugugccagcuucaaaauccauaaaauuauuuagaaauguuuaguauagaagaagacagcuacuaaggccaucucuuuuuuugggggagggggugagggaauuucaaaacagaauuucucuguguagcccuggcaguccuggaacucauucuauagaacaugcuguccucaaacucauugagaucugccugccucuucuucccagguguugguaugcuucacugucucccaguaagcaagaaacaacuugcuguuuuaguauauaaauuuccaacucucugcuuccauuuucuuggagacaggcuuacuguauguauaauccgauugguccucaaacucuuaacucuugcugccucugccucuaagugcuuggucaggaaauaucaaaguaaaacagaaggaaggagaacugcuucccucgagaugauggauacuauuaucacaucccucacacccuccaauaacuguuacaagaauucugcagcccacacagcuauagaaaccccauacuccaugagcucugcacucuugcuugucagugugucccuuucucaugcucuggaugaugucagagcaggaccuggcagauguccuucagauuguaauguaagaccugaguccugaccacccaguuguuuuggagaaucauguugugacagaugauggugagccugcuuugaauugcuaggauccuucuauaaagucuuuccuguacucuguuaaccaaacgauguuugugguuggauagcauugaggccaaguugcaagcucucaaggcuacuugcaaaccccuggaagagaaucuagaccuggucacuaacauacagcacagucccauccagguccccaugguggcugguuccccacuuggcuacugcaacaaugugcuaugcgcuguuccugaguguuguuagaacaccauugugauaaggugccaggucaggaugacagccaugaugaagauggggagagcagaucagagagcagucacucuguguuuaacugaggccagcugggaagccagaacauuggaagcaacaucacacuugccacccugaacucugaggaagacuauaccaaugacaccuggcuggacgaugagauuaauccugaggugcagguccacugugccaucauccccuccgauaugcugcacaucagcacaaacuugcacagaagagaagaugacacuaacugcuggacuaccuugaggugcagcuugugaggccagggcaaacauaggaagcagcagcuggacccccucacuaucuauggccucaucuauaaauuuggaaucauggaauuggaccuguaucaggucaauuagaacacugacucugaguaccauacaaccuggcaguggaaguagcgaggccagagcuuggugguuaagagcuucucuuggaggacaccauccucauccucauagugccucagagaccaugauaggcaccccucuaccuaccagagagcuacuacagucauagccacaggugugacgcuacauguuggccaacgcacaguaaaugcagaucuaccagauuggagagguugcccagguuccuuaaggggagcagguacagaucacacaggacagugagggcauacugcagauucaucauguuggucaggauggauagucauggggacugugccagaaucucauuccugucaguggugacucaguggcugggguaaccgcucucagcuuuggccugugagaggggacaagcuugaucuaccuggccugcuagaaaugagaugauccagguacuacagggugcucaucauaaccauggcuucuucagacccugcugcuacaggaauagacagguugcagcugcagggcagugacacucaaguuuaguacauccagcuggugccccacagcuguagcgcaaaugggccuagcaacccauucugcaacuggaaaugcagcuugaacguggagccaucuagaucuagugaaucuugcuucagcaagcaccuguggguucugcagggcagcuggaagcuccuggggaaagguccuggucacccccugcuagaagaugccucaggauuugagucucacugcuggucuccagaagagaagcuuaucuuggagcauguugaguacauucagaaagacaacaacuaugauaacuuuguuuaaacagcuuuuuaaaacuugugaugguguuuauaacaaaaacaaaaauggagagagaaaaaacccaaaccaagcaagcaagcaaacaaacaacaacagagcagaaacacaacuguggaguagcagaagccuggcugugugcucccucaggguugugacguagguguuggagccagcugauggugcuggagcacucuggaccugcugcuagggugcuccccagugugcuugugcaguucuaauaaaauaaaguguauuuaugacgaaacaaaaaacagaagcaacccuuucuguuucuggcuucuuuagaaaccucugacauuugucagcugcuugcucuauagaggagagauguggcucuugcuguccauguuucagcuuucuuccucuuuaaggagagauccuuuugugucuguugggugaugauuauguauauuuuuuuaguauauauauugaaaagugaaaucucuaggucuuuuguauuguuuuugaugcugaagauuuaaucugugccauagacacacaaggauucugucauguuauguuuuuagcccuuccuugguuuucugagguaggaucuugccccaggauauuucaguuuguccgugaacuuaaaauuaguuugccucugccucccaacugcugggacucuaugcauguucugcugugcccaggugaugugcccuuccuucuuugaugagcuuuauagaaagcuugugucucaggaagguugugccaggguuccuauucaccacugccagggcucccugcucaggcuuuaguguguguguccacauuuacaccgagccaguaugugaggaggugucucgacgguuuucuuuucuuuuccuuuucuuuucuuucccuuucccuuucugucugucugucugucugucugucugucuuuuuuggagacaggaucaucucauacugaacugggaaucacuuuguagugcaagauggccuuaaauuuucaacaauccugcuucagccucccaggugcuaggauuauaagaauuauauaggauuauaagacuguuguaguaacucuugggugucugcugagguucaguuuaaaauuacauuuaucgagaugucuucucauaaucuuaguaagucuuuucgaugggaguacaaaaguacuggcuaacuccugauggaugcuuucugugguggaccaagaauggucagucagugaaggauucuucacagccccucagauaggcucugaggaaggugagaaaaccaugugacauacaggcugagugagucaccccuguguguccuagagcagaacaugacagaauacaguuccuauucaguugacuggugguuggguuucuguuccuuauguuacccagugcaccuucagagcucaucccuaugugugugcacagacuuuuguauccaguuucuggugacacuugagcgauuuuugccuugagauuaugagcuauguagaggccaaagaagcugcacauaugauucccuucucuuguuuauagaaaaaagaagaaaagcauccagaaauauuugugaacuucauggagcccugcuacagcagcugcacagagagacaacaucauuacuaccucagcuacaucgaggaguggugagcagagccuuccucucucacugucaggccacacaccucagucacugacgucaguguugacuuguucaggagagggaaguacaggcugagaagcccucagugugacgaguggauggguaguaauguucuuuggcuagggaggcaacuucccaacccucacuuguuuguacucaauguguauuagucuugaaaagucuaauacaugugucucaauauuagucuguacucacuguguagucugggcuggccuucaacucauagaagucugccugccucugccuccagggaugggacugccaccacacccaguuccacaaaguccaauuuucucaaccacagugagugauuccaaugaaaauacugauuuuguuuauuuguuugcuuugaaaaagucaucuguagcucagaguacccuuaaauuuacaggccuccugccucagccuucugagugcugggauuacagccgucagcugucacaccuggcuaacagauacugauacuuaaggaacucauuuaagguuucuccgagagcagccuuuggaaguccauggaagccucuccuuuugagcuggguuucccugugugggccaggguucuuguugcaagccccaaccagguucugugugucucccuagucuuugcguggguaguagugggcagguuuacuaagguuuuuucaaacuaaaaagcucagcaccaccucuagcaccuuccauucucuuaccagcccaguaccggcacugcagacccagucagguucaggcugcugaggagcuugaacguaauggccuuuugguuuuguuuuuaagggauuuagugcuggcagcaucugcagcuucuacagaaguuagcauccuugcucgacaaaaugaucagguaaauuacuccuguuuucuuacuuugauguugaaugauguuuuuguuuuuguuuuuguuuuuguuuuuuugagagagguaacugguuaagacuaaugagggcggguuccuuucaaugagcuuuuagugcaaauacuaaaugacagcaauaacuuucuuccuuccuucccucuccccuccuauauggauguuuuuacucgggguuggggauugaacccagagcuuugugcaaauaugccaaguacuuuaccaaccuugagcuacacucccaaccuugguaucuuuucuuguuacacuugucgcaucaacauaaugccuuucuggcuguugucuccgucuuucuguuugcaauucucacacugccacugucugcgugcuggccugcaaagguuaucagauccuuugguuuuguuugcagauuuauuuaagaguuagagucagcuugguuugcagcccugggacugcacuuucuuuacuuggcacagucauguauguuagugucugcucuucugggccucaacagcuucuguucucuagcuucauuacuugucuccuguucccuucugacucaugcuucccgguaggucaagacagaaggcuaggcagaaugagucuuaagaaucaggaaucauuuguuggauggaauggagcccagccaggaaaacaaggagcaagaagggaguuacuugauagauauagaagcuucuuaugggguguaagcagcuggccagugugaggcaugaggaagaaaggaccuaaguuugccuucugucucagcaaguagugacacaggcaccugcagaguguagcuguugaaccaccuugucauuguccuuaggaacugccagguuaugggaggcaccuacaaggcagggauggguacaccaggugcugauaaaguagacucacucaaccacucacaggcuggggcacuuguggcuucuagauguugcaggugucagaggcuccuuccucaucggcucaggaagcugaagcaagcgcaccauguguucuuuggugauugauugaauggugcugagaagaagcaguguaaaacccuaagccacacauguuucugucaugucuccccccuagacuaauugggaaucuuggcugcuggaggacucuagucgagcugaacugccugugacagacaagagugaugacuccuugcccauggguguugccauagauuauaccaaugaaguggaagucaccaucagugaguguugccuagugugugcuguaguaauagcugugcucuaaugguugauacuuagaagcuauuaguacaucucuaucuacagaguagugggagguucgucaugacagugcaaagcuacccaaagauggggacucauugccgacaccgcagccagauacacucaugugcacugacuugaggauggagcaguugaauuucaagacauaguuucugcccauucggugcccuagugaccucacaagugucauugucagcuggcagugcacccaaaccuagguuaagagaaggaugaggggguagugcucuaagcuucuguuuuccacaugggaccugcacaugcucucugaguacgccuuccccuguggagguuagcaguguggccacagugacagaugucaugaggcagcugaagaagcucugccugcuggagcuucacucugcagagcuguccuacucagacaccauugacccuguccuuucccugguuugguaggcacauuuggucugaugagcuuguauucuuuuucucuuguguacuuaugauucaacugggaaugaguauaaaguagcuuaacucuguguguguguguguguguguguguguguguguaagagccaucuugucauuucuguaccaaacccaucauugccuagagacuccuagcuugucaggguaguguugaaccugccuccggaacagaggagcuugggagaguccagggcuuagaguguccaacagggcccagcaggauguggugaucugauagugauaagagcucuugaugcagcugcuguugcaagaaucacuugaguaccucucaugcagggcagccugcccuucagguugugcccggaaacugaugagguucucuuaucagcucuguucuuuuuuuuuacagaugaagaaaagacucuuccgccugcuccgguucuccuguuacuuucaacagauggugugcuuuguccauuuuauaugaucaaccaaaauccugggguuaggucccuaaucaagaccuuggaacugaucucaacagaaggagagcgacagccuaaguccucaggugugugccucugacuccuuuggcaacccaugagcaucuccggggauggugacuuagauguauguagucaccuacacacagucaguuuacugcaggaaggucuuggcugaucuuguccuggaaccuaugugcacgcacaucuuuaccucacuuaguccccaggcccauucuccaauccuuacugcacaugucagagaaaggaaagucagccauguugauccaagcucuguugaaugaccuguuuuaaagaacuguuuaaucgugggaguuagucaagcagaugauuguucacagacaguuuaaaauaacugaaaaauguuuauugacagcaaggaaguagaaagaugugucaagaagggccacugugugucauguguugcuucucuaaaaaagaguccacauacagaaacacuggaagggggcuguuaaacucuaguggcucuuucuggcuaagaggaauauggagacuuuaguguuugauuucuauuucauuggcuuuugauuuguuuucccccuccucuuuuagaauauugucagguaauaucuguauugcagaaaaguuagaaaauccaagaacggguuucauagaccaucaagaaauaacauagucuguauuuugggauggaaucaacugauccuuucuuccguggauaaaugcccacagugucucuaguuccaccuaagcacugcugcccguuuugggggaggggggguauggcugguuaugcuuggugaugcuuucaugcugcucuguaaggcagagugacucaugcgucauggaugcuggcauacguugccagagcuauaccaaauuucgguuaugggggguggggaaggggguuuguaccuuauguucucuccugagacuuuccaugagcaccuacacccagcuucagucuguagugagcagggcugcccaucgggccgacacugguggcugguuguuucugagcacaaugucccaccauugagugccugagcacagccauggguggcgacuguuagcuuuuucuagagacccuucuccuuccuuuucaucuagugcagagguaacagcuguccccugguuagugaacaugggagauagucuguccugggaccugcccugaauggcuaaggcaaagucagcgcuuuggaagaagacauuagugguucucucuguucccacauagcagcuccaagacugugguguagauuggccaguaguagcagggugagggucuccaaauacuccauucuaaucguccuuggaagaguggcuacaauuucuuuaggauguggccucagcuuuuccuucuggucuaauccuaaugggugugguagugguuuaugucuacauguuucucugaagucuuugucucuugcuaguuccauagcuauuguguagaagagguagcugaguaaccuagagaguagccuuaguuauucuucuagaagugacaggaugucagaagguggugauuucacucuuguguccucuccaggcucuugaagauaagauguccaucucucaugaacaccaacugccaucuuagccuaauagccaaggccaacuaauguaaauuggaaguacacuuauuuuuuuaaaguauuuauuuauguaguugaauugauauuaggaaguugggaaaguagaacaaauucuaacccugccuuuuuggggagcugucugcccguguuucugcaugaucaccuuaaacuuaaauguggacaucauugaaauguugauuuuauuuauuuauauguuuugauacugguccuggcuggccuggaacucauggacaucagucugucugccuucugagugaugggagcaaaguugugcaaugcugugccccaccugagauguugauuuugaauuuaagcuguaaacuuuguuuuauguucuuagcuaauuuucauggucuacaauaauugacuuuuuuuuuuuaaauagauaggguuucucuguguaucucuuacuguccuggaacuuacuuuguagaccaggcuggucucaaacucacagaaauccgccugcuucugccuccccagugcuaggauuaaagacgugcaccaccacugccacuuguuucugcuuuuuugaggcagucucucacaguguaguuuuggcuggccuggagcucucuguagaccaggauggccuuaauucaaaagauuugccugccucugcuaggaguauuagaacauaaggcauaugcuaucaugcuuggcuaaguuuacaugucuuugauucuagagauuggauuuuuuuccucugaauuaggcucucugcuuacauuuguuagccuugacuuuuaaguaugacugacuacuuugguuaaaaccuagauccuuugccucaguuauuuuaucucaucuaaguauuuuuuaggaggucuuugacuucaucauuuuugacauuuuuaaauagaugaagugguugcacucucagacucaacucuucgagagagcugaaugaaaggcuuucauuuauaggacccuaucuuuaauucauuuggaguugcuuuuaaauaguguuuugaggcagagcccugaacgguuauuuucugguuaaugaaguacugcagaaugagguugaggccucgcucuuuagaguuugcaguaugcaggcuuauugcgcuuuccauccaccaaguccuauuagccuggugccuuucguuccacacguugucugucuugagaguuucacgugugguauccuguggaaccccugccacggaaagaccaacucuacccacucuuuguuuuccuuccuuccuccuuucuuucuuucuuucuuucuuucuuucuuucuuucuuucuuucuuucuuuuuuuuuuuugguuuuucgagacaggguuucucuguguagcccuggcuguccuggaacucacuuuguagaccaggauggccucgaacucagaaauccgccugccucugccucccaagugcugggauuaaaggcaugcaccaccaccgcccugcuccacucuuuguuuucuuuaccggcaccauuugcagccccucuguccucccucccuuaucuucugucauguggagcccccggguuacaguuuacauuuguccuuuuguuucuccuugguucucguuacaggaaguuuuccugguacuccaucuuccccucaagcuccacaaaaccuggacgcuccagcaacagccucuucgccucuuccaccuguguccgcugcucccaccuccaccuucccuaugcccucugcugcaggaagcccuucuguguucuccuuuggcccuucauccuucaagucuucugcuucugucaccggggagcccccacuguaccccacuggcuccgacagcuccagagcagcaccaggcucuggcaccuccacuuucucuuuugcuccuccuuccaaaggcucccuggcgucgaccccugcaguggcuccuguggccacaucugcugcucccuucacuuuugguuuuaagcccaccuuggaaagcacaccuauguccaguaccccaaacacagggaugaagccuucguucccucccucggccucuucggugaaagucaaccugaaugagaaguaagucaccuugaaaggccgacuuuucggaagacuggguccaauagugcaugguggucagugagcuagucacucgagggcaguacugaacaguccuucugaaguagcacuuaacagugggaaacgagccaaugggaaggcugugucugcucugcagcggaguccagagugacucuuaaagggcuucagcucucugacuguuagaaguucacacuaaguaguugucucacuuucucagccuauaaagauagcagguguugcuuauuuuaagaaggaagcugcccagagcaugcagccugggaaggaaaucggacuuuuguaguuuuuuccucucauagcuacucuugacuaucaacuguuuucugugcggccaacaaggugacuugagcaguuagagacacaugaggucacucuccugcuugccggucgguccccuaagguuucuuguugcgcguuucuuuacaauucaaaccuuuuagugugggaucuaguuuccuccagaucuaguuccagucaucccgcucauccuuuauuuauuuaccucuuggucuuuuucuguucucccaauaaacugagcguggagagggaguguuccccuguauuguacagccuuuuccaguugcagugggugucagaaccuucaguuugggggucugcuugccucauugccaggauguccuccugcagccaaacugucauugcucagaugagauccacauguggcuacuucauuuuauuuauuuuuuaagauuuacuuauuuauuauauguaaguacacuguagcugucuucagacuucccagaagagggcaucagaucucaauacugaggauggcugugagccaccaugugcuugcugggauuugaacucaggaccgucagaggagcagucaguacucuuaacugcugagccaucucuccagccccgagccacuucuugguauuucauuuuguugggcugcuuguucuuuaacugagcuugucuacauugguggagcugacuugacauucuuacuaggucauggugucccagagacagugacuugcuugcuucccugguguucucacagcccagaaacaaucauccucaaaacucauucucuugcuuuguugcaccacccccuuaaaacacacauacacacauacaaacgcacacgcacccacguacacacgcacccccaugugacaggguagaaaauagaugccuccugcacugagugcuucggcugugcugcaguugaugaguaggugguaacugugcccucacaagaguaagcagcacgugugcuggucugaaagcagagauggcuugucaguuuuucuuggcuaucacugcucacgccuggugggaaagaagccucuaacagacuguugugacagaacugcauuuccguuuuuagguucaccgcuguggccuccucugcaccuguucauagcuccacgagcacacccuccguguugccguucuccuccuccccgaagccaacggcuucuggaccacucagccauccuacgccucucccagcaucauccagcuccaugccuuugaagucuucggucucucccucgccagcagguaauaaucucugaagcacacacgccuuuuuagauggguggguucagcagguuaagaguccuugcuaaugucgugaggggagguuuuuuuauuuuuguuuuaugagauaggguuucucuguguagccuuaucuguccuagaacucauucuguagaccaggcugaccucgaacucagagaucuaccugccucugccuccuaguggauaaauggugugcaccaccacaacuaccaucuggcuaaguuuuuuauuuguuuguuaguuugugugcuuguaugcuugaauauuuuaaugugcugugguuguggugcucugacuuagugauucacgguggguucagaucugcuagccuuuacuuagagaucauggaaauucaaagaaagugucucgcccucacauaagcugguuaugaccuaggugcucgcccucacauaagcugguuacugagcugcccuucagcauggaggacaggagcagcccucggggagacuugcgcuuacugcucccgacacuguggaguacaguuucccauuagccacucugaacaugugaugaaaugggaauaguuauagacaggauccaaggcuuccgagacaccagcccugccuuccugucacaugucuuccaaccugguugcaaaaguauaaauacugugcucgguuggcaccaaggcgcagugaauccuaauaguuuacauuuuugcuuaucucuuucuuccuuuuauguaaaaauuugaaaauauuugagaguuaguugcagacauugggaaacacuuguccucgagcuagauacaugggugccuauaaccuaaaagccaaggcuauuacacucaagagucaccagucaacucuagagucccugacauauuucuccaguggucugacagcuggguuguuuguuuuguuuuguuuuuccucucuuuuucuguucaucucauuagcauagacaagaaaauccccagcuuagugguuuugggaccaucccuguuaggguuggauuguuuccacaugauagaauucagguugaagauuuggggcggucacaccacaugggagauguucuucaccaagcaugcuguuccucaggccgacuguaaaacuguuugaguuugggcuugugagggcuuuugcugucugucuuuuccuauguggaugugcaugcgugugagugcaguuacuuggguaaaucagaggugcucgauccccuagaauuggaguuacaggcaggagccuaaagagaccuugaucuuaaauccucccugccugagccuccugagugcugggaguguaggugugcuucaccaggcccaguuuggucauccuucuuuaaugcagaugguaaaaguggagccagggacaguguccgcuguaagccacugacacuauugcuccuuugcucuagcuggccgcuccacucagacugcgccaaguucagcacccuccacagggcagaaaucacccaggguaaacccuccagugccaaagucagguucuucucagguaaguugaaauuuccuugauacacuugaauguuacuaacauggccuuugugcuuuagaauucagacauggaaacaguaauuauaacuauaggagacacugaagucaacauguacuuauaaaagcaauuaccuauuuacuuucuuuuuccagacauggucucacuauguaguccuagcugaccuggaauuuacucuguagacaaggaggcuggccuugaacucgagagauccuuugccuccugagugcugggauuaaaggcauguaguaccaugcccaaccuuuauucaguuuuuuguuuuguuuuuuaauuuauuuauuguauguauaagaguacacuaucuucacacacaacagaagaaagcaucagauccuauuacagaugguugugagccaccucacaggcccucuggaagagccuucagugcucuuaaccacuaagccaucucuccaaaccccucuacuuagcuuuuuuaauucaaaguaauuuauuuagaaagaaguucauggccuagagagaugguucagagguccugaguucaauuuccagcaaccacaugguggcucauaaccaccuauaaugagaucugacgcccucuucuggccauggugauagaucauuguauacauaaugaauaaacaaaucuuaaaaaaaaaaaaaagaguccaugugguauguguacagcucaguugucaucaacuaguauaccuuggaaaccagcaaauaauuugacaaaggaagcauuaccaagaucucagggcuauuccuuucgagcccuggcuuuaggucuucauccuugccaagaaucauucacucuuuuguuaucuaacaguaugcagauuaauuuagcagauuuauugauuucuaucaguagauugaacauguaguuuuacuauguuccugaugucuguuucgucucuguugcugucuggaguagaugauuuauuguggguacugcugaguaguuuccagcuaaagcuauccugaguagcauugcccggucagugugguugaugucuucuagugaauauaugugcaccuuucuuugggguuuaagcuuagucauuggauggcuggaccacagacuuggacaugucccuuagcaaauugucacccaugguugacacuuucauccuguccucaguuuuuccagguuugguauuuucaucuuacauuguauuuggguuuuuuuguuuuguuuuuguuuuuauuuaacucauuuuccuagugauuagcaaaauugaguuuuguuucauuuuaauuuuagccaucuguguuuuuuuuuuuuuuauauagucucuuaauguucuuaacauuuuucugcugguuggugcuaguuugauuucuguugcugugauaaaacacuaaccgaagugccaggcuguggugucacauaccguuaaucccagcacuugugaggcagagccaauuccaggacagccagggcuucauagagaaauccugucucaaaaacccaaaacaagggcugaagagauggcucagugguuaacagcaccaacugcucuuccgaaaguccugaguucaaaucccaacaaccacauggugacucacaaccaccguauaaucuuaugcccucuucuggugugucugaagacagcuacauuguacuuacauauaauaauaaauaaaucuaaaacaaaaaacaaacaaacaaacaaaaaacccaaaacaaaaaacauacaagaaagucuguagauuuaggggaggaaaggguuuauggguuucccauucaaggucacaguccauuauugaggaaucaaggcaggcucacuuauuguuccacacagcaccaccucugaccagggaacuaacuucacagacaaagaaguacaguggcaccauggaggaugcugcuugcuggcuggcucucagccgugcuuguccuuagcuuccuuauacgguucauaccacccaccuauggcuacuagugccguaguagacugggcccuccuuccccagacaauccccacagacauauucacaggccaguuugaacuagguaguucuucaguuuaggcuuuccucucagguaacucuuaggcuccauccugacaauuaaagcuaacugauggucuuaacugaucuuucauguguguugcauacaggauugacucuaggguuuugugcauguuuaacaugcacucuaccacugaucugugccauauguaguucuucagagagacacaaacacacaagaaagcauauacagaacacucucuuuguauuaccuauuuguauaagaucuuuauuuuuaauauaacugaaugauuuuuauuuuuaacuuuuauuuugcagcucugagauugaacuagauagggaacuaccuaucauugagauauaaugccaaccuaguucuuguguguuacaauaagugcuuuucacguaaugcuuuuuagaauugcauuuauuaguguguaugguaugugcacgugagugugaugaggucagugaagacuugggugucccucucugucacuugcuucaaugugucaaaguaucucacugauuccugaaacuagguaggcagccaguaugcuccagagagccucuugucuuuuccaccuaagcucugggcucugugcaccccuggucacacccagcuuuuuauguagggaaaggcauuugaacucagguccucaugcucacacaacaagcauucuuacucacugagccaucuccccagcuucucaugacuuguuuuaggaaucauugccaauuucaaauucaggaagauuuuccuaugcugucuacagcuuugaaacuuacuuguauuuaagucaguagccaucaccucagcuuguucuugagguuuuaagguucugucaguuucccacuugaacauuccaggagcaggaguccugcuuuuuccuguuguaccucccauccuggguccuuccaucccagcacacauucgugcuuuguuaguuuauagcacaaugcccagcuuaugggcaucugcuagguggcugcuguuuggugacugcucaugcagucuaaaaccaugucaggacccaucagauuuucccagcccuugcccagcacugacaaaccagggcuuugcauaagcgcaggaacaaaaguacgcccccaccccccacccccgcccccagguccacuugcuucacucacaguacuucuuccuauuccaggucaugucagucauguguccuauaucuugguuuaucauuacaugucuuugucaggcuguggcugucacuugccucuuggaguccugacugcuguaccuuuuuuuuuuuuuuuuauaauuuuuuuauuagguaucuuccucguuuacauuuccaaugcuaucccaaaagucccccauacccacccacgcccacugcccuaccgacccacucccccuuuuuggcccuggcauuccccuguacuggggcauauaaaguuugcaaguccaugggccucucuuuccagugauggcugacuaggccaucuuuugauacauaugcagcuagagacaagagcuccgggguacugguuaguucauguuguuguuccaccuauaggguugcaguucccuuuagcuccuuggguacuuucucuagcuccuccauugggggccgugugacccauccaauagcugacugugagcauccacuucuguguuugcuaggccccggcauagucucacaagagacagcuauaucuggguccuuucagcaaaaucuugcuaguguaugcaauggugucagcguuuggaagcugauuaugggauggaucccuggauauggcaaucacuagauggugcauccuuucgucacagcuccaaauuuugucucuguaacuccuugcuguaccuuuuuuuuuuuuuuuggcuuuuaucucucacuguuaucccucuccuuuaaauagcaaaagggauuuuuguuuuuguuuuguuuuuuuuauugauaaaucauauuucauucaaacccuugugcaauaccagcaguaguuuucgaacaguguacaguagaaucugaauucuuuggucuguccuuggacacuugcucagccugcuucucugaccccuuucucuguuuuuccuaccccacucagcuccauuaagcaagcccacgugacuuggacauuccgguguauuuccuccuuauguccuuugugcuugcucuugcugccuggaagauguuuaccucagcucugccagcagccuucucucacagcuuguuccuguucaggucucugagggagaacuuuguuggcuguuuugagcugcucauucuucaguuuuaccuguuauucgccaguagaaauggucaguagguuuacuucuuacugucuugucccugaagaaguuuccugaguaaggaugucauaacuggcucaugguuuucaccguguagaaugaaugcauccucuacaaauuggagacccagugcacacgguucagaagaguggugacccacagugcaugagugcucccugugauggcccaaugggguugcaacuacaaacuagagaugaccguguggagcuccuccugaugcuuuugccuuccauuucaggccaaggcacuucagccuccugucacagagaaacagaggccucaguggaaagacucagaccccgugcuggcugggauuggagaggaggugaguuuguugcaugagcauuauucuuauaauagcucggucagcgagacuggaguggucuuaagagcagcuaccuggacugccauuccucuaacauuagguccuggccuggacccuguuuagguuugcccugaaaauguagaagcaguggccuuucugcugccguucagaacaaacuuucuccauguuuauggucucacagauugcacacuuccagaaagaacuagaggaguuaaaggcccggaccgccaaagccugucuccagguuggcaccucagaagagaugaagaugcugcggacagagucagaugacuugcacaccuuucuuuuugagauuagagagaccacagagguuuguaucaguggaaaccuuuccugaguaaaaggaggcuuuuagaaacugcuguuagccggaacauugauauuuuccgaggccccucagcucggcugcgguuucucccgcaaaagccugaauucagacuaucggaacugaggcuuaccagagcugucuagcugucuguuuccauuccccucuguaagagggagcuccaucucuaccucuuuagcacauaauaggcacuccauaaacauuggugguagguuuuuuaaauuaaccuaaguauacuuccaagaguuuccuuuaugguauuaggguaagauaaugauauuuuggagcaugcacauacaaaaugucaaguguuuauugcugagaguguuauuuacuguuauucucugguuacugaguacucuuaucaagccagacucuguguuuuaccaaggucaccucaugaguucucacagauuuucugccugggggaaguugugacccucuccauuuuguaccuuaggaaggcaagugagcugggcguaguaguggcgcacgccuuugauccuagcacuugggaggcagaggcagguggauuucugaguucaaggccagccuggucugaggagugaguuccaggacagccagggcuauacagagaaacccuuuucucgaaaaaaccaaaaagaaaaagaaaggcaagugaguuuuugaaaggauuuggcagacauauuaucaugugucuccagucuucuggucuaaacaacaggcuuagaacgagaaagucccucauggagcuggauugugaguucugucucugcucuuauuuucuacauugucaaucuucagaaguugagguuuuaaaaacaggagaaaggguaauuaaaaccaggaaaacuggccgggcguaguggcgcacaccuuuaaucccagcacucgggaagcagaggcaggcagauuucugaguucaaggccagccuggucuacagagugaguuccaggacagccagggcuacacagagaaacccugucucgaaaaacaaaaaaacaaacaaacaacaacaacaacaaaaaaacgauagaacauguuuauacaacccccaacacaaaacaaaacaaaguaaaacaaaagcugaaacuauaggaaagcaguuuugagcauggggacaaagaaaguuuuaaacugagaucuucaccauuuaaauagugggcauuuauccuccugggucuacauagaggguuucuuguuuuguguuuguguuuguggcuauacagcaguuccauuguuaccucucugggccuuuuccagucucuucauggagacauaaguacucugaaaacaacuuugcuggagggcuuugcuggggucgaagaagccagagaacagcacggaagaaaucacgacucuggguaucuccaccugcuuuauaaaagaccgcuggaucccaagagcgaggcccagcuccagguaggcgagcgaagccucucugucaagacggguucagaagcagugagcuugaguccguggaugugguuuugaguggguaugagugcugucuccucaggaagcugcugauuuucugcuaaacacuggcugugcuuuuccauaaauuuacuugcagcaaagaaacugguacacuuuuuuaaaauauaauuuaaaauuuuuacuuuaaagauuuaagucuugaguuugauaaaguccuuuguuaaaauagguauucauaaaucaaaucaugaaauaauaaugaaaaaaucauaacaucacuguggcaccuuucccggcggucuauagguauuuuuagacauuauuucccucuguggaaguagcuggaaacacuguguuagcacacgccucacacucaggagauagagaaggagacugcugaguugaggccaaccugggcuuuccuaaaugaagacccucucaaauauaagaacagcaugcagaccgcagcugcucuccagugagagcucuugguuccucagagagauggugcauccugagcuaaggaggucuggccugagcucaugcucgcuggggauagugccgucagagccucggacugggagcucugucaccugcugugcuguagcacuuauauuucucuuuagcuacuugaguuuuguuugccucugugugcacgggucaucuuuuccuuccacucaucauggaguccagaggggugcguaggcagcccugcuucuccucacuucagacauggucuguggguguggugagggccucuauacagaggacuuagaccuuaggcuucuguuccugguuuucuaucccaugcccaggaguccucccagcaccuggagggugagagaauggcucuuacagaggucucagugaucucuugggaucacugacugcucuuucucuguggguauuucuugccagggcuguucucagacugcagccccacacacaaaccccuuugccucuguuccaguugccuggccuagaggaaagcauugagcuuccacacugagaaaagaguaauugucuucuugaccaugcuaaauagguaauugcaggaaauauaauuggccacuuaccacauacaaagcagggguggugcugcagugcagacugcggcucauaacuaacagagccugcgccaugcccuuagccccugugcuacaaucaggaagguggacguacaauuuucaugugggguauauugccaugggaccacagaugacaagguggaagccacugcaaaauguugcagccugccuuugaagaaggugcugcuccacccaguuggcacguguucggaagaaagggcaucagcuagugcaggccugaggucauggcugaggugggugaaagaaagccuucuauggucauugaaugccuuugaggccgcugccucccuggauucagcuuggcucuuucuaaaugacauuuucuguuuuaugguugagacagaacacuuuucucagaaugugugugaaauacauuuccccacagucagauaagugccaugugugaagagccuccugggcuguucucagugccuguauacuucguugauuaaauaauuagcuccauuuuuaauuuuugagugaaaaaucguauagccaugaagguuagcugugcccccagcugaaagaguguuauuacaggcuuagcagccuguuggaguuuuagguguggugaguugacuuccaguauggauagcauuguguauuuuugaauagugcuucucaaauggugagauggccuguauguucugugcuaugaauaucuagggucagagguauucccagcaccaauuguugaaucagcuugucuacuugacaguucauuucauaaugggggaggagaacuaaaugggcgcacugugagugagcauagugggcugcuccugcaagucccacccuucccaggggcagcaggggagaggaagugggugcgucuguuccucucauccucucccccagucucugcuccaucucuguuacacuacugcagaaauggaauuuccguuuuucauuuuauuaaauggcuuuuauuuaauggauauauuaaagccuaguguuuuccuuguucauacaguucucaauauagaaauauuucaagauuauuuuugaauacuuuaaugcaucuuccccccagcuacccagcuagcuaccagaacaaugaaucauuugccuuuuaauuuuucucuuguaggaaauucgccgccuucaccaguacgugaaauuugcuguccaggaugugaaugacguccuagacuuagagugggaucggcaucuggagcagaagaagagacagaggugagggcgaggacauguuauccccuccgcuuuuuguaggagcacaaguaaaaaucucacaggcaccuuuccuccugcuuagccauuucaccuuuacauguaucauuuacaaaacccugagugauggccguuguaauuuauauaaaugaguuugcaucacaucuuaugcauggaauuuuaaaaugauaacuugaauuuuaacugggcgugguggugcacgccuuuaaugcgagcacuugggaagcagaggcaggugaaugaaucuuugaguucaaggccagccugggcuauacagagaaaccgugucucgaaaacaaacaaaaaaaagaauaugcauuuuguaaggguugagaguagcucggggauaaggcaguugacuucugugugucuauaccacauguucaaugucuagcauuucaauugucaaagcccaaacaucaagaagguauacguuacccuuuguugccaccgauaacauguucuugaggaauuacauugaaugauuuuuaucuuguaucaaacguauaaaauaauugaaaagcauuucagauguuuucagugggaagguacaaguguuggagagaggaagcagaucuguggggagauucacagaagcaccucacagcuccacccugcugccaggugggacuuguguagugguaacauggcuagugugacagucccacugucuccaagacacacugccaacugugcaggcuucaguuauccuguaagccugcugcauugcugagcugcgcgcccauaucaaacaugccuaggccagcgaguucccaguuagucauaaccuggcugcagugucuaaguccauuaugugaaagaacucaguggggaaacccccacucagcucccgauucggcgugcacccaagaaucacgaauagaacacaacaccuugauguaacaacaagagguuuuuaauggcggagcuccgggucgaaacguaucucacauaacaggagacaguggauucgaccacgaggcuuggaagcuagggguuuuuauagaaaaggaguggggcugggggaggaauuggcgcgguuucacaugauugguccauuuaaacaucagcuguaacauuuaacuuaggucagagggguaggagauagggaggcgaugggccugcccgggcauguccuggucuguucugcuauguucucagccccagguuucaaagcucacaaacaacucuuugggcuauuugacauacauuacaugaauuacaguuuuauuuccuuucauaugcauaucuuguacauaacugugcuacaggauaauuuauguguuaugugucugugguguacauugcaauauuuugugaaauguaagauuauuucaauauuauuaugugaaaugaaauauggaugauggaaccaaccacccaagugucaugccaaggaaaacaucaaauaaaccuagaacaauggaaaaaaaagagaauuccccaugggauuggauaggauggcucaaugguuaacaguccuggcugaucuuccagaggaccugaguucaauucccaucacccacauuggguacugcacagcugccuguaacuccagcuucaaggaaucugaccaucuucuuugcacaagcucuguauguucauagugcucauacucugacacacacuaaguaaacacaccuuagaaaacagagagcaguccucuuguacauuuguuaguuuuccaaguuguccuuuugagaaaauauuuuucuucccacccccacuuuuuuuuuuuuuugguuuguuuguuugauuagcauuuugagaaaugcucucaccguuuauugucccgaaggccuugggugcuuggcauuccuccugccucagucucccaagggcugggaauguaagcaugagcaugagggaaaauuaauuaagguggcuguuuaaagugaugcugaagacgggcgagcuugcagcugccugucauggucugguuugugcuugugcuuuguagaaggaauagaaugcugugugcugagaacgaggaaguacuccagaaaagcaugaguguguuaacccucauacacguugcuuugccuagaaguaggcuuucugagacugcacaugcuaccagaaacgagcuuucuuuacuguuacugccccagccaucuccucgcugcacggcacugaucaggucccuuuccgcagagcucaaguucacucucuuggcugccuuguucuucucaguggguccgagaaaaggaaauaaaacugaaaguuucuguugaacaucagcaguuuucauucugaucguucugugcugagagaccgaugcccagacagacagcagcagacaaaccauguggcuuguacuuguuuugaacuacccauuuuuuguuuguuugguuuuuuuuuuaauuuuuuauuagauaauuucuucauuuacauuucaaaugcuauccuuccccccccccaaaaaaaaacccuauacccucccccugcccugcuccccuacccacccacucccacuucuuggcccuggcguuccccuguacuggggcauagaaaguuugcaagaccaaggggccucucuucccaaugauguccgacuaggcuacauaugcagcuagagacacaagcucuggggguacugguuaguucauauuguuguuccaccuauaggguugcagaccccuucagcuccuuggguacuuugucuggcuccuccauugggggcccugugauccauccuauagaugacugugagcauccacuucuguauuugccuugugcuggcauagccucacaggaaacagcuauaucaggguccuuucaagcaaaauauugcuggcguaugcaauagugucugcguuugguggcugauuaugggaugaaccccugggcccauuuuuguuuuauuuguauauuuuucucaagcuaaaagacauuuuugucaaugcucaaagguuuauaaugacaaacaaaagaaucucugacuuuagaccugccacucagcagcaaccauuggacuguuucauucuuaaggaaaacagcaccuugcucagucagcagucagugacugggaugggacccacacacuuccagccugccuuauugaguguaacuugcauacagaaaagcucaagucacaagugagcacaggaggguuugccuguuguuggcuccugucuuccuccuacugcguccuucccaaugcuccaauauugugcagucuguacuauggcuggcuauaggccuucucagucuagcucguucucaggugauucucacgcucucuuacuuccuaguaucucuugauguuucagcuucucuguuuuauuaauuucccuguuagaauugcagcuuccuaugaggugggguagaagggagccacuugugucuaauucuuucccuuguugccacuaggcgccuaauugugccagaacgagagacacuuuucaacacgcuagccaacaaccgggagaucaucaaccagcagaggaagaggcugaaucagcugguggacagucugcagcagcuccgucucuauaaccacacggccccguggagccugcccucagcgcucucaacucagagcaacagucacaggugugcaggagauggcugcugggcagggagcagugagccugugagguggccuuagagugacucgggcaguccugcgccucugccucucagcauguuguccuggucagguuccucacccccucucaccuccaguucuuugacucgagcaggggugacaguggcugccuuccagguguguguaggccugugucuguaaggcauggaguguggugucugaugaugaagugggugcucaggccguagcagucugcagaguagcgcugaggcggcuggaccgacaggagcguacaugacuuacauuuucuaacuucccucagaagcccagauuugccauucagcuuuagagcggagaugugcagaucuuugcaguuagccaguuuacccagaacuuaacccugauggugucaugguucugcuuucagcaagugugggcuuuagugguccuuuuugcuaaggcaccaguauuaggcuuagagcaggaguguguggcguugaaguuguuggcuuuccuuucaugugcugauagguagcuuguuucuauagugaauggucucugcucucuugggcuuagauauugagaagaguguauaccacauagcuucagccuucucgugguugguuuggauauaacacugcccuauuucaguuuugacagugaccuugaaugccugcuaaaaacuaccauugaaucucacaccaagccuucucccagagugccaggugagugcugcccccuagccucccagcauaguuugugaucuaaccuggcucaucaaaacuaaagcuuaagcauuuguggguuggugaauuguuuuguagguaaauuguccccggcgaaacaggcccaacugaggaacuucuuggccaaaaggaagaccccaccagugaggucuacugcuccagguagggaacuagaccugggguuuccagcacuggcugugcagugcuagcgcacacuggagguggauaaguugcacagauccccagagucugcugcagucugagcaugggaagaagcaggucguguauuuuggaugacacagcucaaggugaaucuuugcacuuugacaucaugcaguccccaggucacauggugaugguuaagaguggcaugggauggacugagcuggaguuaagacucaagccuuauaugaguuuuuaccaacauuacauuggagaaaagucuucuuacaaaggaaacuagagguuaggcagcuaauacuugcuaagggacuaggagguaaauggcccagugaauaaaggcguauguugucaagucugaagaucugaguucagucccuaggacacacacagugaaaggagagagaugacucaucuuuugaccucuacuuguacguugugguauaugcacacgcauacacaucacaguaaauaaauguacuaauauaucuuuaaaaacuugcugaaaaaacuacaauauuagagaugaaaggucuuuuaaauuuuuaucuaaaauuccuuaauuuuuuuuuuuuuaacucagugcuggggaugaaacccagaaccuagcacaugccaaggggugucuaccuauaccacuaagcuacaucuuaucccuugcauauagcucaggauagccuggaguucacgauggaacuguguguagccguguguuuaauuuuccaaagccaggcuacauuuugccauugcccuggugaucuuuaacacugcaucugaccuccagcacagcacaguuguaaaggguuuuguuugcuaaucucugccuuuuaguccuuuccucuuggagcugcuuccuaagucuucugccuccagaggauuuugccagauacuuuuccauggccaccucuucucaggccaccacuuuuuuggggaagggaaacauaagcacacaaguauagucauggcuaugcugagccauggcugccuuaugacagucagacaugucaguguucuccuugagacacggccucugagcuggagcucgcaguaccauugauccccgugucucugccuccuucucaagacaggcacagggccgcacacgagcgccugcuuuucacauggcugccugggcguuuuaguucaggccucauguuugcacagcauggacugcuggccacugagccaucucccuggcuccauuucuguugcagcuucucaaauuccaaggcuuugccaaacuguuguacugucagaccuuccaggucugugauacuauguuagguuuuuuuuguugcuggaugacagcaugaugauggaaaucaacuuggaagagaaagaguuuauuucaucuuauagcuuguggucuggugucaucuggggaauucaggucagaaaucaagauaggccucuggaggcaggaccagaugcagaaaccauggaggauugcugcuccucaugucuugcuuaggcuggcugcuauauagcacccaggaucgacagcugguggguggcugugcccacagucagcugggcccucucacaucacucauugaucaagaagauauucccacaggcuugccuauaagacaagccuauggaggcauuuucucaguugugguucucccaauauaauucuagcuuacgucaaguugacagaaaacaacaacaaaaacccacccaaccaggacaggcagcaguaccuguuaucugccacuaacacuaccauaaucagacuucucuucuacaguaaaccuuuccuguuguuuauguucauugaacaugugccugaugaugacuuugggacagacacauccuuguauuagaaaaccauugcaguuauccagucuuguuaaucuucauuuauugcuggggguuacuuaaaacauccuuacuuauacauccuuagcucacauaucugauuguaucuuuaugauugaguucuuagaugugagaugugauugacuaucuugccgcuagguagugauaagaguagcaaggucugaccacucaaaauuugaauaaagagaacguaaacauuaaauugaagcuacacauuauacuuguuuaaugauagcacacaugcuagggagaauaacucaggacaugggcacuuuuuuuuguuuuggagauagggucucauguaguccaggcuggcuuuaaagucuguguaauggaagauggcaguaaacuuaggauucucuuucugcaccaccuaaaugcuaggauuccaggcauuaccaccgcucacaguguauauauaacaguuauuuuaauuuuuuaaauuguaacaugguuacaaaaaaguauacaaaucaaaaaacaaguaaccucuacugaaguuaaaaaacaaagcaccucucuuuagaaaacccucuccuggagcuagagagagaacucaguuagaaugacagcucggugaacaugcgguccugaguucacauccccagcagccacauaaaauguuuuugccuuugccuuuaaucucagagacaggcugaugccuagauaccucugacucuccagccuuagccaaaauagcaaauucugauugaguaaaaggcuaucucuaaauaauaagguagaaagugauagaggaaguauccuguuccagccuugacauguguaugcauggaugcacacacacacacacacacauacacaagaaaucucucuuguaucccucacauucccucuuaaaauaauauguuacaugggaagauguugaaguuauaucuuugcuggcauuuuuaaaaauuuauuuacaucuguguaauuuuuuauuuauuuugaggaaagaaaccuguaagaauauagucacugagccugugaguuggccaugccuuagcuugagcuuaacuuaggaucuuuuugcuuuaccaucaggaagauuguacucuuguagccuuucugucuucaaauucaaggcaguguaaaguucaaaaucuaacacaagauacucaauacucuguuauaaaaaaggcuuugugcugggugguuuugcccagcuauagguuacuugugagcugcuaagcauauuuaagguagaccaggcugagcugugguguuuagcagccucuacauauuuugugcccuucugacugguuucuuccucuuccagugggcuuuugcaacaugacucugcuauagcuaaaggagcaucugucuaguuuuccacagcuacaucacuucucccucccacucaggacaguuguuaggauggcuuugguacuagggucacacugaggcugcacuuaagacccagcccauaccaacccucuucccuuguuuucccuaagcuauuuuuuuagugagaggacaggguaauagggcuacaacaaaccaccacggcuuaguggcucauaguagauaagcacugaguucagcacuguguggcucagcuagguccugugccgagugaggcuagacucaagguguugccugagcugcucggugggagcuguggugaagauuuacugaaggagguacugaaggaggucccauggaguuggagggugagguucucguccccucugguggcauuccuugucccucaucuuuaggccacaauugcagagaacuccucuucuagagaucuugucuccauggacuucugccuucucuucagccucccccuuugcuuuaauccugugccuuuaagagagggauugcuuggguggugguggagcacgccuuuaaucccagcacucaggaggcagaggcagguggauuucugaguuccaggacagccagggcuacacagagaaacccugucucauaaagaaaaagaaaagaaaaaaagaguucaugggauuuguccuguaggauaagcucucuguuuuuaaguuagcagauuugugggcugacgagauggcucagcggguaagagcacugacagcuuuuccagagguccugaguucaaaucccagcaaccacaugguggcucacaaccaucuguaaugagaucugauucccucuucuggugugucugaagacagcuacaguguacuuauguauaauaauaaauaaaucuuuaaaaaacaguuagcagauuugugacauuacuuauaccucuagggugccuuuugucaccuccucuugcuguguguauguaacccuacgucuguccauccaucccuacaguggaaauccuguuggcauaggacccucuuauagaagcauugagaaaaaggucuacaaaguuagaugcacaggguuugaauucuggcugcuuaccaacuuuauaaccuuaggcaaauugcuucacugcucuaagcaguggccaaaaguucaguaacaguaccuaaguucuguggugauuaugugaggagcuggcacaguaugucuggaccugccuccuuccuggugcugcuuuugguugucuugacaagguagcacuguuaacuaacaaaggucauaaaaauaacaguucugccauauugcauguguaaauuaacucagcuggcuuccccaaccuccuacugaacaacuuuuggcucagaaauggaagacacagaaacuacauucuuacauugaauaaugaagauaucaaguuguuugcagaaaauaaacuuuaauauuuuggauccugguaucauauacuuagauggcauuucuaaguggcccaccacauaguugucugucucagaauacuugaucagagcauguucccgcaugcaaaggcacuggaaaugggaaaaagaacuuugucuuuuuugcacuuauuuuuauuuaguuuuugagacuaggucuccauuugugguucugacugaccuagaacuauguaaaccagaguggcuucgaacucacagacaucuaccugccucuaccucccaaguccugggauucaaggcuuguaucacagcacacaccacuguacuuaacuacuuuaaauaaccacaguggcuaguagcuacugggcagcagugcccugguauaugauuuuuagcuuuaccuguuguauagcacuuaugcugagauuuuguuuuuugagacaaguuuccucuguguagcccuggcuguccuagaacucacucuguagaccagguugaccucaaacucagauccaccugccucugucucccaagugcugggaccaaagccugaaacuuaagauauuguagcaugaucugccuacaggacagacaagcgauaguauaagagugcugcuuugaauaacuagggaaggaacggggcugggcauuuuguuucuccaguguacaauaauagcauacauucucaagcacaugguagaagguggcagaaccugacuccacaguguaaagagcagagaagaccaggcuaaguccauguggagggucacaggacucacuuagaugugagugagaugcucagacucaggccgucucacucugguguucugagguuggaaagcaggggugaugcuguggcugacuagccugcccugggagcuggccucugacaugucuguuuucugugagagcuuaaucucuuguuuuucuaccagugcugacuaucgcucucauuuucagucuugucugauggucaaagcugucuuuguccuagcagcuuaguuuucaaagcuuaguuuugagcaaagaccacaaauucucauuauucacauucagcaauagcagcuuccaccuaagguauaaaauaaugaaagugcuuuauggucugucucuuagcacugaaauggcacagcuuuuggguuugcuuugaguugucuaauguuguuuuggggugggccuucugcagccagccugucccggucagccuuccuaucucagagguacuaugaagacuuagaugaaggcagcuccgcgucauccguagcucagccucuggagggagaagaugcccggccaaccugcacaucuguagcucagccucuggagggagaagaugcccagccaaucugcaaagaggaagaggcuguggucccaguaccucggcaugccccugugguccgcacaccuucuauccaacccagucuccugccucagucgaugcccuuugcaaagccucaccugauccauaguucuucaccugccgugaugagcucugcagguaagucaccaauugaagcucugcccauggaggaccguagcuggagagcugcaugcccaugucacaguagccacucacucacugaggcugucugcauugugugcucacugcuacagggcaguugucagggcugugugucacagcgaccucuagcagagacacaggacugagguacaggagugaagccacuuuacagaacagcauucaucccuguuagguuucuacugagggggcucaccaggguuuagacuuuagaucacugaguucccauucauuucugguaauauaccaaaaauuagaagaccaauucaaaagauacagguucucuugaagagguuggaaaggcuacuauacaagacucuguuacuauacacaguaacagcuucacuccaccauccacuuugcuuuguuaacguaggucucuuucagaaguaaaggagugggcuguuugccucaguguaaagcagcacguggauucagggccuccugucaguagcuguggggcaucgggcucagaacuuaccagcuccagugcccaugucauagucacucgcugaggccaugugcauugugugcucaaugcugcaggacagugucaggaccuugugccauagugacuucuagcagagacacgacugagguacuggaacaaauccaccuuacaggaaaucaggcucucuguugcuauaaauguucucuguaacgcuaaaaaauuuuaauuuuuuuaaaauuuuaauuuaaaaauuuuuaauuuuaguguuuuuuuuuuguacaaugcaacagaauuuaccauuuuaacuuuuccucuguuuccuucauugaccccauuugucugauaauuuuucuuuuccccuuagucucuacgucagccaccaaaguuauuccucagggagcagacagcacaaugcuggcaacuaaaacaguaaagcacggugcaccagguccuucccacacuguugcagcuccccaggccgcagcugcugcagcccuaagacggcagauggccagucaggcaccagguaaagacuacagccccauuucuaggagagauugugagcuguccaggucacaggcgugggcuuuggggugggagacagcuggcuuucuugccaauucuuagccgagaaggcuaguuugaugaccuucaucccugugaggagagcuuccaggaggcaaagacuaggucucaauuuuuuugcuuugaaagggagguauuagaugugccacauuuaguuuuaugggaaauugaugaauuuugaugcugauuuuccuacuuuugauuggugaucuccagaccaucugacaucauaagaacaauguuuuacggaucccaggcacugggagggcggcugcacuacuguuccuguuuuuuguugcaguacugagagaaucagcagagagaguuacccaagcaguguauaccagagcuugcccuuuccagauggcuguucugcacugacguuggcuuuaguuaggacagugacuuagcugaucaggacuuaggucuagggagugggacucgggcuaguugucacugguuguggccuuagcaagcgguucccacucagaggcugcucauccuuucagcuggcccaaaaauaguuguagaguuaccggcuaggaacaucaaagaagaaucuuaaaacaaaacaccccacaaggacagguuaucuguuccccaacugccaaauauuuucacuugggauguucugagacaugguggacucauacagcuaggaaagaaugguuagccagacagaguugcuuggaccagugauccuaauacuugggagcugacugaagcagauuguuguaaguucacagccaaacggggauauauugugaacuugggagucuaccuagguuacagagugaaaccccaucuaaaaaacaagcaaacaaacaaaaccuaaagaccauuaaauagcaauaaaucaaguuuaaauagaaccuucucaugguaccuaaaacacauaauaaaaacuaaagacaagauaacaaaucucaacuuauauucaagcuuucagaacacaguuauuugauggucuccuuguuuccuggacacacaggaucuugacaguacacugaucaggucccucauccagccaacuuuauaaaguucagauuugucaggauuuaggaugcuguacucagcacgaacuggaaccgucacacugucucuuggagcaaguuuuuaggguggagacacugucacguguucagaugaauugugggcaguucauggcguguucucccagcucuuccgcuggagaaggaagugagcauucccacagauccacaggcugccugggauuugcucaggggagaccagagagcuuuacuccgccuucccaguuguuaacagaaugucauuaaaggugauaaaguaugacggagaagugaggcaaaaaggauuacaaagcuggugugggggcaccugugcuagcacuaggaggcaaggucagcugcaucucuggaaugugaguccagccugcgguacuguaggcucgucuguguuugcacauuuacccagaacuuggcacaucauaagcccaugggagaggaggaaugagaauggcauuggcccugagcugagagcucuuaauccucuggguguugccaccccuuucaagaugagccaacgguguggcagguaucuggguucugcugcagaaagcuggcuagggaauugucccucuaagccagcaagcuuuauuagauggcaagaaguccacuccuuggccucugguaauagucagccagguguucuauugacugcacugcugacuagaucuccuucauuugagguugcugucugccggagguuaugugcugggcauugauuucuguaaacuuuauagaaaaggauuuuaaauccucugcaggaauuaauguaguucucucuucccuguuuacauagcuaugagcacucugaccgaaucaacucugaagacugucccucagguggugaauguacaggaacugaggaguaaucccucgcccccaucugcggccaugggguauguuacagcucuucucuguacgcagccugcaguuggcugucauggacgcaguuggucugaagggagcacugcugccacagcuucuguagaggccugggcuauggagggaugggcagccauuacuaaguuuuuaggaagguggacuuucaccuuuccagggcacccacuauaaacuauaagccagaugugaauuuggauagacccaguuuauuaauguucuucagguccugcugaccacuguaaagauggugggccauggagaaugacagugcccucccugacuuccucucuccuagcauuuccacucuuuacuuuuuucucaugaagaaacaguauuugagaagcaagcagcuacacuugcagaacuucugcuucucuucugugcuuauuuaggcaagauucuugccagagcucacuugcguuuggucuccaccggggcugguauuguguggugccccccuuaucccacccagggcucauguuguguggugcucccucuccauacacacucguacauuuccuuuagcagcauuguucaaguccuacucacugugcacaaaguuugaagccucauagucuguggagcagcuagccucccuaugcuaucugaaagaguugggagacauucuuuugccuugaaugggagaucaucagagacuaguauuuuuagggaacccaaugucuggcgcccauggauagucaguggcaaggugagcaacuacagacccuguguuuucacacuguauucuuguccucuagugacacuacagagcagaccuaccuacccaaggcuuguuuucuugaguggccuugccaugcugauguuggacuuugccugucuguauguuggucuauuuaccaacacugccuauugucaacauuucuaguuaucucagggucaaaccaaauucgcccucuuuacuguccaguaauaacuugaagccuuccuuggaaugccauuuggaccaagacugguauuugugguugcugugaacccuucagagaacugugcacuggaguuugggaacuauagcagauucccacuggagagaaggcgggaggccacugaaagucagaguguuuugcaaggccagucuugugggugcggugugggcagguacuucucagacacugacuacagaagagaagcacuuuugccugcucagcucaccucccucauucugcucaugccugauggcagggcuucccuagcuuugcucugcaacacaacacaaauagccaccaacgguggaggaaguguuuuuaaaccuuuucuuuaucaucuucuguauguauggugugcuugcaugaguuuaugugcacuaugcgcauguaggagccuguggaguccagaagagaguauuagaaccccuggaacuggaguuagcacuaucuuugugagccgcccuacaugggugcuggcaacugaaccuagauggccuacaggagcuccuaacacugggccaucagaaucugguaacauguucucuuccuuucuccacagaguugaacucucugauacacuacugagcuucagcacccaauaccugaagcaguuuccuuuuguuuucauuuucuagcuuuaaaauuguuuccuuuuuaaagauuuauuuauuuuauguauaugaugcucucuaucugcaugaacaccugcagacuagaagaggacaucagaucccauuacagaugguugugagccaccauguaguuucugggaauugaacucaagaccucuggaagagcagacagugcccuuaacuguugaaccaucuuccagccccuuaaaauuguuuuuaauuacauuuauuccuguucaugugcacacgugugccaaggcacauauggagaucagaagacaacuuaaaggcauugguucuccuuccagccuguggguuccagcaaucaggguggcuugacaccucacuagcccuuuuuuuaaguagacauuuauauagcugauaaucuugaaaacaguucauaagugaaaauugauacauuucaccaacuuccccaugggugaguucauugucaaauggcugacuuucagggccuuguaagcagcuaucucuaaagucuauuaauuaauuuugcacuuaacuauucuuaggugacaccacacacauucauucugcucccuguguguugugguugugagacuggcuuuucucuuuaacuggaacaaauccauagcuguucauacuccuguaucgcucccugcagagcaucugcugugaguguggugcuucccuggggugaaggagaaguaguugugaagaaggccuucaucccuguugucgccacagggaccucagccaggaggccaccaggcaaccaaauucauugguucugccuugucauauaugcauauuuauuaaaacauauuugcuaauaauuaagauuguccaaaagaagaccuaacugugucucuugauuuaggccauggaagcaagcuguugaucuaagugaaagaaugagucccuuuucuuaagcagcagcaggcaggauacuuaccauugguggccuaagaagugcuggaacgccucgcagcagcucugcuuccauugugcagucugauugugucuacugugguccugauuguugcuucccuucuuagagguguguguguguguguguguguguguguguguguguguguguguguugcauaccuguguauguguguaucacaugccugaugccaguauaggcuauaagagggcaugaguucccuagaguuagaguuagaggugauggugagcugacaugaugagcugggauuuggaugugguuccuuugcaaacacucuugccacugagccgaucuccagcccgguuguuuagugguuuuguuuguuuuugauaagaguguacaagcagugucacacccauuucacaguccucuugauacucaaaauauagcagagcugagccuggcuuucccuaauauucucaugagcauuuguguguuggccuccuucauuugccuguguuccuacgcaguccuuugcauacucucucaugcguggacuauuugcuguuuggccccuuuagucgagguagagcuuucuuguagcugguuuauugguagguucauugggugcuugugccaaacagcguuucucuacagagaggucacgugguauagugugcugguuuggugccuccugguuuuguguuuggggauucaggaugcccaggagacauguggcauucucacaaguaaauagaacagugacuguacacaacuuugccuucgugauuugauuaccaucauguugucacuaagguuuagcuacaaauauuuuccaugguuuggauaaaauacuguuuuuuaauguucauuucuaguuuuuauacaagagauucauuucccuugugguucccugagcucagacuguucugucagcaaguugucuaaauccacucuggaaucuugggacccagcagucuugccaacacauucugggucucugguggaagagggcaggaacagccugagaccccgaacuguggagcgucucagggcauuccuguaucuucaucuagggcacuccugcaucuuccuuugcuuuggcacaaucaucgugggggguuuguuucauugagauugagucucuuuucuucuucagccuaaucaagucuaggaagauuauaugauaucacacagaauuuagauagaccauugaggacuaaaccauuugcugauuucgucuuucaaaagaaaaaaaaaauuuauuuauuuauuuauuuuuagaucagguuucuguauagcccuggcugucuuggaacucagauagaacaggcuauccaugaacucagagaucugcugaacucugccucccgaguaccaggauuaaaggcauacaccaccacugccuggcaucaaauuaauuuuugauggaaaguuauuaauaaucuucccucaaaucugaaaagaguucuaagcuccuacaucccacaacuacaacugccacuauucauuucaguuaaaguaacugcacuggggacagagaaauugaaaagcuuuuccuaaauaauaagagcuugugucuaugauagaacugacaggugggucuucauaugcuaccacaaggcagguagugagacagugguucccuaagugcagcagacggguuuagugagagcuuccuuggaaacuggggugugccuucguucccagaguagccaagcugcaggcuggaaacagcagguguguuguggaauccacccacagcugugccagucuggggcaggggcagcacuuuugcuauaugugcagcucaucauuuaugccucacaguuccuguugaacaucuuuuuuucagguuugaaaaagaauaggagggguuggugagauggcucaguggguaagagcacccgacugcucuuccgaaggucuggaguucaaaucccagcaaccacaugguggcucacaaccauccguaacgagaucugacucccucuucuggagugucugaagacagcuacaguguacuuacauauaauaaauaaauaaaucuaaaaaaaaaaaagaaaaagaaaaaguuuagauggaacuuccgaaccaucuaaaaccagggagaaaggaagggggaaugccaguugucccaguaagaacagcaucuauuuggaaaugguuauaaauuguuucagggaauuauagauagguagaagaaaguuaacaaggucauuggcuugcauuuuauauaauugaaaacccagauuucauuuaaaacuaauucuucagcaaaaugucuguugagugugggguccaagacaucuguaugccgccccaaagucuucuuauguguugagcagggaacuagcuugagguugaacauauuugcccuccguaaugucucagcaaacucucucucuuucaguucugccgugcagcacucagcagccaaaacaccccaugcuguguuaacccccguggcuaacagccaagccaagcagguaacuugcugauguauucuuuagcaauaugucucuaacugaagaucauuuuaugauuuuccuucauuuaaaugaaugugauucuuagaaagggcugacacuucuuuuccauaacucaugccaguccugacaugguuaaccuguugaggccauugacuuucuagacucgucaucuuagggcaugugcuaacagaaugcuuuuggaugagauguuuaguuugccauuuguuuuguuuuucuuuucuuuuuuucuuuuucuuuuuucuuccccccccccccccagacacgguuucucuguauagcccuggcuguccuggagcucacucuguagaccaggcuggccucgaacucagaaauccgccugccucugccucccgagugcugggauuaaaggcaugcgccaccaccgccuggcuuuuguuuuguuuuucuuaacauugucucaguacugacuugugcaguagguauuuagauaugucucuuuugaggcagccgaggucaggugaguuacaugggcucauccagucaguuauugauagaagcagcugggagccaaggcugaacgaucugcccuuugcuucucccaccgcacuguuggaaauggguuucggguauggauugucuuacuuuacugcugcagcucugccuuucagagguugcaugcuuuuggugaugugucuagcucugacuuuugauugauuguaagcaguuaaacagugaaaaagaaaauaauaaagagggggcuggugagauggcucaguggguaagagcacccgacugcucuuccgaagguccagaguucgaaucccagcaaccacaugguggcucacaaccauccguaacaagaucugacucccucuucuggugugucugaagacagcuacaguguacuuacauauaauaauaaaauaaauaaaaaaaaaauuaaaaaaaaaaaaaaaaaagaaaauaauaaagaaagcaguggggugugugugaauuaggaggaggcuagaagggaacccaagcuaucucuggagcuuucccagcaguccuguuucucuuagaucugucuuggagaugagcagccuuagauugcacuugaauccagaguuugagacugcaccauuagcugccggcuguggguucccacaccauccugugccucuguuccccauggaggaugguaguaggucauacagcggcaggggugcuggcugcagguggaaagcccgguugcuucuccugcucacuaauugcugggacuguguucuucauccacccaucccguccucuaacaaguacucaagugccauuuauguggcagacacuguacuagguaccgagaagucagccaugagucaugcagaagccuccagugugguguuauauuuuguuauuuuucuauuccuccuuuucauggguaauuaaacugaauucaaguauucgaguuugcuggguuuauguuuuuacauuuccguuucagacguucacuuaucccaaggauaauuagcaguuuaccauaaauguuuuucuuguguucuguacaggggucucugauaaauucuuucaagccgucaggacccacagcagcauccugucagcuguccucuggggauaaagcuguaggugagucugcaugucucucucaugagaaugaagacaaaaagugcucuugagaguuccuucuguagauccugaagccaauaggcagaugccgaauuccaaaggccucaguuuugaggaauuguaaggacaucgauaaguccuuuaacacuugcuaaacuuggaguuuagacuuuagagucagcaugagaaaacguuugauggucuuuuauagcagugucuuugugcaucacugcaugaugggugaagagaaguuagacagacaguugagcacuguuccuucaucucaaagggaaagaacuaucauaccucuugacgcccuugcagguaaauuacuuucuuuucuuuucucucccuucaucucccuucucuuuucuucccuuuccuucccccucucucuuccuuucuauaugagacccugaggggcaugucuguauagcucaguaaugacauaucaaauuugauauguagcuauagaugauaaccuuaccucugcuuuccuagugugaggauucugugcaugguacugcaugccugauuuuaugcagugcaggacuuucugugugcugggagaauacuccuucaggugagcuacauucccagccccuucauaauaacuauucaaaaucaguaaacagaugaaguacagcauacuugcugcaggguaagauccuauuagguaggcuaaucauacaagguuuuauagcuucgcagacuugccagcaaacugaagcauaaauauuuuuaauuaaguuaguuuuuacaguagcuggaaguguuuugaccauaggauaaauugcuaagguugugcuucuccagggaaugacuugacaggacugucgaggaaaugagaaaaacuggggucagaugggccagccacagcauccugggaacucagcguguuuauuauacacacuugcaggaacagagagggagagacaggcuugcuaagccuggugggagcggucucuguagggagcagucuccaggcugugaguagggguguggggaaagcgacagugggugucuucugcacaaacuaucagcauucacacuuagaccuuucccuuugacauguccaggaccugucaagcauuccacgcucgcuaaggacucuguugcuucccaguaccuagccacuggaagccuauccaugagcaucucucaguguuugccggugaucucccguagccgcuggggggagggggcacccacggcuuccacugaacagucugugcucacuuaguucugcacaccacaacucugugucuaacuuuuauuuucauuuccaucugacagcagauucagaggcugagcggcacccagcagcugcccacuucacauaauggccaccagucagucagucagucaggcaccuccuuucuacaucaugcagaaccuaauugaagcucuaaguguuccuuaugugcaccccacacucaccacuauaggccaagacaaauuuaguggguucagcaaagacuugagucauuuagguuguuuuuuuuuuaaaguuucaaaaggcacgaucuuacuucucugaaggccuuuguggcaggccugucucagccccucacuguucacugcugccuucccuugcaggugaccaaggcuuaagagagcuuuucucuuugaggcuggaaacaucccugaaaacuguucauugcugaaaccuuuucuuuucauuucagauaaagucccacaugguagcucaggcuaaccuguaacucaauauaucuggcucacuauaacucaggcuagccuugccuuugagcuuacagcaauccuccugcuucaacuucccaagugaaggguuaaaggcaugagucaccauaccuauauuucucucaugagcgcucucucuccccccuccuccuuccuuccccuuccccuucucucucucucucuccccacccccacccucacccucucccucccuccucuccucucucauuguauguguauuucuggaaccuguagaauaacucucuuacucauuaguuauaggaauacguaauuguggccgggugauggcagcauacaccuuuauucccagcaaggcaggcaggucucugugaguucaaaucuggccuguucugcauagugaguucaaguccagccuggacuacguagugaguuccaggucagccacaguaacacaaaccccugucuggggggaaaauaaaucuuguuuuacugaucaugacaugguuauaugcaaaaauaucaguguaaaaguacaacauguuaaaagugaaagcugcccugggaaucaguuuuaaaggugcccuuaagaaugguaugauccgggcuggugagauggcucaguggguaagagcacccgacugcucuuccgaagguccgaaguucaaaucccagcaaccacaugguggcucacaaccauccguaaugagaucugacucccucuucuggagggucugaagacaguuacaguguacuuacauguaauaaauaaauaaauaaaucuuaaaaaaaaaaaaagaaaauguaaaaaaaaaaaaaaaaaaagaaugguaugaucccagcauuccagaagcagagggcaggagcuuucugugaguuugaggucagccuggucuagagugagucccaggacagccagggcuacacaaagaaacccugucuugaaaaaacacaaacaaacaaacaagaauuugauagacagauagacagacagauaucuugaggucuuuuguuugcugcucauuagaauuguuacauuauguaguaggaggguugugcauaccacugugcuccugucaggaagucaccugacauccacaggaggggcauccugcacaaguuaccuccugucauuucaccagauggggcccuggaauccagcucuggcucucaguccugacagcagcuuccuuucccugcugggccaucugucuccccugcccacugcauuguaugaaacacuaccaggcauuuacugugugcuggagacugcuuccccacccuuccagccccaucacacuugaacaucuauuccucuuccuggcagaucaccuuacucguuuauguaauagcugccugggauugcgucugagcagcacucugcugacaguugagagcuucuuauacguuaguuauggacaaaccugcacugagcaucuuucuacaacccacacugcauuucaguacggagugaagcuuaauuaacaugggguggauagucaguguccgcuuagugucugugucuagagugaucauguguagcaagugucuguuaccucuauagguuaggaaggaaggaaggaaagaaagaaaaagagagagagaaaaagagaaagaaagaaaacguauuuucugaauuucaaaaaaaagaaaguaaaaccuauggaaaaggcagaaauguauagauaacucugaggccacugcuuagaaaugcucacuguaucagcuugcuuaucuugggauuuugucccuguguauauggaaagcaucugccagucaguugauguagaggauugguaugcucagcucuggaguuaggcugcacggagacuguuuugcugacuuuucuggaaaggagagugugccaugccuugacagaaccaaagagcaagacugagagaccuugagcacaaggugacacaccagcuucccucgacuuaaggcuugucacaagauacacuggaggucccaaaaacuggggcuguggcucugggcaacagcacacagucuaagcuguagggaauuacagaacagcacuccuaagugacuuuuggaauguccuuauuuuguccauuucaggucaagggacagccaagacagaguccgcugcgaccucgacuccaucugcugcaggacagcucaacaagccuuucucauucgccuccccagggucagugcuaagucacuaucagccagauccaugaaaguccugagcucucacagcugugccaguccauccacaguguuuuaacuguuucuguuuugugguucaggguuauuauaucuacuguuuuuaagccuaagccucuuuuuguuuggcagagaaaguuuguucccuucuguaggucauuggguguagcacaccagguguuuucuuuuuucuuuuauuuuuugguuuucccagacaggguuucucuguguagcccuggcuguccuggaacucauucuguagaccaggcuggccuuaaacucagaaauccgccugccucugccuccuaagugcugaucucuaguuguaaauucuucaagggcauauuguaugaaugaauuauaaggaggaauauuuaaaagcugaugcuguguuaaguuugcuccauuuuaacuucuuuuuccacuccucaggaccuuuacuuuugggacaaucacaccaaccccaucuucuaguuucacugccacaccagguacagucccuguguugcauaguguucucuuguguuccccucaugggagaagugcuguacgugacugugugcuuucuuuguaacuuguggcucuucuucaguugguacagucagguugguagugaugauguacaucagagacauguuggagggcugagaguggcuuggugguggggcaccuuccagcacacaggacacccuggcuugaguucauagcagcagggcaguagcagaguguguaacccagagcuugauguggggcugcugaaaaggcucagcaccuggacgaggccaagcaucucagugucauuccugggacccacgugguagaaggagagaacugaccacugaagucauccucugccugcacauugucuguaacaugcaaacaacacaaauaaaauauuuuaaugcaauaauuuuuuuaaaagaacuuguugugaaagagaucuguuuacauaacuauaaagaggaaaaagacuugcuucucaaagcuucauuugcuguaacauucuaauguuaacacacaaacuuggucccaacaagaggugggcauaguaccaugaaguaaaugaucaaacuugguccucaacacugguacacauaccugugcuaggaacccagacccauccaaagacaacagcuuugucacauuccuccaagcucucuaaguaaugaaaucaaggaagccuuuacugugauguguuuuuaauuaggaaauuuugagauauaaaccguaugauggaguuugaaucacucuauagcagccguuacaguucuguugcauuuccuuugcagaguuuugucuuuagcaaguucucauguaaccucaugucuucugucaccuuugcugggucugcugacucaggcuuagaaucucggcuauauagaggcugagagaggaagcucucaaauuuaaagccugucuaggcugaagaguugguccaggccagccugggcaacuuagcacuggacuuccucuaaauaaaaguagaaaggggccuggaagacggagugcaacucuggaacaccugccaggcauaggcaagauccugccuguccagggcucaagggucucucccguggcuuugcugugcuuugucgucugucugcuuuucuugaguguacuuuugggcuauacauaugauaaguaagacaucagucaucuuuaguuuuucaaucaacaaaccuuuucuaaugugugcugggaauagaacuuaaugcuuuguauuuaacaaaucuuuuuucaaaauuuuauuaugagacauggugucaccguuacuuugagaagcaagucuuaaggaaauaaaagucaggaugagaugcagcaguaauccuacaucaacucugaaucaguacaauaauggguaccaacccaaaggccauaaacaacaucacuaacaauauaaugccaucuucagcaggacccuacuaaacagauuaauugcaguaaaaauuaucaucuggguugacacucugaccuuaaacggcgaagagcuuucagucuggguccaauugggcuaugaggauuacccauacauuagcugauaccaagaguaggagggaagcccuuacccagggcacuguguugagagcagucucuuuggggacaauguguccauuccaugucuccgagaugucacacguuuguugugauguggugaucauaaacagaaucuucauuccuucccacuugagagcugacucugggagugcuaauguuccugugcagagcaagcggucauccugcccuuucacaagaacucugccauuagaaccauacguuucgucccugacugaagagaaagauugccugagaagggcaaucaguacaaaugugaugaauucuauuuugcuaaauccaacucuuuuccugguuucuuuuucuugcuaggggcaggacccccuacuaaagagccaacccagcuugaggcauucucauuuggcgggggaggcaaaccuuucucugaggccauuccugggaacuccccugccacaggagcaacaucggcacccagcacuucuguaacagcugccucucuggaagacucugcuccauccagcagcaaaccugcagcuccuccugaaacuacuguguccucugcuucuagcaaauuggaaacuccaccguccaaguuaggagagcuucuguucccaagcucucuagcuggagagacgcuggggagcuucucgggccugcguguuggccaagcugaggauucuacuaagccaguuaguaaggccuccuccacaaaccuagcuggagcccagccagcuaagcccucagggguuagcuuuccuaauacuucaguguuagggaagccaguggagcccgcugugaccuccucugugagccccgccccagcagcaccagccucagcucugaaugugagcacuagcaguuccucagcaacugucuuuggcagugugccccuuaccagugcuggaccuccugggcucaucaguuuugguggggcugcuuuggcuaguagcaaagcuaguuucucauuuggaaaccagcagacuaguaguaguacagcaucaucagcuaccccaacaucgaccucaguugccccuucccuuccagcaucuuucccuacuuugucauuugguggccuccugaguucaccaucagcuucuucccugcccguguccucugguaagaguacagaggaggcagcaccaccagcuguuccugacaagucagacagcagugaaguuucagcaacaacacccucacuuccaguacagccacagucaacccaggcaucucugcaaacuucugacccugucaaaaaagaaccuguucuugugcagaccacagacagcagccccagcagaccagcaucuucugccagcuuuguggcauccacagaguccaugccaguaacccuaggggccccugacagcaagauagaggcagugucuccugcguccaccuuugcagggccuggacaggcugcuguggcaacagcuguucucccaggagcaggcucggcagccacugaagcaucggguaccccuaccaccuccacugucuccagcaguagcccaacuucugccacagagacagcuguauuugggacugccacaucugguuccucagucuuuacacagccaccugcugccaguucuagcucagcguucagccagcucuccaguaacacagccacugcgcccucugccaccccuguguuugggcaaguggcagccagcauaaccagcacagccgcugccacaccacaggccagcaguucaggguuuggcagcccugcauuuggugcuucagcuccuggaguguucggacagacagcauuugggcagaccccagccuuugggcaagcaacaagcagcccugccaguggcuucuccuucagccagccuggguucaguuccgugccugcuuucggccagucugucuccucuacccccgcauccaccagugcaaaugucuuuggagccaccucgaguaccagcaguccugguuccuucucauuuggacaggcuucuaccaauacaggagggacgcuguuuggucaaaacaacccuccugcuuuuggucagagcccuggcuuugggcagggaagcucuguguuugguggcaccucggccacuaccucuacagcagcaccuucaggguuuagcuuuugucaagccuccgguaagaauuugcagaacguuuugacuuuguucucuuccugugcuauuuaaaacauaacaggccuccacuguucuuauaauuagaagagcuagguucugugguucaugccuauaauccucacuuaggauagaggcaggaggaucaggaguucaaggcucuuggguacauaauacauucaaagccagcccaggcuauaugaaauucuguuucaaaaacuaauauccaagaugaaggagggcacuuggugcccacauggcaggaccuguuuuguccugauuggcugugcccuguggcugaguauugcuccaguucuuuuccucagcaaacucucuacuuugcugaccacagacuaccaauuucacagguuaaaacuacgccuguuugcuuaaggccacagcaaguaauuuaacucuuaauuacaauguuuuguuuuaauuuagaggcucuagaacugucauacucaggcagucagaccucauaguagacggugcaggugauaagaguagagaggauccaggacucccuguuuaguuaauuggcucuguggauaauuauuucuuuuguaggaagcagccauguugcuacuuugaauagcaauuacacacacacaaaaugcacacauuguagaguuuuugaagagaaaacuggaugcuucauucuguauccaaucuuagcaucgacuuuuacuucuaaaaguuuccaguaggcaugguaauguggagagguguuccagguuuggcuuucuagugguucucuuaugaaagguaauucuugccaggcaaugguggugaacaccuuuaaucccagcacuugagaggcagaggcaggaucaucucagguaguucaaagccagccuaaucuacaaauggaauaccaggacagccaaguuacacagagaaacccuacacagaaaacaacaacaacaacacaaagaaaagugauaauucuuuagcaguuaggccccagaaaauaaaacaaaaaauaauggcuucuuguuagacaggauugaacauaauugcugauucauuuuuuuuuucagugauaguuuauuugaaacaacuuguaauuuguuagaagaaauguuucccuucuuuuaaugaguguuaaauucuuaccaaaacaacuauaaagacacaguaggcagagaaacacaacucugaacaccaccaucccacccaccaccaccuggucuccucccugugcccugagacugcaagcacauggccuaucugggugaggggcauuuaaugggcagggagaaggccuaagacuuaaaggagaguaaaaucuugccacugcuuguccugagcaucaaggacagaacuuuaaaaaguauguacaaacaucauugagccggcucaccaaauuuggagccucccaaggggucuuguuuaaacauagaagugcuugguuagauccuggggccgaccuccaguugucuguucuccgggaaacuccacccugcuuaguuauaggccugcaucccuugccucacuuccaguuguaccuggcagaagagacuccacucugauggaauccaguacuugaguguauguagauagggagaaugauugcuggugugggucacuggcaguacucuuguuagccaagaucgugacgguaugccacccgccaccaccugaccugguaggagagaagaguucaauccuagggacuuuuagaaugcuaacagugagguaagaaccucgcaaucggcccuccacauguauggguucuguaccugcagauguggcccuccauggauugaaauaacuagggaagaucuaugcugaccauguacacuuuuucuugccauuaucccugagcaggacagaguagcagcuaguugacauagucucuccaguauacuuccguguaccauaagucaucccaaggugauggaagauaugugggagccuggacacacgggcucaaacaccacagcgugccacgucaugaaagagacuacugcauccucagauuuuauaucuggguacucucagagaucuagaauuuauggauaccaagaacagcuguguuuacauagaauuuucuccauuuccucaguggggaagcguuuuuuuuuuaauuguuaauauauuuauugacauuuuuguguguguuugcaugcauguauauaauacaauuugaucagaaucacauaucuccagcccccuaucuuacccuccucucuggaacccuuccuuucuaacaaccccuccugcuuucuguuucuuuucuuucuuaaugacuggcugaguuuaacaguuugauuagcuuuuaugaacguagguaugggauugcuuacuggaucacaaacaacuauccauaaauacacuucuggagaaaaauuacuccccuucuccaguagccauuaacuaccaguagguccucaacuagacguaggguguuaugaguuccgcccccucuguccuggacuguuagcaagcaggaaaugguuccugcugugggccccugagcacagcagucaugucguauuuagaaaacaguuuuacucucuuccugccgauggucaugcucuucaauucuuuauacuucuugcucugucuuccaaaguauucugggagccuuuaguccaacuuaggguaagacaccggacagucucuuagucucagcacaguuagcagucucuucacuaaccaacugcccacuucaaaaagcugcugugacuaagacugagagcaguguuaaucuguggguguaaguacaaguauucagaaagaaauuggacuugucuauuuagcagaacaacaauaauagcuucuccccgccaguguaugaccuugucagccugggauuuuaaccaguuuguuuacagugccaggaaugaauuuccuccuguggagcaggccucuaagcagaaagugauaguuuacuuccauacauucaugccauggcuacauaaauaggccuaucuuuuccagcgguuuaguacuggagcagguacacucaccccuggagaaggccagugauggcuuuuacauccagugacguucauaacacaucuauaggcuguggguguuuugauuggguuuggguuuggguuuggguuuaauuuugauguuuaaaaaagauuucuccaaauugaaucuuugucuuugugucuuacagguuuugggucuaguaauacugguucuguguuuggccaggcagccaacacuggugggucagucuuuggccagguaaguauacaugauugucucucucugugugaucaucugucuaguuuuuucccaguguaauagacuuaguuuaugcucaggguccaggcuggcaagcaaccacauacaguuccuuuuuccuucuuuuucuuuuccuuuuuucuuuucuuuuucuucuuuuccuuuuucuuuuccuuuuucggauucuuuccagacagauuucucugaguugcucuggcuguccuggaacucacucuguagaccaggcuggccucgaacucagaaaucugccugccucugccucccgagugcugggauuaaaggugugcgccaccacgcucggcacauucuaauuuuaguacagugauaugcguaagcaagcccucauuucucuauaacgguucauuucccaacauuuugaagugagcagguuucugucucacaccaccgugccccucagcuggcaguccccauuguuccucugcacugcugccuuuccuaaagccugucuuauucugcaucaucacccaaugucagcuuaacuaaugugagcagcccccaaaccacaagcuggucucugaaaggaccggauucuaaacagaaagagugccuggagcuugugcagcucugagucagcaugugccccgagugcagcauccucugaguguuuggaugcaauucaacagugcucaucauuucagcaacggggcuaauuuaggcugcucuuggcagcacugggcaagucauugugaaugagaagugcacaguggagagaaacgccuguaaaucacgagucauugcucaugacgucaccugacacuagugaagacaucggagcuucucccuguucucaaacgauuuguaaaucuguaaugcuugguuucccugccccugguauugagucagacagugcagaaagcauggcagauaagcauugccaccuacucuaaaugcaguaaccaaagaaccucagauuuguagggagccuuccagaaucagccucuccuggggcuguuccagagugucucuuccagagauggugagaguucucuuugcccaucugcccuggcugugggcuguccagccaggcugugccugcaguuuuacaaugaucucuaauccuuccuugcuuccuauuccccuccucacccccacuuguuuuuuucagcagucauccacuuccagugguggcguguuugggucuggaaaugcuacaagagggggcgguuucuucaguggccuuggaggaaaacccagccaggaugcugccaacaaaaaccccuucagcucagccggugggggcuuuggaucuacagcugccccaagugaguugagaagaguuuucccagcuccgcgacccacucaugucaaagcuucaaauacaaauacagaagaaacaaauacagaaagggcugaagcuagagagggucuucaccuacacugcucuacuuuugugguuauuguuguuuuaauaaggaguccuccuuaccuaugaaaggacaguagagcuuuggggacagaugagugugacaggcugcuucuguuuucucuccuaaggccacgcucacucuuguuuucuacccugagguuaccugaaggcagugugacagacagcagccaugagccccacccaggcacagggcuucugcucaccugacuccucugacgcugaagugcacuagugugggcucgggccugcauguuucucugauuuaccucugcugccuuuucccccgaagcuggauuuccuagcacguuuuucuccaccugauuucccauguuguguugaucugucuaucacgguuagaaggaaaagaugcuauagacugcugcaguggauggauggcaaguuguauucuugccauccuugccuuaccugcuuccacuuaagugcuguguugagcuguccacauuaaugaguguagugucugcaucucucagcucuuuuccucauauuaaggccuguggcaugaagagcaauguuuucugucucagauuugcucuugugguuguauggaucagggauuuguuguccugaugucucugcucugauaacauguggcaggauugcuuggccaggcacuuccuccuagaucaucaggcugugacaggagggauuuaggaccuacggugaaaggaccucagaaauuguauucucaaaaacuguucugcaggugaacaacagaauccugauaaguaaagcaaaaauagguucauuugaaggcaggggcugagaguccugauguaauggaaaugcuugaccaccuguccuccgggacugaaagacucuguguagcaaaugcuguaaaaccccgguccuuucagaugaaagugagaaaagaacagaugugacacucagcucacauacauguuacaugcuaaacacagcccacggcaucaucacuggucaugcugguuggaaauugagguggaucccagauuguuuuuuuuuuuuuuuaauauuuauuuguuuauuauauguaaguacacuguagcugucuucagacacuccagaagagggagucagaucucauuacggaugguugugagccaccaugugguugcugggauuugaacucgggaccuuuggaagagcagucgagugcucuuacccacugagccaucucaccagcccgaggccguguuauuuaccagccaguuuguuaauggcuuagaugugucauaucccuguaagcauccgucugcaccaguccaucucuggcaccauggcuuuugcucgucagcuggccuucucccagaggucagucugagcuagugugcacuagcccauggaagucgaccuuguacaucccugcccaugcccaauuaugugucugaagucagcugaaaagaguguugaccgagagggagugagcaccccugacuccccucucugugggugguuguuaaacagccuccauaccagacagcugguggucuuaaugguuuuuuaugauuucuuaaguaaagggaucagggucuuauuaaacccuaggaccaaguccaugcaggcuagugagaggcaggagcuggaagagcugagcugcauccuucuccagucugcagugacugccuugcucccuguugacucuggcaucccaugcucacaagcacugcuguucuccugguugaaguccaugaguuuccugcccaccugucacagaggccuucuccauuaccguggucacagccccaccccaugcccaacuuuguuauggucgggaaauccaucucaaaucaaauauucuuaagcugcuuuucuuuugcagcuuaaguucugaugcagaaaucuuuggcagcuuccuaccaaugauaggauagagucugagcucacuucagucuagaugaccaagacagacaaucugagaagacuguaguaggagauggggguaucaugugaugucuguguauacauacauauacauauacauguauauguauguauguauauauaugugugugugugugugucuacacauguccaaggaaaaauguuuuugaaacauugaccauuucuucacggugaagacguuuuaaaaaugcuauuagcuuuaaaaacauaaacuguacacgcacgccauuacccauagcagcuucucccugccuugucauggguguaaacaaauuucaacaaaacgggggcuggagagauggcucagcuguuaaaaagcaccaacugcucuuccagagguccugaguucaauucccagcaaccacaugguggcucacaaccaucuguaaugagaucugacgcccucuucugguguacaugaagauagagaccauguacucauauacauuaaauaaauaaacuuuuaaaaaaaaauuuuuuuuuucaacaaaacauagucauccaaacgcuguaaggacuuagggauuauuccugaccccgccucucuccuccuugggucagagagcaguggcaggacucugcacagcccaagcagcagccagcaugcuggcagcccugugcugggccacacccugcucugacucugagucuuguaguuugacaugagagagaugugaucuggccuuguuguauagacguuuaagcacaggaggcaagcacugguugcccuugguggauggaccaagaccucugggagaccugcaccugagugucggugauuucagacccagcaucugcagcucugcugggcugugccauugcuccuguccagagacucggcugaucugacuccuuucugucuucugagcuucuccuauucaagcucccucacaccuguucuuguucccuuuagauaccucuaaucuguuuggaaacaguggagcuaagacauuuggaggguuuggcagcucauccuucggggaacagaagccugccggcacauucagcucuggcggugggagcguagcaucccaagguuuuggauuuuccacuccaaauaaaacagguaacccgcgagugagccaugcucaucugugugcgugugugaaugacuugugagcuuauagaaggugccccuuuggaggcaacauccuugugugcuuaucucaaggggcugggaucacaguaagaagucacuuuguucuccaguguauuuuuauauuuauugagaaucuacugcauuucuaauacauaagacgugcuuuuaaaaaaagagagagaaacugggcuggagagauggcucagcgguuaagagcacugacuguucuuccagagguccugaauucaauucccagcaaccacaugguggcucacaaccaucuguaacccucuacuaguaugucugaacccaacuacaguguacucauauaaauaaaauaaaucuuugaaaaaaaaauuuuaaaaagaggagagagagagagagaaaccagaugugguggcauacuccuuuaaucccagcucuccagaggcaaaggcaggcagaucucugaguuugaggacauccugaucucaugaaugagacccugucugcaaaaacaaaacaaaacaaaacaaaugucuuuuauaaagaggagauauguaauauagcacuuaaaagaauguaauauucucagaguccgucucacagugcugaaggcucaggcccucgucccugggccgccuuuccaucccaagucauugguuuaggcguuugucugaguguuuucucugagguaguaucucccuguacaagcaaagcugcccugaauucaugauacuuugucucaaccuccuggacacugggaucaugggucugggccacccuuuuuaaucuuuuacuagaaauacacaucuauaaaauuuuaaauaauuuuuauacauuuucauuaaagguccuaaaaggugcauuauuaugaaauguguuauauguuuguuuauuuuaugugugggaauguuugccuucauguguaucugugaaccguguggauccugguguucauggaggucagaacauggagcuggauaccuuggaaauggaguuacagauaguugugagcugcuacaugggugugggaaucgaaccuagguccugaaagagcagccguuguuuuucuuuuuuuaaguuuauuuauuuuauuuuauguauaugaguacacuguagcuauacagaugguugugagccaucaugugguugcugggaauugaauuuaggaccucugcucgcucugggcggccccucuuguucuggcccaaagauuuauuuauuauuauaaauacaccauagcuaucuucagacacaccagaagagggcgucagaucucauuacagaugguugugagccaccaugugguuguaggauuugaacucaggaccuucagaagagcaguuagugcucugaaccgcugagccagcucuccugcuccaugaaacacauuguuaaauucugucaccugccugucugcagucugucacugccugcaaugcuggucuuauuggugggagacuggagugaggguuuugggagggggcaggaugguccucuggaaagggagccgagccucuagcaaucuguccuccucgggagugggcaguacuguuugcccuuggauggauggccuguuuugaauaguucccugccugaggaggugacgcugaucuuggaguggcugacccagauuagaaagugacccugaggugcaguggcuuuuagauucaugcuguguuucuuucuaaaacccuggcuugacaacugaguccuagguuacuaguucuuagcaucuuuuccuuagaauuugguaaaagguacuagaaauaggcauugcaacuucguuugggggcuacauacagaauaauuaaaaaaugaaaaggacacagcuuuuagcucuaauacaaggacaaguuuggagcuggugguacugacagucagcauggccacuuggcaaccuuucuuuuuuuuuuuuucuuuuuucuuuuucaaggcaggguuucucuguauagcacuggcuguccuggaacucacuuuguagaccaggcuggccucgaacucagaaauccgccugccucugccuccccagugcugggauuaaaggugugcaccaccacgcccggcuucuuuuuuuggggaggggggugcaaccuuucuuaaaaaacaaacuggguggcuccugaucaguggccucccacacagcucaugacauguacacaaggaaaucaaauaagcaugaacacuugagaaauguuacauuguuaaccacugagccuuucuaucuuuuuaggcaccugauguuuccuuuacuucuucuguucuggguucugggguguggcucuguguuccacauuguccugguggacuuaaauugagaagcuggugaauguguuuucugucuuagaaaaaauauaccucccaccuagacauuuguuuuccuaauucuggcuuuucuauuuggugagcaucuagaaugaggacugacagggacccaggcaucugagcagacagaggagaaugucugcccugcacucagcuugcccacgcgcucagugagcacuguccugaagguggauugaaggacuuggacagaaggcuggggugcacucagugggaguacgugcgcucaggagccugugaggggaucagucagacuuccagcucaaaggagcagcaucagccccucacuguaaaagcgauuucaggcagagccuuuggaugagccuuugaaaacucgugucuguuccuccucccuucagaaaacacugugucagagcuaacgcuauuggaggccaccacagaagggacaggagacgaaccucaccauggccucacagccagccagcccggggucugcaggcguuucuucgucaguuagaaagcaggacacaugacagggccaugagagguuccaaucccagcucugccaccuacccaugcugcaguuagaugagaagguaaucugagagcuuggcaccacuggaggaagggcccaggccagccaggagagggugggagcugccuugaugcagcugccaccgccccuggaagcccagagacuggagugucuggccagcaaaccugcuucuugguugcucagucagacacucagccugcagcugagcuccugcucucucauuggagggagucgccugaccccagaacuaacaccaaagcagccauucucucauuuagcuacacaccaaguuuguuuugcuuuugcacgugugccugccugucuguuugcuggcucuccugccagcuccucuccagguuaauuucuugggucauaaaaccucucauuuuuuugcucacauuccagcaagaagucuaaacaauauugaauacgaggugcgagauguaaccuuguaugucuaggaagaaagugcaacuagaucuguggucaauuuaaauaauuaaaggacaaugguuuuuuagcacuuuuuuuccauucuguuuauguuuguaagccaccagucuccguagcacagccuggaauuucacucaagguuuuaaaagacagaguaguaacccaaacacgagccacggcaaugucuccucagcugugcagcccugugaacgauagacacagaauucaauugcaaguagcagccgcugcucgccugacugcucucaugcccuacauuugaucuucugaucacgguggcaggagcgggugugaggacgauaaagcagauccgccacuugaacaggagauuugcugucagcaguaaugacccugccucuaaucugagcucagcauacccucacuacccuucucuucugaaccucagaacuagagcaaaucuuggagguuuggggauaccucaggaacagucccaggaggcugccuggugcuggaccugacccaguucuguugucuccgucuugccuguaauggccuagaguccugaucugggcgcuuaggccauccucacagccaucuuaacaccuggucacauuuauacuguagccuucauccaaaaugagagucagugcgcuuuauagucaugccacaagucagggacauuggugauaggcccacagccacuugccuguaaauaaauaaaagguauguggcugggugccagccugcaccacccugcuucuguugugacccaguucauggguucugccagggaaggggcuuugaaccuccgacuuuauuagcuggguuuaguuagucuuuacauauucuuaaaauuucaaucucuuuaaaauauccaucucuuuuaaaaauccaaagucuuuuuaaauuaaaagucucuuaacugugggcaucacuaaaacaguuucuuccuucaagagggaaaauaucagggcacagucacaaucaaaagcaaaaaucaaucuccaaccguccaaugucugggauccaacucacgaucuucugggcuccuccaagggcuugggucacuucuccagccaugcccuuuggacaugaaacuaggagccugcuguguguauuaguaaacaguaaagccugucacccugccacugcugguugagacacuagcuuuggggauggguuucuaugaagagucacagauaucauggggcuagaaagcaaccugcaauggaccugcuguguuuaaggugguuuguucucaacaggacuugagauagguuccaccugccucagggaggcauuagggugcucagaucucuuagugccacagacccucugcuccuagugggaggagccguguggcugagggauugagguugggguauugugcuuuuuggcuucuuguguuggaauuacugacguccucucucccuuucuccucuuuugauuugguuucugacugcuugaugccuucuuuccugucuccuuuucuuucucccuguucuguuugccucuguuuugcucagguggcuucggugcugcuccaguguuuggcagcccuccuacuuuugggggauccccuggguuuggaggggugccagcauucgguucagccccagccuuuacaagcccucugggcucgacgggaggcaaaguguucggagaggguacugcggcugccagcgcaggcggauucggguaagcugcaggugggaccugggaaaaccacaaacuugugccagcccaaagcaccagggccugucauucuuacauucucuaaaccacacagugaccuggcggccuugccuuuaaguagacaaaaaaaguugcuagaugucuuuuucucaggacaaggcacauugugagcagguucuuaaaucauuggccacagcauugcuggcugucagugcacagcaugcaggacaucaauaaccuguucucuggaccagguuuagcugcagccaggucuguuucucaggugguccuuauauuagaaaguccugaagaaagaguuaggauuguuuucuugaggugccaguuggucuuuagcaaacaacuccuagaacauaggacaccaaugggauaacccccacucaagacugcuguucucuuggcugucaacagcugcucuauacacauccuacacacauccucauuagaaaaucccaugacuggggcuagagagauggcucagcaguuaaaagcacugaccaauguuccaggggacucagguucaaauccuagcacccacauggcagcucacaauugucuguagcuccaagaucugauacccucauacagauguacaugcaggcaaaacaacaacauauauaaaauaaaaauuaaauaaagaugaaaauaccaaaaagaagggggaguuucuucuaguggcccuagaauuuuagucucauugccagaaccccaagaaguagccuuugcggcacuguaccgucucaacuaaguauauauauauauguggugaagucuacagagagucccucaucugaaggagagacugaugccuaaaguagacccagacggacucauccucagugcucagcucaggacagggaucugaaggggaagaguaacauggguguuggacaugagccagcagcggcuuuauccugaaaagagaucacauucuuaacaaacucggcuccacagagggaugcuagagcauucaggaagagcaugcaagaggacaggcacgccucagauuucuuguacaggcuaaggaaucuuggucauuuauccuuggggaaacuccaagaacaacaguuaaagagaacuuccagaagggagaguugagaagugcucuaagccuguguuuuacacaguucuggauggacuccaucuguauacacugugaaucuuaagguuuuguuaaguuacuugaaagcagcuguuugcuuuacuagcagagaagucucuugaggguuguaaguguagcucuaugguagggacuuacugggugcccucccauuccuaagugaguccccagcaccacauucacagugcuagcguuucuccacauggguaacaggcaccuauugaggaugcugaagaaguaggguuguagacucugaagcuagcacaggcuacauaggaagacccugugccaaauaguaaugauaaagaauuuaaaauagagcuggggggcuggagaguuggcucagcaguuaagagcauugacugcucuuccagaggcccugaguucaaagcccagcaacaacaugguggcucacaaccaucuguaaugggaucugacacccucuucuggugugucugaggagaucaacaguguacucacauauaugaaaugaauaaauaaaucuuuaaaaaaugaauagaauugggaagauaguucagucaauaaauaccacgaaagcauaaagaccugaguccaauucccagcacccacauaaaaagcugagcaggacagcaugugguugggguucccauacugaggaggcaugucuuggaggcuugccagacacugagucucagccccaggucucagugaaacccugucuguaaaaauaagguggugucaugcagugguggugcaugccuuuaaccccagcacuugggaggcagaggcaggcggaucucuugaguuugaggccagccugauccacagagugaguuccaggacagccagggggcuacacagaggaauccugucucgaaaaacuaaaaaauaaauaaauauauauauauaauaucuaggucacuuaggcugacccacacgcaugggagguuagaggagagaacggaauaucuuaguaaucaugacugacuggcacauuuucuagggcuaguaaaacguaccagcacagacauucaaucucugggaaaacaauugugugccuggucacuggugguagccuaacccugacagagaucucaggucagcccuagaguaggagcacagggacagcuggacaccugggagcagugcagagaggcccugguguaugaggccauggacugccuggcuucccuuuguaacuuaggcauuuagccuauccugucuccuuccaagaaacaccaacuccucucucccugaccucuuggggacccccacugaaccccucaaaaugucuuagguuauaucuucaaccccauuuggucaagcaaaucuggaaggagaacccuugaacgaggauuguucuaggugagguagcaggagagagaaaauuucuccguugcuucguguauuuauugauuuuuaugaaacacaauucugcgugaaauaacuuguaaaguguccccucacacacacacgaaagggaaacaugaugacuuaucuucauaucucauaugcagggggcccuugguaaaccaagucauuaaagcagauaggccaccgauaggcuuaguaaguaaaagcacucaccucaccgugaaagcugcugccucaaaccaugauggaaggaaagaauguauucucuacaguuguccucugaccaccaugacacucugucacacgcaugccagcauccgcacacacaucacacacacguagucuuacuaaaaagugaguggagagcugggcaugcagcucagugggaggcgugcugagcccucaggaagccuuagcuugcacuucgcacuguaaccagguguggugacacacaucccagcaaaggauagaaggaguggaaucaccagacuccacagcacuagcuugugaaaccagcccucaggaggcugaagcaggaggaguauuugaggccagcauaggcaacauagagucgccaaggcagagggggacuggcagggaugaggccacgcagguggugaagagaugagaaugucgcucucagugaggguguccaggaggagagcgggaaguguguuugcucucagggaccuggaguuagucagugcuaaggacucagguccccagguggaucucacacuauguuucugaugucuuccuucucagagccacgguaaaggcuuacucugggcuagaagccgguuuccucugagucuguugacucgguccaagcuugucaccacagcuccugugugguacauccaagacaggugacagugagugaggugugggcagcaugaggacuagggccaugacaacccugucccauucucaccgcacccagguucgggagcagcggcaauacugcauccuucgguacccucgccagucagaacgcacccaccuucggguccuugucccagcagaccucaggcuuugggaccccgagcaguggauucgcuggguuuggaucgggcacaggagguaaacagcuguguucuuuccucccacagaagaauagguguuccuggacacucagcccagggucuuaaaaacugaagugacaaaaaaaaaaaaaacauugguuaaauagacuggcaacauugugccauuucugaaaaauucaaagaaauuacugaguucacuuucuguuagaauuuuagaacuaaucuguacagugcucugcaucuucagagagcaaauauauguguccuguguuguccucacacagagcucagcaaaguugugacuuuuuuuuaacaaauacagaacuggcugcagaggcugacugaugcucagaaccccguguggcaucugagccagaccuaaagugucugccuuucugcucucaaaaggaaaggaaucagauuaauuaucaauaaaagaaaccacuuguguugucccauaagaugaugcagggcagcagugcacagaccguuaccugcagccagagcugaggaccuaaaauagugaggaggggcugacuguacccucagucaccuaguagaauuggguuggggaaggcuugucaggagccaagcaggacagagccugcauagcugagaggcccucagcucucggcucugacauccuccuuucuguguuucagccuucaccuuuggaucaucuaacucguaaguacuugucugcccuguggucugcccucacuuaacucagucaaauggcccagggagggggaagucucggccaugcuggacuugugugaugugcuguuucuguuugcagagccaggcuaaagagccagguuagcagcagguguuggguuuagggcugccggccugcgggaggcugaguaagagaugauuggccuucccggcagcagggcguggagacacuugccucauuucugugguggugucuccagcugccugcuacugaaggcuccaggcccaacucgaggcuuguguguugauccucucugcacuucuugcaggucuguccagggcuucgguggcuggagaagcugagcugaugucagcauucccucaaguuccugugagcuccugugcgcaucccuccacagcaacagacugucaaaagaacuuucucaugaaaacgcucagccaggaagaaacacuggagaccaaagcucagcaaugcuuaacuaacugccuguuccccgcuuucaaauuuuacaucaaguuuuucgucugcuauuaaaguguuuggucugguucugcacagaacaucuggguauuuauuugggucacagccagagacauuccuauggcuugaggaaaccaagccaguggucucugcccaguggcauucugaguagagccccucuacauggaaaagagcagaauguggcagacaccuccccacguuaaugucuaugccacauguucugugguuccaugucaggcuccugugagggccccuuccuucacagccaguucuaagacagguauggcaaacagaccagggaggcagccgcugagcugccugucaccugccacccugucucugcuccugcaugcucugcaucugcugccaguucccagugcagaggcagucugcugaucgucuccauacacagcauuugcagaccuacaaacaccacguccuuccuucacuguuuggaacccacgacuuacggggacaucaacaagucgcugcaggcuuggacagugugcgaauccauuuuagacaugcuucuuucucugggugcguuagcuuugagggccuggcauguucugcuccuugggcuguggaguccugugcuaccaaagccucugcagagaccaucugucaccuuucagguucacaacauggcacugcucuggacugggucaagggcagagggaagagcuguggguugggguuugucauacuggaaagguuuugguuccuuuguuguucagggguuguucuuguuuuugagacagggcuucccuguguagcuggcuguccuggaacuugcucuguagaccaggcuggccuugaacucagagaacugccuaccucugucuccugagugcugggauuaaaggcaugcccacuaccaccuugcuaagaugcuguuuuguaaugcuuuaaggucauggugcagucagugugacugugguccuauuggcuuuugugucccccaugccacagcuugcucaggugugcccuuaugucucagccuuggccucagacagggaguucaagccuccauccauccuuauucaggggaagaacaugaccaucagggaugggcgcucccccagaguguucaguggcuucuuaucaucucaagaggaaucugcccugcuggguuccuaaccagccaucaccagagccaagacaagaccuagaauuaggcacaggguccacccggacugucacccauucucugugccacagagacuugucugcaugcuucacucauuaggggcucugccucuucugaggagcuggagccuugagagccucaguguggccuccuuuugguccuuugggaauugaagagccaggcaccgcuugaggccccucugcccggaagcaggucugucucuccguaugcuuggaacuuugccgaccaggucucucagaccaagggaucgccaggcuucuuuuugugucagggucucacucugcagcccuggcuggcuucaaacucucugauccacccuuuccgauauauaucaagugcugggaagaaaggcacuugcuccaggcuuucuggguuugauggggaacauucauggaugaggacuauaacuggguaaagagagggaagagcccguuuuguuaccugaagaggaagacugagauuaaaaauggaaaugaaggaguuagugaacug

SEQ ID NO: 12066 - RNA, 129647 nt, Mus musculus
auguugccaauucucuccauguuuauuuaaauauuugcucuaaaggaagcaauuauuccuuuauacuucuuuaaauuuaguauugacauuuuuuauuuugggaaaggaggucuuuuuuuuuuaaacauggauacaggaaaagaaaacucuccaauaaaaauauugucuaaaaaguuuguuuuguuugcaugauuuacuaaauauguacaauuucaauucacagcgaagguaacaaagauuuaaacagccaacaucacaaaugucucaaguucuaaaaaaaaaaaaaaguucacugugcacaguuugacaauuuaauugaauaaaaaccaaagcuaagccuucaguaugaaucuuuuucgugaugggcacaagccauguaguuucuucaucuuuguuucacgaugcauauucagugacuaaaagccccuucccauuuuaguauauuagguuaugucaguauacugaagagaggcuuuacagccucuuuguucaccaauaugauuuguaauguguucacauauauauuguaguauuuauuaauauauaaaaugaucacacgagucaucugugacuuuuuaauguuuuaaaauguaggaauguuuuucuauauguauaacauuuuaaauuuauaguuacguaugugagccauaauaauuuaucaguguuccuuugauguaaaguauguagaaagaacuauucugcuuuugaaauauagagaugucucauccuuaucugcuucagguccuuaaaguuugcuauuauaugaaucuaaacacugcaguccuucugauguaaugaucaagugagugaaauaacuauucaucguuagaaacaaaugccacugaauacaaaaucauuguguuucaguuaagaagggagccauagcuuuggcuaccuuauaacaucuacaauaacauugcuuucacauauauuuucccccacguaaauucuuugguguuucccccucuuuuaguauuaguucugugagugaugagcaugcaaaugcgagacucaaauaauuguauugagcauauuuauuugaauaauugccccauugcacaugaaauaaaucugcugaguguguuuguuuggauguuuuuacauguacacgggaacacauacucaaauaaaugcagcuguguuuauuacaaugugcgggggcuucagagcacacacacuuguuugugugcauauccagggcucacagccuggcauggccacacauccuggagcaaaaaaacauggcuaacaauuuuuuauuucaaauauauauauauguauauauauaaacuuauuauuggggaauaucuucaaauuuaugacuaaauuuugauguuguuaaggcuuauguccuuagaagauaaaaaauaacauuuuaaaguuaucugauugugaaaaguaucuaauaaauuuauuaauaccuauucaaauauagucccuucucuccuuccuccuucaggcccucccacuccacugcaagcucaaguucaugcuaagggagaugaacgcuguuaguucuggcugagaaaucucaucucucuugcccaguuucucagaacuaagccuacagugucaugugcaaaaaagaaagaaccucccagaucugcuagaauacaaaaggcucuugagaaaaugggcgggguguucaguuccaggauuucaucaccuuuucccagccccuauccucagggguaaaggguaauacuuaagacuagaacaagggaagaguauucgauaagaaaaggagauuaugugucaugauuuggagggcuuucuuguuuaugaccuuggaaaggaauccuaggauaaguccaauguuuuagucuucccuggaguuggaagauuaugcagcucuaaugugcaauacuauuaguggcuaaauugcauuuuuaaaaaggaaagaaaccuuaagauauaggacauuguagugauugucacaauuuacaaguguuaaccugauccuugcagacucagguauucugagccuuccugugaaaaguaauuuguaaaaacaaugguggaaagagggauuucaggaggggagggagacucugugcuccccuuugcuccuucucaugcaugcuuucuucuuucuggggagaaagaguauguugcucauguguucuuuguugguccugucucuuguggguagggacacagauaugccccaugggcagcagagaccuacauugcuuuaaaggaggccacagggauuuauucuacccagacaaaauuuaauggcuugauauuuucagguugaauuaauaaagauaucgccuagagccuuuaaaaucgggaaaauuucuauguaguguauuuauuugugccauugaaagaaggagaaauagggaaagaaugcuguaaacuuuccaaacaugcaaacucugguauagcgaugacaggagcagaaugcuuuaugccaucucuccuaaugccaguccucaccaggcuugaagauagagcugaaaauaugcuuucuacaaguaucugcucaauugccucuguauagucauuacaucuuuucucucucuuggggcauguaugugugugugugugugugugugugugugugugugucauuucaaggaacaauguuuaugaaauuuaggaaaauggcuaaauaauaaaaauauguuuuucuugccaacuugaggugucacacuuaaaguuuuagcaaauucaauagcaaaaucaugcuuuuguuuuuugauucuaaaguagaaaaaauauguggacagcuacuauauuauaguuacguauauucaagagcuguaaauuucauaagguaaucugcuuuuguauuauuauucugacuuuguuauuagauuuaggaauuagaaucugguuucugauaaaaaaaaucauuguguaaaaaccuaugaauacauucauauacugacuauuagggucgucuuguaaaaacugaaagacugucuuggaaaaugaagguuauuuuuguuagcaugugccuuuagcuuuguuuucccacccaccccccauuuuauaaucuuagauaaaggauaagcuacagucugcauuucaaaaagugagauaaauuaucccaacucuuagaaaaaaaguuacauauuauaaauaacauugaauaauagcugucuuuuugaaauuagacuuuucugaauaaaucacaaagaccccuuggacagaaaagugaguuuuuaacacauaaucucuaaauacuuguaaugcaaaaguagaaaugucuguaaaguaaauagacuaaauuugaauaauauaaccucacauaaaaaauacacaaucuggaaucaggaucaguugagaaaagcuguaaaauugcuguacauaaguauggaauuuuaaaaaacaguuauugguaccagucaaaauuauugcuaaacuaaaauuauauugaaaaacauaauuagcauuauuauaagcauaagcauguuacauguuaauggucauugaaggaaagcucucuaaaaguacagaacucauuaacuacauucuuaguuuggcuacauuuuuauucgagcauggucauuuucaaaagaaauuacaaauugaaaauucaauaauacuuuuacaaagacaauucaggaaagauuuuugucaugguaucauacauuguauuuaacagucccucuugagguuagcuaaaaaacaagaugaagaaaguggaauuuucagucgaaaauacaguguuuucacaagauuguaucaaaaguuuccaaauuuggaaucuccaguaauuggaaaaacaaaaacaaaaauaaaauaauaaaauugaaaaaucccaucucacaauuaauguuccaaaacacaauaaaugcucuucucuuuacguaaaauuugcccaaaugaucaacgucauguuccuuuuuuacuaaaauauaucuauauauugaagaacuauaauacuguacacuacaguaugaaauaaauaaaauuaggaaauauaaaaugagccacauaaauaaaauguuauuugaccuaaaauuaaaugaaugcaaaaaaaaauuuuuuuuuguugcaaaaaaaguuugguguaauacugacaaaauuaaugaacaaaaaaguacagaaaauaauugcacaaacauauguaaacuaaggaacugcugccuagucgucuaauacugacacgggugcuucaaagaacacggugagcuuaacacugaagcuggugcaaagguaacccucguuacccucugaacacuguacaaggauggcacuugcagagacacagauuaaaagguuugcauaaggcuuuuaaaaccaccuuacaaaggcuuucuuuacuucucaucuuacuuuuuccuucacauccaggucacuuuaagacuucgguaucuuaaauucacacaugcaucacuucaaguuccuucacagaaaaaaauaaaaaauaaaaaauugaggccuaaaagugugugguuacuuaggcuguaaaacaaugggaaauucaugaauagcgaaaggaaaguguugaggaaucguaauacugaugcacuguagugcgggcacauuaaauuaaacaggaauaacaauaauaauaauaauaaaauacugauguaugguagugcgggcaccuuuuaaaauguauuaauauaaauuagacauaauuuuuuuuaaguuuguagugauacauacguagagugcaauucuuagaauuuucuaguugugcuuaaaguauaaaugcuauuaaacacaggaauuagucucugaaccacacaguuuuuaggccuuaacacuguacaaaauuuuugcauaaugcaguuuuuuuuuuuuuaaacaauauccaacuccaucuaacucugucuuggcugaacugccccuucugucccucucuacagcuuccuggaagcgucaggcacgugcaugaacagcuuaacacagcaguguuuucaagcagguaacaauacuacuggaaaaaaaaaauaggaagcuuaaaaugcaguaguuuauuccaugccaucuuccauauugucuuccucguggucugauuugguuuccauuuucccauccucugaacugucguccaucgagugauccccagucucuuccucaucccguaucguuucgggauccguauccauacuuuuauuuucacuuucuuccucuuccuccucuuccuccucgucgccgucccuucuccgcagcuucccauaacccuccucgcccuccuucucgugcuccuucucgcucucgccaucccucggcaugcucucccucuccuccgagucagaguaccccugaggggugaugcucugcagguaagcccgguucaucagcagcucgguggguuccaagugcccuuucucucgcgccucgcgcucggcugcuucccgcuccuccgccucccgcuugcaguaggaguaccugugauucaugugcugcgaguaggagcccgagugugagaagcgcuugccacauuugucacacugauagggcuucucgcccgagugcagccucgagugcucgauaaggugguguuuguguuugaacgcuuucuuacaaaucugacacugguguggucucuuuccugggagaaagaacaagacgacagggugauuaguggcuuggcaugaagucucuuuccaagaauucugucaucgugucccgacucaggcaugagcaugucugcuuaugucugaaagaucgacacacuucggucuaacccaagucgguuaggaagguccauuuucaucucauaaucugguuuucuaccgauuacuaacgaaugugauugguuaaccagauggcugcugaaggggaacucaaaauggaggcuuugucacugucucaaacggaaaaacguccugggaaacaagacauuuuuaguggccuacaacauuuuaccgccagacaauucuucucauccuuacgguguuuuguuuuguuuuguuuugucuuguuuuguuuuguuuuguuuuguuuuaaggcaagaacuugagugagagcaauagaaaugguaucaucacugguuuuguaugguccaucaugagcuagcugcuuugaaagugggccuagucucaaacaggagcaaacugcuacguuaugaaagaacagacuggaggcaagaagaugcuaagagugucugaucagucauuggauucuaagaguaaaacuuagggaagaaaccaucugaaaugcaaacuagaaagauguguuucauaggaucugaacuagcugcaaaugguguuucccccccccccuccccgcuagaguuuuccaugggaugccagccacuuguugcguguuaaaauacuccugagcuagagaaccuagcgcuuccuuucccauuccaggcaguuucuaaccaguguuuggaacuugaaaccacugccaagccuaaacacaucugguugauuccaggccacaaauagcacuggaaugccuucaacaccuuuuggagcugucauacuuaaaacuuuauuuccaaaauagaacugacaaauagagagauagaucagccugaugcgccagaguuaaaaaucaauguguggcgcggagcaugagguaucaucauaucguacaugaagcuaggugauucuacuuccccuacaaacuccuguuucagcaaauuaaauuaaaacaccggcauuaguagaggccaaccccguuuucauuugcuaagugucauguuauaagauuaggaacccauucuggacacuucagguuuucaguuauagggugauauacaaucccaauuaguaaucaaauaucuuuaauaauguuauugaaugccuccagggcauugccacuacuuagaaaacgcugcagacaguuugagcugcuauuucauugaugguugucauuuuacuggaacauccgauauaaauuaguggugagugauaggggaaggcacaauauuuuaguaggaaguuuuugcuuuguuuugcuuuuuaucuguaagauaagaauucaaacauaaauuguggguacucaccaaaugggaaaugcagacagaauuauauuaaccuacuucaaguuagcuaauaggcugaagauaacaaguuuaauuuaaggcauggaagaaccagucuuuaaguuugggaaaagaugcuuucuaugagggaaacuggacaacagaauauucugguagagugguaggaaucuggaaauacacaguacuuuuuuucauuuggguagguaacaauaggagucacaagaguauaugaaaagaacuuaggaguguauuauucuuucuuuaaccuuucaggaaauguucaagcugcuacaguauaguguuggucuuccuuguuuggaagugcacauuuaaaaugaugauguuucagggagaaggguacagcauugauagcaauuguuccaugggggcagaauggugcucaauaagggugaugagcucuggacucacauugaaauccauuuuuaggacaggcuggaguacguacagucuuggguaugucaacugcuucuagguucagggucuuugcagauaaaggaaaguaauuuggggacuuagccugaggacaggccauagauagaauaauggagacaggauuuauaaaguguuuaguacaaggacuuuguagugagcagccuauuaggguuaaaucucucaacucuuguccauuaauacagguucaaccaucuacuauauucuaagcaaaaugcauacaucagggaguaggcauacaugcaagaaguaaaucugaauggagaaaaauuagacaugaaaauuuucuuguuucuuuaguuguuaaaagaugcaugaacaacacuaucccgugauaucuuuuuuaugcugcugucuuaucagcucaggaucaaagguggucaaccaguuaggucacuuuguggagagaauauaugaauacagguuuuauuuuuccaaaauuguagaaugagagcagcaucuggacugaaaacaucuauucuccaagacaaacuuccagaucuuuuagaaugcaugggagguggguccuauaaggacaggcagccagcuuucaaaggauguauuggguaauagacacuguacuuguaauagggcuacauuauauaucacagacaacuuuggaggauaaaguacugugauacccugcaaaggacaacucagugagucacugagaguuccacacaacucuuauacuaaauagucuaguaaucuugaggacuuucacuaacaaguacuuaauaaauucaauuuaaaauaagggcuaauuuuaauuuugccauauaacuuaggaacaacauugaccagaaauuuauuuaaaauuuagauuuugucuacuucaaaguagaaauaucuuuauuucuuuucaaaauaaggugguuugaaagcaccuaccacagugucucaacagagaaaguaaccaaucgauaucagguugaaauuuuaguggaguaaaaaugaguccuugacagugccuaccaagagguucagaucuuuuauuucagucauuauuuaugacaauuauuccaauugaaguuaacauuuacaaaguauuucuuucucuguacuauccaggguaucucccucccccccaccaaaaccgagcaaacaagcaagcaauaagccauugguaagagaauuaagcaguaugacuuugguaucugccuagaaaauaaauuuaaaguagauuacggcaaaagagcacaaacucccaggaauaaauagacacuaauuuucuucuuaauuuaaacaguucuauagacagauaacaaacauacuuuaucaaugacacauuuauaaucaacauauaauaaccaaaugacagaucaacuucauugcccagcuuuagagucaagacaguucucucuuagaauauucauauuaacucauuuaaaauauuauuagauauuaauauaagcaaaaggcuuguggagcgcaguuagaagaaagcaagcuaaguuuacauauacaucauacugacacauuucaugaagacuuuugcuuggauggaaccuaauacaaugacaauauuaaugucaugagauguuuggucaagagaccaaaaaguuaacagacuggaaacucuacaagcugggucaccaacaggaggauaacuaaucaccaguuuagagaagccauugaaugacucgcauccuguugcuaggcaaugugucuagguagcagaucucucaucuuaaaggaccaagauauuuuacuuuuaaaauaacgugcuuuuauuaaaaaaaauaaauauauauauacauuugcauuugucaacuuuugggucucucaacuagcuggacaucuaugaaguuuauggacuagcuuauuuauaggagauaaauaugcugacuggaugucacuauguaugagagcccucacuaaaauaaaaguuuuacacucaccauguaguaaaugauagaguuugcauauggucauauaauaagaccaaucagagagggaaagaugccuucagugaugugccuauuguagcugaauaaugaaauacaaaauauauuugagguugauuaaaauuaaaguaaauuuaggcaugaaaauauuuguuacucuguaaauacuuaaauaagacucaguauuaaaggaaguauaauaaaugaacaggguaggaaaaaaaugauguuucaaauauauagcuuaaguauaaaaauuguguagauuugcaaaccaauuugggguguuuuaacauuaauuggccuuuuaaaauaauaaccacagauauuaugguuggagggaaaggagcugaacugguuggaccaggagcaaggcuguuacaaccuggguucucuucacaaagugcucucagcacuagcgguccagcaugggccacuuucgcccagcgcucagcuugauucuggucacaugugcuaccuccaacccauggcuagugaaggaucugggaagauuuggaguacccgaguuucccaagguaucuuuaagauguacccuaucugcagagaguuaagaucuaacaccuccucuucucuuccacaccacaugcaucaaugcuaacuuuugcccuuguuuaaaauaaaagguuucccuacacuuuguccauccugcucccauuuacaauauuuugaauaugacucuauacuuucuuuuccccaccacagacaaauucauauuucuaauggagaagacuuggacagggauuagggacaggguaagacuagguuucuuuguuuagagcagaagaugggaaggagaaaggaaacguugauggaaacccuacuacagagcugcagaucugauccggaguuguggaaaguaucuuuacacgguacacuuuuaggaaacguaacauaccaccuguagucccagggagcccuggggcuguugucuugucaggguuggugauuaauagauaacacaugaacuggauauauuacuuuagucuuucaguuauaggauucacuggcuuauuuggucucuugccuuucuuuuauggaaauaacauuuauaacugguucaaaaguggccaauuuaugaaaaccaaagaaagucaccccaaagcauggcuuacuuaguguuuggaugaguccacuaguauaucacggaccagauuuaucauaauaauuuuuacacauauauauauucaccacagcuuaagaauuugaagauacuuucaaaaaugagcucuugucaugccauuucauuacccugggcuuuuaaauuuuccuuugacaugauaggcaaauuuguuuuacagauaacuugaaaguuaagaagacaagcacacucauaaacacaugaaugauccaauaaacaggcaacacaaaaguccuacugaguuaugcaaaaguauuacuucuuucuuguugaaggugucagcauaugcuacaucuuaugucgcacaagugcacucauuaaauauuaugaaauauacagcaggccggagagcucuagcuagcuagucaaagucgcucauaccuguguguucguauuuaugucgcagaagggaacugcuuuucuggaaugucuugucacauaagucacaugcauacaugccacuuucugucuucuuuaucuucuuucgagacagacaggaaucggagucugucaugucaucuaggccugacauguagucuugugcuccauccagcaagucucccugugauauaaucacauaguugaacauggucucuccucuuuguguuuacaucaaacaauuaagcauaggcugacaacuagagauccucaaaaaugcuagaugccaaucuaucuuauaacuaaaaucuucucauuuuuuuuuccuaaacaacauggaaguuucacuuuucaacaaaacauaaaccuucucugccauagaugggaaaacaguuuucuuaaaucuuucacuuuuuuuuaauaccagagaaaacccaagagugaacauuaaauaucaggauuaccauauuuuccaguguacuuuacuucaaaaaugauugguagcuguagaagcuucauuuuaauugaauuuuauauuuagguacaaaauauuauuauuauacaaucuauuuaaauguaugucuaccaacuaaaagccuuaagcuauauuuuuauauuuaauuuucuaauuugaaauagagaauauuaauaacacuuuuuaucaauguucuaucuauguuaaaacagccuucagcauugagcaauaaugaauguggaucaguaaauuauuaaauuucuugauauuuauuuuugucuugguccaaaggagugcaaacuugcaugguaacauacauuuccauuugcuagcccacaguuuaguuuucuuacacuauauuugcacuaauuaauacuagagaagauuaaauaggcuuaaaugcauuuacaaagagggcagauguguuguaaauuggaauacuggacagcuguuacagccgugcacugccacuuuggcuccuauuuugcaaacagggauuauacaaaauaaugccaaaacaaugccugcuuucagauucuaccaccuacaaauucuuugaccauuugaaaauuaggcaagaaguccuauguaacauguaaaauauuucuuuaaauucucuucaaaaugaacucuucuuuauaaaacaaaauagauaucaaaauuuaaauauguaauuccuucaagucguacacuccuuucugagaguguggcuguuacacacuucaguuucaagcaugucgguaagcugaccaacuacuagcaucgaugcguaauucucagaauucuuuauucuguuuuguuuguuuuggagaccggauccugcuaugcugccuaaccuuaaacuagcaaucuucuugccuuaguuuuuaauaagcuuauccuuucagccacuggcuuagcuagcuugcuucaaagcucucauauuccugguuuccccaccccaacugaguguuuuucccccaccuuuuguaucuucuaggucauuuaucaauuuauuuaggacugggcagccugggaaucacaacuagguuauccuaugugccuuuccucagagcaaagugacucaucucauuaccugaaauccuuguuuccucugguauuuccuccuuugcugcauaucagcaaagguagcugcucccguuggguagguauaggccauaugcgguaggaagcucaucugauccaguccuggguauggucguagcccggggaugcuggucuggacugguggcaugaaaguggcagggggaaaugcgcucugugguggaagagggguguauaaaggcuuggcacuaaauggguucaugccgaacacaggguuguugcuuuuauuguccagguuauuagaauuugaaaacucuuucuugauaaaagucaaauucagaggcucaucugaauucucagacgaugaagaaacacuguuguggucuaaguuuaugcuaguagcuuuuguuuuguucuuuguggcuauaauaccuuuggguucucucauuuguuuugguaaugacagguccaacggcucagccugcagcuccucggaagagaagcuauuuggaguguacgagcuacugugggaguuuuuagaagauguggaggaaagauuuaaaggagaaggaguauuacuccucgagugguccaguuuaucaacugcuuuaauauuggugaaaugggaagauuuuguuagccugagaggaggaucacaacucguaacacuguuguggaguucugcuauagauggcgaugugauggaguccauagguuuuacaggagaccuggguaacaaagagucuuuuguggugggguuacuguugggagcuaacggcuuggagguccuuuccagugauggugaccuggaauucgaauacugguagacuuuucuuugcucaaaccauuccuucacaaauuccugaggaaggcccacagcaauggagauuuucagcaguucaucagaguugggcuccauguucauagcauaguaugcuuucaguacagacaugugguccuuguauggguugauggggcuugucaguccuuucucggaaaguacagaugacaagaggagggcuuuauuaucaacaaaaacuccagcuuuguuggggacuauguuuucaugagguugcaggacugccuugaucucuucauucaucuuacacagguaucguucaugcugaugcaggggaauagggcccgggaagcuuucuuuacagaacuggcaugaaaauggaguggauaugcugugguucucaaucauuuuaucaucagugaccaaaucuaucaaaguacgcaacuucucuuucuuuauguuacugaucugucuccuugagucgguggucaagcucuggaggcaagcuuuggcuucauugacuuucucuaagguauagucaauaauacuuuuaguggcaccguuaugacucacuacuggaagaccgacagggggaauauugggagaaguuaccccuuguucuucuggcugagaacauggauccuucaugugauaaccuuucaacuuugaaaugucuuccgucuugcaguccaucuuuugccuagaaaccguauuguccacaaucuguagaaccuuuuguaccucacucaaguuacuauucauagugggaaauccaaguaaaggggcuuccaucccuacaccuaagugcugcauuggacucugagcagauggguguacaccuaaagggcugguggcuccaagcccaccguucauaaagggacugcugccacuaaacccauguguugccauaagaacuuuauagucauugaagucuagugguucuguuuuaaucuuaaguaagccugucugcucagacaugcuaagugguuuuccauuuuccaacuuguuccuuaacugaguaauggcugaguuaguaggagaagaagaaacagaauuaggggaagaacccgucuugauauuguuucucauucggccauuuacugauauuaaaccaauacauuucuugcugcugauaugugaacuguaggacccagaaugagagaagcguuucuugcaguuugggcauucguaagguuuuucaccugaaaggauaauuaaaauuagcauuagauuucuucauuuagguaacaugcaaaguugucugccaagauaagaaucugugaaaccaaaugaaauuaaucuaggugucgaauguagguggacucuacauucuagaugcuuacgucagaguuauaugaccauaacuaucucuggauuuuaucuacccccaguggacauaauucaagauguaagcuguggaagguaaaggcucucuacgccuuuuucaguuagaaucccaaaucuugucaggccaucagcagccuccuauuuaaacagagugucagauuaauguguggucaauagcacaauaaagaugucacaguauuuaaagggaaguguagccauggcuuuaaucaacucuguggagaccccauugauucuaccaauucaacuaguucuuugaauagcauccaauuugguaauaaaaugcuuggcagagcuaucaaacuauguauaaagcagaaaucucagcgguaggauguggguuuaugauguauagcuaucaggagucaagaaaugguuagcauaugcaaguuccuguccaauuuucucccacuuuuucuuguaaguuuagguaucaaaaaaaaaaugaauaucuuucugaaauugcagcccaaauaucuccaggucaaaguuauacgguuuuguaaaagucucuagauuuagcagaaaacacaaaucaaagcccuugugaauuguaagaaggauaagcauuuauaggauaccauaagacucuccaagacuccuagagcuuaugaaauaaagggguaagcccacaacacuccacccgggacuguguacacugaaaaggucuccacaaucuucucuaguaggaaagaaugcaaugcagcgaccccccugugacucaccacugugaauucucagguguucuuucagguggugcuuguacuugaaggccuugccacacuccgugcacuugaacuugcgguuaccugcuccuuggguuagcauuuggugcuguaaaaggagaaaaauggccgucaucuuuguucaggaggcacaaaggagcuugcuuaggaaucuuucccaagaccucuuuuuuagacaggcugagaggucugaguucaugcuuauuuaucuggucagacuuucagaguugcaauaaaagugguaaugcugguaauaaaaugggaauuuuucucuuuuaagaaagugcuucccgugcacgucggacccuugcuucacaauuacgccugacaucuuuuuucuacagcauuucuuugacccuugagaugagaaguaugauuguagagaugcucauggcuccuuuugguuuagugcagaaucugaacccuaaaggcuuccuuucaaaacacggcuggcuugaggaggaaaaaaauacuuuccugaaaauuauaaaauuguucuuuucuuuuaacccacacuuaaaacaaauuuuugugaaguuuucuguuuccagguaaaaguguaaacuaaaucaaacugaaauuuaaagaaauggagaccucuccccacccccaaauaaaagacaaaaucaaaaaaaaaaaaaacccuuugacuauaaauauuugguaugccuguuuaaauaucccauucacugugcuacuggcccauguuaacuguguuuuucuuaggugcugccuaucagauuugauucauuaucaaauaagagacaacaucuuggguuaugucugcuugaacagcuuuaucacaagucaguaggaaagacuucaaugacauuucauuuuccguuuuaguagugugcaagaaccaacagaaaaaaaaaaguuugcugaaaagacaaguuagaggcagcacagauaccauccaacaccgcugaccuuuuugaacaagggggaaacgcagugugacuugaaauucuaagggggaaaaaaaaaaacaacaacccaacagucauccacucuggaugcucaagguaggaggccagccuuuuucugcagcaaugacacaaaagccuuuugcaaaaagacagcccagaaacggugugacaacugcuagggugugcugaaucuucccacauuccuagugagacagaugguguuacaugggacacagggagguuuguucaaacagcagcaaccuucaaagaucaagcggagcccaacccgccgagcgccauugagggaccagugcucauauguugccgaguugcauaaacaaacagcaacagcugcuuugucucccccacagcccucagaggacuacuauaaacuuuaguugugccacuguuaauaugauacaaucauuuuaauuuacuaauuguaaaugccaugagcaaaugaggggacuuuucaacaccaaagcuaccauucauaaugcgccaacacaaucacacuucugcaugugaaauuuaaagcaguuauacuagauaaauaucuaggcuuuuuuuuuuuccuagaguuuuuuugugcauagaagcaugagaagauaaacuguuacaaaaguguaacugcacaagcguauuacuuauagcugaucuuuggaaaacauucaacucacaaguccaaucagaaacaaauggugugauaaugugauauagugccuuaaauaguaaaaauuuguaacacaguauugccauucuugcuuaauugaguuugugucuucuuuuccuuauucaaagacaauaaggccuaugaggacaaaucggaguuuuauagagaaugucauauuuaaccaucucaaaaauauauaauaucaaaguucauuuaggggcaauucuguaucuguaggaccaguuauugugacuuaugaaacaccauuacugugaccacccaacacaucauaauaucaauuugcacagucaauucucccaggaggauagaaagagcaguuuugcugaaacauuuaagagaugcugugaauuagcccuacucagucauuucaaggauuuaagacccuauuccuaccuuuccaagccagaguucuuauuuuuaaaacaaguaggcuaaaagaggcagaacaauuuuggcauuuaacuacaagcauguauauugagauggagucauuuuaauuauaaccaauguuuuuuaucauuuaucacuuuuccaauuuauuauguguauaugcauauaacuuauauggccuuucuaucuccuuaaaaacauauuucauaaauuaguaagcuuguaaaguauucuaaguaauuuaaaaguguuucgugacaaaugagagaaauaugcacuucuuuugcuauguauuagguccuauauaaaaaaaaaugccuaagcaaaacuaggugaaaaauggaauuaaaauugcugagauguuuaauaauguauaauuaaaaugcuacaauuucauucacuuuuuguggaacauaaaaaugaaacuaaagucaaguuaaagugcaaauaaaauuucuaaauuagaaauuaacacacucauucgaucgugaacauaagacuauuaaaucauauuagaagagaccaucaaaaaaucauuuagaccucaauuaaagcuauuaccauuaaaagaucugcaucuucaaaaugccaugaaaaauuaauaaugauugccaaucaaagcaauaucguuucucuaagggguuauuauagaaagaaaucacuuagaaccaacccccaccugaucugucccuggcuugugcgucaccauaugccucucgagcugggugcgguaggcgaacguguagcuacaaagagggcaggaaaaguucucuucauucuucucguggcgguacuugaugugcuccuucagcgaugucaagcgcuuguagccgcggucgcaguaggggcaggucagcaguugggcaaaagcaucuggaguuccagguggcaggucuguagccgagaggcgaggggagaggagcgggccaaaaggucaguaaaucaauggcagcuaaugggcuggcugcccgggcugcuaugacaggaaucgcugcaaucugcuccugcacagcgccaucauugcgccccggccuccucacaaccagaccccuugaacacccagggcaggcuuguccgaaucagcucacacugcgcucgaaaauuaauuaauuacuugagcuuauuuguggggagggggaauuuaaacagcugauaaaugaagaaauucccuuugggugacugacagucccccugaacccuagacucacauguaacucaggaauucacaggagggaaggagauuuuuuuuuucaggugucagagaacaaaaggugagggucggugaucuuaaacuuuuuuuuuuccucaaaaguaaaauaucucugaaagauuggaauacauuuagauauuuuuaucucuuagaaaugggcuguaauuguucuuauucuguauuggauguacaaaugacacaaauuugcugacaaaaaaaaauuucacaauacccuaaaauuacaguucuaaucuuugcucaugaaauuccaugccucugcagcuguucuucaaauuuuaagguaaacacccaggcauguagugcauuuguaauucuaacagcugcagaggucaguaucgcggcuaaaaaugaauuacagccuuaccauuuucuucuugcccguuggccucuggcgugccaaggcgagacagcuccucaggggcuucuggguaaauaauggccgugucgcuucgcugaagguacucuucgaugcucacugcguggccaucucuuuccuccaguuuucuuuuggcaaaguauuccucaaagucugaugugcaauuugcauucuuaacugaaaucauaagcaagagagaaaggucuuuucagggucuucuuccuaggugaccaagucugcuagaucauuguugguagcaaagguuggcuuguuacuaguaagacuuaaaguagcucauuagucagaagagaagaugaccaaacacugauuaaaugcuuguuuuuacaauacagguaaaagagcuuacuuuuuuuaaguaggcaaauuugguuuuuaaaauguccgucuguauaauucauguacaaaugaaagaaaauuuaaauuguauuuguuaaaaaauguuaaaaucgaauuaaaaaaaauuuccuaaacauggccuaacauaacauugcagauacuuuaauggucuauauuaaacuucuuuuuugucuuaagaaaagugcauuuagcuuuuagugacagggaaaccuugaccaucuccucugaggaguagauaguguaggccucuccagcccuuccacaagcccuugaauacaauguucugaaacacacaaaaaaaggaaauuuaauuuucuugagaagccagacuaaacuucaccucccucucuaccgaugcaucugcugcuaaauaaaagcuuuugcuauguuuuucuaagagaguaaagucugcagagucugagacagaugugaauggagggagagacaccuaucucuacaagcacaagugugacuuggcuaacaacucacauucucucucuuucucucacugcaauguugauccuugcucagaauuguauaguuaaaauaaaacuaagcucauaacugauaaaaaauaaaauauaaaguaauggagccccacugauaaaacagcagcaugauuucuauaugauguuagcuucuuaaguugcgauuauuuuuaugaaauaauugucguggaccaauuccaacaaucugugucacaagacaugauguacuuaaaaucucuagauacaucucugaaauuuguuauggcuuacauaucccaaauaaaagauuauacauaauguaggacugaaagaguaacuguuaguuccucuuuaugggugcuggggaaagggccuugcacagugccuggccgacucacgcuacuguggcuugaaagcagugcccucugaugccacuagaucuuuaccauauuuucuuugcuacaagaagcaugcaggguuuccuauaagaaauauccuuggcaaguuuaugaugugauaauguucaagcaaguuagugaauuuucuuuuucuuccccauuuuuccuuugguucacacuauuauaaacuuguggauuuuagauaagaagauuagaaaaaaaaucgaagcucccacuuguuuaacaugugaugauugaaagccuaaacagcaagucuuauuuuccuaagugaagaccaacgcuaaccuuauccuucaggaaaccaccagagagagagagagagagagagagagagagagagagagagagagagggagagagagagaggggaagauaggggaagaaagaaagaaagaaagaaagaaagaaagaaagaaaggaaggaagaaagaaagaaagagagaaagagagagaggggaagauaggggaagaaagaaagaaagaaagaaagaaagaaagaaagagagagagaaagaaagaaagagagaaagagagagagagaaagaaagaaagaaagaaaggaagaaagaaagaaagaaagaaagaaaagaguaauucaaaugacagaaucucaaaaauaaacugauugcuuccgauuugacuggguauuauggugguggugcucuacuguggcauaaacaaagguaacacaggaaucaaaugagcucuaaagauuaggaaaacuuuaaugaggaaaacuuggaauuaacguacucucaaagcaggagcagcaguguguacacaggugacuaggaacagggacaucuugguaucuaacuuggagugcagagugaaagaaaaaaauauauaggauguuggggaacagaucgcagaagugggaacauggaggggaaauuucccuccuaaggucuuucauuuuuauuuuaggaccaagaagaagggggaagaggagagagaggaggaagaggaggaagaaaaagaaggaggagaaggaggagaaggaggaggaggaggaggaggaggaggaggaggaggaggaggagaaggagaaggagaaggagaaggagaaggagaaggagaaggagaaggagaaggagaaggagaaggagaaggagaagaagaagaagaagaagaagaagaagaagaagaagaagaagaagaagaagaagaagaagcagcagcagcuagcaaaggauauuaagcaaaaaugacacuuuuacagaaugaaaacacuuguacuuuuuaaugaugacucugacuauaguaugacagggacagaagaaaaggaaggguagguucugcucagaguuggcugaggguacagugggauugggacuggggacauguucaucuccaaaaucccugaagagacaaagauuaaggaagcggugguagagacggaaaaaaguugcuggaauugagagagauuuacaaaguaaaaucucuuaagacuuggggaaagauccagcuugcccgaguggcaugcugaagugucuucuguaucuguagcuuucagucugauaaauggcuagugauauuugccaacgcagagaaaacuagaauucuaaagaguugaaaucauguacaaacauuagaucaaacagaagaacaaucaggagaauuuucuuuauauuucauggaccaccaaacuaggugguaacaauucugcauguuguaaccucaagucuuuuccuuugcucucuccaccuucugcuaaguuuaacaaggauagcugucuaauuccaagguuuccuuuuagaaagaguuuggaauguaagguacuagaugaauacauuuuuaccuugaacuuucgcuuauaucuguucuuaguuggauuuacuagccaucaguuaggaucaugacucagcugcucgguucacaaggccauaggagcuuucaaaggauaaugauaacaucacugaacuugcuccauugcuccauugacuccuuagggagugugugggaacuaccagcuuacagaaacuauuugcccguuuuggggcucauuaaaauagucuuaccaaauauuauuauuauuauuaugcuuuuaaugauaggagaaggcaaggaacaaaauguaaaauaaaugguuuuauuuaguuuugguuuuucauuuuuguaagaggguuucucuguguaguccuggcuggccuggaacucacucuauagacugggcuggccuugaacucagagguccgccuaacucuggcuccagagugcugggauuaaagguguguaccaauaccacccagcuaaagugaauguuuuaaaacaauaugacuaacuuuaacaguggcugacaucuuuuuuugugcuaugacaacugaaaguaauguuacagcucccuucugaacacauaccuauuagaauauucuaaaaaauuuauucgaggcuuuucagaauauugucccacuugaugaccuuaguguaacccaguaaaaguggauggauguacauuuaauauccuaauuuuaucuugauauuucagcaacuauuugaauuaucuggcuaucuuugcaugaauuuucauuugcauaugaauguuuccaucagaaauguaaucaaaugcaaauucaauuggauuugcauuaauagucuuugggcuuaaaagggagaaaaauucugauuuuucuggauaggcaaacuaaacuacaucuagauacacuucugguguuuggcaagggaauuugauuacuagaucagacuucgccaugcuagauuucugugugaacugaagugaggggagggcgaaagggcuucaagucacauguucuguuuaaggaucaucuguggucaccuguggauccugaacacugaguauauugccguggaaugaguaguuuuggaagaaacauugaggagguggauguggaaaauaaugugccuuuaacacuauguuuccaucaaaacaaaacaagguuaucugaugguuaagcgagggauuuagaguuuuguucaauugucaguucagguaauaagacaacgcgacagagugguucaugguauucauaaaugcuuacacaaguuagacauggcuucagugaguauccaaaaggggcuucaugaggaaaugucauuuaaucauuuaagucuauuggcuucauuagggcuuuccaucauucaugugggcgcggaucugcuaucgaucaucuaugcacagccacuuagagugagcuaacauacaaacuuaaaugagccaucauauccaccaugaaaagcaauguaaguuucucuuuguuuuuuuuuuuuuuuuuuuuuuagaauuuuccuuugccuagaucuagcucuucauguccacacuaccaagcauuacaguacccaaguaagugcuauguccagugugaucccccucccauuuucccaguugcauaccugcacuugaaacaagccuaaucauuaauuuguccaggacaggccaagagacaaugcaagcccauggaucccuucccuaugauuuuaggacuuaguuccaaaaugagcauccgggcucaggguucccccacugccaggugacuacagcaguaagaugcagagugaagggacugauauuuuccauuuaggaguggaggguuuggggggaagcuggggaagguagacaagaugguccccagccacacauccagcuguguguucugaggcugggcuacaucuucuagugacuguacucucaccucuccuuauauaugacgccccagaaacuuccuuuucuacucucaacugcgccauguuccagucucugaaaaccaaaacccuucuugcuuguaguacuggagcaagggauaagggugcauuuugguuaccucuguuggcaaggaugaaauuuugauuguauuuggaaguuuguauauuuguuuucccaaagauuuuauaguacaguguaguggacacaggacugagguggagagcuugcuaagaaguuacagaauuccccgcuguguuuuucuaguauaaaaucaaccucauuuuuguuccuucuauaauccucuucacucccuggcugccuuggaaggacugccaaaacacacugacagaggauauuugcaugguauuuaucaucaaaccauaacaaaaaauucacaagaaaccucaaguaauuucuucccauaucuucuccggggauuuugcauuuacuccuaaaauuuacccuaacgucgugcaaauaucucaaccuucccugagguuaguuaaacuuuucuccauccaaaaagagaauguuaauuaaaaauguuuccucauggcuauauguguuuuaauauugguagauaaauuucuagaucccuucaagucaucaaaggcucucuuuucuuuuaaauauguuagucagucuuacuagucgugcuuauuaaugauacuuucauaaauaccuuuaagacugucuugggaaaauauugacuuuuuuuuuuuuaagguagauaacgaauguuagucuaaacugacuuuuaaaguaauuguccuaaaaacaagcagggucagcagaaaaggaccacugacuggcucaggaaucagucaguucccauaauugaguugcuuagaacauguucucaauaacaccacuaaaagugauuuuuacuuauacuuuacaggccgucgaguuuauaaugugaccccgaagcugauucuuuuuucuuuuuuucuuguuuccuuuugccauuuauuuucuguauuuagaacaagaaagcagcuucucuguuaccacuaauuuaaaaucuggcauguuuucaauuuucauuaaaaacugaagagauauauuuuaauauuauuacuaagccacuuuggcaaacauuaacauaaauaaguaagucuuuuggaaaaaaaucuagcuuuuauucacauugcuaugucaaggcaaagggaagagaagcaguagucacgugucaagcauaaccgucuucacccuugggaaaaaacaacaccuuuaauacuaguugaugaaaagaagacagagcaauauuuaauuuuacauugauuuuuuuuaguuuaaagaagcuuaugcaaagguauaugaauuuucacuacucuguauaaaguuggcuaauaauuaaguaucaccauacauauauuggcaaaaauggggaaggggaugaucuuuuucucaaggcacagacacacagcagcuucucagagccuccgacugguacagaggcauguaucaggccagagaagggucgucaagagcaacagagaaguuucuucucuugcagagaauuagacaucuugguggucucuccaccccugcucuuauauggccuuuucugagggggcauguucaaauaccagugagagauucaugcuaaaugaaugggaggugggaauuuguagcagucugcaagaucaaauauuucucuccacagcaggaaguagcccaguccaggaugccaucuaauuuuaaaguuugauuuuguaugagaggauugugaacaucaagacccagaggcuuacaguaaccuuugaaugacuuugcugugcggcaguacaaaaugaugcagcguauugacuuuuaauucccuagcuaaacaagauguguucaucuuucccuuaaccauguaaucuaacuaucuggaauuagcauugcugucuuuaggacagugacuuugcucagcaguucauacuuucuuuucauagaaagccauaaaacagccaguguuugccuuggauagucauugguuuucaagguuugguuugcauaucgguggugucaauauacuugggaacuuauuugaaaugcaaguucucagggcccacuacagaaucagcagucuguguuuuaacaggccauagagaaaaucuugucugacuuaagaaucucuacugguaggacucucuuuucugucucauacugcacacagcuugguucugaguaauuucacgggaucacuucacaucgggcugccuccugagcacuuaagucugaguuugcacucuucugcuuugcuugcuggcuaccaucugcacaugugaacccuugaaugguucauagcacauuucaucuuucucuuccacauauaugaacugucagaggugugggccaugugucuccaguacuuacugggaagucuagaacacaucuaguucuggauaauugaaagauaauaucaaacucagagccugggacuccccauuuggaccacuuauuuuggguuugguucguaauuuucucaccugugaaaugaacuaacauguaccuccuuggguauccuuaaaguaaccacaauccauacuuugaauuaauugccauaaucaauuuguugucuauucccuagguaagucuagagaguuucaucuguauucuuuucaauuaaaaagucaaaauaacacagauuucuggugggagaaccacacacagcgauuaagaaaaaauauuuuggagaugccuggaaaccacaggcggcaucgcaaggagaacagugcuuauuaaauauuuguugaaaugagugaaggaggcaugcaagaagaggcuaggaguggucguuauuucuugugggaacucuugcugugcaguagagauggcugcuccuaauugcagaugaagcuaauaaaaccccagcacuaaugagccaggaagugaaggcacucuuccaggugcacaccugugauggguuaucccugacaauuccuguccguccuguccagcgcuccuucuccucucaacuuuuuuuuuuuuugucauugauuuuuuuuaaaauaggagauuuacuuuaaacacacacacacacacacacacacacacacacacacacacacaccccaaacucaugauuuguaugacagauguauggcugaauuguaugaauuguauggcugaaugacaaaaucuccccagccuugaaaaacaggacagagucaaacuagagacuugcuucacaguaaguagcaagauaguagaguaguguguguccuccuuuugggaacuuggguacuaacugaauucuccacuccuguauguuugcuaauacgucacagucucucaucuuaugcugggagauaccugauguucaaacuugcauggccuccaaccuuaaaaaaaaugcuaaaaagaaaacuucaaaccuuuaauuaagauccauuguaggagaacuaagaggauguuggggcugcuaaaccacaaagaaaauaagccuuaucuuaacccagucagaggagucaaacuacuguguuguuggcucagaugagauuuccacuguuggucuggauuauuauugaggguucauuugcuaugagaacacuggucuuguuauuuuauggacugaacuguuauuuuagggggaguauaaaucccuuauaugauucuguaguauucauccuacaguuacacucugcuguuugcguucugugaaaugacaucaagagaugaauuguagggcugggagcggggaggggugggauaugaaacuuguagaguaccuuguuuguaguucuuaaaaugaucaagaaugaaaagccaaagacagggcagcuuagggaccaauuacaaggcgagguucacugcguagggagagcagaagagagcagggcccuuacaggacuuccauucccauguaucaugacaguuuuuauuuucuuaaauuguguuucccaaggcaauuucaugaggagaaaggaugagaauugggaagcccaaaauuucuagccuaauuuucucauuuaagaagcugaugcccccaagauguagugaggcuaacgauucacacaguuacaaaagaaguuucuagaagaccuggagccagacaucacguuucuggacuccuggcccauugcucuuucaacuacaucacagugauucaacauaagagagagacuccaucucuguaguugcuguuuaucaugcuugauuuaauaacauuugaaaaggaccuagaugcugaaaaagaucacaaggacaugaauaauucuaaaugccacauuauuacacuauaaaguuaguauuaaaaaagccaauuaaaaugccagcuuuaguggcauaugauauuaaaugacuccucuuuaugucuguagauuuauuuuguaaauuaaaauuuacuuauuugcugaaagugucccuacuugcauaaaucuuauaucuuuucauucuuuccuugcccugccccucuuuccuuuuucuucuguuucuaugguuauccagauugaguaacugcaugucaucauggcuaacuuugguugguugucaacaugacacacaugggaagaagaaaucucaguugaaggauugauugccuucaucagguugaucugcgggcauguuuguggggcauuuacuaaaucacuaacuccuguuaggauggcccagcccaccaugggcagcaccauccccagacaagagagcuugggcuguauuaagaaagcaaguugaauaugagccugaaaccaagcuggcaaacaacauuccucuguugguuuaugcuucaagcuccugccuugguugccuuggcuucucucagugauggacuaugaccuguaagccaaacaaauaucucuccuccaacuugcuuuuaguuguguugcguaucauagcaacagaaaccaaaccaggauaaugggguaaaagaagaauuuuuucagauucuguccuagagaugcuuaaccuuucuauuuaauauauaaggacuguauuuucccuauuucaguauuucuuauuuuuaaucaaguuuuaaauguacucaauaaauuauagcucuuggaagcaucuugcaaagauacauuauuaugaacgauuauuuuaauagucugagugcauaguaaagaaaauaugucuuaaacugaauauagaguaagagaccaaaaaggaacuucauucacgcuucguuuugcuuucuuauuucacaaacuacuuguuuucccccccacaugcuuaaugacauccuccuacacgagcuccacuucuucggauuaaaugaaauugugucagcccucgguaaucccccaucccucauaggcuucucccucagagcccugccugcuugcaucuuucuugaaacacagagcaaaaaggcugggucaaacuacuucuuaauucacacugcugauccaaaucacuguucccuguuuuacaagcucauucaucauuaauucauucucuaacucaagauaugaccugcuuaucaaccaccagcacuacauaaaguacugcgcauguugaggggacuauggagaaaaacaaacuuaguaucuacccucagagucuccacucuauaaaguuucugaagcauuuuguuuguuucuuucagacagaaccuugugcucauuguguagcacaggcuggccucagacucaccauccuuuggcucgcaaaugcuaguuagagaaguguucugccaugccuggcuauaacuauaauguuccgaagucuaaaguuaucuuucuaugcagcauguuuuagugcacuaucuauauagaucaaguaaaaugacuuauguccuaggacuaaauuuuguccaggcugcccuuggcuaaaagguaguaguccuuccaggcaaguuaguguacaccuuuaaucccagcacucaagaggcagaaguacucagaucucugugaguucaaggucaguccguucuacacagugaguuccaggagagccagagccacauauugagacccugcucaaaaaaaucaaacuaacaaacaagccaacaaacagguaguaaguaguuggugccuaauuguccccucagucuugguacuucccuaagcuccaggcaguucaaucugucggaaccagaaccaggaacaugcgugcucucaucccccauccucaucauugaguuccucauuccuuaagcaggcacuucacugauaaccaggcgcagacagaucccccgucugcucugggcacuugccuuaguucaccuugaaaugugucuuuucauucuuacuccacucuuaccuuagcacacuaagagguauuccuguccuaucuaugugucuaauacaguaccaaacauauggaaagagacuuaaauauuuauaugcuuaaucucaggcuauguuuucaaaacagaauauucuuucuugaugacugacuguauacgcuguccagagcaauuacucuccauuucuacuugagauuucauccauacuccuacuuauuugcuaguaacugaagcucuuuuuuuuuccuguucacuucaagaguauaagcuauaugagagaguuccccgguacaccuuaaauuugguuaauucguuucaaguaucauuuuuucucucagaucacacuacugagacaaaaacaacugcuaccacuguugccaucgugcucuuuuaagagccuccucagccuccucucguuuguguguccagccuuuccauuauucucuuugcacacaggcaugcucaugaagcuguucuccugaagaacuugccuggaaaucuucaggcauccgucuauggcucuagcucuaacauaugaucccgguucucugucaagaaacucugcaguauacacuuugccuuuggaccuacguagcuugcuguacuugaaaugaaacaauguaacacauacguacauuacuagcaguaaaaauuauaacacugguuagcaaugaauaaauaucagucaauguuguguuaaauauuuggcacauauuucucaucccugugccuuuucuuuuacuugucugauugcucugugcucauagcugaacaaaauacuucuacacuuaguagggucucaauaaaugaugacuggcuugcagagcuaaugaagaaacaauuauuuauuugcaaauguugucuuucuguuauuaugacuugaccuccccauugcccuauaaaauuuuauguuucuuaagggcacauauuaaauauuccauuucuuuaaaguuugcccucccucaagcaucgguuuaaauucugucugcuuaagaugaauacugaaagaaaagaguguuuguuuauugauggcuauccaagcugaagaaaaaaaaaugaauccugaugguaaucaguuaugaaauaacaaagaaauauuugacagcuuuaucauuauuauauaugaauaauauuaaaccuuccucuucuauaauuaauuuaaggaugcuaguuaaagaugaggugaggagacucacuggguagaugcggguaguuucuaggagccuuccaaacuugcuuucauuacuugagccucaaaugcuacagcagaacaaugggcagagauguucaaauugaugugggauguucuaggacaucaaagguuuucaaaauugucucgucaauggcugcagaucuggcucagucaguaaagugcuuaucaugcaagcagggaccugaguuugauccccagaaccuguguaaaaaugcuggguuggccaggccugaccgcacaccuuugaucccaguccuggugaagauaaggcaagugcaucucuaugaguuaaagaucagccuacuaagucuuguugaaaauuccccacuuccgccuaugacaaacuuuuuuuaaaaaucacuucauggcuuuaugacuacacggcuacaguuugauuuucccaagacaucauggugguacaacaugacccaacuucuuucuucuuaugcuuucuuuauauucucuaacaguugucuucgguuuauaacuuuauuucgcauaaauucccuuuaauuuauaucuuuugcccauuaucuucuacuuagauacuauguuuucucuuuaccuuauauauuccacuucuuccuuccagacuacugaaaauguacuuaguucaaauucaacuuccuucauaaaaccuagacagauucccacucugcaggaucuugucaaucucuguaauucaaauaauuaugacuccucccauuugauuuaucacauauuuucacuuacuguuuaucaucuuuucauguaaauugggcaucucucccaaauuaaauaauaauuaugacuuagucuuccuggccaucaucuccgucacaugcacacaacagggacuauauugaaaacacucaaugacuauguauugauuucuuuauugacugcaugcauaugaagucuaagaaucacugaguauuaggagacaggggaucuuaaagccuggugaaaggguguucaaaauugauuugcaaaccuccuggaccugaguacuuuuuguuaaccucauguuagacucagguauauacaauggaugcuaaauugucacuuuaucacacugucagugaucaggaaggaaaugaaaucagcuuuuaugaaugcuugcuugaagcugagacauuuuucuucaagggaaccugaggccaucuugaagcucacaaacugggagguuuuggagaguccuuaauuuaggguacauuguuauauuuuaaacaaaaccauuucgcuuuuguuucuauuuuuauagaaacaguaucccagcaacauagaauauuaaaacuagaagcauucugagcagucagcuagcucaacauaugcauuuuacagauauagaaacugaguucccaagagacuaauugauuugccuaagguuguaaucuagguauuguugaagcugcaucuagaaauuagaauuaucagugcucuaguccacaguuucucuaagcccauaugguuguauacuuuuaguuuuguacucaauuugacauuacucaaaugaguaagucaggaguuuuuagaaaauuguuucacuuacuuuauacccaagacagugaacccauaucucuuaaguaguuaauaaacauauuuauagacagcaugaacaguauauuaugaugcauauugacuuaagggaaaugugaaugucaucuuaauuaaauauacuucugaagccauuuuaaagugcacacuuuuuucauuggcacgcugaauggagacaguuaugugauuuuuguucuugucuuauuuuagggaaugacuuuguauuggggacugugcuaacauuuguaaugguguuacaaugguguggaggauuguuugaaacaugaagguagugccauacagaaaaggauacacacagagugaaucuaugucaccuugugcugugagaagagaugcuguuugggggcgaacauggaaugccacccuuaaccagccacagcagagccaaggaaaacacugccuacuguguccugagugguuauucaucaguuuuauuuaauucuuguuuaaaagucugucugagaaauauuacuugauaccucuaguagacgcagagauuuaaaagugaagagagaaucugagagaaguuaagugauaaaauuuuuuaaggaauuuauggaaauguggauuugggaaagguacuuuucaauuuguacuucaucauaucacuugaauucucaaugacagauaucaaguaguagcuaaggccagcauauuauauuaugauauaaaaauuauguuuaaaguaaaagcuaaaacuagaaagccauacaaaucaugcuguaagaauguccauucauaaaacucaaaauucccgagcuauagaggugaguuaggguauaagaauggaagacaaaguugcuuaauaaaauaagagauauggcaaauucaaaauugaaacaaaacuagaccugugaagucuaacuucuuguuaaucauggaggugcaaauggaugugucuguguuuuaucagauucaggaaaaccacaugacacagaacaaacaugauguugcuaugugaacguaacuuaccuguaccauuguuaauuguggucuggaucguggcuucuggccccauugcaucauaaucuuccuucauuucuucugugggggaaaauuaucuuuagcauuugaaaauuacagaaaggcuuacuauucuaagcaugccaaacauaggaacaaggaggagucuuugaagggaaacagugaggcuuguuguaaaacucuaaacaaaagcuuuguucaggcaucugaaugaauucaacagugcaggcugcacaagaacuuauuuacuuuaagcguuacugcaagcugugaaaaacagaggugcuuauuugaagcaaacgaagggcuuuucuucugguggcaguucuagugacaaacaggggggagauguuauuuuuuucaauaagauugagucaaaagugacgaaguauuugaacuuaugaagagacacaguagcugcugucucugggugcuucauggcaagccagaauaucucauuuugcuuucauguucuuucugcuugguauagcuaugauggaguuaguauaggcugguauccuuuuaagaaaacccccaauucugcugggcagugguaguguacgccuuuaaucccagcacuugggaggcagaggcaggcagauuucugaguucgaggccagccuggucuauagaguaaguucuaggacagccagggcuacacagagaaacccugucucgaaaaagaaaaaaagaaaagaaaaucccaauucugcauaucauaacuuggaauacuuagauuuuacaaacuaacaucucagauguauuaaaaauaaccauugacuguuuuacauaaauuucuaaagucuauuucucauaccuccccauuucuauaaauagcuuuuuguuuugagcauuuaugccuccacaggcaaucauauucauuuccugaugaaaaaauagagagaaaacaguagcucaauguuuuaauuaagaugaaaauauguaauguugaagguggaaauucaugaaugauuaagggccauuuuugaaaaugguaauacucucaaauaagggagaaaaaugggaauuuucucuguguacuauauuauagaguaugugggaaggcagagcaaggcagccugccaguuaaaaauauuucaaauaaacaaacauaacauggacucucagaaacuguagcuguacaguacaauacuaaugagagcagaccaugauccgaggcgaggauuucuguacuguaauccuuuuacuuagaacaccaggaacugugagucgaacucuuucucagauguauccugaucauuuuuuuguuuaucacauaauacacugcugugguugguggaaaaacaguggcuagaaaacguuauagcaaaauugaaucuaucuguauauagaaucaaagcugaaagagcacauuccuaucagauacacacacacacacacacacacacacacacacacacacagagagagagagagagagagagagagagagagagagagaguaauguaaugccauuuucaaaacagucacauaauuuuaauaauauuuauuuagacugugcacccacuucaaauuaacuccugaccuuaggcaccuccuuuauuccaggaauauuuucacagggauauuuugcaugaaacauuuggaaguucaauacacaggaacgguguguugucaaauguaauagucaauguuuugggaagcucuuuuugguauuuuuauugguccccaaaagaaacaaaauagguaugucugcauucaguacuagauauaaauauagccucugggccucucgcccucacaccucucucucacaugacuuccgguaaccaagagucacaagaaucauaagauuuccaucugagagaacacugagucaccgaagggaaaacgguuaacagcuauuuuuauuuauuuauauuuuacuucuuuaaauaauggugguaguauuggcuauuucugcuggacauccuuccucauagucauuuucuuauaaaaagguaagagaaguuacaauaguuggcuguuucccaaauucauaaaugucauuugcacagccgaauaguaggcccuuugugcauugucuagcuauaacccgcuuuucccaaagauugcacacuguuuagagauguuggugccacuuuuaccugcaaugucuuuaccccagcugacuugcugagcccggccauuuuuguuuuggaauauuaagcucauucuaguuagaugagucacugagccuucucagguguuaggguccaugugaauccauauccaagaggacauaaugauagcacuuuaggaaugccuccccucaauuccuggcaagccucacuggccgccuuccucaugcuuaaccuuuuucaagacaccucugacucagcauuacggugucuaaaaccacauaguauauuuauuuuucaaacacuuguaaaaguuugcacuuuccagucacccuuggggcuaaagggugcauuuguaaaaauaaagaacacuuccuucuguaggaugaagaauccuugaauaagcagaaagaggcugagaugcaggugacuuauuuaagucuguguccaugauaaugaugucaugguuuccagcacacuguguccaccccauugugggacgaaagaaugucaaggacagcuccaaacacaaaacuuugauugugcuaggaccggaaaggcacaguaagaacucugccucacucuucagugcaaaaaccugcauccugcagacaaacuacagagcgaggggagaaagagcaaaggagaggagcuuaucucaggggaaagcuaugugccgagguaggacugcagacagccaggcaccggggagaaaacacuccuaaauaaaacacaccagaauuagaguuauugucuauaguguguguuuugaacaauaaauaagaaaaauauuuuaucagaagaaaaauguguuaucuacaagucaggauaaacaaugaggagcuuuuuaagacuaauuucuuuucauuagacaucuaggcaccacaucagagcgcuuuuagaacaauaauaaaaaagagaacaguaaaucaucacuaaucaucagaacgagacagguaauagcugggucacuuucuuguccuaaagagauuaggauuuacauuuuauuucauuauuuggacuccagaaugcuuguuuauuuacuauaaagguaagagcauuuacaucacugucuccauuaacuccaggugacagcaggcuguguaagggauucguauggaucauuguacauugagaugcuugagauuaugauccaugaccaacacacaaaaaaacugcuacagucacaaacuacuauagccugacagugcuguuuuggcuguuucucgacuaucggcuucuuucuuucuuucuuucuuucuuucuuucuuucuuucuuucuuucuuucuuucuuucuaucuuucuuucuuucuuucuuucuuccuuucuuccuuucuuucccccucucucuuucucucucucuuucucucucucuuucuuucucucucucuuucuuucuuuuuuuaauuaaacuuuuuaaaaagaaguuugaggcuguacauuuauuauauuguuauuaauuauuccuuuaagggugaaaauucugguaauugguccuuacccuugauuucuggauauuaaaauuuaaagcauccgaacauuuguucuuauagcccugcauaucuaguucauuaacaaauaugaauagcuaacaccagcucauuuaaauaguaugucuuacaugaguucucgccacacucuguuucugucacacugcucccaagaaucauuggcucuuauuauacauguaaauggcuaucauaaaaauaaaaauuucauuuaagauuguuaaugacuucugcagcagucagacuuccuuuaaugaucauccucugccccuaauuaaacguauuuaucuuucaagcaucuuuggcugaguucucccucauaguugaaaaucuaaaaccuuaagucuuaauggauguaacgauaaauguuuaugugugggauugcugagauucgagaaaccuucaccgaaagcaaaauuggaaacagaaagaauaccaaacuuggcacgguguauuagggaaaugagaaacaaauacaccacagucaaacugccauuagucuuccccuacacacacacacgcacacgcacacgcacacgcacaugcacacgcacgcacauacauacacacgcgcgagcgcgcacacacacacacacacacuuaauuuucuuuaccaguagaccugauuuuauuauccuucccacacagcaaacaauugcucugcuucuguacaguguuugcuagccugcaacaccacaauaacagagagguaaaguuaaacucugucuggcccgcuacacacauuaaucaaucaaacaaacaaacaaacacacacacacacacacacacaaacaguaguuauuuauauugucaacgcaaaaccaaggugggcuacauaacgguaauucuuauuaggucauagaauagaggugaaggagacacaaagucugaauuagaggggacuuuuaaaaaacuucucacaggccacuuaagcuucagaggcaggcccuuggauuuucguuagcaugcccugucuuccacuccaggggaauuucaggcucaggcauuuccauuugugcagugacaucggaaguuucagauugaaacugaucuguuuuacuucuauuacaguuggcacuggaccggucuuuuuguuuguuuguuugguuggguuuuuuuuuuuguuuguuuuguuuuguuuuguuuuguuuuuuaacuucccuuaagaugaccaucaaacaguaagaaucauuaucgaguacuuaacuguuaaauaguaagaaagcuaccugaccagguaaaacugugaaaucacauucacacuuaacaaaaaaagaaugauuagauggaauuacaauagaauuaaaaggaauuccaauagaaggugucagacaugaaguacaccgaacugacaguuuuaugugguuugaaauaacacaauucccacacaaaacacacgugcaugcuugcacgcgcgcacacacacacacacacagagggggggggggaagagagagagagagagagagagagagagagagagagagagagaagccuuuguauuucuuuauacuuucugucaugagaguagagaucuugauugcguucuguaauguuucacauugaaaauguacaaguacuucauguuuuguguuuguuacacuagaguugauauccaacuuggguugaaaccaauacacaaucauuuccuaaaauccgaguacuguacgugaugugaccacauugcuaucacuucaucaucugccaacagcucugcucucuacuccagaagggcgauggaaagaacuauuugaaugauguggcugcagguguucugcugggaagcacaggugacaugcagguggcccaggaaggggccacacaguggcggacagacagacacuuaccuggaccggcuacagaggcuugcagaaucucgccacugugccagcugugcuccacaacacucucccuuagcuccuccucuucuuccucucuugguagcagcccuuggcucauguguggggaggacucaugguugggcaugcuagcugggcugguguccugguccagaggguuugcaaggcuaucaucuucagcaaugugaagcuuguccucuucaucugucuccgagccugcguccacuacguugucauaguucaccacugugggaagagaugcacaggcacauucaaaaugcugcuuugaaaauaccaaugcccccacauauucaggugaauagaaaauaauuaauauuuucguaacugaauuacucaaccaugucaggaaaacaugaucaauauccccaauguauagcauuuguauucuuauuucuauuauagcuguguacucuuuuuauuuucaauauuuugcugaaaacgauggaaaauuuuaaagguaacagagguacacaugcuuaaauucugcuuauauugcacacauaauaagacauagugcaguuuggacuuuccacacuucacaaaaacuuauaaaauagaucuacaguugacaguuuuauuagcucagugacaugacguguuuacuauauaagguuguacuauaaauacaagaugacuucaguaauuuaacuguaguuuuguuccuagaaacaguucucucucucucucucucucucucucucucucucucucucuuucucuccaucuauuugcccaauacacagacacauacacaaaccaguacaaucugaaaugcucagucuuucuucuauuucaaccgucaugagcuaaggucauuuauguccucaucuuuuaagcagaaaaugaggaaaagccauaucuucugggccauuaauacuacuauugagaugucuucauagugucauaauuacagaagauuucaaagugacacgggcaagaccaacacaaaugcuaaaauaauucacaagagcgggcgggcugcuucugcagccugcagucccuacaacgcucaguagcuuuucuuaaaauagacagccuguaaauaaggucugugaacucaauugaagguggcuguuucugaauuagucagcccucacaggcucucggccuacaugcuaguacauaaauuguccacuuuaccaccagacaagaaagauuagaguaauaaacacggggcauuagcucagcuagagaaacacaccagccguuacgcacacacaggauugccaagaacuguuaacccaacucuccagaaacacacacacacacacacacacacacacacacacacacacacacacaaaaacaagucagaaccaugacaucaugggaacaagagggagagagaaagagagagggagagagagacggggaggggggggaggcaguggaaaaaaagcgcaaacaauuuucagguucauuuugauuucucugagccuaauaaagcaauccugcgcuaaguuaucaacugagcuaucucaaguggcucucgccagcuaucggauuauacaaaaguggcggaaaaggagggaaaaaaaaugaaaaggauugugugucagguucauaaugcuuuuggcgaauucuggaaacaugucuaguuacaaauuuuagucagucauaucuguuugcuuugacagguucccagggaguaaaaaaggaacaaaaagagagagauuuuuuuuuugucaugugaggcuggggacaaaaagauuacaccgugcauaucugcucauaauaugaucuuuguauaauccgcgggucugcacuugccuuccgaacaacugcacaacaggugcaaauuaaaaugaaaacggcaguagagccgggcaaacagaaucugcugaccugguuugaauaccaauugacgggggaaacaaaaccuuuucaagaggugugaccacaagggcuuaggcaaguucaggcugggcaaugcucucagaucuacaaaaagagagauauuccaacgucucugcucuagcuguguggcccacauauaccuuaggacaaucaauaaugugccgcucuuuuuucccccuggugacugagauuuaaccauuucuuagcaacgagcagaagauucuuuacaaauuuucugaacacugaguggggguagaguguguguagggggguuggggggggggcguguuccaacaaaagcuccgaaggccugggaagcuuucaauccaccuccuaaaaacugaucucugggcacaggaggaauaaagaaagguccagaaggagugaauaaaauuaucuaaggcuggacaggcauuaaaaggccuuuauccugcaaaaccccccaggccuuuuaagguccuuuucugcaugggcuacaauaucccaugugacgugugaguguuccugcagcaauacaauugaaauauuuucugcacagagagagagagagagagagagagagagagagagagagagagagagagagagagagaugauuuaugaacagcccuuaaggagucccaaauaucagaacaaucuaaacaagcaaugaagucaugucucaccauauagggucaggagcgcagcauccaucaccuucacaggccaacaaagcugcacaaccuuuaggguuuccacucacaaauacuaguaaauacuuuuaaacuaaauaaauaacugcugucaaguccacuuacagaagcaguacgccaucuuuuccagggcugggcaaaguaggauagucaugcccauaagccauuguguuaccccccuccucuuuuuugguuaauccagguaaaguaauucauagcaaacuuaguucuuacuuuagaauuuaaaugagauucuuucuuucuguucuuuuggauugaugcaccgaugauuacaauuaaagucacugauugcacccaggcucuccaucuuauccccucuuuugaguucuuagauuuuucccucaaguuagauuuuuuuuucucagagaaaguuugggaacaauuuucaucaaauacaaaacaaaacaaaacaaaacaaaacaaaacaaaacaaaauaaaacgaaacuuuuuuuccuauagaaaggcuaguauaugguggacuuagccccacuucuauuaaaccuuaucuauaaauaagagcuuuaauuuuauauaauaacuaacaauauauuuucuaaccauauacaucuuuuuaaagacaaaguuucacuauguagccuuggcuggccuggaguuuacuauguagacaagguugaucuugaacucacagagaucugccugccuaugucuucuuagauuaaaggcauuuacugaaauaacuaguccagguuuugaaugaaggacacugggcagaauauauuaaagaguaccuguuuguugaacuuacacugcaaacuauuuuaaaaacuuaagcauguagaucuuuccauagacuuuagaaaagucugguugguuauuguauggggucauauauaucacccugagcauaaacaaaacaauuuucuacauguuuugaugcuacaugcuagcacaaaacaauuacuucaaaagacacaaagaagugggaguccaaagaauuccucucugcaauucaaugaacaagaaggaagauguacuguuugcuggcucaaaauagacacuaauuuuacaucugucucugaggcacagcaaaaagccaacuaaagagcaguaauaaauguccaaaaacagcaucaguauccaaaacucucacaguaaucuucagaggaauuaauuacaauucugugaaacugucgcauuggcaaaauucgcucauaauuauauacagguacuguacaguauuauagggagguuugccaugugauaccauguuuacaugauaauugauggauaagacaaaacuauuugcauaugaagugcaugugaauuauuggcauggcuuacuauuuuauguagaaucauauuaaaguuucauuugcucuagaacuguaugugugaugugggguuaccaaaggguauaaagaugaugcuuaaauuugcuuuauagcaaacagucucggaaagauguaucugaauacgcauuacuaaaaaccuguauuuaaaagguugcauaguugaucuauaauaagcauuauuuucaccuugccagauucuauuaaauccucucucuccuuucucccaaguacacaguacucuaaauuguaucaacgugacaauuaauuuuauagucauaagcaaaauaaguaauggcuucucuuuauuuuucacagcuauaacuuuuauuuucagaguuuuguauuccugugacauguaaaagaacaguagcaaaaugugacauuuuuauaaugucuauaccugcuggaaaauuucaacauuugcaaaaauggccuauuauagcauuuaaacauugcugauaauuagcuugacauuugaaacagcaggacuauuguuuugaagaugcccuauacaauguuaccuaacuaaccccuucuccuacuuagauucuuucucuccauuauucugucaguuacaguacaaauaagguaucaguagcuaauguauuaacauucgaaagaacugaugagaagggacaguacuucaucuacagcaggagcagaaguuuuauugauguaaaggaaaauuacauaugcacauuauagacagcuaauuguuaauaaggcggucaacagugauuuccuauaaaucgcucaaguuaaguguaccaauaggaucuucaaugccaucaucaaacauuuauuaaauaccuacaauacaauaaaccuaggaaaauacaaggaggugcacugaucacuuuacgaagucuacagucaaguuaccuagagaaacagaagcccaaaacugugcuagagggacaccaaggucagcuagugacuuguaacaaagaagguaacacaggcagacugaggccaaaugaccaggcaaaggccacaugaucauuugguggcaaugccccagcaagaaagcaaaucuucacaaaaauaauagcuacucaaaaaaugcauaauaauacaacuuuccagcaaagaaugcaaucuaaauuuaaacuacacaaguaaaagaauggaaaucccugggauuuuggggggauuuuugugcaguaagauggagaugcuuaauuuuaaauuguuuugaugauuguuacuuucauggauccccuuaauuugaguuauagaagccuaccaauuugaucaauuaccagaaucuaacaauacacccuuguuuccugcaguaguuuggaaacaauggaaauaaagaggcaguucacagaauuacgagcuugcgacuugccuucuugucccagcaccaacauguaaccagcuguguggccuuggucuaucacccaaggaaacuucguucaaauggguaaaaauaaugauaauggguucccugcuuccgagauugucacgggagucuagaaaauugugcacgugauggcauuuugugaagcaugacacacuaauauggaaaugcagggugauguaacuguuagaaccacugcuguaacaaagauagacuaccucccugguguuuuccuuugcuugcaauguggagaagcuauaaggaggugcagccaucuaccaaccacuacuuagggguagugccacgccuugguugucauugaaaagguagcuucaaggcagagucagacaagagugcucucuuguuugcuacugacaugugacccagacaugcagccucaauuuuaaaauguccccacugaugauacagccuugaguuuaaagaaggacuuuggaauuuugagucauuugcuuuccuuauuguuuuagagcuuggaggucauuuaauuuggguggagcuguaagcagaggucccuggcuugcuuccuuaguuggucuuucuggguagagaggugguaggacuuccuuagacuuuccaucugaacucuggugagguguuauccuaucccaccccuaagcaucuugcuuucugacuaugugcuacucaggacaggauguggcuccuuuauuuucagggauuuuuccuucccagugacucuuguuuuuuuucuggggaaaguucaucacgaacaucuuuccuucaucauuguuaauuuguuaacucucucugcuuuggggugggccaagaucacaugaucaaauucaaggcccaaucucauuuuauaaucuggucuagugagcauuacaaggcaaagacagauucaaacagagauuuucuuccaaauuugagcauaugucaucaaagugcaugaacuuaaacuucuaaauuuuaauacaggaggagauuuaucuaucacccagaugugaaaauaugaauuaauacuagagagagacuaugccaacugaaaacauccaaauggaaugcacuauuaaguacaacacacuguuauaaaagaauuauuaccaacguacuauagugagccuuuauaaacuagcuuggucacuuuaauuuuuaucccaggaacauucaaaggcauuaaaccugcauuauaaauuaaugaguuguaaaaugucagcugauaaaacaaaagcaguuuugaauguagagauaaaauguuuccauuucagauuagcuauguaaaaauaugcauauuaaaugaaacaagagaggaauuucugccuugccacaauucugugggcgggaacauucugaggguccccccacccuguuacaggagcaucuuagggagacuggcagcuucucauccaacuggaaucacuacuguuuccaaauuuuaguaugauacugauuguuaaaaagaaaauuuccauaaaguuauagagguucugauuaaacuugcacaugguaguggcaucuuagguaucugauuuccccucuaaacuucuugcuuaacauaggaaacauuaaaaggugauggcagaugugaacaaaagcaagacucccuuugccaucuccauaaaacagauauuagucaaagaauguguaauagugaagucaguuaucuuuuaauacaagacacuuuauucccaggucaccguguucuaagugaaaaaccaugauuucccaaagcuuugacaucuguuucuuuucuuuucuuuuuuaaaguaaauauguuugguuuuccuguauaucuaugacucaaugauugugaucaccuugcucaaccccugccaaaggaaaguagucauuguacuguugguucaagcaugcuccauucuguuuuuauccagcaagucuuuguaguuuuuauuuccauccuucagaauguuuuucagcuucacucccugucuauaucugcaguccaaagauagaccacauagcuaaucccaucacuggcuaaacaaugugucccaaaguaccuguaucagcgagccuguccugauagcauguuucuggaaaaccucaaaacaauugcucuacaaauccauuuuauauacauuguguaucuauucgucaucaguucuucagagccuuauuaaucuuauuaauaccaaaugaauuuaugucuaccaacagcauguccaaagagcaaaaguuuagaagauucucuaacuauugggcuucaugaucaugcaaugaguugcuauauguaaaccggcccgagcaaagucauaagaggcaacaugaaaagaauguucauugccauuccugaggcaugugaaaagaacuguaauuuauuuaggaccuguaaguagaaaauaauaugcucugggccaucagaauuguuuugggguuuuucuuuuaucagaaaugagggcagaccuugucuagcuuuaaguuuuauagucauaaggccuugggaauaaaaccuugaauaaagcaaguaucacaagaugggaaguauguccuuguguaauuagauauugugucugucaccuuccccugaaaagguuacacaacuuucaaaguccauaaaagguguaaggucaguaacuuucaggauacuuuggaauguuuuguaaaaaaaaaaaauuacagacuagaaaaacuauuaauauuuuucuccaauuguuacagauuugccccacccgugaaccucaucugugauagcgaaguuuucuaagauacagauacugauauacacuuagccauuucaucccaccaaauuaaucacacacacacacacacacacacacacacacacacacacacacacacacacagaguaacuugaaucuauauccucacgugaaguaaaaacauauuaaagaaauguuuucccagcaaaagauuuucugugccaguucuagucaaucuauuaaaaaaaaaaaaaaaacaaacuguucucaaguaugugucagucggacagaccuauuuggugaguuucuugguugcugcaguguacuggugucaauaauaauucuugggucuaaguaauguucugugaggcugcagcggugugucuaacccagcuguggaauaauaggaaggacagcuuuuccagaagaaaauaauccccuguaaggcagccagggguguggaucaccuuaauaaaucuugguggguaggggcagugaaaucauugggggaauacagagucaucugucuuuggagagguguggcucaacagaaggcaguuguggaagacuuuguuccucauacagauuaaaucaguaguuuucgccugaucaccauggcuuaaaaccaugggucauuacaaacuuaaucacaugcagagaaucuuaaucuugguaaaucuugucucuuaccccaaagaaacaccuaaaacaagaucaugccagugaguugagcuccucaugccgccccuacaggauuuguccuagaaaucucuguuuuauguuacgucuaauacccaaggaugacuuccaaacuucaucucccuacccagaggauuagguucaggucugugagacuaauaaaauaauuuacugugaagccaccucggcuaacauagcaguacccuucucagaggccuguuugcaaaauagcgucauugcaccucacaauugacagaaccagacaacggugaaagggacagugacaucucagacacaaaagcucaacacauuauggccacucuaaacagaguacaaaaggaagggagucacugauguguaaaccaaacaaugugaggggaaaaauauugaauaauuucugucaugaggcacugacuaaagccaggcucuaauugaauuaaacucccauuuauuugcucaggccuaaacaacaggcugggaggaaaagaaagaaagaaagaaagaaagaaagaaagaaagaaagaaagaaagaaagaaagaaagaaagaaagaaagaagaaaaaaaaacccaaaacaaaacaacgcacaaaaacaacuuaagguuugcucaaguguucugagguagcaccuuuccucaccccuguauaaauccaccaucugugcucacaggcacacauguucucucucucaacaaaugcacggagacccuaccaagcacagaagccaaaaaagcacaaggcacacaaaggcuccccaggcugccccaggccuaaaggagcaaagggggagaaaagagccuuugcucauugcccaggugagacggccuggugcguccucucagccucgacacgcgucaaguaaaagaaagguuaaaauuagaaaauucaauuuauuugauaauuucccagaauaauuagaguuaauauggguuaauuaauaugcaaaucucucagcagauguucugcagcagggcccgugugagaaaacagccuuugcuuucuccuacgugauuuuggcugucaguuauuggguauaauuacuguaacuaaccgaauacacacaaaaccuuuggaauauaaaauuguuacaguucuagcucugcacaagcugcuacuuuucugcaauaaaagcgaacaauuucuuucagaaaauaggagccuuuuuguuccuuucuugauuuaaaaagaagaaaugaaucaaguaaauggcuuaucuuuuucuaugcauaauuaggucaguauuauaugaacauuccaaugagcagugguacaaacguacauauaaaaugauagcucaaaccaccugcaaaaucacauaaaauuguuuuauucagaaucuuuuuuuccuuccucaccagaacuuugaaaugcugaaugccuuucuuucccacauugccaacguuuucuaaauucaaaaggacccuacaacuuuauuaauuuuuuuuccucuucaaagacacaaaggaauaaaguggcuaaauguuuuuaaagguacauaaaaggguggacucuuuuguaaaagaacuuguguggaguuuaaacuuuuaaaacugcuaguacucugaguaggcgcucuguuucuacuuuggguuguucagcaagcugggaaagacacaaagguuuaggacugcuuuagucuacccucaggaccaaagcuaugcuguuuggccaaagcuauggcuacuuuuaaaggguaugaugauuuacucaaggaggggugggggcuuggaguacuuuucucacuuuguacagucgaaaacuuuauugaaaauuauuacauucucaugugcguguauccuucugaaaggaaaaacuaagaaauguugggcuuaacuuaacaaauuuagauuguuaaauauuggaauccauuuuuaugagauuaucuccaggauaguuauucaaccucaaaagagggauguacucuuuuuacauugacugguaauggcuuauuuaaaauccaacaaucaccaaauauauaugaagcacaauuuuucauccuacucuucggcugggggucaccuguccaaagguucucuguucagauaggaacugcaguggguaguaguucuaggucccuuuuaccuuucuaacuggcagguuaaauaguuuucaacucuccccuuccuaaagggauguguccugggguucacauccguggucuaaacugcaagcaaagucagugagcugaagaggauaauguugaaaggaaagcagacagauuugucuuaaccuacacaacuuuucaguauuuggagucugggguuaaaggaaugguccacaugcaucucuagcaguaacuuucaccagacuugccacuuucugucacuucaacagcauucaggcuaacaguaaguuuacaggaguugggugaacacggagccugcauuugucaugaugauacuauguugauacaucaggaugcaaauaacauugggccacuuuuacauuuuuucuauguuucucaggggccggagagagagaguagagagagagagagaggagaaagagagagagagagagagagagagagagagagagagagagagagagagagagacuuucuacuauguaucauuguagacugggucuuuccaggcggggccccuuccugccaccuucagccuuucccagguaguggaaguggcugacccugaccacuugguggcaaaauucagacagucccagugccaagggcagcacacacccaggagaaagcugucauuucacacacacacacacacacacacacacacacacacacacacacgcacacacgcacacacacacagugugguucacuaauuuguauggacuucccuccuuugcugcagacagaaacuaaaucacaugcugccucucucaaguaacaaguuacacaaauuaaacaaucacacccagguucauuuucucaagaaaaaaagagaaaagaaaaauuuucacucugcgaggugacaaggaagcauccccagacagcugaggaugccuugcuccggcugcaaacagacaccuauuuuuucuuuucuucugcuuucuaauucuucuggauacagcuuacuuagucuucccuaagcaguuuauuuaaucuuauguuaguguguguaugugugugugugugugcacugccaagcuagguagacacucuggcacccugcuaggcccuacccccaccugagcacuuuagaugcaggcugcauuugcuugcuaguuucauuucacucauuaagacugucucuuagugacagcugugugaucuaugacccaggcccucacacggggagcaguccgaaggcagcuaugaguuuuacccauucucuggccacacuuaucucaccgaguauugauaacacuuuaucaugcugagcagaauaauguugcauaaaacgauacucagaauuuaagacuccgccuuacuguaaguuauuauucugaaguuuauagaguccgugaacaguuaucaggaguccugggcagaaaggacagauccuccauuucauuaagauaccagggaauguugggaguuuggggcagaacaagggugaucucagaaguuggaaucuucuuugagguagaacaguuuuauaaauaaagacacggcuguuaacaagcuccaaagucuugucugggccacccuuucuuaccuuauggagguuaaaaccauagagucauuucaggucacauuguugaacuuaaagccaugccaaugaauagcaaacaaagcacagcaaaauaaacaaauaaagugucaacuuaugucaccuaauuaauuguuuguugguuguucuuuugguuuuuugagaccugguuuuguuucucuguauagccuuggcuguccuagaacuugcucagugaaccaggcugacuucuaauucacaaaaauccuccugccucugccuccugaguguugggacuaaaggcgugcaccaccacugcccagcuauuuaauuaauuuuuuaacaauuaauuuuauguuuucucuacuauacagaaucccuauaguuccauucaugcucaugacuuacgagcaacaagcuaggggagggaacugaaaugcuguguccacuuaguuuucaggcuaagugauacagauguuucuaagguuucuaagaacaagaaaggggcggggggggggggaggcagaggcagggggaucucugggaguuagagacuagccuggucuacagagugaguuucaggauagccagggcuacacagucuugaaaacaaaacaaaacaaaacaacaacaacaagaaaucacucucccauuauuccugacuuguuuuucaccaugaguuaagugauguaagagcaccaagcuacuacuuuuugaaaaaaacuuuaaauugcuugacagcugaaauauguaugcaugcggauuucacaaugauaccuuuguuuuguguaaacaauguagcuuuccuuacaaagaguguauauuuuaacggacagauguuuaaggcauuucccacacuacucaguucaaggguuugagaaaagucuauguuugugauugcgcuuacacacucuguggcacagaaggccuauggugcgcuggugcagagcaacuugagaaugaaggagaggauguuuauggguuaaguuuuguuaguaggaaacuagaaaauuguauggcuuuuaauucuaucucuccauacauuaaacuuucuuguauguuaauacaguacuuuaccaauaaagguauuucucaagccuuguauuuuauuuaaacuuacagguguguauguaugcaugugcaugugugugugagcgagagcauguauguuagugagugggggcagucaagcuaauagcagaagggaaaggagaauuauaguuuuaaaaguagaucacugggagugagaauuauuaaaguacuguaaagagcauagcuuaaaaauaaaugguaggagaaagaauugcaugcaauaaaagauauacgacauuucaaaauguuuagaaauauuuuagcuaaagaaucaaccaaguuuuguagcuaaagggccauaugcccuauuuuaauaaaaaggaauccauaaaaaauaaauuacuuucacuaaguauaugcaaauuccaauguaagcaaucagugcaaaauuaauuuugccagaacugauuaaaagcauuaauaaaucuauaugcaguauugcuucaaucugauacuguaaauuuauuauacuuccuguaagauuaauuauaaugcuacaauaacauauuacgaugccagaacauauuacuguacauucuguuaauaacaguuaagcguaaccugaguuguaauuauggacuguaacaaaguaauuugauagugauuguuuucuuuaacuguuaauguuagacgggaaauaaaauguguaugugcuuguguucauuauauuuuucucuuuaauacaauaccuaauuaaaauccugaaacaccacaguauuugugcuaacagacuccuuucacuuuugcuccccaacaaaacugucaggcugccugagauaagggaagguuaaaaacaacaguuuaaguuauucaagguuguugcacauucuugcccugaacuagagcagaauguauuuaaaaaugucuguagcgcucagaacucaucaucaagguucuuccaaugacguaagcaauacccccaccccccccccacccccuuguucugugcacagcucacaaacagcauaaaaugccugcaagaucagggcgacaauggcuauuccagguagcaaacuaaagaacugaaaaacccguucaauggcucaaaauaggccacauacaaacacuuucuuuuucgcucucuuuucuaagcuuuucuuuuuuaccaucuucccaguucuagaauccuugauccaguuacugcaguaucagacucgucggaugcaauacucagaaaacguaagaugaaacuguugauggcaucuguaacuuaugguccuucccauuuuguuauccucucccccuucuuacccaccccccccaaaaaaaaccaaagcagccacgucugcacauaacuugaagaacgcaaaaucugaggcccuuuagaacaguauacacaaacuuugaguggcaaacagguuucuggagaacuaccaaaagaaauuauucaaguuaagcuuuuuuuggauauauuccugauuaagccugaacacaaugaaaaaaacagugugaagcgcgguucugaauggcaucugugcuaggagcuucagaggacugcugacugucauaaaacucucugugucaccagcugggggucggggauuuaaagaugucagggggaccuggccucucagaugggguagagaucagagggaaagcuguccaggugaugcccgggcccugaacaggccuaucugcacuuucauucaaaugauaaugaguguguaaaucacaucuguucccccucugugccuguauccuugucaccugaauagcauccccaccagguaucaaaugagcuacaggaaauagguuuucuuuuuauccaacuucacucugaaaugagaaaaugagcacccugacaaggaaagccaugaaccaacagggaauccaaggccagauuucauccuaauaaagaauauuuaauuguuagcugaagguucaaucagggagcagaacucagaauucugauacgaaggcuccucucuggcuccucacugcccaguuccucaauagccucagaaaagucgcuugguaauuaguccucacugacuuuuaaugaucugaucuuuucuaauggugcaaccccaaaaucuccaacaagcccggcaauucucaccuuccccuucccgucuucuuuuaaguaucaaaacaagggaugaugagaugggcacacuccugaaagccugaugguaaguaauauuuugcaauuaaaacauuugaaaauguuuaguugucuaaaaccacgguggcagagucgagaagaccccuuauuuauacuuuuauauaccaggaauuuugaucuaagaauacauuucaccuuuagguucagcauccgcugcuucuaucaaucucuccccccuccccuucucuuuuugaucagaggcaugaaagaguaagcaagugugaacgcuuagguaccugggguauggaaaggugguaauuagcacagcgggguaauugguguguagauugcagcaugaacaaaugcuuugacuuguuuguucuuccuacucuuccacagucucugucucucugucucucugucugucucucucucucucucucucucucuuuccucccucccucucugcccccccccccacuuucucuuuucucugucuuugaaacucagccuggcuaaugaucaccuuaucugcuuaguuuagcugaucauagacacacuuguaggggaaagggaguauccaaccccugagaagacacuuuuacuuucaguugcaaaccaagaagaaucuugauuugcaacugaaaaccaacugcccucaaucauuaaaaaaaaaaaaaaaguuacccaauaauacacauaucaauaaacaauaccccucccuucaauuguaaaaagaagaaaugaaaauagaaaaaagcauuaaguacaaauuagaaguagaaaauuuccuuaaaaccaucccuggucagcaaaagcacuggcauuugaggcuccuugugagaugugacacuuuguggagucucagaacuauaguugcuggaagaucaggcucuuugagguaugugacacuuugggguaucucagaaccacaguugcuagaagaccugcugugucaaugauuucagcaucuuagaaagugauuaaaucaaaccuuuuaaaaauaaauucaaucuuaaaaaugugugucugaguguuuugcuugcauguauguuugugaaacccuugaaugccaccauuggauucuucagaacuggagguaccauauaggcagugggaauuaagccuagguccuuuggaagagcaaccagugcucuuaaccgcugaacaaucucuccauccccuaaaaauaugugugaagaucuggaaaggaagcucagcaguuaagagccuguacuguucuuggagaggacccaaguucaggucccaccacuacaacugccuguaacucugacucuagcaaaugcaacauccuugguuucuguggucaugaguguauauaccccaaaagacauguauaaggaaaauaaauuuaacacauuauaguucauuauuuuugcugagucacuuuuccagcugaugaagcauguacaguauucugaaugcaaucaugucucuucccuuucucccuccccucccccaucccuccucuuucucucaaucucucuguuacuugaaauuaaauaugcucaauuuuggacuuucagucaagcagcugaacuugggacuuccugguggaacacuagccuaccuaucucagaauauauuuaacacaugcuuuuacuggagucauaacucuuuggagauauucauaugauacuuaagacucuagguaccaacuuccuccauuuccccaaauagguuucaagucaggagacaaagcauguugaguuauccuuucuuuuccucuguuauucucacuucacucccucuuuucuucccuuuccacauugcuucuucuccccuucagcaacuuagcaaaugaauauuuuacucacuuaggagcagagguagggcucuguaaaaagguucuaucugucuugugucuggugcuauuuaccauggguauuccagagcucugaguacuuuagugaucuucguuuuguuuuguuuuugagacaggguuucucuguguaguccuggcuguccuggaacucacucuguagaccaggcuagccuugaacucagaaaucugccugccucugccucccaagugcugguauuaaaggugcgcgccaccauugccuggcccuaccuuagugaucauuaauuaaucuguucuccccucuucuucucucaaaaagucucacauaggaguuuguuuaaugacucgcuggaguaauugcacccaagauuaaggauccguuuuauuaacuguacauaucaggaaacugauuucuuaaguucacuuuaaaagugguaguaauuugcuacuuaaaaguuaccagacuucuuuaacucucacauuccaagugcuuuagauuacuguucuauuuuacagucuacaauucucugucuaaauaccugaucaacaauagcuuucuccuacaaaugacaaaguggaauauauacaauuggcuucccuccaagcacacacugauauuuuguaugucuaacaugccuauguguguuauaucuuuggucccuggcuuugcuucuaacaaacaccuucuuuacuauugguccugaccguggucccuacuuauuucgcuucuuguucauuuacaaugacuagaaagcaacauauuuucucagaacucuaaaacuuucucaaucucuguucaauuaaagauuaaacuaaugagccacagaaaaaugugccuugguaccaagcacgugggaagcaucgauugggucccugaaaaacaagacaaguagccagaagcucucccuauuuuccucugcccauuuggcgucucucggggguggggcaggccggggggggggggcgcaacuucaaacaggagguacaaagagaggcaacaagccaguaucagagccagagcagcuaagugacaagcaggcucuuaucuugcaugcauuuuaucuuucuguagccaccuggcucaaacugcuuaaaauuguauucuagcuccccacuuuacucacuugcagcuuuuagcaauauguuuaacaugccuugguguccuuuauuaaaugaaggacaccagucgcauugcugcuccgccugugacuguccaacgcaagcgccgaaagcuuugcacauaguaaaugcuuagugaauguaaggugcuguuauuauuugcugugcccaggaaccauuuuuggugacagaggacucccuguguguaauaauuugguguaguaauuugcaacuaaaauccugcaacuuacagcugucacacugagacgccgaaauauuauuuuuacucugcuucuaagugugaagcagugaaaggucaugaccuuuagacaugaaacauacagcuuaggauguuugagggguaccugcuguggaugggggcaccccagguguuaaacuagguacugcaccacuuccgcccucccccccacaccgccgcgcccgccccauggggucggcagugggauucuacuuuacagaaguagcuaaaaguucaagaugacaggagacccgccgaaagggguuagacauugaggugguagcacugagguuuugauuuucauaggacaaguuucucgcucagugcuccaucaagcuuuccaaagcugugcacucaagguacacgcuaacaagagauucuuaggguucugccauuuacauugcacacacucagaggcauaaaaauagacugcaugcugcugauauaauuacuagaggcuauaaacgccgugcaaaaaucuggagaggggaauggagaaacaguuagagaaagaacauaaauaaaugaguggugacacagacuaguacuauacacuggcccucaguucuuucccacaauuccacacgguccugagguguuccaucaagaaagaccaagcgucuauucugaauugggaaaguagccuauuuguaggccgugggaaugccagcaagcuacaggugggcaccgcaggagcaggcgagaaaugccacugggcagggaggaugaggucuuggugucuuucagggagcauaucaauccagacaugcugcuuaggugcccacauacgucacagccuguuggcagcuugcaagaguuucagacgcaugaaaggaaacauguagcagccuuggaagggaaauuggcugagcaaucagucugcaugcacuggccugaggaggccaugcuacacugagcuggccuaacugcuccuggcccagcacacagcccucaagaccugagaggaaccugaggaucauugucuguacugcaccucagagggaucugaagagaggagacggauuuguucaggagaaugugcuccgacccucccuucuguccuuuugcucauccccaggucucuuauaaaauguaagauggaauccacaccaacacuaauguguuaagaggacaaccucaaagaaagaagggcucccuccuccaaccuagcaccaguccccaccuucaucaacagcaggaacagauuccuggauaccuuaaaaccaagucuuugcuuuuccuggcuuucagagucaggcagaaaccagcucaggcucagaguggucuacacaguacaagaugagggucucucuugagacuuuguacauucgggggcugauuauaaugacacagacaccuugacacagagcugcugcuucuugcaggagcucgagcucuggcccacccgugggacuguguucucugacagucgccaugaaaccaagcucauccugaggggagacgacgucaggaagcagggugaaauguuuuccuaaaggcuauacaggagucagggguagcuacaggauuccaaagugcagcccugugaugcccaagcucacuacaggauuuuuauaguucuccuuugggagcaugguagaagucuagcagaacgucucagauagucuggaugacugggauauuugggaaguuauuauuauuauuacuaauacuauuacauaccaauuugacuuuguagucucuaaaaucagaaucauaaagagaaauguggacuaguacacauuacuauagcaaaccuauaccauggcacauuuuaagucagaaauagaaagggaguaagccauaagccaugaaagauaugggaaugaagagggagagagagagagagagagacagagacagagacagagacagacagagagagacagagagagacagagagacagagagagacagagagagacagagagacagagagaauauuuaaacuuguuauuacauaugagaucacauuucuggcccuuugcugagguucuauggaagcugauaguuccaguguagaaauccuacaguagauugguguuaaauuuuaaaucugcuuggaaaauaacagccuagcugcauuccuguucagauucucugaaguuaaucuggaaaagauuuuaucuagcauuugauaaacugcuucccaguauaaaugaauucaugcccaggaaaguaaauuuucagauagaaacuauacucuauugacuuucgugacucuuaugacaggauuucaaagguguuauugaccuuauuaagaaaaauuaguauuugguauuccugggcaaguguggaaaugaucugacacugcaucagaaaacuuggaaauuauaggauuucaauagaucaauauuuacauuuuaaaaccuggaaaucuuaaaugaugaacgagccuggugaguggcguagcuuccugucccgucucucaucccagaggucagcgccucccucccacugcagaucugaugggccaacuagaaaccuugguuucaucagaauuaccuagcuuuagcuuuauugugagaaauuuuaugucguauuaaguuuuauuagauuuggaaacguuguauauuuaggcagaaucuuuuuuuuucuuuuuuccauuuuuuauuagguauuuagcucauuuacauuuccaauuauuuaggcagaaucuuaagacacuuagguuuugucauugacauuucgcagagguagguacccauguauauuacauauugcaaagaugaugguaugcuauuggguacaugaaauucacuuugaucaagugcuuugucuaauuuuuuaauaaaguuauuuuuuuuccucuaaauaauguacacauacgcguuugacaggcugcagaaaagaugaaauaguauaccucggaaagacuaguugugccaaaugugagcuugcucucagcuaacuucccuucugacauuucugggcucccaaacugugguuugccacgccuguggauguuauguaucuguauuuagugguacucuaggacuuuggcaucauauacuucuuuugaccuuauauuuucauguggaaaaaaaaugcauaacuagguaggaaaaaaaguuuuuuuuuccuucaaugugcugcaaguuuguaauaacuuuucuguaacacauccacaaaugugugugaugaucugcaucuguacauugcugaggugagugggggaggggcccugacuuaaggccuagagagggugaaccuaggcaaaggaaggagagggaacaaguaccgucgccgcagagauauuacagauaaguaaauacugcgucaccacaaaagucuaaacacuuguuaaacugucugguuuuagaacauuucagccauacaacauuauucaacuacucaucacugugagagcaggcaaucaggaaagcuaauuucuuaauuagcuuugcuccggcgguaaugauugcagaucgugucaacuaaaaucuguuuggauuucuguaaauuggaguccgacaagccugcaguuccgucgccaaccugauaacucucaccccccugucuuuuguuuuuccuuccagccuuuuuccugucgccaucucgguauuuaaucugacaccaccaggcagcgagaagggcuuacucuuccccuuaaagagaaagagaggggagggggagaggcacacauucacguggggaaugggggggggggguagcugcacaggaaaccuggucccaaccccaaccacugacaaaagccuuuaaucuuucccacaguccucaaggcauucuccuucuguaauaagacauauuccuuucaaguaaauccugauaagggaauucauuuuuuuuuuuuacaggaaauguauauccuuguaagucuaucgucuuauuuaguuucuauauuauaggucuagcuaaucuaaaaccauuuccuuaucaucuggcaugcuaacaguaccgucaucaaaacaaacaaucuguuaauauaacuuagguuguggaaagcggaguagggugugcuauauuuaauaugcagacaacagggcugagauccuucuugaggugcuuggucagggaaggccacuuggguugauucugaagggucuggauugccuucuaaauucuaggagccauucaggucuaguuuuaguacuaaaaucauucacacacacacacacacacacacacacacacgcgcgcgcacgcgcacacacacacacacacucacacacacacacacucacacacacacacucacacacacacgcacacucacacacacacgcacacucacacacacacacacacucacacacacacacacgugcgcacacacucacacgcacacucacacacacacacacucacacacacacacacgcgcgcacacacucacacacacacacacgcgcgcacacacucacacacacacacacacacucacacacacacacacacacacacacacacucaucaggacaguacuggauguuugccuguggggacucggcaccuccagauuucccaucugcaucgggccguucccuucucuucucuucauuugugguguuucaucuccauuccuucccugagacuccguggucucaaaguuucagcacacacaaaggcagagugaggcggcauuucuaugcauagacucauuagcuuggagccuagccucucugucacuuuaaauaaauuaaaaugagauuuagaaaaacacaaaggccuggucuguaaaucauucuauuaguaugucugagugcacuuaggugauuaccugaugucugcaugauuaauacuaaccagaggugugggccaaacugccgaccccucccccuuccuggaggaggaaaaagggcaaaguaccaucgcugugggacucuucaguuuacaucacugaacaaaaaaacaaaaagccuuggagaaaggugaaaagcugacauuuuaaaagacagaaggagagguacaaaguuugucugcugcuuaggacagacacgcaucuuacagaguuuagcaaagccacguggcuugagaaggugauguuuuuagauugaagucuugaacagagucagugcugucguggaauacaagagcgcgcaccuaugaguuuguguuagcacuggagaagagaagacaguaaucaugaccucugucccuuucaagucaauacaaaacuacggcuucagcucauuuuuauaaaccaagucuauuacuugcaaacauaaauaagugacccuguugacagugcuccaaaagaugcugcucccacuuugagauguaagaugaugaggaaagugauguugcuucauauuugggaaacaucauuuauuucaaaucccuauuuuuaggaucaaaaacccacaaauaguuuuuuugacagcaaauuuuuaaaagcuucgcaaacuacuuaagaacuaaaagugaauuacugaaacaagauugccaaagcaaugacgaacuauagagaaaaggacuuuucucaucacuuuguggacaccaucaaggccccagucaauagcaaacaauaagaagcacaaagcaaaccuggaauuucccaagucauauauccagaagccauuggacaucgcuagcaucucccacugcucaaaauauguacacagauguggucagggaugaauuuaaccuaugcaaacuucuugcugugagaaccaguugcuuuaugguguauaccucauucaaaccaugcccagagugcaucgacuaugcuuugauuaaugcugccguucacucuggagagcauguucccacacacagcacaggguucucauaccaugagacuguguuagcuuguaguuugcacagaaugugucaggcuuguucacaguguagauauuuugcuugaaugccauauuuucaaaguuaugagagaaacuaugagcugaucccgcauuuaucugaaugugcacauuggugugccugccuucagcaucacaguaucacagcaucacacacacauacacacacacacacacagagagagagagagagagagagacagacagacagacagacagacacacagacacacacacagagcuaaaucugccuccaauuaaccaaaagcacaauuuuucucugacagggaagauuucauuuggcccacauaugacuagggagccgauuucauuuccuguaaaaaacccccucaaacgccacaaaguuaccugacucagcugcuuguagaaaucaaauucggucagagauaacagcuaaucauuugucacaguaagaagcaauucccugaaaucggaagggaaaaccugccgcuucaauccgcaggucugucagauugcuagaaauuacauucugcucugacuaaccucugcacuuggauugcuaacaacacgcagccugcucuaucaaaagagaauaucauacaaccaggaaccgcuuuugauucgcucuguuccaauaaccugagaaaaguuuauggacaugccuugcugccuggaccucaauuuccaccaaccugcacacuguuuugaauuuauagcacugcagacucauaguaauauaaggaaaauuuacgggcuggcuaucugcugcuucauugaaagaaaauuaagaguucacguuauaacugcacaacugauaguuguuuucugaugcuuugaggaggaagcacacccuuuggagguuucaauuaaaaugccagaagagagaaggcaaauugauuaagucucaaaauacaacuuauauuuuuucaaaauguuucccaggagggaauaaacuuuauauucuucuauguaaacacuauuuguggaggacauagguuuaauaaaaaugauguacgaccucuuuauuagauuuauaauuugcauacagguaguaaauauggaacuuggguaaaaaugguuuuauuucaacagacacacagacagacacacacagacagacagacagacuauccucuguauaucacuucuguaguagcaauaaguaucaagugacuauagccaaggaagccauuauuauuacuuaagggauauuucaagggaacuuauucacuuccaauaaguuacuaucuucagcuacauuuacagaaccuuuaaaagaaaucaagucaugcaaaaacaaacacaaguaaaaccaagggaaugucuuuugcaagcaacacuuaacaaaaccaugaccacauugcugugagcauacauauuacaacucuuuuauguaacccaaaguucaagacacuagacagugcagaggcugccucaaaaacuucgggauuauuccaaggcuguucuguuuuaaagcauuuucuuuuccacaguuggaacuggccgaggaugggguuugagcccugacucguaguuucuuuugccuuugucaaacugugucacaaccguaaaguuauuuuagcagagugcauuugccuagguauuucgccuguaguaguauaagagaaaaggaaacaacaguuuaaucuguaagugaaguaaugugcgggugaaggacggcuccagcccuggccaguacuggucuuagucagaaaucaguaugugggauuuuugagcuuaaaaaaaaaucauaaaucccuucuuucauuucaauuuuccucaagcaacugcagugggaauuaggcagguuugaaagaucuaauuucuuucuaggaucaggccugauugcuucuaucaugguuaauacugacuuaaauggggaauuugugcaaauucuucaauaugggucguuuuugauauuuaaaaaaaaaauccuuggcguauauauucagaauugaucagcuaauagauuucguuggguuacacagcagauuucccugagguaacucuggcacugccuuccuagaucaaaagcaaccccuuuggccuucaaucuggcucucaccugucauccauacaguggccagggguuaagcuccagcauuguaccaguaugcaaacuagcagauuucucaaucccgugggugucaaccagacagaggcacagggugccaagcucuccuuauuaacugcucucucaucuugggccagcccagggaucugagaacuugcuguaguuagaaagaagucaccugacugugaaguucccuccugucuauuuucaaucacuauggucacagucaccaugagucaggguuccucauagcagcccuggccaguacagcuuccccauagaagaagugcagggaccucucucagggaaaucacguggaggauacacacuaucauucccugaagauugucucauuuuuggaaucucaugugugucuuaaaaaaaaaaaaagaacucauuuucuguguuugagcccauuaugaauguauacuaagaacuguaugugugcauuaaucuccugagacugagaacagaucacauuucuuuuucucucugucuccagaacaauccuuacaaaaggcacaaacuauuguaaauaaguaaacaaagaugaaaaaauaaauguaacuaccuuuccgucaaauuagcugauguuguaaccuggacauaaucccugauuccguucccucuucugcuucugaggcauaaauucaagucaaaacaggaugucuaacuucuucguagaggacugugguguaggaaugccaucuucuuacucauuugauuuuacagaaacagcuuuucaggaagggaagaggaaaggaggagagaaggaaggccaagucaaacugaccccacugcagucgaaagagaaggaaguugggcuuaaggacuggcauaugggcagcaacuugcucaagggcucaacgugugucagugggacaaguuguaugguugcuucaggaccuguguuuaucuagcuugaagaauuuaaaaccuuuaaugucuugguggucugucguugucuguuuggguugaagugauggcucagcaguuaagaccacuuguggcuauggcagaggacuuggguuugguuuccagcaucuacuugguggcugacaaccauuguuccaggggcucugaugcccucuucugaacucuaccauguaguccacauacauacauggaaguaaaacauucauacacucauacacauacaauaagaacaaauaaaucugaaaaaaaauguuuuaaaacucaaaguuaugugacuaccuuccaccauauucagucucaucucucaauuuaucugaacauagaauccaaauggauucuacagagguauagacaucaggaugcuaagcaacuuaccuaaguuuuccuuuugcuuauuuuuuccuguuucaguuaauaguuccuucaggauuuagauauuuauuuuuaaauuccccucucccccccccuuuuuuuuugguugaggauauugcucaacagagcuggacaaggccuggccuugccuccagcaugaagaaaaccauguuuccuuguuugggauaaugccguugaaguacuaauagauuagcuuggagauuaagcguacaacaugacauacuauggagacucggugcuaugcuauguacaaacuugaagcugauuccauauuuuccauauuuaugauuuauuuauuuuuuaccagcaaaauugucuuauuuuguauauuuauaauggaaacauauacucuagauaggaagaaaacaaaauguuuuccaauugucaugucagcaugaagaaaaacaaaacaaaacaaaaaaaccauuacaccagcuuuuauaguacuuucaaaagcuagugggauggcucaguggguaaaggcacuugccgucaaaccugaugacaugaguucaauuccugggacuuaaauauuaaaagucuagaaccuacuccuauaacaugccuugucuacugacuccuguguguggauacacaaacacacacgcaauuagauaaauguaaaaauaaaaucuaaaaccaaaaagaaugauuucauaggaacuuaccacuaucacucacuagcagaguucuuacaacuauccuuggcuaugacauauggauauuauggaacuugaaguuaaacaaaaaaaaaaucaucaguuuaaaauuuuguucacauuucaccugauagaagacauucugacacuuaaauuuccugagaaaaaaaagaaaauuucugcucauucugaaauuuaaguagacagcccuugagagaucacuggguaagccgguguuuucucagguuuaacuaaauaauuuaugcauacuuucacuuuggcaugaugaagcaauuuuagccuuuaaaacccgcaaguacucaagugggaaaaggucugguuccugcaacuuaaauaauuuaaacauccagguggaagugccuccagcacuuucccuuuuuaagacaaaggaagaugacuuuagaaaugugagauaccaaaaaaaaauugauaaaagacauaaccgcggaugcauuuaauuuagauuggaaauccuacucuuuuuuuuuuuguuuguuuuguuuuguuuuguuuuguuuuguuuuguuugaaugaugggcuccagaaugaggugaaaugccugcuuucuuggggauuguaacaaauaggcacauagaaauguuguaugagcagagcccugagccaaauguauacguauauaacauaaaauauacaaagagaaguauuuguaaaggcuaaugcagccuucuaacuccucagcccaugcuguaaacaugagguguugaucagguauaucagaagcaguuauacuaagacacaacugugcucuggucucaggcuucuuggcuuguauaaaugcauacauauuuugauacauaacuguguagaugagaaugaaggaaaugguauucgauaccauuucaagacucagagcugcaagagaggccacuuggaucuacuaaaauacuagaggagacuuuaaaauuuagguguccaguaaaaugggcccucugacucuauggccuuuggccuugugucagauuucagagcugccauggggggaauuuuccuucucacuugcaggucuguaaugaccugucaaagaaggugggaccggggacacggacauguacauuuagagcacagcuuuuaaucagcguguuuuugagguugcaaguguuucugcuaucucaugaacaugccacaauaugucuaggguacuuuaauuugcuguucuaaaaucuauaucacacccagaauuaauggcucauauaaacaggaauaucaacuaaagcgcaaauaagauaacagguggagcuaaaaagaguuuacuuuagagcuaaccacgauaaaagaaagaauuugagaaggguaaaauaaauauugcuauguauguguuccuuaaagucagggguaggcuucauucuuucaaaggagcagaggucuucaaagcauauguacuuuaacauuuggugccugugcaucaugaacauacaacacacuggacaugcggagggggaaggggcgguuccugcaggagacagcugcagugggaaggcugagcauguggccagggugcagaaagaagagcuucagaaaccgugcagcagguucagaacagggcugcugugcugcugcuggccugaauucugugcuggcucuggugccuuugugcugcugaugugggugagggucaccuaagugacacagacuagagagaaagcaugggaagagugacuuaagucauggacaugucggugcuccgaagggaugugagaaauaguauucuugauaucuacguagguccccaaugcugcuggcuaagguuagaaacacaagggagacugggaaugcuggacugugugcacagauagaagaccggaguguguggguggcuguucugucauuuuauauccguccccuuaauaaagcccggccagccucagaagcaugagaaacuuagaaaacauuuuuguuucaggugaccuuguucccagaguuugcccuacaucuucucucagcuaagcugcaaggccgaagagucacauucuugcuccgaaucucagaacguggcaccugguguaaaaagaaauuccuaaucucaccugaaguaugauccauaaaguaccguguccaaaccaaagaagaaaggcaaaggcaucucucuauagccuugcugguuagacuucuucguuguauuauuuuaagucaauuaauucaaauuuaaaaauaauggaauuacuagcagaggcucuaaacuucuuuuacuauauuaaauugggcagauugcuucuuccuucuaauuaugaauguugcaguuacaaaagaaacugucauuuugauagagcaaaagacaaucugucugccaaaaauguccaacggaaaaaaaaaaauuaaaaaaaaauuuacaaaaaaaauagaagaagaagaaaccuccacuggcaugagaaguaugcuacuuuguuugaugcacugucuuauuggaaaccuaauuugcuuucaaccucugagacaacacauaaguuugugugacuaauuuuucuuggaaaucugaguaauuaaaauuagggggccauuuuccuagcaggaguggacagguuuuuaaagaaauucaaagugaguguuauaguuauuugcuuugccuuuuuuauggcacuccuaaaaccaaguagaaggggguacugagcuuuguacgggauaaugugacuccccauguaaauugugagcgacugcagagcacagaaagguuuaucaccuaaggugagcccucccagagcuguuggaguauaaaagcauuaaacguguguucuaacuaagucauaaaaaucaauaaacaggaaccccccaccugugcaauggccccaguguuaaguuuuauacacguaguaaucguacuuaccaaugaucaccaaccacccuuccuacaccagcuauuacccggcuuauccgcaccggaggccagggcugcgccauccucccaucccacagagcugucuaugugccaggaguacugcaccacugucagacaguucucuuuguaacuggacaaggcuguugcccuugcucuacacacccacucaggggcauggcaacugcaaacugggcaccucuguuuaaagagcuuccauguucuucugaaagacaaccagaacuggugcuuauuaaugccccagacucaggaugcuugcacagaaggggaaagccaagucacuuccacugacaucugaccuugaccaacggcugcaggcuuaucuaccaagguuugaaaaauaagaaacaaaacaaaacaaaacaaaaccauucuggagaaacaguugggugaccagcuuccacagcaaguagugaagcccguguccuuuaaaagccagaagauucagaaagcacaggucacccucuuacuacacagaggggaacauaugcuaaaaauuaggccccaaggagucagcauguucaccaggcuacagaaauaacuacuaacaccacacuuaccucauaauuaaaggaaauccucucaccccaccuccccauuuuuaccaauaaggcagaaaauaucacugaauguguaaccuuuguaucacaugcagucuuagccacccguuaaccuacacauggcgagggguggggacaggcuuauuaagucacagccgcuuguugguaaggagauccaauaacauuguggagggguacugcacuggggacauucugaaggaaaaaaaaaaacccauaaaagaagaagaggaaaaaaacucuguguuuuaauuauaauccagagauaaccacuccaggguaaaugaguaacauuugagaagaacaccucuauucacacacaaggcuuguuuuuuuuuccucugucuuuuaaugguucuauugcuuauaguuuuaauaggccagagaaacaaaagaaggcccucguugaugacucuucuucucuccuccccaggaagaaaaacaaaacaagacagagaaacccaggacuuuuaucugucugagguugccuuugauagcgcucacggcaugcaagugccgcuccuggacacucaaagcugcaucacugagaagcauagagauaggauaaaguuguucaguaaugagaaaauuaugauacagcucaagugcuguggcaugaagcgggcagaaaugggccacucugcauguuugcagaacaacaacgacaagaaauacagaaaauggcaaauggaccucuugaaggugugccugaaguuuuacuacuuucagcggugucugugaggacauuugcgauggauauuaugggggaaauagacauuucuagcaaggcaaaggaagugaagcacugcacuugugaacagcuggcauacaauagauaauuuaagggaaagugacccucauguauaauuuuuaacugaagaacugucaggccccauuaguuccaauagggccugccagggccaagauugguuuauagaaguauuguaucagcacugcuccuaaggaccagcaugaaaacauaauauggggauucaguaaauucaggguuuuuaaaaaacuuguacacauuauuuguuacacugacaucaacgcuugcugccuaugcguucagaugaaaagcaccacggggugaccacuuccacaguaaacaguuugggagaaagcccuucugagcaguuguaaccgugcucucaaggagcccccaagcauuaaaagggaaaagcaaaugguggccaucuuaugauuauucucgguggcacugagugcuuaugacucugaggccccagaaagaaacagggacaggagcugacucacucauaaaaccggccaacucaaguucuuguuagagguauggaaacugucagcagucgucugugaaggauguaaugaguucuaacugggauguaacauagcuuucgaaagucgcggucaauguaaaucauacagagaaaagaggccaccucccccaccuuaggugaaacacagaagguuucuuggaaccaguuaucucacugaaacaccugguaggaccaccuugcugucccagagacucucuggaagcagggacuccugguaggguagaggaaggugacaaggggcacuuuccuggagacaaagacaaugaaggugguacuugcacaaaaaugcucacuuugcugaaugccuucuggagcucuacaaaugguggcuguauuuggcaucugguagaacccacuguccucaguuuuauuguguaauacugugcuguuuagagucauguuugccuuaccucuguguccuaagggagaacugcuugauagagucauguuguucuuugguguaaguguuucgggaaaguuugaggcaguuauaucccaaauuaaugggaugcuuggcauucucucucgguuuuaauguugcacugauguggacgcaaucucuuuauuuagguggcuugccuuuacuacaaauaugaaaugaucaaggcacugccuuuauacauguaaaccuaugauuuuguuauuuggagaggcaacuauucaauuccauaauuauagcaccuuagaucaaagucuacuaauuggugcacagaguugguuuuuacaggucuuagggaauauucuccucuagacauuauaucacaagcaaucauuagguuggcuauaaagggcuuaaauacuaauguauuuuuaaauuuguuuuauaaacuaaacaagcaaucaauguauauuaauaaacauaauuacauuucuggcaucuguccauucaucggaccuugacagcucuagaaaacacaucagcaaaacucacugaccacaacacucaagugagaucgccagugagagccucgcaaagauuccuuaugccugagccaucccaacgcugagggagggaagccucugcaguugccagugcaucuuauacagauguuccaggcaaagucucugacagacacaguucccacucagaacacugcuuucaaguggccauaaaacaagccuuaaugaggcgauaaaccuauuuaccuuugauuaggugagcuguccgguaagauaguacagagaagcacuuucuaagaguaaauaucuacccaaaucaccagcugugaccguucucuugagagccuagaagugagaccggcugccccaggaagacuuugcuuaucccagagaaucucugaacgggcugacauggcuuugccaacagacagagcggcacuuaugagauaauuuuccauuaccaguggcuuuuagaauacucuuuuucucuggccuggcacacaccuguaauuccagcacuucauuaaacagggaaacaccaauucaaaaaaaaaaaaaacaaaaaacaaaaaacaaaaaaaaaaaaaaacaaaacaaaacaaagcaaaaaaccaaaaaagccccuuaagaauggaaaggggauaguggagagacucauugcuagacucucagacuccguguaacuacacaacacaacaguaugcuguaugcuaccuucccagugaccucugaauacuuugugaaaagugagaccuuuuuuuccuccaucuuuguaugcacucagccaggguagucauguuuguggccaguguuuggccauaacugaucuuuuuuaaauacacgauuuguuguuguuuuuaauaaagacacugaaauaguuauacuguggaauucaauucauuuuucuuaggugauaggagccuuccucucuucuuaugaauauaaauuuggauaucuuacuuccuuuggacaaauaagacaauugacaucuaccaggaacacucugccauacuguucccuccacggcuggccuuccuguggugguaguuuuagcauauucucuguaaagauauguucacuggauacauguaagaagauucccgucauuugauccucaacaacaccauagcaauuacucuuagccuaacaagcaaaaauauaacuuaaaauuggaauaaaaagaagaccaaaguagcagccugccaaaccacuugcaugcauucuaaaauaaagaaaaaauaugaaaaaaagguagcuuauucagugucacuuguacauauuuaugguuuaaaaauuagucaaaguuuaugucccgagguugcaccuacagaaagccagaugugccuucugcacgugaccuaagauaggcccagagcaacaacuagauaauuucucgcucuuccucuauaccgucgauugcggcggcuuucugaggugagagaaacugacagcacuaacucuccagggcagaacuuuccagucaaguggaucaacggacugaaaaucucuuaugaauagucauuaggccuucauuacaaaccccucaaaacccaguucucuuuucgcaaccaaaugccuuuugucaucuucacaagguacaucauuuaauuaccaauugauuucuuuauauaugacaacaugucagauagcaaaauacaguguaucucccuuaggggagaaaagucuguuaacuaucagaaugccagauuacugaguuaucugaaaagcaggcacccugcaugcuauuucuugguucaauccacucuuccuaucggcagaguuucuuucuguugagaaaaaccaauaaaaggaauauuuagaagcuaauaagcagcaagauggaguccuucucguacccggaaacacugucaaauuaaccagaauguguuuuaagcuuucucuacaugaagaguggauucuugucaacauguagaggacacagagugaauucuaaagcaugacuauagagagggggacugcagcccaaauuucucuaugaagagucaagagguugcucccaucacuccacaaauuccucagccucugacuucugcugcgcaacugcagcccgauaaucaaggcugugcuguauuaauaagcugaauaacagggaaucucagaaauguacaggacugcuauaccguaacaauaaaaccucaaauggaguaaaccagggcagagcugaaggugggcgucggggaauaaugagccagugugcggcaaugcgcuccauuguguggugguguaaaugccugcuucucucauacacagaggccacauuacaugagacccaaguguucucagagugucacugugacuggcugugcuagaaccuggcacggaugggcacugaaagcugacauuauauuucaggaugcguugcaggugugccggccugggaacgugcucuaauuacauauuuuccugccgagcaacaauuaaggucgccaaaauaauugccaguuucuuaaucccucucuaacaagacugacauaaggaaugguuuauuuuucucugauuguuuugaaaguguugcucaagauuuugguuuucuauggaacugcauaaaacuaauucuuauguucagaugugugauuauucccauuguuuaaaaaaaaaaaaaggacccgucuuugaauugugauaaacuaaaaucauagaaaaacaaugugaacuauauaaccugguaggugacuuaaauguuuuucuuuuaauggaaguaaaauuugcuuuaaaacccccguuuucacuuucuacacuguucaccucgugcacaacauguaaauaugcagacgagaggaaaaagagcagagcuuaggaaacaagacagaauugguugauuuuucacuuucaguguugacuuuugaucucuucauuuucaacucuggguuauuccagaauugcauuaaauguaugguuccacucacagaaauguagaaaauauaugcguuuucuggugguucacagauucccuaauccagaaaugauuuccagaguagguacccaguagacuaguaacuacugcaauaaucuccacaccucccuuugcccaucucuuuccauauucucuguaccaucugaccacgaugugaagggcaccguguuuaccaaagguaucagcagucaaauucauaugcuuugucuucuuaacuaaaacuuauuucucccauuacguugucuauuuuccauugcaguuggguucauugggcagagcuccuuuaaagaauuuugaggcaacgaacucauucuagcuccccuuuucacaggcagaggacagaagugggugaccuuugggcacuuaguggacaaucgaaagucaggucaaucacagcacaauuuagcccaggcuacacggugcaggcagccgagguaacaggguuaggggaacaagaagccugagcugggagaguggggacgggggaagcaacacuggcucuaucuguaauggagacuucaaaggggagacguuuagaaggauugaggagcgguguggcaaauggaacaagaggccugucuaccugcccagucgcugagggaaggaagaggaauggcaugcuaugagagucagcaaagaaaggagccaccaaccacgagaagccaacuuggauccuuuuuuuguguggagacaguaccauaaggcuuuguacaacuggggcugucccaaacugacccauuucuagugucccaaccauaagacuucuugcuaaauacggcaucuucaacgauugacaaggcacugucacccgagugcuugaaaagcccacucuuauucugguuagaaaccaaagcucucuccuuuucuuauagcuuggaugcuaaccagugcugucuggcugaagugagggcucuucuuccaggagaugaaggaaaagcauugauuuuuuuaguuccaaugcuguguguguguguguguguguguguguguguaugcacgugcucguuauugacaacaugacaaggagugaggagagacacucccuuacagcagcugcggggaaggcagaguacaaaaaauggggugugccacugaaagucaugccaucauuucucgaugcagugcccaaugccagcagcucucucuucuccugccccccuccuguuggaagcugugccccauagcucuaacucaugccuguuccuucuuacagcuuugcuaacuguucaaagaaaggaucuuucccucccuccuuguuacauacgcugaaugaagggcucaccuugaacaccacacucuaucagccacucagccaacaucucuugaacgcauguagugugucauaucugagccuugccaagcuguucucucugacacugaccugugaggcuuuaaugggacuuaguaccugguaaauagcuaacgguuuaaaauaaaauguuucaaaugacuccacgcuuuaaaagaugauuuuccuggggcuggagagauggcucagcaguuaagagaucauagcacuuuuaagagaggacuggaguuugguuccugguaucuaagccaaguagauuccaacugucuggaaguucagcucugagggcaucugacuccucuggccacagugggcaccuguggcacacucccuccccccuuaauugaaaaauaacaaaaccacaucuuuaacaagauuuuuuucuguccuauagaaagguauagucaucagcgagauaagcuuguggcuuuuguuuguuugcuuguuuuguugguggugguguuugguuguuuuuaagucaacugcagcucaguggcugccuccugcgcacagcacacacuggcuucccgggcaugccaggcauacccauuucugacugguauaaaugccaucaguacugagcauucacaaacacucaguaugcugaucucuggaguuucugcagacucccugauagacacuacgcugcaauuccacacuaccccacagcaggcuuucucccuaacccaauuuccuugaccuguguuuuccuuucaaccagacuucagagacaaagacagaauaguaaauucauuuucuuagaaauacaccaccaagguuucagucuguggggcugcuacuuauuugccuuaccugaaguuaugucaagacaggguauuaguucacuaaauaauguuuuucucaucacuguuauuacuucaaaaugaucauuaauguacucuuuggcuuucgaagaggggggaccaucaaaggaacuaguuuccccuaauucaaauuuucuugaaagguaacugauuuacaaacaaauuacuugugccuuguaaggaacugccaaaugugucugcucauuugauacauuuucaagggcuacagugucgaaauggaacuguaagaagcucccgugugauccacaaacaacuucacgcuguauuacacgugcaucagauacugagaccaaacuccgaguugcaagcaaccugugaugcagaaugcuagcuuggcagaggcucaaacagcuuauuuaaauugcaaacuuugcagucacuacucacaggugauuuugaaaguucauuauagaaacuaaauagcgucuucuccauacuuuguuucuuaaaucacacauacaucaucuuugagagaugcuauuuaauguuuuccucacagaagcacaucaacuuuguuaagaaauugccuaggagacuaaaaauguauuuaaaccaggcacgaagcuuaaacaaauauuccaacuggaguacagauaaugcuagaauuccuggcuaggaauuuccaggauggaguuugcuaugaauagaggucacgugaggaguauuuuugaaggcauaacuuuacagcauaagaugaucaaagccaaguauuaauacauuauuuuaucggcucaccuucuaaacaauauuucaguagauuuccuuucacacagugauauuuguaauaaauguucugccuuuguuuuaaagucagucuguagaaagaugacaucagcuuaccaaacaauaaagugccuguaauauugucuccagagggcuguuacauuuacuuuguagcaguaaaauucaauuuucaaaaaacacuacaugaaugauguuagguuauuaacccuaucaccaccguaaaacaucauuauuguguguagaauguaggucacaaucuagaagccauacauuucuuuuuuugucaaauaauccacuuaagcuucuuuucucuccucgggucugggcugcaucucuucuuugggggcagaaaacauugcaguguucucagcuggcuggagggucucacccccaagugucuccacagcucagcuuugaacucuucuucgccuucuccucaucaccaaugccuauuguucuggagucagaaauuagcauaucauaucuuuuucucucucacacaugcugcaauucuaggacaggaagaaaacaaggaagugugucccauuucaaaggcagacuccauuuaauucgaagaccuugaacacaaacgcacuggcaaauguuucaauucucugcccgugugacuguagcaguaaccugaggcgagggacaagaauccccccugcguggaaagaaggccauucaggcacacucacgccagaaggcaaagaguuaacuaguuaaacuucuacauaccucccaggaacuuuccaaaagcuaacaauaaguaaaagcagcacugguuauccauuuuuuaaagggaugggauugguuuuagaagaaaggggaagaggaucaaacaccucaauguaacaaagguuaugucagaggcccucaaucacacacugccuuccacaacacauccuccagccuuccagagcagucacccuggcagcgcaacuaaaaaguuccugacaugaaaagaacaaaaaccaaagggacagagguaguuauugucaugcauacccucccucccucccuccuuuucuucucucucucccucucucacacucucuuucucccuccuucccucucucagguuuuccuccuuucgugaaacuuuugcauaagcuaguagagaaaaagcaauggcuugccuuucuauagagagauccccagcuguaagccaucccagggugugggauaggcccaguggacuuucuauaacacacaccggaugaccugaucaucguucaccaauacccuucagaagccucaucugauauuaaccaggauaaucuuagcccugcaaauguggucaaucuugucuugagagccccuggauuuguaaauugauguuguuuuccccucguauucugucuucggagcacaguggauguaagcuauuugcauuuucuguauugagucuugagguagcuuaacagcauguaugcauuucccacuaaaauguaaauuauuaacaaguuggaguuuucauuuguuuuaucuccugaugugagaucuaaauaaguaugcacaacacuuaaaauucuuaccauuucucugcuuucuaagaaauaaaucucguaucugcugcacaauacacuuucuugcacauaacauacacccaggcuaugggacgaacauuaaguugggaagcaaagcuaaacgcuuuguggagacuuaaucaaaguguguuaacccaaaggacuauuuacugaugucuucacuaccggccacaucacaccaccaucaauaucaccaccaccaccaccaccaccaccaccaccaccaccaccaucaccaccaccacagcuauggucaucaucuucuuuaaaagcacuuagcucuucaucauuacuuggggacaucagguauuuucaauugguuucaucucaaugucuaagacauguacuacucuuagaaacagauuaaagaaagccagcuguguuaucaucaugccuuacauucaugggucuaagaggacgcaguauuuuggaauugaagggcugugaugggcaggugcuuugaagauaugaugaguauggguauuuaaugguacugaugaugaugccguuaacgauccaaguaaagugucucauguagucuucaaaacagucacuguauagaugggaaacugagguacacagauuuuagguaacuacccaaugucauuggcagcaagcagugaaacucaauguucgaacaauguuuuauguucugguacagugggaagaaaggaagggagggggaaaaaggggguagggggagagagagaggaaagaggggaaagugagagggggagagggagagggggagagagucagggaccaaggaaagaugguuucaguaacuaccaucuggaggugaguaucaggaaccuguguagcaugaaacggcuucuggaucaagacagaauggcugaauaaaaaguaauagaaaaguucuuccuguaagcagccugagauguccugugaagauggcuugacccagaaaauccuccaagaucauucauuuaagagguucaagucuucauguucaucuuaagaacacccacgaaauuggccaggccaacaaggguaugcuuauuugaaaagcuaccacacucccaaugcuugcugucuggcaggguaacgguggugucacuagguuaacuccaagcaguggcacuagacacagggucaguggcucagaaggugugcagaauuuuugcugcaugugcuuaaaaaugcagagugaugcugaccauuuagaugucgaugcucuagucacugaacacugaugcucuagucacugaacacauacaggucaauaaagcuccuaagacacucuggccaauucauggagcucauggcuagauuaacccgaacauuagcucccuccaaacuguuugaaagucagaagaggagguugcauagaaggaaaagauaccccagaugaaaaugaagagaaaaacuuaggacaagggaacaaauucaguuaggacaagggaacaaauucagcauaaaacaaacucaggaaaaaaguuuuaaaaaguaguagaaaagaauugaacuaauuagcaggcuccuguguacacucaucacaccugcaaagugaacauggggaagaguacuagacagucaugaucccagagagaaagaaugguccaggccaggaugcagacaagggagagagacgcuuaucccuguuacugaagcaaccuggagucugauacauucaacaggagaaggcagagaaggcugcaaguucuccggaagccaaagccacggccuuugguugugauaaagaccacagccaagagaaagaaaagaaaagggauggauucuggaaaugcuggcaaaggagaaguggcgacugcuggcgggagcccggauguggggagccagacaguggugagacaaaaguacaagguucuuagcugggauauccuugguagggcgguauuucccacugcgauggaaaaaugaggcagauugggaaaaugaguacuuuuaugcuauguuauuuaauuugccaaagccgaugucaguaaguuuuaaggucuuuuguggggaagaugguuugaggcccuaaaacauggagaagguuuugcuggcgaaugccuugacuuuauagagaucaguggucucgcuugggagcggaagcuggcggcugccugguguggaggaaucugaagggcaguggagaaugggaugugcacagaaugucguaaaaggugaaggagaagcagagagguuguuuuuuuuuuuuggggggggggggaguguagaaaaaaaaacggaauguuaguucuucaagcauggagcaggaugaaauguguaagaagagacuugggaauaaguuauacucuuugccccagguuuuggcucuuucugaagggacaauaauccauugauuccgaguuuauauucaaaacaaagaaauuuuuuaaaaaaauuaggaccuaggguugggcaugguggcgcacaccuuggaucccugugcuugggaggcagaggcaggaaguucugugugaaucugaagucagccuggucuacuuagugaguuccaggauagccaggggauuauagagagagacccugucuccaagcggguugggaggcuguagugguuggacauucagguagaugggaagggcuugcauagcaugcuugaaggccuggauuuuaagcucuuugaccuaggggaaaaaaaucuuccuuccuuccuuccuuccuuccuuucuuuucuuuucuuuucuuuucuuuucuuuucuuuucuuuuuuuuuuuuuuuuuguguguguguguguguguguaaaaauuccugaaauguuucacccacuuuccccauguacugucucuagaacugcaggguaaauacccauguagaaauaagguucuccccagugcucugucuagggcucacccauguuuacaaccaagcagacuuguaagcagcccgggcugggucguggugagcagaaggccuagcccacgggaaggaggguauuauuucagcugggagaagagcagggcccugggaugaggcugauugauucagaccagauggguggccacacaaaggugugacaaaaauagaaacacauugcagacauuccaggcacuguccucccuggccaggaggcggucacagugcuguuccccuaucuaccuccuaaugcgaacuccaaucuaagaauguuaaugcugcugauucugccucuccuguuagcagccugguucuccuguuagcaucagccuugagguuccacuuaaaaggcagaguggccauuguucaggguccccucugaguaaaacugaagcaaagcacugcguuacucccuaaauauguuuuuauuuuaauuuccucaucugcaugaagaccuggaugucaaaacugguuucuguuaccggcucuuaggagacaauggcagauuucuaagugguggcagaauuguaaccacagcuuagaaguuaacucauagagauugcaacucauauaguaacugagaacucucauaagggucccaguagguacuuuagccauaguuucccgaccuccgauaucucacuaggcaguaaggcccugcaguagauagucagaaccauucaguacucugcgccacugucauuugaaguuuaagauuucucuuagauuauuuuggguuucauguuuaaaauguaguaaaauuuaaauuuguagccuaagguaaugauuagcuugacaaggagaaagaaauacaauaaguuucuuuguuauaagaagcccuuucuuucuugaagggaaauucaacaggcaugggaaauuuacgaucauucaaaacuaaaguauagaaauugugcacaaguuugaauauugaucaaaauuagaggaaacuccaaaggccuucugaaaaauaaugcaaaacccacagccuuuaauaccagcugaggcccgugcuucaacaacguaaagagaggccuggucauagcaagaaugagguuuuucucacuuaguaccuuaaguguccuggccuguuuuguccccacaugaaguuuuaguuuguucguucucacaaaggccugaaacuauuaccuacuugcuauaaagcgucucagauuucacugcuguugguuaacugugggcucugauugacaucucuggcucccccucacccccaccccgccccaacauuacuaugaaguccacaaguaacuaccugaagggcaagguagcagacuguuugaacuuucaugucgauguaugacuaagaggccagucuucugaugcaauuagagccaauuaugcauugaggggauugcuagucaaguuaaagagccauaucuauguuauuuuucuuuccauaacacuguuggcccauugcucucaugacagccaucuggaauuaagacuccacaauaagggugaggauacagcucagugcucaagugcccuggguucaauccucuacaacaaaacaaaacaaacaaaacaccccgaacauaaaaugaaauagaaugaaagaaaagagugcacauagaccucucccauguaaguauuuauucauuucuugugucauaauuccuagaaguaauguacuacugauagcucuugaauuuuuccugccaguaggcuggcuuaaaaaaaaaauuauuucugugcagguggagauuagcauaugaaaaaugcuuuuaauuuguccacucugagacuucgcuaucugucaaccccacccaugugacaacaguugggucuaacugaucucucccaccucaacggcagguuugaaacagucucugggcuguuaguuauuggugagcuaaacacaucuaacucucuuugucaaaauaaaacucaauaaagcacaaagacccaaaacaauaggaucugucucugaauagaagaaaugagaugaucguguccaagagucugugaaauggcuuccuuuugacacaaaauaaagcagccacuguagagcauuuucuggcaaucgcucugugagcgccuguguuucuugcaguaccacacugguuuacauaguguccucuguagccaugcuuuuccacuaauaauuucauucuauugcugaucuuuuauuguugagagcuagccugccugacuucacaguuuugauaugugccacuaggguuguguaagccacagcuucacagaccucacgggauaaggguaaaugagaugucucgauguugguaugacugugaaucuucacagauugacaaaugacaagguuucccauguggaaguaccugucaugagguaggccuaaaggggcuaacaugggaugaucugcaagcagacccauagcucaucucauccacucccuuguaaagaaugcgcagugagcacccuuuuacaaguucgauuucagcaaaagaauauagguauaugcaaaguaaagggcccaucucaucuuucuaacuuguagaaugaagaacacugggcaccuugcccucuagagggcaaaagcugggggcagugcugggaaagacguugucccugaggcuagaacgggaugugaguucucacagaaaaauaaacuaacuuggccuacacccaacuagcucaguucuccacauuuuacuaacuugccuauccaauugcugcucucaaaauucaggaauuucauguacugaaaauauaaauucuucacuaaguucaccaaauaccucaaugcauguauagaccucagggauucgauauuugauguauugcuuauagauuuuuuuaaaaaaagauuuacuuauuuuuauauaagugaguacacuuuggcugucuucagaguacacugucuucaaucacacuggaagaagguguuggauucccauuauagaugugagcuaccauauaguuucugggaauugaacucaggaccucuggaagagcagucaguacucuuaaccacugagucaucucucuagcccccuugcuuauagauuuuuacacuaccuuuacauagucacaaucuuccuguuuggagaccuaagaaguaaauagaugacagcuaagugugauguucaaacuugaucuacccaggucauuucaagcauucaaagaggccaggaagcaaaaauggacauauuaucuaucaccuuggguaaacacuggucuugauaauaaguuuuccaguagauguguggaaucuguucaugcccuauugauguuuuacuggccauaagagcuaagagaaguacuuuaaauuuaagucuacaaaaaugggcaguccugaagaaaacgcuagcacaauucuagauaaaauauacuguuguggggcugaaaagugcaugcaaagcaagcugcauuauuagaauguuuaaauauuaauuauaccgcuguguaguaaagaugaucaaguaugagugucaacuaauuuccuaaaagcugcaacguuuacuuucaucuaaacuuccuuuguuaagcuaaacuacaagcccagcaaguuuagucuacuugaguguguuuauuuuuauugguuucugcauaauuuuuuucuaccauaaaccaacuuuaaccccuuuucuguaaucucugccaguauaacuccaauagcacaucauaaaauuccuauaauucuucaaagccacggaguuggaaaggaaaagcuugggcacuuuguaacaagcgccagcuacaagcuucagccaauuacauuuaacucuugcaaccccuuuuaauuugugagugagcagauaaacuuacaaguucacggguuuuuuuuuugggggggggggguuguggccacuucccuuccuauauuguaagcacuccagcaguugcuuucaagucggaagccaguuacauuucaggaggagcucugaaguggaggcuauaccuagugaugguagcucaggaggcugggcugacagaugggaaggcagauguccugagccauaaaaaaucaaaggcuucguaccuuagaaccuuugcugauggagaggagauagcugaaaaguggacauaguucacaaagucuggacaugggagaguucaggagacucugccacuuuucuccucacuucccucccuagaaucuauugcugcucucucucucauuccaaaacagcuacuagaaucgagcaggagauucuuaaaagacaaagggagaacauguguggagggagacacucggguuuucucccgucacccauggaugcccagccaggguuucccaccugagacagauugcgacucauguacagcucacucaugcacaagaagcaauauagaagcucaguguaaagccacuuuaaaagcucauccagugcauacuuuacuuguacaaaauaccuuauucaugacggagcagugagggccuagguaauuacuggaaucaagguggccucagaaguguuuaaaucugcaaggacacuuagagcaugaauaaugcaaaauaauuugcaucuaaauuuuuuaaguguucuuuauucaaaacuaaaaugcaguuccgauuaaaguuugaugacugagagcugagcgcuccuacccacugugagccgucuccuguguguggaaaugauuucagacaguagugaggggaguuugcuuggugcucuuuuaaguugggauuaaguugcacuuuccagcugaacuuucuuuacgugucuuggugacuaccaagucguucuugagcuggccugcgagguccaaguccagauuucaaucuagcccuuuaggaaacaaaacggagccauuuuuucucucguuggccaagcaauuugccaaacaaaauaacaugugaguccaaagcuaauacaacaugacuuucuuuuucucucaucuaagauuuuuguucuguguucuuccuuuucuaucauuagacacaaaauaccuuagauuucuuuuauuaaaaagaauuaggauaucccauuuucuuguaguaguauuucuguuucugugaaaauacaguauuuaauaucucacuaccaaaacuggaugaaaaccugagcacuguuaaugaauaugugagccuaaacuuuuugggggagaguauauaagauugaggagcuaaaaaucaaguugaagaagucaaagauaucuuuguuagagcagccuaggcacuuauucuaacuguaggguaguuuucuucaucuacuuuuugaaaguugaacauuuugaagaugauuuuaaagaaaggauauagccagaucaaauuacauucccauuuuauauauauauauuuuuuacuaguaguuaaaagaaggaaagugaacuagaauuuaaaagaaaaaguauuuuuuuacuuuuuaguuggcuacaccacuagagucuauuauuacucgggcugcguggccagccagccauucccagaauuucacaaugcuugcauuucguuugauuuuugccagcaucuggagaaaacacaauuuaaaagacugccauugucccuuaaauuauuuugcuauaagacuggggacuucaguggccugugugcuccaccugaaaaggggcucucccugggaaggcaguggccuuuuccuugcuguguuccuuuugcuagaguugucaggggaguagcuucccuggcugggagcagccaugacccuccagguaaaauuucaagguaggccacucugcagugcacaggaccuacacuuuaaagacucuugcaggcaaaaugauuuuucuccuguaaacccuuauaaacuguaaagacucccaauuuacugcaugcuccaaagaaggcuuccacuuuauuggaauuuuagaugaguguguuugccacucucaguguguauguuacuuuuucuuucuuucuuucuuuuuccuuucuggguuuugaacaaugaaaacauuuuaaaacucaaugaacaaagauuuucccagcaacagacccccugcccagcaggucaccuaucuuugcgacaguuuuucuuuucccacgcuaaccccagggcucauuugcauaaggucucuguugugacaauuaguuucaggugagcugauuucuaugcagccugcccaagacgaugcacaggccccaggccucccugauccugguccuaauugcgacugacuggcaccagacacaaucauccucuugauucagcaaauuguccggcuaggagcuuguugcgaccuugcaaagcacaaaucauaucaugucagcccagccuauaaacaacaaauaaaauauacucugaaugagcacaauaauguauuuuccauauuuuaugucuaguugacugaauacaaaugauagcaacacaguuuuuaacuuuucucuuagcagaauggcacuguguguaacuccccuauaaaaacacaggaaugucccugcauuucauuucccugguucuacaccccugucaccugggacaaagucccucagguaaaauaacugguugcuuucaaaacuucuguuagcuuuguuguuguagaaauaagucauauguucuuucaucaucuacagugugcaucaaugcgcacauuagcagcacucccaauggccgccacugacaggaaggauuacggagccaguggaauuucguaucuuaguguaacagcacaagcuaggaaagaacuuuccuuaauucuuggaaguccagggcaagaagugagagacuuagcauuaagcaugggcagaauguuuaaggccaguagcuguucuugccauacggccugcccccacacugucucacucugaacuuagcaguauuauauuccacaaggcagcucccuuuaaaacucucugugccuugauagucuggagcucugucugccauccuauugucucacuuagcuacuucccugguauuucuacuuauuccauacucuaaagguuaaauggaaggaaggaaggaagggcaaacuaaaagaaccaaauucaauuaauguuccaagaagccauuugguuucuucugccuacucauauaaaguaaguauacuggcauuuuuuaaaaaaugauuuaguguccuggcauuuuuaugguauuuacuucaggugguccuauaugagcauguguuuucacggugugaaagacucauaugcugcgagcaacuagaaaacuuuucauguggacacuacuguugagaauuuuguaucuuacuucaaacugauuuucccccaagugaaaaauuacauuuuuagcauuccagcucauugauuuguccccugaccccaggaacaaugauucugaguugaguauguuaaaagaucaucagggaaagaaaggaaaagaagagggaaggaaaauauuaaaaaucgguuguuugggggucuuaugaaaaugauuuuauguguaucaugggaaagagguccaccaucuucagguacaugaaugguguacgugguccuuacugcccgauacacagccccuaccacuuagagcagagaauccugcagccuguggcucagggaagaaguauacaacucuaaucuuuucccauuucuugggucuuuauuacuuugaguaggauuuuuuuccaacacagagacaauguugccaaagacuucacacacuaauucaauggaaggaagagaagcaguuggggacgggaagcuucucuucuggaaucccaucaggcaagcuccuagaacaguuagaugcagaaggugcagccccagggaagacucucagugucaagggaagagccauugcaggggccacaagaaaagaccucugcugugaaaaaccuguuaaucaaacuccuggaaacuuggagcucugcagcauaugaacucagggaugugaauuagcgucaaguauguuuugacauaaauguuugaacauaacucccauucauaugaaucauggauuugcugaaggagcagcuggaaaaaugaugguuaccucuagccccacugucacacgucuuugcaguacugugcucgaggaaacaauuuuagccuugccuuuugagagagcagaaaagacuaagcacucuugugcuucuuuuuccauacgagggugccauuaaagucugauggcacuuagaaguucauggguaugguguaggacauggaucggagcagaauccaacauacaaauggagaauucugagacagcaccucaucucuccuugaacacucacuucccauggucuugguuugcuuucucucuuccuggccucuuuuggacaguauccucuccuuccucaccucacaggguuuccacacuggggcucagacugucuuuccuuuccuuuaguguuuucuuuuuuuuuuuuuuuuugaguugggauccccaucuacacaaccugugcugcuugacccucacuuuucaccuccccucccacagucccuuucaucaggcugcuuuccacuggugcccccuuucucugcaguauuguuuccuuucuaccggugacagccaaaauucucucauuagcaucuauuauuucucucguuuaccauggucauuucuuuccucccaaaccaacguguugaccaagucuuuacaaaguuuuauguucaaaacacuuucuccucugaacuucagaaucuccaggcacaccuucuccuacauaucccugcucccugaguuuuggucagauucucugcuuggagguuuuagcuccauauuuccuggguuuggcuuccuugcuacaauuuccauucguuuccugccuuuauccuaaagugcuuacuggaaagucuccauuaucuuucacaucuccuagcauaucuuguguauagucucuuuuuuuucucuucugagauggggucucacuauguagcgcugacucgagcucacaauguaggcuguucuugaacucacaaagaucugaauuaaagggccuguaccaucugguuuaauaucagagguuuucaaucuguggcucacuaccuuuuggggguugaaaaacucuuucucaggggccgaauaucggauauuuacauuaugauuuuauaacagcaguaaaauuaaagauaugauguagcaacaaaaauaacuguaugguuggugucaucacaacaugagggucuguauuaaaggguugcaguauuaggaagguugagaaccacugcuauauaguaucuucuuucaaccuucuaccucuuauuuuacagauauauuucacuauaucugcaguauaugccucacagaauauaugcacauauaucuuuaauauauguauauaugugaagaccuuggaaacucaauaagaccucugacauucucauuuugagagaguagcagugaaccaauauucuaauagccauccaauauuccugagucucacacuugcuucguuuucaguguuucucuguguuccaccuggaacugcuaugaaucccaacaaugauguuuggaccaauguuccugguacauugaacaucuauuuccaguagugaaaaaaauguuacccuuuuguguuccaagugaauaugucugaaaauaugguucaugaaaguauaauuuucuagaacaaagcaauaucuugauuuuuuuuaaaaaaaaaaaaugaccagauaguugucugagucaacauaauuuguuuccaauuauaugaauagaaaacuuuggucaacuuaauauucaaauagaagauuguagacauuaguucagagauagacauaaaacaagcaaugugagaucacaaggucuauaucauuuacauuuuacauaauuaauuuugggguaauuucuuuuauauagguuuuuggauagaugcuagccauuagccaaacuauuuuuccuuaaggccaucuuuuuugaaccacuccgaaucccauuaucaaguaucuacauggaucaagcaggugagagaugaaacuaauccuucuugcaggaaaccaguauaaaauucacuccuugcagcuaugugggccagagacaauccagaggaacuggacacuugcaguuuuugagagacuguucagauguuaaaagacggcaacgaguucaaaugcuuuuuauguuauuuuauaaaccaagccaagcguaccuguuccgaucaagcucaguccugucugaccauugugcagcuggguaugagaggcccagagaggguguguagugcuaaagaugaggcagaaaaugguugaauccaccugaauaaaaaacagggcucugccuguuauauuguugcgauuucagaugcccccagaucaaucugcucagaguaggagagauuaguagaagacacauggcuaaaucagacaugacuucuacacucuuuuaccucaaaaauucucucgaauaaccuaagacuacuauuauuuuuagggacgaggauaguuggcaguagaaaccaacaaucaaggcaggaacauacauaccuuuuauuugcuuccaggaaauacugccauucuccccaaaacugacucuucugccacauccccccuaagauagccagucaaagauagccuuagugucacacugacaguaaaaaggaaccacacaauguuauccugaagauaacaacagaugaaaugcuuccugaacucaguuaugccuauagaacaaccguggaaaggaacccaguccccagaaaaagggacugcucacuuuuccuuaacuguuagaacaauaaaacauccaaguacugaguucggaacacguggccacauaguccaagaacucacuguugcggugagcaaaugaauugaguuuguucuuccagguuucuucacuuguuggaaucuuugucuuuagcauggagaugcuaagaggcaggaggucuuuaaggcacgcagccugaagaugauuggcuugcugggaaccucacugucagcuuggagguaaacaauucucacuggauccccaguaguuucugaaaggagguuguucuaaaagaacaaagcaacguugcucccucccugucuucuggcuuugcugccuggucaugcauccccacuacuguggugguaucagcugugggcucuuaccagaccugcccagagcccagccuuacuccgggacugaaggacuaugggcuaaauaaauccauuucuuuacagaguccucagccucaagaauguuguuauagcaauagaaaguaucacucgggcacacuggguuuucugauucuggccccuaucuguauucuuggcauguacacaaaaugauaaccugacacuucagaguagagaacaucuuaucuacucuggggcccaauuucaagacaaaggaauuaaaaugaaaauagcaucuuguuuuuugacuuggaaccagaaggcugaggguugcacucuggcccuacuugcucugccuccucagucucugcucacugggagaaaucuagggacaugggaucugcuggcuccauuccagucccaagauuacaugaaacauaaaaggaacauaguuugaaaaugaaauguaaaugccagaucauacaaugagucuuauaauaggaaaagaugugcuggggcauagaucagucaaacaauguuuucccagcguguacaaggcucuagguucacucugcaggacuucaacaaacuaaacgauaaggguacauauuagugauaauuaguauuaucauuuaauaucaacuuaaauaugaauagagguauuuuuaauacaaaagaucuuugguuaauuaacauuuaaguuaauuaauucauuguaugugucugggcuuuagugcuguccuacaagagugaaggucagaggacaacuuucaggaguccauucuuucgggagcccuucuacucuggguccuagggauggaacuaaugucaucaggcuugauggcagucaccuuuaucaccaaacuauuuugaucaccuaaauaucccuuuugaaauaaauacaucccuacuauauaauacauauauacaugccuaugcuaagguuugggaggcagaaaaaaaacugaaauacuuuuagaauuauacagucuuuuuuacaugccguaaaccauuucaacaagccauauaugcacugaagaaguggaucaaagguuaaagagaaauggcuucucuugcugaagacgcaagucugauucccagcacguacacgguggcucacaacugucuggcaguccagauccaaggccuucagugcccucauuuggcuuugaagugcaccagguguucacacguugcucauaccugcaugcaggcagaacagucuugcaacacaaugaaaauaaauaaaugcacacuuuaaaggaagcgaggucuucucucgucuuaguuuuagaggcaggcacaguggcugcauguaccuaauccuagcacucagaaugcugagacaggagaaucacuuguuagaaaaagucugggcuauauaguaaagcuuugucaaaaagagaagaacugaaaagagaaaaaaaaauaagcaaagcuaacaauuuagacgcuccucuccaaacaaguagagaaaauauauuuuuggcaaacagcucuacauuuucucccuaucuccuucuuucccuuucuucuccucccuccccccaucccgcagacagagccuuuccaugcagcccagccuggucuugaacuucgauucucuugcuucagcacuccacauccugugauuacagggcugugccaccagcucaggcugcaguuugcuuuauagcaacagaaaaauauacuuuuuaccuuagacuguuagugagacucuggaugaauuuagaucuuugauugggagguuugaguuauucuauccaagucuacaagacuuuauauuugacugaaaaggacucuguccccaaaauaggacucuguccccaaaauuuaauauugagaauaaucuuuugcuguauuugaaacucucuuuaaacuaaaccuucuauauuacacaaaaugcauuuuuauucauuuuuuuuucuccacauggaaaaaaauaggcaauucaguaaucaugggaaaaggauaucaagaucuaaaaucuucuuuuuuagaugggaagaauacgacaaaauuucucaauugcauuuuauaaaacaugggaaucgucacucaguuggaacucagcaauuaauguauuugcuccuuauuuccauaugucuucuuccuaaaacuaaaacuaccuugaucaugguuuugauuacaaaucccaaaaacaauuauggaaaugaucuguaauauaauaauauauuuuacugacugucucagguuuuucauuccaacgacugaaacagagacaauucuuugcauguugaaauguauaauuaucguguauccaaaagggaggguguaauuuucacaucugauuacaagggaagggugcgcugccuggguaaacuuacacuuguuuacaaagagcagugccucugauauuaaaaacucaaaacaugcaaaccagagaaacucagaguagcaugcacagaaaugaacaaaagccuuaggauuuuucuuggccuuacuacaaaaacagagucauuucuuccgagugaguauugacuucugaugaauuuaagacucaaacauuauuuuauuuugaagguucagcgacaucuauauguguuaggaagcacaaacacuauugaaugcuaaaggcaagcuuggauccguuuuaugcuuauaaacuuacuugaucagcuugaaauacagucugauuuucaucucaaggaaacacacuuuuuccuaaaugcaguaucguugcuuacaagauguacuuuuuuuuuuuuaaucucuguucaauuuuuuuuuuaaaaaccuucugauuuaccuuugauaagaucagcuucugcuuaugugaacuuacauuuuagacaaguggaagagaugauaucaaggaaagcccuugcugugauggugacugucagucagugagauuagagacacgagacaugcaacagcagagaggagaaggugcgggaaagguaggagccacaggaacacuuuuggaugacacacaauugcaauugcugugucaccguggcagacuuuucaacgcuucgaaagacugacaauaagaguuaagugugccauucccagugcaccucacaaaaugagcaacaaaggaaaaggaagagaaaagagaggaggaaaggucaaaaucgacuuaggaauaaaaagcaaucguauuuaugccgaaaggaacccaccaaaauguauuuaguuaucaauuuagcgucauaauuauauagaaaggaaugaaugcguuaggaagccauuaagcucuagagguuuucaaaugcagaacucagagcaacccugauuuggcuauacuucagaaauuaggcugacuuuuuuuuuuuuuuuuuuuuguaacuugcaaaauccaacuuuaaaaauaaagacuucaauaaagaacaaaagcucaccaaaugauugagauagaagaauaaucgcaaauaaauaaggagcuauuccggggaaaacaacuggagucugcauucgcugauugccuaaaggauuucagcaaggguugaagcuggacuuuuaaaacagcuaaagcugguucccuuuucuuuaugagagaugucagugagagccuuacagucuacuugccauuaaaucaaaagggaaaacaccugauauaaaugccuuuccuuuuucucagggagcaggcugugcuggggccccugugcaggaguaugucugaaaccagcaagaaguucaagaggacucuggcaguuuccagguaccucagacgcuccccuugccccacacaggccgcccucagcacagcaaucaaugcccagugcccagcacauuuuucacuguguuguuagaguacauuugcuuauauuuugcacaauuuuaauuuaaccauauugaucaaacugaacacucaauaagacccuagacaccguaggcuuauuuaaauuagucaacaugaagcaagcgagcuaaggaaguaaguggaaacuguuaggagauuuaaauacaguggcgcucccuuaaauaaauaccuguuaaugaaagaaaucuauuaaaugaauuuauuuucucaaaaucaaaucaaaacacacagaauaacacucgaggggaaucucuaaauggauacgccauaaaugcaugagcaucuuagauggauaguugcucuggaaagguaaacaguauuuucuuguucuuuaagguugccagaaaaagaaaagugggugccuuugcuagggauacauugucauucuuugaggucaagcagcuaaaacuccuuuuuaaaacauccuuuaagcucugggaacucagggacaaaaccuccacacaacugaguuuauccauuccucaggcaaguuacccaugucuaguuaaaauagaguaauaguuuaacuguguaguuaccuacacaaagcagaaauagagugggugcuuuguaccacguugaaucuucagaauacuguuacuucuccagcauggccuuacguaaauuuaaaagcauggauucucuuacucucauuggcacauucaugggacucaagauaauguuuugagagauggagugccuuuugcugugaagucccccuuacuaacgcaggcagugcugcuaacugcaugcauaguauucugcagcagcucucugaacuuccauagcuuucuccugugagugguugugggaccacaucuuuaacugguuagcucucucuuuucagagggcugaccuagguguuaagcuaugaaagugaugggaaaggagcaacacaccuugaaaucucaaaggaaaaaaaaugccucuuccaaauucagugggcacacaacucacagagauuuuuagacccuuuucauguaguguugccuuuagagggcuuuauuuauuuuuccccuagccuaauaaaagauauuagcucuuuucucaaaacaagaaacagucauaucaugaaucaggcaacuagugggaaacugcuggccagguuucaccccacuaaaauucuaaucuauacuuugucuuugagaauuaaagagaaaaugcauaucagcagaaucuccucucuauuucauuuauaaauuacgagaaugaugcuauuauauauuauuaauuucugcuguucuccaacucugcuacagcagugagcugcggauguuggaacgguguaauuauguucuaguaggguagccauccguuuccuuucaaaaauuuacaggauucuuaaucacgcugcucauuugggugcgcagcagcgaggauggagaaacacaaacagggcacguucguuuacauaggaacaccugcuuagcaugacagcagaugucagucaguaagcagaacacaaaaggagaaaaaacaucaacaacagcaaacucacaccauuuugacucgaugcaagaaaaucuuugcagaagugauggcagcaauggacauuccuucuaaaaacacaaacaggcuuugagaucucaagucuuguccacaguucacacgucaccagaaaagagcuuugcuuuuucuugcauucugaaauggacucuaauucauucuuuauucacuggugaaauuacuaaaauuacccuaccucacuuuucugaccagugaauaugcagugggucagaaauucugaaugacuguccccauccguuauggucaagcaauagggaugguaaggccauggcuuucagccaacuuaacucaaaucccaccucggucacuuaacagucauaugauaacaaccuuaccaagccacaauuuucugacuuauaauaucugugcauaagauucaaugagacgauauacaaagaccugccacgugauacgaugugccugugguuguaagaucugaguauugucaucaguauggccaugaccaucacucugcuaaucauugagcuuucuuuccuauucaacaaauccuuuauuagaagucugggggaauugacaccccagugugucucauggauggccaacauguucuauaguauuuugauguguacaguuuggcaagguuguuaucacaguacucacuacugcuacuuauaaugacagagaggcucuucguuuucacuauguuuuaugagauccauaacugagccacaaguuuucugggcugcacccuucuugaagaagagucccagugaaagggaugugcuuucugccauuugaaaagaugaaaugaaccuguggaagggaugcugcaagcuccugccuugccuuccuauguccacuccacccuuauaacuugaacaccaauuuuuaaaggacauuuuagccuacuuugguguuuuccuucuucuucuuccccauaaugcuuaaaauucaaaauggaaaacagcuaucacacaugggcaaugacuaauuuuccuaaggaauuuuaguauucggaaugugucugcuugugccggacugugcaauaaaggcucccugaguaugcauugacuugauacccaauaauggcugcuaaggagccguuauguagugcugugucaaugauccgugcauugaggacucccugaguacgcauugacaugauagaccggaacggcucagaagaagcuguuauggucuaucaugccaaugaugcgcagauauuggcagggccucuggcccuuccguggaaauuauguagucucugaaggaacugugguagguaccaugugggugccaucagccagcacacaguagcuccauuuucucuucuccuuggguuuacuucaaaagagucagcugagaauggguguccucuaacuucaguggccccaaauaaugucagcaaagcaaauguuuucggguagaaaggaguugcuuauuacuuaaugacuuagagaaagaaacuuguauuguuagcugagaaagaaggggcaaauauuaggggaacauuuuggucaaguuuuaaaacuuuucucuuuucugcauuauaaacuccuccaggugguacauuuucuuggugcugggcagacuuuuuguuauugugauggaaggaguguguuucugagaucaaaacauucaagacaacuguuuuucccuaugguuucaagaguugaacagguacucaaaacuuaacauguggggaaaaaaaaagguucagaaaccuuaggaggcaaaggagauaaccaagaauaaaguuuggauucaugcuugcuauaucaacuucaggcaguaauuaauucacuuauggcauuuacgcgucccucuucagauacuuacaaagaacaugggaauuuuaaauucacuauucagugcaagauuucaaauguucuucauuagaauuugaagcuauacucuaaauugcuuuccguacuaccaacagggagccucauuauguaggacuauauuugaccaccuucuuuacauuuuggaacuguagauuuugaauauuucugguaugcuuaagcagaaucaaacagaauguuuuaaucagcccuauuaacuagccagucuacagaguugcauggccaacacauaggcaagagacccccuugcaucuuacauucugguaucucgcaccggucauaggaaaagagaaauccaagaugcacaggaugauggcaaaccuugcaaaaacacucaagugcuuugcuaaacaggaugacugggacaaagaaacaguuagauuaggcagaaaauagcaaggaugauucugcaugcucauuuccgugagaagaaaagaguccaacuuucaaaaugacauuuggaaauagaggaagauuccucaccccggcaugccaauuagcagccauugggaaaggaaggcucaggaaagacaagaugacguagaagcauggaggaagcgggcguaaugcaaaaaccaccuacuacacacuuaccaccugaccugaaucacacucuuucuucacaacccuagaacgaaggauuuacugugacaaauagagacacugucagguugagcaacuugccccaggucacaugcugguaugaaagcugaaaccaaaauugagcugaaacugaauguccaaagccucacaauucuugaauacccauacugccugucagcuucccugacucaaaggucucaaaggugucauugagacaggaauggggggucaagggggagaaaaaggaaaacaguggggaaaaaaaagagagaaaaagaaaggcagcuaguugauuuaaauaaaaaccaaaacauuccaaguauaaaccagcaaagccaagacagaguagaguuuaaagugguguuacuacaggggcagaguuuucuagcuaguauaauguacccuaaauuuuaaauguacucucuggcuuuaaucaaguuauuucuguaugucacgugcuaaaccauucacugguacuaauaggcaagcaaaacugaagagacauauaggaaccagauauuaaguacugugauaaauguuaguacagaauacauauuugagaaguguuuuuuugguguuuugguggugggaauggggugggaggguaguaguucuaaaagagaaaguauuauguauacuucuucgaaaugaagaaacaaaaagccauaucuacccaucacuguaacucuucccuccucuccucuucucauucucuucuucuuccuccucucuucguuguucucuccuccuucccucccccucccuucuuuuucuuucucaucccagauaaguaaauaaacaccucagguuaaugucaugccuuccucuucucaagagaguugcaucagaacccagaaacugaccuauaucaccuuuguaggauugcuggcagccugaguagucacaucuugaaauauaguuagaauuguuagcaucuucuaacauuggcuuuagaauauuuuucuuccauuucaguagauccuauaaaugagcauugucuccacauccccuuaaguuuaagaacuggagcagagagagguugagaaacacacuugaggcuacacaguaaaugaauggauuagaaacauguaggcaucugagcuuucuauucuuuugcuuaugcuaaauguuucacuccaguguaggaguggggggcauguaagaacaguguaagagcagagcagaggagaacuggaugucaccaguuauaagugaauggaucaagagauguucuuacaucagggucugcuuguagagaugagaacagcggcccgugaugcagcucugagugaggaguaagagaaaggcuggguccucugcguugggaccaggcagcagcuauaaauuccagcuucagaaggcugcacagggaaucuuaaaaagcuaucuugaauccauacccuuuucauacugcuuacagauauuguucaaacccuaccaucuagaaguuuaauuuaugauaguguggucuuuuugaccugucaaagcucuaguaaaaagaggcugcuuuauauaugcaccgagaaaauucuguaggggacagaaacucagcucaaacugugcccuuacuucagcagagguggggucuaggcagagcaaacaguuccgguaugaacugcagcagaugacggacugggaaaccuacuggagagccacgagucugcuuaucaucuguaucucuuaacagacuuuaauuguaaugacaacuuuuaacaaggcuuaaaaauggacaaaaugccaaauuauuguucuuuucuacaaugucaauuaauuucuaaaaagauaaagaucacuaagcucaauucccuuaaauucuaagccuuuuaaggaaggcgaacaggguaaaaauuguaucugccaauuuuuaagggcuacuguuccuuuaaugcccagcugguuuugagauguaauaaaauugacauauugauuccuuugaauuuacaaaugccuguuucauaaacuccaucuccaaagccuaggcaucuuuagagcacugucauuuuuuuuuccaaauggaucaauuaugugcccacguaauccuguuaccugugaaauccaugcauacuucucccauuugcuagaguucccaggcggacaaaccugcauuauguacgcauaaacaaacagcgcauuucccugauauuagagauuguuuucaaagugaaaggcaaucucuugggucuuuuacucaaaagagaggcgaggagagaggagacuggagagaggacagaggcuuguggacagaggaagaagaagaagaagggggaagcaaagacaaauugugccuguuauuucaaggcacuucagccugugugcccccccuuuugugugugugugugugugugugugugugguauguguacauacaagaacaugcauauguauguauuuauaguuuaauuucuaacaguuuguuuaaauuauauggcuuugcuguguuaagucccuuauuugcuccaaggaagcaaauucuucauuugagucuggucaggcuuaucacauuuuuuccugucuuuuuuacuuugcugauaauuaguuauuuaagggcaaaucaugcccaagauacuuuggaacuguuggggaaaaaaaaaaggaaacccaaaaugaaucagcuucuaaaguuuguaagugucauggagggaaaaauaaaaucacgguaacacuuggaacuggcucagggacuuucuuuaaacacacaguccuuuauugaaacaauuguagauucugcuccacuacccgaggagggaaacgccucagugaacuaacaggccuuucccguaccuuaaaucuguaagagcaaacgcuccugcagggacaucugcauauucacgugagaccacacccaccaggacaaauugcuucaagaaggcuuaugugcgaauaggcacaccaacuguggcccuagcaucuccuugcauaaaaaacaacaaacaaaugugcuuuugucuguaugugaacucccugugugagcaaaguacuguguauguucugcaccagagauaugaauucuugcuucauucuuucagccugugcugaaucugauuugccucacuucacugggcgcccagcaguccgguuacacugcacuugcgcuccacaauuugucucuaagagauuccccaaaucacaaaacaucuucucugccauccagugugcuccccuguaugcagaaaagauggucugcaaaauuggguugugcucggagccccguggccuggcccucugcugccauuguguaccaguggucuuaaagauaaauggcuguguguuaaccagauuugacaugcuguagaaaggcaggcaccuuugguccugcgacacagccaaacagaaaacacaacaagcaagccuggcaaagacguccaacaggagcgaaagcacaaaaucuaucacaucauuguuacaaaacauuaccagcuuuggggguugccacaggacaagagauaaggcaguguagaagaucugaaaggucgagaauggagagauuuuagguaauggaagaguuaauucagaaaagggggaaaugaacaccacagagggauuauuuuuguuuguuuguaaggaggaaggucuuaugucaugaacuaagcagcaagccagugcuuuggggguugguaagccccgcugguuugaauggcugucuauuagccaucuuuccaaacucccacagauagaaaguauucuaggaucgguuucucaaggguugaugcucaucuuugcuuuccuuucccaaaguggcuugccgaugaaugagaagaaggccucugaggaugaaaagcucuuacagcccacuuagucucauacucauccugaaauagagaaccuagcugccccacuguaacucugucaacugcuuuguuuccuuuucugaauguccucccagccagugaucacugcugccuguaauucuggaaauuccauggcuacaguagucguuaaccacagacucucuuccuggcucugggcuuaugcccuucuaggcuuuaauuuccucaucuguaauaagaucaguaaauaauaguaucagucucaaagaaucauuggcagaaaacaucggagagauguuuagcacaauuucaaagcucuaccgguuccccaccagugcuggguaggacacuuccugaagguaccaggcaccuguuauaaaacacaaacaugguaaugugacuguccuuugagaacugcuucucauccuacuuacuggagaaacccuagaacuauagggugggagacuguauuccaauucacuuucaaagacuugaucuaagcuucucucuucccaugugcucuguauuccagacaucuuagauggcuggcaauacuugacaacauccucccauguuuguucauggcauccccuuggcugggacaccuucccucacucaacauuuagcacucauguuguaugacaauauuuuccaccacagccaccuugccaggaggucuccuauacuccugacucccagauccuguugugcuuuuuuucuguccucuuucaucccaggacauacagcauacaguuacauguagcacuaccacuguaguccaaugccuucuuucucacuauaagaugagcucugcgagcaucaggcuccaucuagcaccccccaagaauagugccuguggucaguggguaugcugagagcagaaugaaucaacuacacagauucucacggaaagaccuuacagaggccuaaacaggauagaguggccuacucugugauuguuucuacaagaggaaaaacauuuacuuucuaauaaugcgaaguucagaaaacccccaggaauaaaaguagcagaaacggaguggaaaaauaacaguguggaggcuaaggauguaacucaguugccgaaugcuugccuaacgugaacaagaccuugugcuugguucccagcguggcauugaagcaggcauggugcuucacacuugucaccccagucuggaggaagccaaggcagaaggaucagaaguacacggucaaccuuagcuacauagcaaauuggaggccagccugggauacaugaaacuuugacaaaaaaaaaaaaaaaaaaaagguuuucuuuuaugacucugacaucaccuuacacggcaaacuuugaaaagaaagacuuuaagaaagaaccagggagccaagcggcccauggcauuucaguuaagaacaagaaacuggccagaagaagaaacuggccagaaggagcuuguguggcugccauucuugauacaguuaacacagaugcauucuccuagccugguagcuauucuguagccugguauacagggcccuacuugcugguagaccaucaaaacagacacagauuucuacugcagaguuugcaagacugugaggggccuggaacccuacugacaucugugauuugccaagcuuuggagccacuugugaacucagaaccagagcagccugaagcucaucacagugcuucuccuacuccaccaguccccugaaaucugagccaaggucuccaaauguagaucuuaucuucacagguucugaagggaaccugggaaguuagucuuugagaucugccccuccccccacuccccaccccccaccaagguaggcuggaguggaaccuggagccaugguuaucacaauuagugggaggcaagaacuggugaccagggcaggaucauggagugacugugaccuugcgauauuaggugggaaacagauuuaaauaugagagaacugacgcuacuuggaaccaucaacugacuugcuaacuccucuaaacugcaaauuucauuuguauccuaaaaaugacaaagaaggccaagagggaauaugugguaccagaucuggaauagaagagagguuuccuugucuuucauaccgcccugcaaugugucuggccuaccccaaagauagccucagagugaaaucauagcuuuucugugaagaaccaugccgaaccuuugacaugaaagaaucuaaugcuaccugcuccacagcaguuagcguauucucuugaugaguuugccuggauagagagaucauuguacagagugcaagaugaaaaaggacgcuuaggaaacccacaggcucauggugucagagcuguccagagagcucagaaucauaccugaggcccaccuuaaaaaucuuagauuucuauuaauuggagggucaggguaagcagaugaaagcugaauuccuaacauuaggaagagauuuuaaaggcugagugucccuuacuuuagcaguguaaguaaaaguaaaaucuagauguauaagaauaaauaauuuaaaauagcaucuagaugauaaaauuacucauacgacaaaagagaauacuugagcuauaguguugguauuguuagaaagugacaucuuagcugaaagaagggagauauucacaaauggaauucaugcguaaaaauuguuucuggugauaacuuuuaaccagucucacaggcuuauaaagggagucguaaugaugaacauuauaagaaaacuuguggcacuauuagaggguucuguuucuuccuuaaacuuucaaaauaaguuucaaguuggauuauuuauuuauuuauuuauuuauuuauuuaucggacguacuaccugcgccaugaagagauguuucuauuuuauggaugggaggucuucacagccaaccaaauccauauccagugcacagaucugaccucuguaacaacuguaggccugaaaugucugcugcuaucucucuccacguaggucugagauaugugucacacugaaaguaaaaaccugacggaccgagccauggauggcaacauuuauucagcauuugguacaaaugggaggggaaaaaaaaagauacaaaaugcauggauugauuuucaaauuaccucaauauuuugaaaacauuuucaccugcaugcugagaaugcuaagaaaggcaagggaggcaauugugcguuugcauagccuccacugcauucauuuauaaauuaccucaucacugacugaaauuaacacugauucuuacaggcaauuucucaauuuccaaugcuaauuacauuuuuuuuacuuuuaaauucuguaccaccuguuuugggcaagacaucuuaggcagcgcgaccgcauuuaaucacaauuuuaauuaaccgcccuguagaugugaaaaagaagcaauuauaauguagaugaaugaugauuuuucugcauuaaauuguuuuguuucccugguauguugauuguaacacagcacacaaauacaguaacuguacaauuuuuuucuauuguaauuuaguaauuguuuuuggaaaaccaguuugggaaagagugacuucaucuguuuacaaauugauugauacuguucgcucgcugauugcugcagcguauauuuugguauugcacagccuagcauaaaauauaauuagagaugcacaggcugagcagcaccauuuuggaaucugaaaaucaacuguaacugaaguguguuuuccuugagcauccuaguaucaguuggggcugaugaaaugauaguagaaacaaugggcuucccaauuuuacuacuaguagaaauccucgcuuucaaucugauagucuaauaugguaaguuuaugaauaaguccguacuaggccugggagcugggggcuggcaagucugaagcuugcacaacucccucagaucuguaucagaaggagcauacacguaaggcaaagaaacagugauggaggagaaaaaaaaaaaagaaguuauugcuuuagagacggaaagguuguuuucgccaccagucacgaugagcuggugugcuguaucgcuugcuguucuaucucucucuacacuauggugcaacgacaucaaauucaugcuccuggcuugcagauacagaucauuaaagcuguaccccggugcagauaaauucaaagaucuuacuuauaggaagcagagcuugcucuuugcacagcuaguaauggggaugcgggggugaggcagccauggauacuuguuucugaaaccuuaugucaagcuuaugcuaaguagaaggccuaugcuuuacuacucucucaugaauuagagaucccuccagggaugcccuagauuagcaucauaccaaacccagucucagggacucucucaguuaaugcacuucauugguaguacagggcuggugucucccuccaaccauccccugaauagcucugaaaugugcucacuuggacgaguccugagcuaggaccauuucugccugccuggaaaaaaggggaaaaggccauguaagcaaucauagcugcucaaagggaauguuuacaagacguguucuucugcuaggcuuccuuugguaccccauuucuuuagaagacccugaaccaggacaguucacuaaaaaguaaaaagucacauuggucuuagcugggaucuuggcuuuauuuagagcaauuuaaagauagaauguuaaagcugugaguuggcaggacaaagcagagaguguugagaugggguugggggcagggcuauuugaguugaguucuguuugucuaucucuuuauaaauagugggugacaaaauauuaauaggaaauaucaaaccucaugccaaaacucacuuuguauauucacuaaaaaaucugcucuauuaauauguugacagguugagucuuuugccaguuggagacucacaccuauggcucugcacccuucugggaggaauguaaagaaacaaaccacagagcacucugcaagcuaugcugcccacaaguguuuuucccauguaggauguucucuaucuguguaagaaguacuugguacugaugaacucggagccaagcuauagcugaaagugggugggggugguuguuccugucagucuaucacacagccaaugcuaagaaaguaugcucagacaggugggggugcuuuaccugggagauuccagcucugcuuuuaguggcagucucccugcuuguuaauagcuguacuuuugugcagcugugcaagucucucuuugucaccuuccccaucuucauaacagcucaguagaaagaugcugccuuaugaaugaagguaaaaauaacccugaaaaucucaaauuauagccucuuuacauaacgaacagggagugcccuggcaauagacuucaacaacuacauacauauauguaucuacauguuguucuagcauucaugcuuguaaaguuucuaaaagugguaacaucugugguccugauaggcuaugccauccccaccaacccuccuaagaagccauuugucuuggagagaaaauuaaguaccugaucccaggcccaagccagugugaagucucugcaucuucacacucugacccacugcguuccuuugagcagcuagcugcuucccauggcuaccuccucaauauaaacucgcuaacuaaucucuuagcaaacacuugaagcaaaccuggagagaggaaaaagacagagagagaacaaaaaaccggcaaagauaaagccugagacccauucaacaggacacuggaaacuaaauuuaguaccaaacuuaagauuucuuuugaagacuugucuguugucuguggagcgggaauuuucguaccccaaguuuuauuuuuaagucuuaaccuaauuccucugcugucuuaaguaaggcucacuuuaacacaaacuccccgacaguggauaugugcccuacucuuucagguauuucuaaauggcuuccuuuagcacuaccuuuuaaauaauauaucucuuuuuucaaaguucuugcagugcuguguguacacaagguaacugucccuuaggaauuuacgugagaacacacuguuggaaauaaauaaucacuuucagccaaugaucaaagaagaaauaaaucuuuuacucuaauaaggcuuuuuaaaggcugaaaucccauuuuuaaauggguaagagcuaagaagguacugggaguccguuucuuuuccagagcuauguucuaauacugguugcauuggggggugggggugggggggcuggaggagcaaauggacccuggggucuucaaaguuaaagcuuuuuaaaauaaaguugguauguaguagcauuugaaaaacuuauuguucagaauuuagguuuuaauaucuaggaauaaacagagcauuaaaucaagcacacugugacaaggccaauaugcacacgggugacgccaguaaggcaucuccaaccuuuguucacagcuuaacaaaacugugccgucacaccacuuuaguucaacagugccugucgaaugggcaucaacagaucagccaaugccugucauacacggagcuugaagacugcuugaaagcaaggguuuauucgacccccaagucuagcuggaaagagaagaggauuuuaaaucaucugguaaagacaccaggcuucccccauccccccucccgccgcccuucuccaaaguuuaaaacuguagagaagaauggggaaacgugcaucuguuuuauagacauaaagcagaaaaacacguacucugccaaagauagaaaaaaaauuuuauauuuauuuucauugugaaaacaaguuuugcaacuauagaauucuucuuaaagugguauucucaauaggaaaauaaaaaaaaaaaaagaaagaaagaaacauucucacgguuuuaagauuuucgccuuguuuuggggccuuuaaacaaacucugucaucaggauagaagggaauuauuugacaaagagaauuggcaacuccuugcuauucacaggagugucucuucgaacauauguuuguuacgugucuguuuggguugaccaaaaugcauuuugcauuuacaggcuccugguuucuggucucuaugaacauuuaaucugcuucagaagagaaaggcagcaaagagacaaauauuguucauggucccacaaguuaacaauuugggagcaggggaaagaaagagagugaaagaaagaagcgcaaaccuucucauuuucuucuagaacaccgaucaugagauuuggccuucgagcucugcuaaguaccgaggagaugccucagauaauuaagugcacccacuccucuuuaggcauccaaucagaguaagcaaacgugaaccuaggcagggcugaggggcccuaguggugggagguguucugaaucuagaccuuuccugcuccuucuggaguuucaggugcuacugacauuggcccaggaggggcugggguuccccaacacucaagcugaaaaucuuucccuuucucccagccucucccccucucugucagacucggcugcugucaguuugcugccuguacguuggcugucucuucucuagucucuacccugugaguuucuggccugccaauuucaacuugaagcuugacugggcugauuugaugcaaauaccuccagggaaaacccugaaacugaugaacaguuaugucaagucgauuuugcaccaucgggaaaagguaaccucugugagaaaaaaaaaaacaacaagguuaaagagacaagggcuuuucacguguaauaccuccgcugcacagcucgcucacuguuuaccgucccucagaaauuguaacugucagaauuaguccuaauugcagaugcgaaagcugccauuauaauaaaaacagaggcagugcaggcauuaaauguagcagccuaauuugugagacuacagaaaagguagaguaaaugaauauuucauuacuuuaauuaccagggacuacuccuuucuugcugucuuaugauaaguguugcuguaacuagcaacagcaaacauccacuaaaacauaaagugcaauaaucguccugcugucaggaucaccacuuuaaaauacgagcaggagaaaaaauauaaugguuuaucuauuucuuagagauugcagaaguagaagacggaaauucauuuaacaucgggggaaaaaaugcacacacaaaggcaccaacaaacaggguuuagucagagaauaauggcucuaacagagagaagagaaauuucauugacuauccaucugaaaugcuggcccuaaaacaaugcuaggaagcaagaaaguaguauguaucguguuuggauguuuuuaaggcaacauuuuuuuguuguuucguguugcacgacgcaaucaucugaacauuagaaaaugacgcucaaaucacuggagagaacacaugaggaaaggaagccguuuucugagcgauuaaguaaaaguggagaagguucgaguuggcaaaaguuuagcuccaguuuaguuucauugaaaaagaccagauaaagccugccagaaaaaggacuuugccuguaacccgaauaccgguuccuaagacuuagggaggggcaauaaucagucaccccugacaccucggaaaaaccuugcccaccucucuacacugucaacuucaagugugggggaggggaagaagguggaccugggaguggggguguggcugaggaggucgcugagacugguugaagccagccugucucugcauuuaucacuuugucccggaggagguguuuguucaacauagcaguuugacagcacaaaaacacuguggccaggaacccuaucaaagaaccuacuggcacauaucauuuguggccugggauucauggagcaaggcuaccucacucuuuaucugcacaaguauaaaguacuauacaccucuaaguauuuaguguagcuuaaaggucucccucccccuuucuccuaaacacuauaaacaccacuuuaaaguauuaucuucaguuaggauuccagaaugcugaguuucuuuucuuuucuuuucuuuucuuuucuuuucuuuucuuuucuuuucuuuucuuuucuuuucuuuucuuuuuuuuuccuuuccuuuccuuuccuuuccuuucccauaauaacuugcaauaaaucuaggauaaucuauauuaagguaggcacuauuuaaggaaaacagcuuaaaagcauaaagcaaguaauuuauccuacacaauacacuuaagcguagauuauuagauacaagcaaauucaguaagccucggguagcacagagaacaucuuucucuccugaaaucugacugcagaagucuacaucaacucuuccuaucuaugcuuuuuguuuaaaugggucucauuuaugggguaggucuucuuuagaguaaggcuaaagagaaaaagacccagaguuaggacccuaguaugcauucguguuuggguguauaggagugugcagauggguuggauuuaguuuucacauuuuuguuagcagagcaaaggugaugggaaaucuuuaggggguaaccaucuugcuucuagauauuucucccuuaaugggacuuuuuguuaugaaaacacagccgacugaguucuuucuauguaaaccucaccucuuacaacugagaaaucucaugaugugaaacacuuccauugaugugcuuggguguugaaaauagaaacagguacuuccaagaauaggccaauugcaaaguuuccuugauuacagcuacuuggauaugcaagagaauauaaauacaauuuaagcuagcaaggagugaaagcuguaugcugaauucguggaucacgugggcacuggcugcuugaaauguacucacuuguauaugaggggaacaaaaucucagaucuacauagcauguuuuaauuuguugauuuguuaccgguuacuuaucugggggagagggaguggcuacuuccuuguuagaaacacuuuuucuucuucucuaggauuaauuaagaaacacgaaacagucuguaaggaacaaaaaccugauauucuuucauuuaagcaauguagcuauugcugguuuuuauguggaaugugucuuguugucauggaaaaucguucuggguaauuacguacucucaaaagaaagaaaucacuuuacuggagacuuagauucaugccuuccuuuagguuaaguugaguaaacugaccaacucuguauucguuauaugauagaaggaauaccuucauacaaaugagauguaaaaaauuaacuucaaagaauucaaguuaagaauucaaccuuucccaguuuauacuacaacaaaaguaaaaaugauucccggauacacaaagauggagaagaagcccaaaaugggaguuauacuagaauggauucuuugaccuauugauugagaaguuaucugaguaguaauuuuguaguuaaaauaggagaaguaacucgaauauguacaguaaugguccugucucaccuucuuuaccagaauggcagcuucaagucucaguguuucaacccagcucgguaagggaaauaacugcaagcaagggugaaccauucugaugacugcaucccucagucaaaaaaugaaagcaaaguuucagucaggucuuuuuggacauguuuucuccucccuacacuauaugucagaguccuugcuuuccugagucuggcuucugaaagcccacaguaaugucuaagcaggucugcggugcccccuguuccugggcauggcuuuaucagcgcucauacuuucuugggucacaaacaccacgguuaucugaggaaacauaggucaucuuccuucuccuuucucuguucagcuccuguaacuuuccucucagaagccuuuaaaaaaaaaaaaucggcagcuacuguugcucagaagagacaaaguuuaacuucuggguuggcaauuggagaauaauucaugagcagauuucuagcaaaugauaugauuuguuaaauuuuggucuuugauuuauauuuauguacuccugcuacugcuauaagguggugccagccucaauuagaucaugaaugagaucauuuuaauucagccccaaacugugaccugaccaugcuccgaaaguguucaaaaaguaauuguaagccuccuuuugcuuugaaaaggaauacugcaugcuuggucguucauacaaauaacauaaaacuuaauuauuggaugauuuggcagagcaucuucuugccaaacaacagucaaugccagcuacugugacucuggcgcugggcaggccccagcccacagcccccuuguguauggguguuuguucauugugucuuagggcaagauauuucaaaugggauucauggaucuaggacgcaggguguaacccaaaggguguacuguauuuauaacuccaguuaaaaaaugcugucucaccuagaagggaaguagaucugcgcugucaaaucaccaggaggcugugacaaagggagcuugcagccugacacacgguguaacgacauagcaaacaccuuuaauucugucaugucucauacccuuuacuuucucacacauuuauggcugcucgaacguugacaccuacacgcucuuugaaacuaaaaaaggcgaucuuauuuaagcccaaaugcaacaccuguaaaguuauucuugugcccaacaacaacaacaaaaaaaauaaccauuaaccccuuccucauaaaaaccucucugcuugcuuuggaaagucucaagcugcugcccgagggccugacucugagguucacaugaccucucuagcuuugacagauaggcaagaccuucccacugccaugaugcuaggacugagauaauguaacuguccgauuggccuuugcagcuuuucaaguugaagccccuuucuuccucacaaacuucugguaucucucacaguaaggagagagagagagagagagagagagagaccccgacugcuucauccccucuagcaacccaagucuaauauuuuaaaagcuagaaaugaaaauagcuuuucuaaagauauuucuuggaauauuuaaugugcugucuugacucgccuuucucuaucuuuuuuuuuuccuugccaauuauaaaccaccauuuggagggcuuaugagcaauguaaguccaccucaucuaauuaaaccacauuguuuuaaaagcuugaacaguuuucaugucuacaagacuugucugaauaauaaacugcgagagccaggauucugagugucuuuggagagccaggauuucauaugcugacugcaaagggccaggcacucaaagaguuaacccacauugcuggguagguuaauaucacagcugccugguaccucacuuaacaaaagccuccuuuugcaaacagacccccccccccaguguccaaagguguuuacugaaguaaaucugccuaaauccuucauugcuugagucauggggguggauaggagaguggauaggagggguggaaggugcgcagcuaaucucuguuuguaaauucuguaaaucuucugggaaaaugguggugaauuaggaaucugugucacaugucaugugcaauucuuaauguguccauuccugcugcucucagaagugacgucuaccacauagguguuggaacagcuacucaaugcccaaacaguccucucuucuauugcaaagcuuguaugucuaaaguuauguguguguguguguguguguguguguguguguguguguguguguacuguaugugaucuaauuguugaggaagaacuguuaguaucuuaaaagugguuagaagggggcgggggaggggggggggagacaagccgguucuguagcaagauaauauccugaaaaguugucacaagauggaccugcgauugcuguggucuuguucuggugucuucaacugcaugcuacuuuugcauguugaaaauggaggcaaauaacacaggaaaagcugacagguccgccuacgaggguuuaaacaauccccagcaagaaggagcccuuuaggcauaaacuuucucugucaagaaaaaacgugaauaccaccagccccucccuacaaauccugaagcauccaguuugagauacaaaaaggcugucaucucacaaauguuaaacauacuaaaaaaaucugaaaaaaaaaguacggagaaggugugaaagcguggcacuuuacagcccucaaagcuuuuuaaaauagaacaacuuuucccccuaaaauucuuuucagagauuuuuuuuuuccuuuuuggcucauuugagaguuucuuucuuggcuuuuuuccccuuucauuugaaaauaugaauuaucauaaaaagucaggguuggggggggggaaugggaaagucuuuuccaguuuuccuguggauuuuuuuuuuuuucaucuguguucaggcaucaggccccugcagccagaccagggcugggucuccaagcccgcccccuucccgcccacccuccagugcccccaccuccuaggucauaugaugaacaaucauaguuauuaaggccaaauuguaaguagcguucaggagugggaagucugcacaccugaccccaaaucuaacaggcgucugggcuagaauucaaucuuagacuuuuuaccucaaguggagcuguggccacgaauaguacagacaugccaucuuguaacacuauaugccugucaggagggacaggcaggguugagcaucaacuauauaaggcugguaacuagggaaaggcccaacaaacagccacaaacaccuaaguuacuuuacucaaccacuacccucugagccucucccucucucucucucucucucucucucucugucucugucucucucucucucucucucucucucuuuucaucuuggcuuucuguggcagaaugcaaauggagccugccggcggugaaggacugaauugugauuaagaagaagaagagcucuuucuuuguucuucccucaggggauguuuacugggagagacacagaggaucagauaugaaaggcauucaggucagcauugaugugagcgaaagugaaaucauaccuaaggcauucaaaagaccgccgugucagggguucagcuaacggugcagcuacuguguaucuucccagagaggcaaaaaaaaaaaaaaaaaaaaaaaaaaaaaaaaaaaaagaaaaaaauccucccacugacuggccauuucuuuuuucccuaauuugcuacaagauuauaaaagcaccccccccauuuacuuagcaccacaugacacaacaguuaggauuuuucucuccuccaggaccacacagaaaaucaaaccaacuucuaaucauuguauuacauaagugaaacagcaaggcacuauccgaucugugaaauauuuguaaacagguguacucguguagguuacauagaugugugauauacaggggagagugaagaagagagaacuccagaagacacaugcaugaaugacuuuuccugucagcaccuugacaggaaacacaacgcaacacacaugcacacacacacacacacacagacacacacacacacacacacacacagagagagagagagagacagagagagagagagacagagagagagagagaacagaacaucuuaaaaugaaauuauuuauuuuguaauuacugguuacacuuuuccugagagcuuuagcucugauacaacugucacccgagauaaaacuaucuagcacaccgcuuaugaaggcaaggcuuucuccagccugaugauuauuauuguccuucuuuaaaaacugccugaugaagaaauccuuggaucuuacguuuaaaaguuuacacucccuacagcccaaacagucauucaauagguuuuuuccaagugguaagcugaugauguuggcacaaacagagcuauauaaauauauacaaaauucacaaaucacagcaaacacacuagcaacaaggagguuccuggagguuccaaggcucaaagauuaaaagaaaaaucacauuucaucuucugguugcuuaagaagaaggggaacugaagacguggggcugcauuuccuggucuccagucauccuucccucugcucuguguucuagucuucaacauucacaucuugguuaaaaagcauaucugggcuuauguuaacaucugcuuuugugcugacauuuuguauauuuucaacuaguguuucugcaucacagauuucccuccuuuaucucuuugcucuaaaaagagaagcaaagagcaaucaaaaaggugucugacuuggccauucagacaauugcccccuugugggaacgcaggggugaaugguacaguggacacccaggaccguugacguuauaaacauguaaaugaaacacauuagcgcagacaaucaauugucugugagcacugcaaaccugcacucccucucucugugacaggcacaaaauagugucuaccuugggaagccacagugcugaugaagaauaggacaaagaaucuccuuucacauagagaaaaagcaccuucagagcuuggaagaacgcagaugacaaagagaguuguaaggagaagaacucccacccccggaauaauuacgccccugauagaaagcuaacagcagccuucauuccuaccuucaagggaagcacacacacacacacacacacacacacacacacacacacacacacacacacaccaucccaggaaaauaaggcauuagagucuugaacgaccucuuguaauuuucuuuaagcaaauuaagaaggaaagaacgaagggaagaauccagaaucuaugacagagcaguuugacagggaacuacagacuagguuuucuccacauucgaaaacaaaugcuaaacgcuaugaaauaauuuuuuucuuguacuugacaacagaguagcauuacaaaguuuaaaaccugaagccuaccccuaucccugguggacugccacagcaaggaugccaccgggcuggcugcuggcucugcugggaagcaaagcacgugucuaccccaauuggcaucgucuuuuuccagaccaaaauaaaacaaauagaucagucuagauacauagcccccagccuugugugugcaguaucuccauggagagaacaggauggggauggaucucucuggaguacccucagagcugguaccugccgcacagacagccugacugaaaagcaggcgaacagucucccugugacaagcucaccaacuuuaggaaagcaacuugccaaagauuuccacaguggcaaagauagguaaguugugaccaguuacaaccugaaggacaccauccugcuucgaugugauuagagggucugucacuuccagcugcccaucccaacuuugccuaugagggaggagaguggaaaccccagucuaagaagggguuguuugauugcagucgcauuucuuuccauuuaagcgacucugcaauggagucgcuucuccacuccuccaaugcccuucagcagcacugauagaaccuccacuccuuuuaaaagagugagaaggagcaaagguuucuuucaaacagggacaaucauuucugcucaucugauuacuccuccccgagauauucaacuugaguacuuuccuuuacaaacugaaaaaaaucacagagcaaagguguuuggugaaagcagcccuguccacuacaccccccuccuaggcagcccauaggacccaaaccuuuagcagaaacuuugaaacaaaaucaagcuaacuuuuccuuccuucuuucguuuccuucuucucccuuccuaauucauuuucuuuuuccacucaaagagaacuucauucccuucucugagacaggaagaccagcaauuucauuuuuuguuaaaacacgcauguugucugugugauuucccagagacuggugguggaagccgggagacugggaagguaggccuuucuucccagauggcuacuaaucaugaaggaaacuggagcauucuaggaccugcugccugaaaucaggggugaaagcaacaaacuuugcaaguuucaaaccggcugcaagugguggcagccugcagcagagccuugccauucuggagagcucuuuccugcuuccaaggcuguguggagauagugggguauaaucagaggacuauaaaggggggggcuggcucucccccuccucucuagccuuagugaaaguguuacaaagugagucaggcggcugaggaucaucugacugaacuuucuugaaaccuacacucauucuugucugcuggcuauuuauuugcuuuuuaccccuuucccuaaucccaccuccccuuucuucccugcacaucugauuuucuaggaaaagguuuccugcuuucccugugggugaaaggagaggaacuagccauucuuaacuugguccuggcacugucuuuacuaggcaucuugcuggcccggagaauauuggugcuuggauuuuuuagauuguuccucucugucuauaaugguauccccugaucugccucucucgccuaggcuuuuuaaaaaaaaaaauaauacuucacaucaccgccgucuaagccaugguuuugaccagccuuucaaacacacaggcacugcucugccguuuucccuuccuugcccccccccccccucucucucucucucucuccccccccucucucucuccacacacacacacacacacacacacacaccagugacuucauuaaaauuauauaaagugucauucuaggucuugggucuuuuuuuuuuucucccuucgcagcuucuacgauuauuguugcuauuauuccuuuucaggaauuucuauaugauguugauaagaaucaucauauuuaguguuaucagcaaagacacaagcucaaaagugacaucuuuuccaggaauccgggaaagaagaaaaauccacucaguccagauaaauccuggcaauucccaaaggaaaaggcauuggguauguauuugaugagaaagaaaaugaaaaagauggucugagcucuucuaccugcuucucaagaccuacacacugcuaagucagauuaaacccaaugaaaacacuggcaaguaaguccccagcuuacagccuguuuuuucacaggcucguuggaaaaagagacagguaauaguuucagucagagaaguuguggacaauccacagaccugcuggugaauguuuagggucugggaagaaaugccuaaaaaccaucaaaguucaacuuuauccacuucagaguguggaagcuugucccaaauuaauggcuggucauaagagaaauggucggucucucugaccgcaccccucccugggacacuguauuaccugugaggccccaguagcuugugccaccagaguucucaggaagccagaaucucucccaguccccaaacugggcuguggcuugaccucacugcuggagccaaguugguauuucacagcaaaaucaugaagggaguggaaggaggaagaacaggaagaaaugaacacuucaaacauucuuuacugcaaaagaauacuucugguagacuagcuuuaaaucucauuccucucucucucucucucucucucucucucucucucucucucucucucucacaucuucaugacacaaagcuuuuguuauccagaugaucagcacagugcuuuagauucuugugaggggggaagccccacaacagacauugauuuuagaaaaucaauaacuaacauuuaauaaagggaacagaggaaacacgagagagagaggagaggggaacauuggauguaauuuuagugucuacuaaauuacccagagauggagaaggggaggucuccuguguaagaaccaccuuaaauaaugccaggcagcaaugaagaaaaaaauuaaauuaaaagaaagacacacgcacauacuuaaaaagaggcagccugaacggaaucuuggggaccagcuuggaauauauuauuguccuuguuuuuuuguaauacuaagccaagcaaacagaucaaagacagcacaaagaggaaagacagggcaacauaacgaacaguuuuugacuaaaauuccucuaucacccauauggcuccccaccuccaccacaaaaagcaaaagacacacacacacacacacacacacacacacacacacacacacacacaguggcacgcacgcuaagagacaggagaggagagagagggagauuauuugucucuaaacagaaucuuuuagucuuuguguuuuacucccuccaggacccuaaacucccacacugcacuccccccaccccccaacccucugcaugcggugcagcauuggggcaggcuagaggagcgcacaauuguccucucugguggaaaguuguuccaagugggucugaguaguacccaucaggcgcgggcuuggggagcgauccccgggugugugcuaucacccuagugcccagcucggaagcgucuagacugcccgcgcccgguaagcgggcugagagcgaaaggagaaugaaguuuccuuuccgauucugggcuggcgcggcuggaucgcuuguuuguuuugaggggcuguccccccccccguuucuuuucauuuuuucccuuuaaaacucaguauccuccgucagcauccacccccugcacccucugucgucccccaacucucuccccucccccaagcgccuucugcgcacuugccaaucacuuuucucuuuuauucccacgauuuuguuugaggguaauaccuagggggucucucucucucucucucucucucucucucucucucucucucucucacacacacacacacacacacacacaccacacuacacacuuuuacacagcccguuuccaaaauggaccuaaacucucacauacacaccccuuuaaucugccaccucuggucugcuuguucccucgcacccccaucucuuuccuccuuccugacucagccuggauaacgggcuccucccggcaguggaggagcaacugccgggaaaagucucuguucgccccgcucucuggcccgcagcgggccccgagccugcugcagaggagccggguccccaguccgcagcucccggcucgucccucuuguccccccaccccccgguuccccgcgucuggccagggccccgcugccccgcgaaccguuacuuggcgcacagagaggcggcccagcgacuccagcaagaaacuuugaggcuggcggagaggcagccucggguccccucccuugcccucgccgcccuccugccacccucgcccgcccgcgccccgagguccagcgcgcccgagcgccggagcccccgcccugcccuagccggccgcuucugccgcggggccggggaccugcgggccggggaacagagagggcggaggcagcgggggugccggggccgcagaguggggagcagguccgaucggcagcgcuccgagccccccacccccacccccggcgcccggcgcucacuuggccccgcacuugcucaacucccccccgguccagcggccgcgcguggggcuccggcgcuggccgcggagggaggcucgcccgcgagccccaggcgccgccaccggcuuccuucucccugucccccccuucccccuggucucgggccgccgaguggcccggaaaaguuugguucgggccucuucuuaccguuuuuccuccugggauuggcuuguuugcgccucuugcaccgggggccauccgccaugaucggcugcuucauugauaagagcggaucagauggcaguucgcauggacucggcgcccugcuucggcagcacgcaggcucgaucuagcaaccaaacacagcgacaaugugggcaucguccgcgcccauugaaacgcgcgcgggccgcccaggggauccgggccagggcccgggugagcacccauccgcgcccccagcgccaaagcgaaacuucggcggcccccuccccgccccccacccccagccuuggccccgaggcgcuuuguguuguuacuguuugguguguugcacucgcgaggggaucagagacaagaauuacaucuucaaaaugagucauaacuccugaccguaugagggaaugcacacggcgguacaguaagacugcuugacucaaggcuaggcggaccucuuccucagaaaaguccucagccgggcucgggaacuuggagagggggucuuucgcucucaucuuuucucaucccuccuccgacccccccauucccaagaggggaaaaaaguaacaaacaacgcaaaacagcccuuggaugaagcacacucggguaaauugauaauaguaauuacaggaagcccacucgccccgcgaccccuccccuccccuuuggaguuuaucgaggcacugucucuuucccuacacccuccgcccccaaauuaagauuucccauuuuacccggcaaaagaaauauaauuauaagccucucuggacauuguuccucccccaaccucaccacuuggacaauauuuacuuaagccccccccccccauacacacguuuccccacacugauuuccuuaaauucuuccaguagauuguuuuuuguuuuuguuuuuguuuucuuccccucucaagaaaggaaagagaaaguccguggccacuauuuaaguuguucuaaaugaucguguccuuuuuggcuucgaaacuuuuguaccuaaaaaucgagggaggcgcugcauucuuucagcucaaacugucaaaacuuggagaaggggaaccucggaggcaggccggagaagaggagagcccugaaacuccgcggggugggaagacgcugugccucgaggauuaguuuaaacagcgggcuauaaaagauguaacagaugcaaacuguaacacaagggccauuaacccuuucucugccgcccagcacgcccagucccuacacccugcaccuauugucuccggugccacaagcuuugcggaaaaccuggaaagugaguaucaguuuccgcacauuugcugagcgggggugaaggggggcagagagaaggggaaguggguguuguaggaagcacuuuaaauuuacuuaggcauacagaguaggcuuuccaguuugacacauuaaaaaaaaauacaaauauaucauuuuuugaucuguccuacuaauuugaaauuguugggggggggggguccuggaauaaagaaauggucacacaagcuugugggaugaaacagcugucugucuguauuucugcugagacuuacaaaccacugcauauaaaauauauauuuaauaaaauaaguugcuaguuuuaugagccagugugugugugagggaaagacauggcauuugugcuguaaacuuuauuugugaauguuagucuuaacucuggaguaagcgaucuugcccucaucauuacaggguuagcaugugaaacauguaaguaggugggagauaaacacguuuauguuagcugagcucagcacugugccugugacucuugaacuccgacuuuucagucccaaagucuggaauggugugguguggugugguguggugugguguggugugguguggugugugugugugugugugugugugugugugugugugagagagagagagagagagagagagagagagagagagagagagagagagaggaguuccaugaaaaaucgauguguauauuacuuggucauuuaaaauaaaauaucaaaaguuacccuaauuuuaacccuauuauccugacagcaguuuucuucccagcuguugcgacccccccucucccauacacuuugguaaacgacucaaguuccaagagaacuuucacuucuuuauuuauaaucacagaagugagguguuacuucacacacacacacacacacacacacacacaaagaaugaaauaaagaaaugaaacucgcuaggcagacaaaaacagucaaguuucugcuuagaaaacagccuucuccggugggaaagguuagacuagucugccagaucuaagagaaggacuugcucccgaauuugguaggucuuucucgaauaaguuuuauaauuauuaacagguauuugccaaguuuuaauugcuugauauaaugaauugaaagucggugugagaacaaagcaguagaaacucuccacuugaugaguuuuuuaccccagccauucaguucucaacaaaacuuuuccuagacuauguagcaaaaaacaccuuugguuaccugaauggacagguacagggcgaauuacugggggaaggggaaaaagggagaggaaaggaaagagagaguaagggaaggcaugagaaagcaaagaagccacucuugggaaaagaaagccugccaccaaagagcuaaaaccaccugaaauuccuguccagagacacccggcucacuucagacuaacauucccacucaaaaugagaaaauuagagagggaggguggggggcaagagcaccaaaaaaggauaaaaagaggaggaaaagaaggggggggugggaaaccuaccugugaagucuuguuuguaguuuuggccagaaauggugagaagaaaaagcaugaagaagccgcgaagugugggggagaaaaagguggaggcgaagaaacagcucccggagcaaacugaacaaaaccucgccaagagugucuggaggcaggaccguuauuccugccgagcagguuagaacugaucucuuuucggccacuccaggaaacacaaaccuggggacggacugacguguuacgccucuucuaaugacauuuuuuucuuuuucuuuucuguaggggagagaagagagacccugaaacacgcgccaccuaucuuuguggggagggauaauugaagcgcccugagcgugagcaucaugugaaaacgugaucgccaaguuucucucugggaaaggaucugggauagauuauaccuugaagucuccgcaaacgcuuuaguggaagaaaugaaauucca

SEQ ID NO: 12067 - RNA, 18674 nt, Mus musculus
ugacaugguuacuuuuuuauuugaagaaaaaaaaaaacccauacguuuuaauaaauacuguggaaacacugaccaaacaaacauacaaagugacuucaacauuaaaaaaaaaaaaagcaacaaaaaguucugcuuuauaacaguuauaacuuauuuucuuuuuacaauauuuaaauacagaaagcacuugccagcgauuuuguaauacugcccaaagcauaaugcuguaccagucagagcguauuauguugguaagaugucugaguuucaugggaaaugacugagauggcauuuucuugcagagacaaaacaaagcgcuugugaagacacagagcuggguguuguaguuaccuucaccuccccuucugccgcgguuuaagggagacaccgcuccagcgcuucaaaaaugaagcgucaucauuggggaaaaaaaaaaaaaagcuuguuuuuaacaagcaccaacucucaaagaucguaaaugauuucuucucugaaaggaacugcucaaaaggagaaaccuguaaacuauuuuaaaugcuuauuaucacucuggcaacgaucaacauuuucaaccuggcccuggccauguaugguuaagugagguuuagcagucacuugagaaacgcccuaggcucauaccagggcagacauuauaggcuucuuugcaaacugggguuuacuaaagcaugagcaaauggggguuuugccagaacagcauuucuuugaaggaaguggcaccagacgacagcuuacuuucuguugcuagucuaggggcaccauccccagacacgagugcuuuugcucuguguauuugacguauaauuuuguuccagacagccccauucaccaacugugcucucggcuacuacuacuccuucauucaaggucucuccuggugaaaucggcaaccaccugccucuucuuuaaucacgcuaucacaucugacgaucacaucuuuuauuugacuucucguuuucaucaacgauggcaaaaagaaaaacaaagccacacacacucuucuaaacagcgcacaaaaaauauuacacggaacaauuuaccacuuguuaaggacaaucacaaggaugaacaaaaccaucagacagaauaaaaagcaacacucucuucuaguugaucuacgcaaucucuguagugcuggucuaugcaucuuguaagggcucugaagcuugcuuucaaaccaucuugcucagcagcgaccuucaggaagucaagauuucaaagccgcaucaaguuuuccucucgaaucccagcgggucccaguacaauuuccauuuuaaugaugagcuaggaggaaauuagaucgcauccucuagaaaacuaaacgcuaaggucacagugcgaguuccccaaugaggacggucuacuaauauauauuuuuuggaaaaagggauuaaaacauugaaaaacgaaaucaaaaaguagagauccacgaauagguuguaacaaaaccacaaacacaaaaccgaaaauacucaagcaccauucagagcguggauguucuucuuggagguacuggcgucccccacuucucuagcgcucgccuguucauagcucccuuuguuuuuggcggauuuuucaagucacacuucuugucacacaaaacucuucaaugcauucgcuucucaccacucggucuacaugccgaaacuaaggacaggauuccgaaaaguggguauccuuucaagggccuccuaagccuguaucuaugugacuuuggcugugcacuucauuugacuccaucuuuccgguuugcuccugcuuuuuacauuuuuuaauuugaauuauuaauuuuuuaaaacaccagauauucccgcguccuccuuauagacggcgaagccucacaucacaguacagcucuucgcuuuguccuuucguaaguccguagcaacugcugagaguucuggucugcuaggcaugugcgaaauccgcuuuguggcccucugcgauuuguuccgcuuaacguuuuuauuugucuuauuuacacacgccaagguggcgacgugaaaaaugucucugacgcuguuuucugacuguaaagcugagcauucuauguaaguggcugcuccgaucugcuuggccauauuugcccccugugaaguaaaagaaagaauuuccgucagcagcgagacuuuggagagacacuggaaaguguugaaauaccacaaaacugucuugaauuggaacauaccuaauaugccaaauggacuucccaagugguguucaaaauaaaaaacagauuuuauuuuaaaaugaguuacuuuguuacuacuucccaacugcugaagacccaguccgaaggcccugaauuauauuacucuguagaaaccccucuagcuccccacagcuucuaguauggcgauuugcucuugcaagagaauccaagcauccagcucucacuaggaggaugcaaagaagagacaggugcaaagguagcaguugacccucagugaugcuuuaagcagguugugaguaaccugcuguguagguaucauuuggggccauugugaggcauggucucuugcuacuggaguaagucuccugauaccauaaacauccuuccuauagaucugaccaaggugcuuuggcccucagaguccucgccagcauuucaggaggcucucguuuucucuuguagagacuauuaaugaccuucaaccccagccaacagguuguacaaaacauagggcugacagauguuacugaacaccaauuuaaauaaaaaucagcuucuaagauuguauugaguuuguuaaugaggaaugcaagauaaagaugaguauaaugcuuuuacucugcacuuuugucacacuggggaugaugggacccuaagccuuucucaugcugggcaagagcucuaugacugaucaauguccccagcccuacaauagaauacuuuaaaugaugcaugccacauauaccuauuuuaacaggaacccucuuuagaaucugguggugaguuuuaggagaauagauuccucaacagauucuccuuucuuugagugaacacucauaucacaaaaaacaaucaaaagauggcaucacagagugaucuuuuuuuuuuaacaauggcuuaauugaggauauuauugggcaagagaacaauaagcucuuuuaagagaacuaauuuuaaucacauucucucuuuaaaaacacugguguaguagaagcauccaagguuagcaccuaucaauuguuugugcacccuaccccuugcugacuuuugcuacagaaagucagacagcuccuauuccaguugacuccugcuucaucucuugaaaaagcgcugcgucucauuuaucacaaauaauaauucucuacauauuuccuuucauuuuuauugaaaggugacuuuucagggcuuggagugauggcuccgugguuaagagagcccuggcuacucuugcgagugacucagguuuaauucccagaacccacaaggcagcucacaacugucucuaauucuagauccaggggacucaauacccucacacagauaaacauucaggcaaaacaccaaugcacauaaaauaaaaauaaauauauccuaauaaagaaagaaaggaaggagaaagggaaggaaggaaggaaggaaggaaggagacuuucccacagugacaacacacuuaccuggucauaugacacaggagucugccugugauuugagaguuccacuaaugugcugacaucuguccgcagaucagacuugcagcccaccaacagcaucuugguauugggacaaaacuccuggauuucaccuuuccacuagggaggagggaaagaaaaauuaaugaaguauugacacauacauauacaauaaaaacaauagcuccccugacagacuuugaagugcaacuuuaagugaagaagccagguuauguuggauuaauuaguaaguggguaccaaacuuuagagacuguuguuauagucugugugacuccgugguuccucccacaaugaacuuauuuuguaucaacacaagguaacuucaacaaugucuuaauuauggagguauuugaaagguaaaagcaccuuaauagucacaauccaaauggauuuuacauccugggauauacugaguuccuuauuacccagccuaauauauaguaaguggaagggugggcauaaggaauaggccacacuagcaaaaaugugcauucacacacuccaucaugacagacuaggacaugcuugcuuucgugugcuggccucccgugguaggucagugucuggccuaugauuacuaaagcauagugucuugcuucaaggaucuuccacucaaguggcuggauggacacagacuacagcuuaagcagagaacuaccucuugacaucccaggacagcaccuaguuuauagcccauaaagacuuugaguuaauuuuuaacugucagccauuacugucuagucuacaauuuaacuauuuucuguccuaacaugaaucaggagaacuuugagaaguuucuggaagggauuccagcugccucaagcaucuaaacagcugaucaugguuuugcuucuucuaacuuguguuuuccaucaucagaugagcaacuagagggguugagacucuucugcccacacuuaugaugccuuuggugcucuaggaagaauguaauggugguggagcucugacuuucaggaauucacagagcagaagaggcaauaaagauuuguaagucuaauacuagguaagagggacauucugaaagagugacuuaggagagagaccucgagaggcuaccuccagaucucaggguguagcugagccaaugacaucuaguucuaaagugcuccagcaugaggagggcaguaacacaccgagugccugaucuguccauugagccuuuccuuucuuccucccuccuacaauuauuuaggaacaucuagcauguucuucuaaagaauuaaaaaacagaauaagacuuaguuuuuuuguacuuuuucuauuuuaaguuacuuuaaacucuugacucaauggacuuuaagacucaauuaagacaaaacacagaugaacuaaguaaguuauggugagcuuuuaagccucacacaaagaaaacauacuaauaucuacagguccaaugucacuaucugaucuuaguaaauaaaaaucaaaguagaagaggagaaaagcuuucugacauaaauuauguauaagcugguacuacaucagguacaaacaccagugaauaaguggccccuuuucucuucaaacacagccagacauguucucagcuugugauguugcgagucucucucuaucuguuuacaggaggacaagaaaguuguauucccugaagacaggaaacuuguauucuugacagaaucugacaaaaagccaacccucuguuuuauacauuacucagaacgaaaagguguuacaaacuaaaaggaccccuugaucuaucaagaguucaauuucauugaacugcuugcaaucaauguuuagcaaaaaacugaaggaaggcuauaccucaaaccuaaauuugucuacucaggcaauuaaguaccaugaggaaaaauaaacuaauaaaaauaaaauaaaaaacccacccaaaaugcaaaugucacugaaaguagaaaccaaaagcacacagcccaaauggaccaaaccuggacaucuacaggggcacuucucccuuuaugcuaucugcccucaugcugacaggaacacagggacaagcacugagugacauucucuguuccuauccacauguacagugcacagaaaagaagggguaguacagcuagagucucacucgcaaaccuacaacaccuagcaagggugagugauuaagaugcugccccaucuaccagcacauauaacccucuagagcuaccauggaacaaagccuggguuugcugcaggccaagcggaaucaccgucccacugaguucucuggaacucaucuguggaaaguuccuguaacuacccggagggcccaguccucugcuggggaaggcucagcaucacucucuacacacauaagcaguugccuucuuagaccucaagaccuaugugcaacagguaccauuccuccuagcccugguuccucugucuacagcuucuacuggucucaucuccaccuauaaucugacccaccuuuguuuccaguaaccagggcugugugauaacauacauauuugguguaacuggugcuuuauugguagacauuuauuaguagacaucggaucauaauucacauugcugcaugucuagggacaagccccacuacacauauuccucuuaugcuaauuucacuuauguuucuauaaauaagugaacuaaaguagcucuuauuguauuaaggugacuaucugaauugagaucaacagcaaacaccuacagagcagucugucaagcaaaggaaugaagggaucagguaagagcuuacuguagcuauuuccuacguuuucacuccauuuccuccaaaaaacgaacgaggaagcugugaaaaguaguuuguucagagcuuugggaaauaaaguuucaagcagauuaauuagugccuuauagcaagcaacaauguauaugggaauguuguuuuaguguggaaguauccuuucuggucuuuucauuagaagaaauaaguucagaaucuuugaauccccuggccaaucaccucucuccaacccuaucucaucgaaaguucagggugauagccucguuccucagcacuuaccuuuuuuaagacacuguccagagucucuggucuacugaugucaaagcaaaugagcacugcaucagaaucuggguaagagaguggacggacguugucauaguaaggagaaccuaagaaacaaaaacacacaggucucagacagaaauccccacugucuaagaggcacuaacucuacccuuugaaauaaaccucuuuccuguuaaaaugcaacaucccauugguccccccucuccagccuccuuccuguaaggaaaugcaaacacauccacaaaagacagguuaguaauacauucacuuuuacuaggagaucagagagcuccuaugcaugggaccucagcuccugggaaggucaggaaauuaaggugcaauugguagagcuuaagaauuagagucaaaaggguuuuagaugaacuggggaguauguggggccaggugaccuugaggacaaacccauucuccucacagggagagaagcccaagucuuaaaagugugugcuucugauucuucaaucaucaggggaacauggugacaaccuauauccacaggaucuaagcaaaccuagguagcagcuggaauuuaggaagagaugaauacauauuaacuagaaguauuguggcugguauggcuguggucaaaggucgaguggcauggcagcagccacuggaaagggagcugcuuccucggaaaaagauccaaacucaagauuagcccaauaguugcaugggggaggggucagugggggagggcaaguuuaauggugcacaggaagccagagcaaagcacaccggagugucacuccauccccaguuacaagacuggauaagccauugaccuuugugccugcuuacacuuaucccccagcucuguguaaguucacuuccugcuacaccaagaaugucauaaaugccauguuggaucauguugccuuucuacagagucccuccugcaaacaugacugcaggacauaauccaagggcccucgccugaguuaaacucaagguagucuaaaaguucaaauugacagucaaucaauggaaccacagaacuuucuggaaauuuaagauuauuuucucucucuuucucucucucucucuuucuuucucucuuucuuucuuucuuucuuucuuucuuucuuucuuucuuucuuucuuucuuucuuucuuucuuucuuucuuucuuucuuccuuuuuuuuuuaacaucuuuaugaguuccaaauguugggaauucauacaaggccaauaauuacaaaauagauugacuauaacacugaagauaacuugacaacugcuacuuuuaaagaacuauuucaucauauaguuauucacagacaccaggaagaucauuuauuaggcaaaugcaaauacgcuaaagauuuuuuugacuuuugauuuaguuuugacauaauuuugcauuucuggcaggaaaacacaacaugccuucccuaagucaaaacuuuggugguccaagucagacacacagagagaggugggggauggggggagcuauucaaagaaaugguuuuagucagguccaguagcaggguaaagaaggauugcaauuuugaggccuaccugagcuguagagagaaugcaagauuguuuaacucuccaugugaguacacuaguauuuccaugcuccuucuccauugagcaagagagacaaugucucaaagaaaaaguacaaagacaucuggccuucaggagucuguugucucuuccuagagguuauuguaguuagugugugugugugcuaggcucugggcacucaucgcugcaaucccuacccgcacuguguguaccucaguucugcuuuagagauggagagucugugugcugagcuaggaagaugcggauguccuaggaaccaggaaggaaugccucagcagugaagaaaggcuaagaagcucucagacaggucagcagccucccacuggccugugggaggcuggaagugagguaaaaaacccugaaugaaagguacucccagagagcuaaggccuuaguugaaaugaauaagaaaaauauguaauguguuucuaaaaaugacaagcaguggcuacccuuucagcaacuugaagaaauuagaggugagaguaacucuaagguggacacuuagaauucacccuaaguuuuucuugaaaggcaccagaaagggauggcuuuacccucuauggauacacugauauuuuacauuaguucugcagcucugacucucuccacuguaaccuuccuuguuugccuguccaaagucuaacuuuggcacagcugcugcugugagcauuagaauaucucuuuccuaauagccugccacaaaaaaucccagacuguacagagaagaaauucaaaggaggacagaggaggcucucuucuguucuucaaagcuagcuccaacgaccugacccgaccuacacugucagagucagccuacuguguaaagccaaacaggugucagaaagcucaugucuuaugcucuccagucuagaccuaugggacaugauuagaaucuggaggugccaggcuccuuuaggacgcugccugcacagaguggcagagcgcaguauuuacaggacaauggagaccaucuuuuccaaagguggcugaaggaagucaaaggggcaaaacuaauuuaauuaaacuugggacugcugggaaaaauccagaggcuggguugcaacauuccagucaccauguggcugcagagaacaccccgccuuuugugggcugcuuccccucccccacccaguuuaaggccacaaagggaucuggcuuugugcucagcccucugucacaggcuggagauugcuugccuccaaaaaaaaaaaaaaaaaaaaaaaaaaaaagauaaagaaaaaaaaaagaaagaaaggcagcuuuugugcucagugacuauaugcaaauaagagggaaauuuacucucuugauugacuuuaaaaagaaacaguucucuucgaguuaaacaagauuacaagauucucauggaggccuguuucugccuuuguuuuuauuugguuuaacaguuuggaugaaaauacauauguaguguaacgcuucaugagacaucagccaccaagcuuggagguaaagagguaacuccuaggcgcuuuaacaagaucuaauuaagagcaggacuuugaucugagcccaguccagcccccagcaguaaacaaugcagcuuuuugaucaacaagugcccaagggcgcuaauaaaacagauccucaaacucauaacuguaauucgaccaccaacgagaagaguaacuugccauagaagauaauuuauucauuauuuuuugaaagcuuaagguuaagauuuuuuuccuggauggggggagggggaacacccaaaacuauugucuccauuuuuuuucagaguaaggaaagugaacuuagaaaacuguucuaacaggaaagaucucacaguucauuggguaagagggacccuucucuucugugaucagcucugugaccugcacaaaggaagucggcaagcuaagggcugaucaccacaggcaugugugggaagaauccuaggaaugcccugucaacugaggagucccggagacgcaggagacuccaaacaguggagaguaagcccucaaagagagaacaaagccagccccggauuccugcugcaucccgcagcuggagaagucccucggcaccuugggaaggcaggcuuucagaaauacuaauuucuauugauucuaguuuaagguuggaaggugcuaacugaacguguuuuuacggugugcucaaacacaguggguccucgugugcucagccuacacuucaguaccuaagaauguaccagaguuaaaauccaauaaaucuaaggaugaagcuuugcuugucaaauaaaacuuccuuggcuuguagaaggggcuuccugcauagggacauuuccagggcagcaucguccuuaaagacacagcacugcacuuaaggccccccuuuaaauaaccuaccaaacucuccauuggcaaauugcagggaacuguuuuaguauaaagcuguaaccggacuauaugcaaagcaagugucucacuccgaccaaguccacccacuccagccccacuccagccccacucccgcagcugaaagguccacccauccccucucgaagcugaaaggcuuuauccaggcuuggauuagaauaagcaugcauuggggguucuuuguugcucgaguuuggcaaacaucagaaaaguucugacagacuuuugaaauugcaggucuaccccaucucugucuucaagaucauuaauuuggacugagaggaaaauuuccagcccaagaagagucacaaagugccucaccuagaaacuaauucuucaaacacauaccugccugcugaagucaccccgaugcagagauacagcauaccauauauguacaugauuaaacauauauggaccaagagccgugccuaaaagggagaccuuuggaccuguugcaaaaccagcucaaauacuaaaacuuuaccuuucuaaagucugcaaacugaaaaauccucuucacugaaucuuuuaaaaagugugauaccuuacacuuaaaaaaguaagucgaaaguuuuuccuauaaggaauugcuaccaagauaaggaaguuaggaauaguggauacuuugggcagaaauuacacaguaaaauuuguuacuuuaaguguucauuaaaagcacaggggaagcaagcagcacgagaggccauggcuggaaggggagcuguacaagagaagucggcucaggaaugugauucaagucuggacaagaccuugagacucuguuucaauauaaaccucaguuauuccucaacuacaccuacauugcaaacaucaggacccaguuagccaucaccacuugguccagcaguugucuuucauuuguaucaaacucuuauauauuaugaagagcucuuaugaaaagauaugggcagauagguguuucuagaaaaacucaguguucucuauuucugggggcagugcagaugcacagguggauauaaguucagguggcuagaacuaacauugcuauuuggugguucuaaauaaaauuuugguacaaguucucaaucuugggauacuucaaaacaauaacaucuuacagagaguggaaccauaaggaaccacagagcuugauuauauagauaccuuuuaaaaauccacauuaucauucacuccagacugaagcuauucuacuauacaucccaugcucugugagagccuguuaucugagcauggggucccuucaguaguuuccccugaccucauacgauaacacgaggcuugcguuucagucccaaugugcucaacaccuggccaaacuuuugaagcagcuugcauucuaugucagaaaagucugaauuuuugccaaaaggagcucugugaauguugccaauauguaauaaaccagaagacauuucaaggacaucaaaaaacaagagaggcccagcugauuccuuuggcacagcccaaccaugcaucaugagcuggguagacacacuggugucucuggcguccucuuuccauguaagagauuguauuacugauggaacaaacaccugguuacuuuaggagcauuagaaugaccaaucugguuaccuuccuccaauguacaacugaggaaaaaccaaauuggaggcaaaauuagcacuagauggauuuugaaaaaagcaggagaagggaaaagaagaaagucuagggaccgaugcuguuugucuaucccuagcccacacuucaguguaugaaggcucaguuuacucugggccugauuucgaaacccuaaguuccaggaaucauacugacuuugugaaacuucugguucuuuguaguuuauucuguuaugcagauaaaaacuguaaacucuuagcccaccucuaagaagcuuaggucagaaaucucaacuuugagaaccuguuuuuuuuuuuuucucuccccugauaaccauuaaauuuaagcaggugugaaauuaaaggggaguuuaagaacuuuggaagaugaacuuguagagaagcuuuggaauaauggagggcuuuaacggacaggaagaccugagcuggggacucggaguuagcacaggugcugaacccucuuuagucuuggugcugugggcgaauccauucccaccaaagcccaucuucuguuuccgggucccuguccaccucuggaguacucauaacagaugcccugggaaagauuccuugccuguucaagugcacaggcauuucuuccuagcugcacccuacacuuauucugggcuccucauuugguuucuuacuucacccuggagaaagaauggguauuuuaaauuuucacccauguucgcaacauuuuuguuugcuugguggcccuaacuagagugcaagcagcuugaggaccugagcuuuuccugcagagcucaguaccgcccaucccccaucagaguccaagcagcuuuugcagagguaaacucugcccuaauaguuuacaaucauaucuuccuggccugcccagauguguucauuuauauuuuaaaucacaaaaaagggaccgcuaaucuccuuuuaaauggcuuuccuugauuaauauguagaugagccuccacaacuguugaaccuuguccauuagggcacuggccuucaagcuugauuuuuuuuuaaagcugaaauauaugggaguaguuagauuuauauugauccugaagaccuuccuccaagaaaaguagcuugguuuuuucuuaucuguuguuuuaugcuaaaguguagagaauauauuguuuuuaguuaauaauaccacaaacagauacaggaagugcgaaguuuagcauucaggaccugaaagagguucauagcgcauuaagauucaaaaaaguuuucacugggcaauaccacaguuaucaacugggaaucagcaguugaauugaauguuuaaaacuaauaauaugccuuaaauaagaugugcauuaacuugcucaagcuaaaagcugccaaggacgacuauugcucccuaaaucauggaugcagaaauuacacugccaucaaguuccuaggaaaagauacccugaucuuuaaaugacuaacuuucuauuauuaguaggcauuuggcuuuauguuacaaauugcuucuacguuuggcaaguguugcagauuuugaagcacaagcuauuagaacuaacuacuuugguuucaguaucacuuuaagauagcaagacuauucccccacccccucccuguuucucaaaacucauugggaaaaucugaauauuuucccagcacauuucugcaaccauuagaucagcucauuuuauaaggaaaagaaacuauaccucagugagaggaagacauggccccaagacucccuuuagaaaccccucacuuuagaagauuuuccugacagguaugauaguucauuacuuuugaaguauuuuaagcagccaugagaguccauuggcacugugccacuguggcuguuguaauuggugaguacuuggggaaagacagaaagacugaaccuaaagacugcuuggagcucuacugggaaagccucaggaaagcacaugaagccaccagauagaagaagccauuacgguucaagaguaagugcacccuaggcuggcaguugccuagcccugauuccuaugcugucuaacagagggcuugcuuacaguagaugcagaagaaaggaagaggggcagaaaggaggaaauauuaacugccuggccucccagaagagaaacgaaugaauggcuuccuuuccucagauaagacuugcacuugcuacuuuuccccacauucaaauuggcggcuuuugcuuacacaugaugcuuacguaugacugcuucaggggaaagcagaccacuuaggagaugugguucgcacacacagaaaacccauaaagaauuguuuccuacaugugugcuccuccacuggaagcucaaacguaauagccaugcaaccaaagggcaaaguugguacucucucuccacccaguuuucccaaucuaaaucucuugcacacagucuugggagaggauaaaaaaaugacauuuagagauccauaaacuuggcuuggaucuucucuccugagauaagcugguagcaguuagggaaaaucaaauguauaaagaggcauaaaguauaugcaauuauuuucaggccucaaccaaacaaugucuuugugagcagagaaaaugucaaacaaugggggagaaagcucuaggaacuugucgggaaaaguguauaggaaagauaguauaaacuuccugcuggaggcacgcuaauucugacuggcaagccacuuucaguaggaacagccucuuucuagaauuuaagcaaugcuccaucacuguguuugauuaacuaacaucucacuccaccaccaacaugauaggaauuucaaauaauuccccaugccucuuuuuucauuuguaugaaucuaaauuuuaaguaagguuucauaacuggauaauuuugcagugcaauacuguugcaaucagcuuuuaacccuucuuaucuugcagaaauaggcauacagaaauaaauaaauaaaauuuauuucuuuuacuaaauaaaaauaugucauuauguugcuacuacugauuucauuucaagugauuaacuuuaauuugaugaaaagcaauauuuauaacguugcuaaucuuaaggcaaaggcaauucagugcuaauuaauaccaggaaccccauccccuuagcaacuaugcauaucauuauaauuugcucaggccuuagguuuuauugggugacuacuguaugcaagacauucugcuauaagugcagagacugaacuauauaguugcugaguaaggcuagaaaauaccugaagugauauucgcauuggcuucucacuauaaaccauucauacacauucguuuuauuuauuagcucuuggagagaaaaagaaagagguggcaaguuuggccuuugggcaccuaaucuaaaaaucucuguugguggucuuguggcuuugggagcuggagacacgggauguauaagccggcauuccuaggagcacacccaucccccuuccuuauccaaauagucucauuccuaaauccaccaggcagccuggcucagcccggaaucuggcuugguuugcaagcuguugagaaccucagcacgggaugccagagccacugagacuaggagcugaagccaaccaacagccugggacacacacacacacacacacacacacacacacacaaaucugccuguccaguacacuaaagccaagaagcauagcugggaagagaucuugcacauuaucuagcccagcgucugcccucuuuuuacagaugaugaaaaugagacccagggagguagaggauuugcacauagaaaucccugguaaccaggagcugagauggaaacagagcuuuguaucaaagacuguaucagacccacugcacugccccacuccacgccuaaauaauucuuaucgaguguaaguccaaacggggcuggggguuggggggacgggggggggacggggaugcuggugcuaauuguugguaccacaccagcuguccggcucacuaggcauaacaauuaccauaauaugucugagaacaggagccuaauaaaauacuaggcuauguaauaauucuuaugaucgaaaguaguaauaaaccccuagaauuccaucaacacuuucucuauaguuucaagauugcguaugcaaucuggacaacaaaaaccacaaaaacgcccuuggcgcagcucaaggaagaacuugacucuccggagggaaacuggauccauccuucucacugcagcagucugagcaucuggcaccgaccgugagaggcgccggugcaagacuucccucuagucuuucuucuagccuuugugcugaggguugccucuggagaucuugggacucuggccccuuccucccacagucuaauuccccaagucccucagagguuccagcccagggugugggaagcucgcugaagcuccacgaggccacucccaguugagcacggcuccaccucgggccaccccgccugacagcaacccugcguguuggcgcuugugcgcuccuccucgccaguuucgcccuaaucugucuggcagcccaguuccccaccagcaccggcuuuuccccucccagauugguaguuucugcuccucuggagaagguaugguuucuacuaacaguaggcguuucucccgacgagccucuggccagucuugauaccggggguguguggggguuggggggugcucaguccucacugucccuuccccgaacucagccggggcugccagccuuccugcccgcgaaaaucugcccuccccaccaccuugugccacguuggugggugggcgcaugggaaggcaacaacccggccuugaacccuagaccucuggacggaacccuccaaggcgccaauaauucaaguagacaggaaggucaaaggcgaucggugcugccugcggcucugcaggcaggcgaagccgaagcaaaaggguaggggagugguauguucggagagcuggcacagagugaucccugggcggccgcagaagccgcucugcaccgguggcacagaggcugcgggggcggaggccccgcgguggccgcugccggcaccaccagcgcauuccugacaguaggcgucacgggcgcuggcuccggccauucacccaucucccucagccuggaacaccccacgcaacccggaggcuuuggggaucuucucccagcucagccugcgccccugcccccaaaccagauggcuggugacacccaugaggggcuuccuccgcgagcgggagggcuuccacgcugcucuguaugcuccagcacugggccacccuggcggcccgcuccggcacggcuccaaggaaggacaacacaaggccaugcggccaccagaggcuccuccagcagggucacuccggacaccuagcguccuccuguccccaagaccacaaucacucccauugcugccccugcccagaaaggauaacauuuuccggcggcucgggaccgggaagucccucaaggagccacauuagcagacagggcaccagaucccgagcccccgggcgcaccgguucagaccgccacgcggugugccgagucuuaccugaagugucccacaggcucaacucuauucuuugugugucgauuucaaaacuggcaguguaauucucaaacaccguagggacguaauucuggacgaacgaaagggacagaagaggaagguggcaaagagauuauuaaaaacacgacccguagaucgaacacuugaaaaaccaccaagcccccaauuaaaaaaccaccaccaccaacaaccucacacuccuuacacaguaaacacgcagcccccucccgagagcccacccaggucuccccacccggccucccacacugaaaccagcaaguuucuggggccaagagcccagggugcuggcgggucccagccaagacccuuccaggacacuuucgcuucccggccguguggcggcagagacggcugggcaugagaaagauuuucaagaaaaucagugaagcaggagaaaggcgcaguccuccagaccggggaccccaccagccgcuccccucaagacgugcgggucacacucacuucugggaagcaguccuuggcgaagacguggagcagcgcgguuuucccacacuggcugucgcccacuacuacuaucuugcauuucacguucugauuaggauccaugauagauuuacuggauaauuucuggcuggcucuucucuccuucauugauguugccuuauuuucucuuggaacaggaauuuucucuuuagaagaaaaaauauauauauauauauacuucucucuauaaaaagcagauauaaaaauaaaucgcaaggccggcgggaaccccuuuaagcacagcggaguggaggaggagaggcagcggcucuuuacuccucuccuacaaguuuucugccugacuccgcgccucucuucccaaguccaauuccgaucggucugcuu

SEQ ID NO: 12068 - RNA, 18674 nt, Mus musculus
aagcagaccgaucggaauuggacuugggaagagaggcgcggagucaggcagaaaacuuguaggagaggaguaaagagccgcugccucuccuccuccacuccgcugugcuuaaagggguucccgccggccuugcgauuuauuuuuauaucugcuuuuuauagagagaaguauauauauauauauauuuuuucuucuaaagagaaaauuccuguuccaagagaaaauaaggcaacaucaaugaaggagagaagagccagccagaaauuauccaguaaaucuaucauggauccuaaucagaacgugaaaugcaagauaguaguagugggcgacagccagugugggaaaaccgcgcugcuccacgucuucgccaaggacugcuucccagaagugagugugacccgcacgucuugaggggagcggcuggugggguccccggucuggaggacugcgccuuucuccugcuucacugauuuucuugaaaaucuuucucaugcccagccgucucugccgccacacggccgggaagcgaaaguguccuggaagggucuuggcugggacccgccagcacccugggcucuuggccccagaaacuugcugguuucagugugggaggccggguggggagaccugggugggcucucgggagggggcugcguguuuacuguguaaggagugugagguuguuggugguggugguuuuuuaauugggggcuuggugguuuuucaaguguucgaucuacgggucguguuuuuaauaaucucuuugccaccuuccucuucugucccuuucguucguccagaauuacgucccuacgguguuugagaauuacacugccaguuuugaaaucgacacacaaagaauagaguugagccugugggacacuucagguaagacucggcacaccgcguggcggucugaaccggugcgcccgggggcucgggaucuggugcccugucugcuaauguggcuccuugagggacuucccggucccgagccgccggaaaauguuauccuuucugggcaggggcagcaaugggagugauuguggucuuggggacaggaggacgcuagguguccggagugacccugcuggaggagccucugguggccgcauggccuuguguuguccuuccuuggagccgugccggagcgggccgccaggguggcccagugcuggagcauacagagcagcguggaagcccucccgcucgcggaggaagccccucaugggugucaccagccaucugguuugggggcaggggcgcaggcugagcugggagaagauccccaaagccuccggguugcgugggguguuccaggcugagggagaugggugaauggccggagccagcgcccgugacgccuacugucaggaaugcgcugguggugccggcagcggccaccgcggggccuccgcccccgcagccucugugccaccggugcagagcggcuucugcggccgcccagggaucacucugugccagcucuccgaacauaccacuccccuacccuuuugcuucggcuucgccugccugcagagccgcaggcagcaccgaucgccuuugaccuuccugucuacuugaauuauuggcgccuuggaggguuccguccagaggucuaggguucaaggccggguuguugccuucccaugcgcccacccaccaacguggcacaaggugguggggagggcagauuuucgcgggcaggaaggcuggcagccccggcugaguucggggaagggacagugaggacugagcaccccccaacccccacacacccccgguaucaagacuggccagaggcucgucgggagaaacgccuacuguuaguagaaaccauaccuucuccagaggagcagaaacuaccaaucugggaggggaaaagccggugcugguggggaacugggcugccagacagauuagggcgaaacuggcgaggaggagcgcacaagcgccaacacgcaggguugcugucaggcgggguggcccgagguggagccgugcucaacugggaguggccucguggagcuucagcgagcuucccacacccugggcuggaaccucugagggacuuggggaauuagacugugggaggaaggggccagagucccaagaucuccagaggcaacccucagcacaaaggcuagaagaaagacuagagggaagucuugcaccggcgccucucacggucggugccagaugcucagacugcugcagugagaaggauggauccaguuucccuccggagagucaaguucuuccuugagcugcgccaagggcguuuuugugguuuuuguuguccagauugcauacgcaaucuugaaacuauagagaaaguguugauggaauucuagggguuuauuacuacuuucgaucauaagaauuauuacauagccuaguauuuuauuaggcuccuguucucagacauauuaugguaauuguuaugccuagugagccggacagcuggugugguaccaacaauuagcaccagcauccccgucccccccccguccccccaacccccagccccguuuggacuuacacucgauaagaauuauuuaggcguggaguggggcagugcagugggucugauacagucuuugauacaaagcucuguuuccaucucagcuccugguuaccagggauuucuaugugcaaauccucuaccucccugggucucauuuucaucaucuguaaaaagagggcagacgcugggcuagauaaugugcaagaucucuucccagcuaugcuucuuggcuuuaguguacuggacaggcagauuugugugugugugugugugugugugugugugugugucccaggcuguugguuggcuucagcuccuagucucaguggcucuggcaucccgugcugagguucucaacagcuugcaaaccaagccagauuccgggcugagccaggcugccugguggauuuaggaaugagacuauuuggauaaggaagggggaugggugugcuccuaggaaugccggcuuauacaucccgugucuccagcucccaaagccacaagaccaccaacagagauuuuuagauuaggugcccaaaggccaaacuugccaccucuuucuuuuucucuccaagagcuaauaaauaaaacgaauguguaugaaugguuuauagugagaagccaaugcgaauaucacuucagguauuuucuagccuuacucagcaacuauauaguucagucucugcacuuauagcagaaugucuugcauacaguagucacccaauaaaaccuaaggccugagcaaauuauaaugauaugcauaguugcuaaggggaugggguuccugguauuaauuagcacugaauugccuuugccuuaagauuagcaacguuauaaauauugcuuuucaucaaauuaaaguuaaucacuugaaaugaaaucaguaguagcaacauaaugacauauuuuuauuuaguaaaagaaauaaauuuuauuuauuuauuucuguaugccuauuucugcaagauaagaaggguuaaaagcugauugcaacaguauugcacugcaaaauuauccaguuaugaaaccuuacuuaaaauuuagauucauacaaaugaaaaaagaggcauggggaauuauuugaaauuccuaucauguuggugguggagugagauguuaguuaaucaaacacagugauggagcauugcuuaaauucuagaaagaggcuguuccuacugaaaguggcuugccagucagaauuagcgugccuccagcaggaaguuuauacuaucuuuccuauacacuuuucccgacaaguuccuagagcuuucucccccauuguuugacauuuucucugcucacaaagacauuguuugguugaggccugaaaauaauugcauauacuuuaugccucuuuauacauuugauuuucccuaacugcuaccagcuuaucucaggagagaagauccaagccaaguuuauggaucucuaaaugucauuuuuuuauccucucccaagacugugugcaagagauuuagauugggaaaacuggguggagagagaguaccaacuuugcccuuugguugcauggcuauuacguuugagcuuccaguggaggagcacacauguaggaaacaauucuuuauggguuuucugugugugcgaaccacaucuccuaaguggucugcuuuccccugaagcagucauacguaagcaucauguguaagcaaaagccgccaauuugaauguggggaaaaguagcaagugcaagucuuaucugaggaaaggaagccauucauucguuucucuucugggaggccaggcaguuaauauuuccuccuuucugccccucuuccuuucuucugcaucuacuguaagcaagcccucuguuagacagcauaggaaucagggcuaggcaacugccagccuagggugcacuuacucuugaaccguaauggcuucuucuaucugguggcuucaugugcuuuccugaggcuuucccaguagagcuccaagcagucuuuagguucagucuuucugucuuuccccaaguacucaccaauuacaacagccacaguggcacagugccaauggacucucauggcugcuuaaaauacuucaaaaguaaugaacuaucauaccugucaggaaaaucuucuaaagugagggguuucuaaagggagucuuggggccaugucuuccucucacugagguauaguuucuuuuccuuauaaaaugagcugaucuaaugguugcagaaaugugcugggaaaauauucagauuuucccaaugaguuuugagaaacagggagggggugggggaauagucuugcuaucuuaaagugauacugaaaccaaaguaguuaguucuaauagcuugugcuucaaaaucugcaacacuugccaaacguagaagcaauuuguaacauaaagccaaaugccuacuaauaauagaaaguuagucauuuaaagaucaggguaucuuuuccuaggaacuugauggcaguguaauuucugcauccaugauuuagggagcaauagucguccuuggcagcuuuuagcuugagcaaguuaaugcacaucuuauuuaaggcauauuauuaguuuuaaacauucaauucaacugcugauucccaguugauaacugugguauugcccagugaaaacuuuuuugaaucuuaaugcgcuaugaaccucuuucagguccugaaugcuaaacuucgcacuuccuguaucuguuugugguauuauuaacuaaaaacaauauauucucuacacuuuagcauaaaacaacagauaagaaaaaaccaagcuacuuuucuuggaggaaggucuucaggaucaauauaaaucuaacuacucccauauauuucagcuuuaaaaaaaaaucaagcuugaaggccagugcccuaauggacaagguucaacaguuguggaggcucaucuacauauuaaucaaggaaagccauuuaaaaggagauuagcggucccuuuuuugugauuuaaaauauaaaugaacacaucugggcaggccaggaagauaugauuguaaacuauuagggcagaguuuaccucugcaaaagcugcuuggacucugaugggggaugggcgguacugagcucugcaggaaaagcucagguccucaagcugcuugcacucuaguuagggccaccaagcaaacaaaaauguugcgaacaugggugaaaauuuaaaauacccauucuuucuccagggugaaguaagaaaccaaaugaggagcccagaauaaguguagggugcagcuaggaagaaaugccugugcacuugaacaggcaaggaaucuuucccagggcaucuguuaugaguacuccagagguggacagggacccggaaacagaagaugggcuuuggugggaauggauucgcccacagcaccaagacuaaagaggguucagcaccugugcuaacuccgaguccccagcucaggucuuccuguccguuaaagcccuccauuauuccaaagcuucucuacaaguucaucuuccaaaguucuuaaacuccccuuuaauuucacaccugcuuaaauuuaaugguuaucaggggagagaaaaaaaaaaaaacagguucucaaaguugagauuucugaccuaagcuucuuagaggugggcuaagaguuuacaguuuuuaucugcauaacagaauaaacuacaaagaaccagaaguuucacaaagucaguaugauuccuggaacuuaggguuucgaaaucaggcccagaguaaacugagccuucauacacugaagugugggcuagggauagacaaacagcaucggucccuagacuuucuucuuuucccuucuccugcuuuuuucaaaauccaucuagugcuaauuuugccuccaauuugguuuuuccucaguuguacauuggaggaagguaaccagauuggucauucuaaugcuccuaaaguaaccagguguuuguuccaucaguaauacaaucucuuacauggaaagaggacgccagagacaccagugugucuacccagcucaugaugcaugguugggcugugccaaaggaaucagcugggccucucuuguuuuuugauguccuugaaaugucuucugguuuauuacauauuggcaacauucacagagcuccuuuuggcaaaaauucagacuuuucugacauagaaugcaagcugcuucaaaaguuuggccagguguugagcacauugggacugaaacgcaagccucguguuaucguaugaggucaggggaaacuacugaagggaccccaugcucagauaacaggcucucacagagcaugggauguauaguagaauagcuucagucuggagugaaugauaauguggauuuuuaaaagguaucuauauaaucaagcucugugguuccuuaugguuccacucucuguaagauguuauuguuuugaaguaucccaagauugagaacuuguaccaaaauuuuauuuagaaccaccaaauagcaauguuaguucuagccaccugaacuuauauccaccugugcaucugcacugcccccagaaauagagaacacugaguuuuucuagaaacaccuaucugcccauaucuuuucauaagagcucuucauaauauauaagaguuugauacaaaugaaagacaacugcuggaccaaguggugauggcuaacuggguccugauguuugcaauguagguguaguugaggaauaacugagguuuauauugaaacagagucucaaggucuuguccagacuugaaucacauuccugagccgacuucucuuguacagcuccccuuccagccauggccucucgugcugcuugcuuccccugugcuuuuaaugaacacuuaaaguaacaaauuuuacuguguaauuucugcccaaaguauccacuauuccuaacuuccuuaucuugguagcaauuccuuauaggaaaaacuuucgacuuacuuuuuuaaguguaagguaucacacuuuuuaaaagauucagugaagaggauuuuucaguuugcagacuuuagaaagguaaaguuuuaguauuugagcugguuuugcaacagguccaaaggucucccuuuuaggcacggcucuugguccauauauguuuaaucauguacauauaugguaugcuguaucucugcaucggggugacuucagcaggcagguauguguuugaagaauuaguuucuaggugaggcacuuugugacucuucuugggcuggaaauuuuccucucaguccaaauuaaugaucuugaagacagagaugggguagaccugcaauuucaaaagucugucagaacuuuucugauguuugccaaacucgagcaacaaagaacccccaaugcaugcuuauucuaauccaagccuggauaaagccuuucagcuucgagaggggauggguggaccuuucagcugcgggaguggggcuggaguggggcuggaguggguggacuuggucggagugagacacuugcuuugcauauaguccgguuacagcuuuauacuaaaacaguucccugcaauuugccaauggagaguuugguagguuauuuaaaggggggccuuaagugcagugcugugucuuuaaggacgaugcugcccuggaaaugucccuaugcaggaagccccuucuacaagccaaggaaguuuuauuugacaagcaaagcuucauccuuagauuuauuggauuuuaacucugguacauucuuagguacugaaguguaggcugagcacacgaggacccacuguguuugagcacaccguaaaaacacguucaguuagcaccuuccaaccuuaaacuagaaucaauagaaauuaguauuucugaaagccugccuucccaaggugccgagggacuucuccagcugcgggaugcagcaggaauccggggcuggcuuuguucucucuuugagggcuuacucuccacuguuuggagucuccugcgucuccgggacuccucaguugacagggcauuccuaggauucuucccacacaugccuguggugaucagcccuuagcuugccgacuuccuuugugcaggucacagagcugaucacagaagagaagggucccucuuacccaaugaacugugagaucuuuccuguuagaacaguuuucuaaguucacuuuccuuacucugaaaaaaaauggagacaauaguuuuggguguucccccuccccccauccaggaaaaaaaucuuaaccuuaagcuuucaaaaaauaaugaauaaauuaucuucuauggcaaguuacucuucucguugguggucgaauuacaguuaugaguuugaggaucuguuuuauuagcgcccuugggcacuuguugaucaaaaagcugcauuguuuacugcugggggcuggacugggcucagaucaaaguccugcucuuaauuagaucuuguuaaagcgccuaggaguuaccucuuuaccuccaagcuugguggcugaugucucaugaagcguuacacuacauauguauuuucauccaaacuguuaaaccaaauaaaaacaaaggcagaaacaggccuccaugagaaucuuguaaucuuguuuaacucgaagagaacuguuucuuuuuaaagucaaucaagagaguaaauuucccucuuauuugcauauagucacugagcacaaaagcugccuuucuuucuuuuuuuuuucuuuaucuuuuuuuuuuuuuuuuuuuuuuuuuuuuuggaggcaagcaaucuccagccugugacagagggcugagcacaaagccagaucccuuuguggccuuaaacugggugggggaggggaagcagcccacaaaaggcgggguguucucugcagccacauggugacuggaauguugcaacccagccucuggauuuuucccagcagucccaaguuuaauuaaauuaguuuugccccuuugacuuccuucagccaccuuuggaaaagauggucuccauuguccuguaaauacugcgcucugccacucugugcaggcagcguccuaaaggagccuggcaccuccagauucuaaucaugucccauaggucuagacuggagagcauaagacaugagcuuucugacaccuguuuggcuuuacacaguaggcugacucugacaguguaggucgggucaggucguuggagcuagcuuugaagaacagaagagagccuccucuguccuccuuugaauuucuucucuguacagucugggauuuuuuguggcaggcuauuaggaaagagauauucuaaugcucacagcagcagcugugccaaaguuagacuuuggacaggcaaacaaggaagguuacaguggagagagucagagcugcagaacuaauguaaaauaucaguguauccauagaggguaaagccaucccuuucuggugccuuucaagaaaaacuuagggugaauucuaaguguccaccuuagaguuacucucaccucuaauuucuucaaguugcugaaaggguagccacugcuugucauuuuuagaaacacauuacauauuuuucuuauucauuucaacuaaggccuuagcucucugggaguaccuuucauucaggguuuuuuaccucacuuccagccucccacaggccagugggaggcugcugaccugucugagagcuucuuagccuuucuucacugcugaggcauuccuuccugguuccuaggacauccgcaucuuccuagcucagcacacagacucuccaucucuaaagcagaacugagguacacacagugcggguagggauugcagcgaugagugcccagagccuagcacacacacacacuaacuacaauaaccucuaggaagagacaacagacuccugaaggccagaugucuuuguacuuuuucuuugagacauugucucucuugcucaauggagaaggagcauggaaauacuaguguacucacauggagaguuaaacaaucuugcauucucucuacagcucagguaggccucaaaauugcaauccuucuuuacccugcuacuggaccugacuaaaaccauuucuuugaauagcuccccccaucccccaccucucucugugugucugacuuggaccaccaaaguuuugacuuagggaaggcauguuguguuuuccugccagaaaugcaaaauuaugucaaaacuaaaucaaaagucaaaaaaaucuuuagcguauuugcauuugccuaauaaaugaucuuccuggugucugugaauaacuauaugaugaaauaguucuuuaaaaguagcaguugucaaguuaucuucaguguuauagucaaucuauuuuguaauuauuggccuuguaugaauucccaacauuuggaacucauaaagauguuaaaaaaaaaaggaagaaagaaagaaagaaagaaagaaagaaagaaagaaagaaagaaagaaagaaagaaagaaagaaagaaagaaagaaagagagaaagaaagagagagagagagaaagagagagaaaauaaucuuaaauuuccagaaaguucugugguuccauugauugacugucaauuugaacuuuuagacuaccuugaguuuaacucaggcgagggcccuuggauuauguccugcagucauguuugcaggagggacucuguagaaaggcaacaugauccaacauggcauuuaugacauucuugguguagcaggaagugaacuuacacagagcugggggauaaguguaagcaggcacaaaggucaauggcuuauccagucuuguaacuggggauggagugacacuccggugugcuuugcucuggcuuccugugcaccauuaaacuugcccucccccacugaccccucccccaugcaacuauugggcuaaucuugaguuuggaucuuuuuccgaggaagcagcucccuuuccaguggcugcugccaugccacucgaccuuugaccacagccauaccagccacaauacuucuaguuaauauguauucaucucuuccuaaauuccagcugcuaccuagguuugcuuagauccuguggauauagguugucaccauguuccccugaugauugaagaaucagaagcacacacuuuuaagacuugggcuucucucccugugaggagaauggguuuguccucaaggucaccuggccccacauacuccccaguucaucuaaaacccuuuugacucuaauucuuaagcucuaccaauugcaccuuaauuuccugaccuucccaggagcugaggucccaugcauaggagcucucugaucuccuaguaaaagugaauguauuacuaaccugucuuuuguggauguguuugcauuuccuuacaggaaggaggcuggagaggggggaccaaugggauguugcauuuuaacaggaaagagguuuauuucaaaggguagaguuagugccucuuagacaguggggauuucugucugagaccuguguguuuuuguuucuuagguucuccuuacuaugacaacguccguccacucucuuacccagauucugaugcagugcucauuugcuuugacaucaguagaccagagacucuggacagugucuuaaaaaagguaagugcugaggaacgaggcuaucacccugaacuuucgaugagauaggguuggagagaggugauuggccaggggauucaaagauucugaacuuauuucuucuaaugaaaagaccagaaaggauacuuccacacuaaaacaacauucccauauacauuguugcuugcuauaaggcacuaauuaaucugcuugaaacuuuauuucccaaagcucugaacaaacuacuuuucacagcuuccucguucguuuuuuggaggaaauggagugaaaacguaggaaauagcuacaguaagcucuuaccugaucccuucauuccuuugcuugacagacugcucuguagguguuugcuguugaucucaauucagauagucaccuuaauacaauaagagcuacuuuaguucacuuauuuauagaaacauaagugaaauuagcauaagaggaauauguguaguggggcuugucccuagacaugcagcaaugugaauuaugauccgaugucuacuaauaaaugucuaccaauaaagcaccaguuacaccaaauauguauguuaucacacagcccugguuacuggaaacaaaggugggucagauuauagguggagaugagaccaguagaagcuguagacagaggaaccagggcuaggaggaaugguaccuguugcacauaggucuugaggucuaagaaggcaacugcuuauguguguagagagugaugcugagccuuccccagcagaggacugggcccuccggguaguuacaggaacuuuccacagaugaguuccagagaacucagugggacggugauuccgcuuggccugcagcaaacccaggcuuuguuccaugguagcucuagaggguuauaugugcugguagauggggcagcaucuuaaucacucacccuugcuagguguuguagguuugcgagugagacucuagcuguacuaccccuucuuuucugugcacuguacauguggauaggaacagagaaugucacucagugcuugucccuguguuccugucagcaugagggcagauagcauaaagggagaagugccccuguagauguccagguuugguccauuugggcugugugcuuuugguuucuacuuucagugacauuugcauuuuggguggguuuuuuauuuuauuuuuauuaguuuauuuuuccucaugguacuuaauugccugaguagacaaauuuagguuugagguauagccuuccuucaguuuuuugcuaaacauugauugcaagcaguucaaugaaauugaacucuugauagaucaagggguccuuuuaguuuguaacaccuuuucguucugaguaauguauaaaacagaggguuggcuuuuugucagauucugucaagaauacaaguuuccugucuucagggaauacaacuuucuuguccuccuguaaacagauagagagagacucgcaacaucacaagcugagaacaugucuggcuguguuugaagagaaaaggggccacuuauucacugguguuuguaccugauguaguaccagcuuauacauaauuuaugucagaaagcuuuucuccucuucuacuuugauuuuuauuuacuaagaucagauagugacauuggaccuguagauauuaguauguuuucuuugugugaggcuuaaaagcucaccauaacuuacuuaguucaucuguguuuugucuuaauugagucuuaaaguccauugagucaagaguuuaaaguaacuuaaaauagaaaaaguacaaaaaaacuaagucuuauucuguuuuuuaauucuuuagaagaacaugcuagauguuccuaaauaauuguaggagggaggaagaaaggaaaggcucaauggacagaucaggcacucgguguguuacugcccuccucaugcuggagcacuuuagaacuagaugucauuggcucagcuacacccugagaucuggagguagccucucgaggucucucuccuaagucacucuuucagaaugucccucuuaccuaguauuagacuuacaaaucuuuauugccucuucugcucugugaauuccugaaagucagagcuccaccaccauuacauucuuccuagagcaccaaaggcaucauaagugugggcagaagagucucaaccccucuaguugcucaucugaugauggaaaacacaaguuagaagaagcaaaaccaugaucagcuguuuagaugcuugaggcagcuggaaucccuuccagaaacuucucaaaguucuccugauucauguuaggacagaaaauaguuaaauuguagacuagacaguaauggcugacaguuaaaaauuaacucaaagucuuuaugggcuauaaacuaggugcuguccugggaugucaagagguaguucucugcuuaagcuguagucuguguccauccagccacuugaguggaagauccuugaagcaagacacuaugcuuuaguaaucauaggccagacacugaccuaccacgggaggccagcacacgaaagcaagcauguccuagucugucaugauggagugugugaaugcacauuuuugcuaguguggccuauuccuuaugcccacccuuccacuuacuauauauuaggcuggguaauaaggaacucaguauaucccaggauguaaaauccauuuggauugugacuauuaaggugcuuuuaccuuucaaauaccuccauaauuaagacauuguugaaguuaccuuguguugauacaaaauaaguucauugugggaggaaccacggagucacacagacuauaacaacagucucuaaaguuugguacccacuuacuaauuaauccaacauaaccuggcuucuucacuuaaaguugcacuucaaagucugucaggggagcuauuguuuuuauuguauauguaugugucaauacuucauuaauuuuucuuucccuccucccuaguggaaaggugaaauccaggaguuuugucccaauaccaagaugcuguuggugggcugcaagucugaucugcggacagaugucagcacauuaguggaacucucaaaucacaggcagacuccugugucauaugaccagguaaguguguugucacugugggaaagucuccuuccuuccuuccuuccuuccuucccuuucuccuuccuuucuuucuuuauuaggauauauuuauuuuuauuuuaugugcauugguguuuugccugaauguuuaucugugugaggguauugaguccccuggaucuagaauuagagacaguugugagcugccuuguggguucugggaauuaaaccugagucacucgcaagaguagccagggcucucuuaaccacggagccaucacuccaagcccugaaaagucaccuuucaauaaaaaugaaaggaaauauguagagaauuauuauuugugauaaaugagacgcagcgcuuuuucaagagaugaagcaggagucaacuggaauaggagcugucugacuuucuguagcaaaagucagcaagggguagggugcacaaacaauugauaggugcuaaccuuggaugcuucuacuacaccaguguuuuuaaagagagaaugugauuaaaauuaguucucuuaaaagagcuuauuguucucuugcccaauaauauccucaauuaagccauuguuaaaaaaaaaagaucacucugugaugccaucuuuugauuguuuuuugugauaugaguguucacucaaagaaaggagaaucuguugaggaaucuauucuccuaaaacucaccaccagauucuaaagaggguuccuguuaaaauagguauauguggcaugcaucauuuaaaguauucuauuguagggcuggggacauugaucagucauagagcucuugcccagcaugagaaaggcuuagggucccaucauccccagugugacaaaagugcagaguaaaagcauuauacucaucuuuaucuugcauuccucauuaacaaacucaauacaaucuuagaagcugauuuuuauuuaaauugguguucaguaacaucugucagcccuauguuuuguacaaccuguuggcugggguugaaggucauuaauagucucuacaagagaaaacgagagccuccugaaaugcuggcgaggacucugagggccaaagcaccuuggucagaucuauaggaaggauguuuaugguaucaggagacuuacuccaguagcaagagaccaugccucacaauggccccaaaugauaccuacacagcagguuacucacaaccugcuuaaagcaucacugagggucaacugcuaccuuugcaccugucucuucuuugcauccuccuagugagagcuggaugcuuggauucucuugcaagagcaaaucgccauacuagaagcuguggggagcuagagggguuucuacagaguaauauaauucagggccuucggacugggucuucagcaguugggaaguaguaacaaaguaacucauuuuaaaauaaaaucuguuuuuuauuuugaacaccacuugggaaguccauuuggcauauuagguauguuccaauucaagacaguuuugugguauuucaacacuuuccagugucucuccaaagucucgcugcugacggaaauucuuucuuuuacuucacagggggcaaauauggccaagcagaucggagcagccacuuacauagaaugcucagcuuuacagucagaaaacagcgucagagacauuuuucacgucgccaccuuggcguguguaaauaagacaaauaaaaacguuaagcggaacaaaucgcagagggccacaaagcggauuucgcacaugccuagcagaccagaacucucagcaguugcuacggacuuacgaaaggacaaagcgaagagcuguacugugaugugaggcuucgccgucuauaaggaggacgcgggaauaucugguguuuuaaaaaauuaauaauucaaauuaaaaaauguaaaaagcaggagcaaaccggaaagauggagucaaaugaagugcacagccaaagucacauagauacaggcuuaggaggcccuugaaaggauacccacuuuucggaauccuguccuuaguuucggcauguagaccgaguggugagaagcgaaugcauugaagaguuuugugugacaagaagugugacuugaaaaauccgccaaaaacaaagggagcuaugaacaggcgagcgcuagagaagugggggacgccaguaccuccaagaagaacauccacgcucugaauggugcuugaguauuuucgguuuuguguuugugguuuuguuacaaccuauucguggaucucuacuuuuugauuucguuuuucaauguuuuaaucccuuuuuccaaaaaauauauauuaguagaccguccucauuggggaacucgcacugugaccuuagcguuuaguuuucuagaggaugcgaucuaauuuccuccuagcucaucauuaaaauggaaauuguacugggacccgcugggauucgagaggaaaacuugaugcggcuuugaaaucuugacuuccugaaggucgcugcugagcaagaugguuugaaagcaagcuucagagcccuuacaagaugcauagaccagcacuacagagauugcguagaucaacuagaagagaguguugcuuuuuauucugucugaugguuuuguucauccuugugauuguccuuaacaagugguaaauuguuccguguaauauuuuuugugcgcuguuuagaagaguguguguggcuuuguuuuucuuuuugccaucguugaugaaaacgagaagucaaauaaaagaugugaucgucagaugugauagcgugauuaaagaagaggcaggugguugccgauuucaccaggagagaccuugaaugaaggaguaguaguagccgagagcacaguuggugaauggggcugucuggaacaaaauuauacgucaaauacacagagcaaaagcacucgugucuggggauggugccccuagacuagcaacagaaaguaagcugucgucuggugccacuuccuucaaagaaaugcuguucuggcaaaacccccauuugcucaugcuuuaguaaaccccaguuugcaaagaagccuauaaugucugcccugguaugagccuagggcguuucucaagugacugcuaaaccucacuuaaccauacauggccagggccagguugaaaauguugaucguugccagagugauaauaagcauuuaaaauaguuuacagguuucuccuuuugagcaguuccuuucagagaagaaaucauuuacgaucuuugagaguuggugcuuguuaaaaacaagcuuuuuuuuuuuuuuccccaaugaugacgcuucauuuuugaagcgcuggagcggugucucccuuaaaccgcggcagaaggggaggugaagguaacuacaacacccagcucugugucuucacaagcgcuuuguuuugucucugcaagaaaaugccaucucagucauuucccaugaaacucagacaucuuaccaacauaauacgcucugacugguacagcauuaugcuuugggcaguauuacaaaaucgcuggcaagugcuuucuguauuuaaauauuguaaaaagaaaauaaguuauaacuguuauaaagcagaacuuuuuguugcuuuuuuuuuuuuuaauguugaagucacuuuguauguuuguuuggucaguguuuccacaguauuuauuaaaacguauggguuuuuuuuuuucuucaaauaaaaaaguaaccauguca

SEQ ID NO: 12069 - RNA, 25124 nt, Mus musculus
aaagcagcccggaggagcguuuggcgcgaaggugucuuagcugcgcuaccugcgacggcgcugccucauacguagucccuuccuguuuucuccacggaggcuuuuccacuccuugcuucguuauuuugccacagagcuugauaucucuucaccgaguacgucauggcucccaagaaaugcccagaaacccagaagucccccgacguugcggugcuccucaggagcaaaagucgcagagguccucaggagcuggagcccgaagccaagaagcugcgugugcagggucccgguacggccugugcugcugccuuagcuuuccggggguucagggugcucgcgccagaggcugaagcugggguggugggugcuugugccugggcuucugaagcaguucuuggcuucugucgccucaggcugugauuuuauuugggagaucgaggguucgaacccaggccuccaguucucucagcaagugggcugccacugagccacacgcugccgacugguuuuauuggccaguucauugacagcagagaguuuuaaguugaacagcccccccaccucuaccccaggugacagaaagagucagaugagugccaucaccguaaaagccacaguccccacuuuccuuguuccagaaguuuuacacaucuacuguuucaaaguaauccucccuuucauagccucucgguuauguuagcucugagagucugaaauucccucccuccuuucuucagaaagcgcauucucagagguuuaccaggacuugaaccuggggcuauaaggaaugugauaaauugauaagagugguuuuagccaugaaaagaaaggaaaguugucaagagaaaaaaaggacuuauagauuggguccaccagaagggcuugguaauucagaguuguuuuauuuauuuguuuguuuguuuauuuauuuauuuauuuauuuaguuuuucgagacaggguuuuucuguguagcccuggcuguccucagaacucagaaauccgccugccucugucucccaagugcugggaauaaaggcgugugccaccauucccggcuuauuuuuauuauacucugauuuaccucucuuccuugaagccaccuaaucaauuuggaacuuuucuaaaccuuacugcauucuucugguuuccacucaaguaaugguugcucaugacauuauuuaguauuucuuuaaauacagagucuugcucuauagcccaggcuggccuccaauccaaguaugcugcagcuucugagugcuaggauuacaguuauacaccacuguauuuggauagcucuuauuuuauuuuuuuaagauuuauuuuauuuaauguaugaguccacuguagcugucuucagauacaccagaagagggcaucggaucccauuuccgaugguugugagccaccauguaguugcuggaaauugaacucaggaccucuggaagagcaguuagugcucuuaaccacagcugagccaucucaccagcccugauguuauuuugugaucuuuaagauugucccucaaaaaaaaaaaaaaaaaaaaaaaacaaacgggcgugguggcacacgccuuuaaucccagcacucgggaggcagaggcaggcgaauuucugaguucgaggccagccuggucuacaaagugaguuccaggacagccagggcuacacagagaaacccuaucuugaaaaauaaaaacaaacaaacaaccaaaaacaacaacaacaacaaaaaagauugucccucaacuccuacuuauuugugaucccacacaagaaaagucuucaguguccacaauuguguaucucucuggcaaagcucuaaggaacccugugagguuauauuuaguuucacuucagaauuucuguuuggaggaguguuuuggaaaaggguuuuuuauuucucucuuggguugagugagacucaacugcagagaaaggcuuuuaaggagaugaugagacaaaggguuuucagggggaaccuuuccugagauuugggagaggaaaauguuuguauucuucuuugguaguuucuagcaggacaugugagucgugcugccuucuggcagaguuguccagccugcagaucccuucacggaguagcagcauugucagggaucuuuaccagcauaaguugggcaaagccaccuggucaucacuacagcaggugagauguuuccugucugacgugcucaaaggucacauagcuuuucaacuauugcucuuucucacuagaugauaaauugguucaggaucaucaggucacccccagguaugaugauugaccuacuguacacugagucaaagagaaaagguuuuacucuguagacuucuagccacaacaugcguucucccucuugcuuuccaggauuaguucacuuacauugcagauaguugaugcacaaggccagugaagacuuauugccuguauauaaaggggccagacauugacaguuuauccaggacuugcguuuaauuuuuauuuauguuuugagacacaaucucacuguguagccuuagcuggccugguccucuguauguagaccuggcuggcuucagucucacagaaauccaccugccucuaccuccugaguacuggaguuaaaggcaugcaucacugucagcucaggacaugaguuuuaauucagugaauccagauuaauucuauuuucucuguauuagggucugcagaaguccuuuuugcacucucuagcuucuuaccagguauuccgaaaagcugcccccuuugacaggaggacuacguccuuggcauggcacccgacucaucccaguacccuggcugugggcuccaaagggggagauauuaugaucuggaacuuuggcaucaaggacaaaccuaucuuccuuaaagggguaaguggcuauaugugccagaugguuaugcuauaaaacuuguuuuuuggaggaauggaaggaauguugauauccuguagcaaggugguugagaacaaaaguaacuggguguuuucaagcuuauaaaugguaacaaaauucaaauauguuuugaaugcuggccuuuaaaauauuagaagguauagacuguagggucauccauagggucuagcauuccucuuccucuuccuccucuucuucuucuuuuaaagauuuauuuauuauuauaucuaaguacacuguagcugucuucagacacaucagaagaggucaucagaugucauuacggaugguugugagccaccauguggcugcugagauuugaacucaggaccuucagaagagaagucagugcucuuaaccucugagccaucucuccagccccccucuucuucuucuucaucuucuuuuugagauagaauuucacgauguagcuugaaugccugccuguagaccagacuugcuucagauucauggagaccugccugccuuggccaugcccuucugcaucccuucuuacuucaccucauuuuguccgucuuuccugugucaguuaguuuuccauuccugugacaguaccugagagaaaugauucagaggaagaacgacagcuguagagguuuccguccaugcuuguuugcuuugcggccaucaugguagaagaggaugguggagcagugcuugcugcucaccucacagcagucaggaagcagggagaaugaauugcaagggucuggaguaagugauggccuugucccccagagacugcugccucuaaccggaccccacguccuauuagcccauucaucuugaaacucaucgauaaauuaaagcagcgaugaagcuaucccccucaugaugcaguuaccuuucaauaguuccaucaucuggaggagcagaccuucaauauaugagccuugggucagggagggggcaguucauacccaaaccauaguauuucccaugcuucagguauaccagcuacuuccugggacucuggacuugauuuucccuuuggcuggaguucucuuuucuauaguuugcucauggcugccucccacuuacaguucaggucucuguguaauuugccuuuuuaaaaaagauuuaaauuauuuuuauuuuugcauaugaguguuuuucaugcauguaccauaugcauaccauaugcauaccuggcaucuucagaggccaggagugagcaucagauccuuuggaacuggaguuaaaaaugguugugggcugccgaaugaaugcucagaaccaaaccugggucuuuugcaaaagcaacgagugcuuuuagcagcugagguauaucucuccaguuccuaaucugccuuuuacuauucauucauucauucauuuauuuuugaaacaggguuucacuauguagcuuuggguggccuagaacuauuuagaccaaauuugucucaaacucauaaagauucaccugccucugccccaggagugcugccauuaaagguaugugccauucauugaucuaccuuguuaaagaggaaggagccccugcccaacccaaucacuuccuaaauaauugcucugcuuuacaauguuccccaaauauuuaucaguauuugaaauauugcauuucucugucgugcccauuggaaaauaauuauggcugcagggaccuugucuuucugcuuuauuacuauaucuucagggccuagaacaaucuuuggcauagaguagcuacuuuguauuuguugaaugaaugaggggcuugaacuacagcuggaucaaauucucuaaaacaguaaagaagagucucugggaguuagauguugucaaagucuucagggaugacuaaagaauacuauuuaaauaaucaggagacaagaggaaagucauggugcugucaggugucaggcaagauuggaagauuugauguagaguuuaggugcuuuguugucauagccugcccugcuucuguuguuagggcucaaaggcaagccuuuuaccacagaacuacauuuugauguccucacuuaaguuucuauuuuagguuugauuuguaguuuuuuugagauagggucucacuauguagcucuaauuggccuggaacuuucuauuuagauugggcuagcuuugagcuuacauagauuuucugccucugccucgugaauacuggaauuaaagauaugugccguggcugggcagugguggugcaugccuuuaaucccagcacuugggagacagagacagguagauuucugaguucuaggcuagccuggucuacaaagugaguuccaggacagccagggcuacacagagaaacuaugucucaaaaaacaaaacaaaacaaacaaacaaacaaaaaacaaaacaaaaagauacaugccacaaugccuggcuauuugauauucuggaaaggggaucucauuuuagcccaggcuguccuugaaccccuauauaaguaagaaugaauuccagauguuucugcuauuuccauuucucacauauggaauuauagacauguaucaccaugcccacaguccccuuaggaauggucuaaaaugcuaagauuuauguucagucucuaagguguuggcuguuuaggaaacuuaccuuauuugguugguaacggacauuggagaguuguucuauaaaaaugacuuuauaguuuuagaacuuaaguuaaaaacucaauagaccucaagaagccaaacagguucgugguggaaagauaaacuguuaauaguaaagagacaauuuuuaugauaaaaaaauguaagucuuaaauuuuuuggauauaauuuuuuuucuuuuucaaauaaagccugaaaauauaugaaugguuucuaugagugcuguaugguuuuuguuguuguuuuguuuguuugguuuuaguuuucuuuuuuuuuuuuaagauuuuauuuauaugaguacaugucuucagacacaccagaagugggcaucagaucccauuacagaugguugugagccaccaggugguugcugggaauugaacucaggaccucuggaagagcagucagugcucuuaaccgcugagccaucucuccaacccuuguuuucuuauuuuuaagauggggucuuacuuugcggcccuugauuguuuggaacuuacagagaucuaccagucucugucuccagagugguagaauuaaacggagguguuacaauguccaguuauuaucguuugagaucagaucuacuaguaauccagguuggccuuaaauucccuauguagccuacuccuaacuuucaaaagauccaaaauuggagauugugagauggcucagcaauuaagagcacuggcugcucuuccagagguccugaguucaauucccagcaaccacaugguggcucacaaccaucuguaaugggaucugauguucucuucuggccugcaggugcacaugcagauagcauucaugcauuaaaaaaaaaaaaaaguuuuaaaaaaaucaaaauggauauaacaucaaguaccauuuuaaaaauuauuuuuguuuuaaaacacauacaaaauaccauauuaaccacuuuauuuuaauuuuugagacaaggucccauuauguugcccuagcuggcccaaaacuucuagguuggaguaauuccuaaauaguugagacuuggaccagcuuaugguaucuagccuaauacuggcauuagguaacagucuucauugguuuuaaauguuuuugugguuaaguaaaauaaagcacacaucugagcuugcucauguucuagcuuaccguuucucccacuauaguuuuagaauugaaagaggugaagcuguaucccagaugaggccucuaauuuaaaugaaaauuuugggaaagcagcucaucugaaaggccagguuagacaggcaugggagaccaggaguucaagucugagaugggugucaggaaaacagggcuguguagauuccccacucccaccccaacccccacccagugcaggcuacaaaacaggugacuuccaggagagguuguuuaaauuuaagccagaacaaagaauuccagcaagagauuuucauuuccccaggaaucuaggacacaggaauagagaaauacaguuaugccuggaggugguaaagagccugaaauauucuagggaacagcaucaugaugaaaaggagaaagacagcugcuuugaguuugugccagaccgagcugcuuuuguuuuugcacacuccaccccucaguuuuguagaagagggugcugaagggcuccacauagcuaagcauacuucuguuccugagccauacaccauaucgcccuauauuaccucuucuuauacuguuauauauguauauuauauaugcuguguauuauauuacaugcauagaacugaaguuuccuuacacugccauggagauugguuugagcauugaguuuugugcuucacaggaagcuagcuuggggcagagagcagguaugcugguauagaggacuuuguuuaccccagauguugauaggaaguuggcuugagaacaguuacaggaaacaguagggccaugguuuguaacuuuugucaucugaucuuggcuuuggucuugacaucuuucaaauccuuggugagguacuacacauuacauuuucaaagugaaaagauauuuaaugaauuuuuguaaaauuuaugucuguuauaaaauucaaguaauagaaguuuaaagauuuaaguaaauauccaaaacaauccauuuuaaacauuucucuggacacauccauuuuucucuucaguauugcuacacaaauauucuaucauagauuguugugcuuaacuuaugucaaauauguauguuuuauacacuaguacccagguuagccuugaacucacuauguaaggaugaucuugaacuguuuguuuguuuguuuguuuguuugagacaggguuucucuguguagcccuggcuguccuggaacucacucuguagaccaggcuggccuugaacucacaggagauccaccugccuuugucucuucagugcugugauuaaaggcauacacugccacugccuggcugaucuugaacuuuugauccaccugucucaccugggauuacaagugcguccacaauucucuuuucuuuuuucuuucuuaucgucaucauugucaccuuuuguuuuagugucaguguaaugcuggccuuuuuaaacgaguuggaaaguacucccucugcuuuaguuuucuggaaauuguauagaauugguauuauuucaacuuuuaauucugcguguguguguguaugcugcauaugaguuguacauguacauauggaugaucauacacauguauguguagaggcuagaaguuugauguuggaugucuuccuuagucacucuccacuuuaauuuuugaggcagagucucucacugaaccaggagcucaacuauuuggcuaggguggcuggcaacaaguucuagggauccaccuauuucuaucuccccagcuaacagcacagacaugcaguuccacuguggcaaagcuuuuuauauggauacucagaaagaaucagaacucugguuuucauacuugcacaacaagcaauuuccuaauugagccaccuccucugccuuccuuauuucuuguauagaauuuauuagcaaagucauuugugccuggaggguuuuuucccuucauuuaauuuuaauauuaguuuuuguccuuguuuuguuuguuuguuuguuuguuuguugagauggcucucuguguaacagucuuggcuguccuggaacucauuuuguaaaaucaggcuugccucugccuuccaagugcugggauuaaaggugugcagcaccaugcccagcaccuucucauuuuagaaaacuauuucuuuuucuuuuuuuuucuuguucuuuauuuuuauuuuuaauuauguguaaauuugacugucuaugugagggcaccugagucccugaggcuggaaauaggcuguugugagccaacuaauguccgugugagaaaugaacuugggucuucuucaggaacaguauauuccaguuccuuccuuccuuccuuccuuccuuccuuccuuccuuccuuccuuccuuccuuccuuucucccucccucccucccucccucccucccucccucccucccuuccuuccuuccuuccuuccuuuucguuguuuguuucugaaauuacauuuguguaguguauggccagguaccaugaaugcauguaaaggguaaaggacaacuuucuuucuuguuuguuuguuuguuuguuuguuuuucgagacagaguuucucuguauagcccuggcuguccuggaacuaauuuuguagaccaggcuggccucgaacucagaaaucugccugccucugccuccccagugcugggauuaaaggcguuguguguguguguguguguguguucuuaagaccaagugucacuguauagcccuaguuggucguaaaccaacaguccugaggccagcuauaguguuagaauauuuuagaggugcauaggggguguugggggauugaacccugggcuuuguacaugcuaagcaugaacucuaaguuacaacccuuggccccacuuuuuaacaauguagaguacauuuuuaaaaagauuuaucuguuuuauuuuuauguauaugaguguuuuguuuacuuguauguauguguuaggaggucagaagaagggguugaauucccuggaacuggaaucacagaugguuauggcccacugugugggugcugggaaucaaauguggauccucugcaagaacaagugcucuuaacugcuuagccaucucucuagcauaauucaccacccuuuucuuugagauaggaucucuauauagcccuggcugucccagaacugcuuuuguagaccaagcugaccuggaacucugcuuccuccauucuguauucaucaccauucguagcuuuaaagauuugcuaaaguguagaaaauauuuauauuugucuauuguuacuuccacugcuucauucucucucucucuuuuuuuuagauuuauuuauuuuauguauaugaguacacuguagcuguacagaugguugagagccuucauuugguuguugguaauugaauuuuuaugacuacugcucuaucuggucagcccugcucccuucggucaacugugcuugcucaggcccaaagacuuauuuauuauuauacauaaguacaccguagcugucuucagaugcgcuggaagagggcgucagaucucauuaugggugguuucugggauuagaacucaggaccuucaaaagagcagucagugcucuuacccguugagccaucuccccaaccccacuguuucauucuuuuguguguucuagauuucuucuuagaaacaucuuccuuuaucugaagaaauucaauuacuauuuuauauaauauagauuaguugaugaugaaaucuuuccauuucuauuugccuaaaagagaauuuugcuguauuuuuaaguaagguguuuuuauuagauagagaauucuauaucuauaauuuuuaggaaaucaaugaaaaauuauuuuacauuuauugcuugugaaaaugaguacuugaguauaugagaaucagaggacaacuugugggaguugguucucuucuccaccacauggguucuggggauuagacucagguugucagucuuggcagcaagugcuuuugccuauugagcugucucacuggcccuaaaauuacauuuuaauuuacaaauaaagacauugauauauuuauguugcacaauguguuguugguucauuuuuuuucaauacuucaaagaugcuuuuuuaaaauuauuuacuuuucuuauuuuaauuuaaauuauguauguguguguguauaauugcaggugcucucagaguucagaagguaucagaucacuuggacugauaugaacuggcuaagcucaguucugggaaccaaacucaggcccucuucaagaauacuuaacugcuaagccaucuccagccccuuagaaagaugcuuuuuagugggagguuugccaccauccuuauaaaauuucuauauaugaauauguuuucugguuccucuaaaagauucucauguaauuuauguacauguaauacacagcacacucacguagucacagcacuuaaggccacugcagucuacaugcugauucggagcccaaucugucuacaugacagccugccucaaaaauaaauaaauaaauaaauaaauaaauaaauaaauaaauaauuaacaaaaauaaaaagagguggggcaguggugguacaagccauuaaccccaguguuugggaggcagaggcaggaagaguuccaggacagccagggcuacacagacaaacuuugucuugaaaaaacaaaaauaguaaauaaaaauaaagcaagcugagccggguguaguggugcacgccuuuaaucccagcacucgggaggcagaggcaggcagauuucugaguuugaggccaaccuggucuacaaagugaguuccaggauagccagggcuauauagagaaacccugucucaaaaacucccccaaaauaaauaaauaaauaaauaaacaaacaaagcaaaagauugugaugugccucuuaauuuuccaaguuucaucagcuugcuaucauugagcuucaaccaauggguuuauaguugucaccaaauuuggcaguuuucaggccacuuuuuccccaguaguuucuucccccuugucuccuccuguuucuuuuucuccccuuucuacuccccucuuuccccaucugccugccucugucuccugagugacgggauuaaaggcauguacugccaugccuggccuuuuauuuuuucuuuuuuaaguuuuuauacaauauauuuugguaagccaggcagugguagcacacaccuuuaaucccagcauuugggaggcagaggcagaggcagguggaucucuggguuuaaggccagcuuagucuacauacauagugaguuccaggacagcaggggauagacaaagaaacccugucucgaaaaacaaauaagcaagcaaguacacaaacaaaagaaaaaauguuuuuuguguuuucucucaauuucucccugauucuccccaccucccugccacccagcuuucuguuauuucucucucaauaaaaacaaaaccaaaaauccccaagaaaacacacacacacacauaccccaagauggaaaaauaaacaaguaaaagacaaauaagguaaaaauaugcccaaacagccagcuauacuggucaugcuuuuaaucucagcacuuaagaggcaaagacaggcagaacuuggggcuggagagauggcucagagguuaaaugcacagacuacucuuccagagguccugaguucaagucccagcaaccacaugguggcucacaaccaucuggaaugggaucugaugcccucuucaggugugucugaagacaggaacaguguacucauauacauaaaauaaauaaaucuuuaaaaaaaaaguuccaggacagucagagcuacauauuuuuucaggugaaaaaaauuuuuuuaaagagccaaacaaaaauaacacaaaagucuacaaauauaucauugaguaauuuuguguuggccaacuacugagcauggauggggccugcccugaagugugguuaauauauccaguagauacccuagauauuaagauauugguauaguguugcuucacagucuguaaucuuagcacucgggaagaaaagacaggacaaaaagauguaggccaggcugggcugaauagugaaaaaaucccauuggagaugagauuacagaucaguuuaaagauuuucuccaacuaauuuguggcauuuuuauuuccucacauacauuuacacaauaguacucagucaaagccuggaggaaguccgugggaaaaucuccaguguucucuguccaucugccuccucaaaaccauguugacagucucucugcccaucuaacugacacaugguggcuauuguucucccacccuagccuggauauauucuccaagcaagaagcuugcacaguugcaagcuaaccucauuacuuuuccauccuuuguugucugccuauugcauauguauuguaaauguguuucauguauuuuguucauuuuucuaguuguuuaaaacaugagguguguuugauuucugauauuagcauggcuagaagcagaaaucuacauuuauuaauugucauaguuuaucuggagauuuuaaauguuuuucguacccaguggcuagugagauggcucaauggguaaugaggacagaauuccaaucuccaguagauggcaugguaguccaccuguaaucucagcaugggaaacaagugccugcucagcuuugccuuacuuuuccugcugugccaucauacugucccacuguguucuuaugagacagagucucuuaguggcuuggaguucaccaguuagggucggcuggagguaagcuccaagaaucucuugucugacucccuaguguggcuuuacaagugagcaucaccaucccagcguucuaugcaggugcuagguguugaacucaguugcguacuugugcagcaaggacuucagagcuacccucccucuuguucuauugauaagggucaugcaguucaggcuggcuucacuuauggcagacuucuucccuuagccucucaagugcugggauuacagcacacacaaccacaccuggcagaacucuacuuaaaacauuuuucccuccuuugggcuggugagauggcucagaaguuaagagcuuugcuucugcagaagaucuggugucuauucccagcucccacaugguggcucaaaaacauccaugauuugucccaggggagucaagacucuuuucugacuuccagggucaucaggcaugcaugugguacacaugcauagaugcagguaaaacacucauaaaauaaacccaaaaaguuuuggggggguugguuugaaggguuuuugguuuuguuuuuauuuuguuuucucugugaggcuagagagauggcucagcaguuaagaccacugacugcucuuacagaggaccuggguucauuucucagcacucacaugugggcuugcuccucucuucuggucuccacugguacuagucacacaugugguaaacaggcauacaugcaggacaaacaccuauacacauaauaauaaauaugaaaacugcagcucaagauuuaacuuuauccuauauaaucuuauuaccuaaaugauaaaaguuuaauuucuuugucacucuuguacuauuuauucccacucucucuuugacauagaccucuaguaugaugguaaauauguggcuauuccauacguccuugucauuuuuguuuuuaaaugcucauuuaagaaauuuucacuacagccgggcgugguggcgcacgccuuuaaucccagcacucgggaggcagaggcagguggaucucuugaguucgaggccagccuggucuacaaagugaguuccaggacagccagggcuauacagagaaacccugucucgaaaaaccaaaaaaaaaaaaaaaaaaaaaaaaaagaaauuuucacuagcccagaguaguauuaagcgugcauuccugccuuaguuccugagugccacuaugcuuggccuucuuuaauaaggcuacauaauguuguauuacauacucuacauucccacauuuuuuucuuuuuuaaaauuuuauucaguuuuaaguauggaugugugugugacuugcaguguccguagaggccaggagaggaugucagaucuccuggagcuggaauuaaugacaguugugagcuaucaugugggugcuggaaauugaacccagguccucuguaagaacagccagugcucuuaauagcugagccaucucuccagcaccaaacccacauuuuccuauagauuggcagcugaauugauuucaccacuggacuauuguaauaaauguaauuauuguaaaugauguuguaaugaagauggguguguccacagcucuuugagauugccugcauuccauucuuugggauguauagccaacaaugggauugcuggaucaaaugcuaaugcuucuuuuugaggaaccccuauacuguucucaauagccaguaccaucuugaauugcauugccaucaagaaugcacaagaugaagccaggcggugguggcgcacgccuuuaaucccagcacuugggaagcagaggcaggcagauuucugaguuugaggccagccuggucuacaaaguugaguuccaggacagccaggacuauacagagaaacccugucucaaaaaacaaaacaaaacaaaacaaaacaaaacaaaacaaaacaaaaagugcacaagauggggcagggggaaccuuaaucagaauauauuauauuuuuuaaaauauauuuucaauacaaaauaauuuuuuuaaaagacugcacaagaauucccguucguccaaauccucaccaacauuacuuucuguccuuuguaagguguggaggugguauuguagcuuccuuguguuucucuaagcggugaugaguaccuuuucauauauuuguuggacaucugugugucuuuuaguggauguuuggaguuuuguuuguuguuuaguuaugguuuuaaguuaauaugacuauuaaccucuucucuuuaugacuuccaaguauuuucuuccauucuauagguugcuuuuucauuuuuguuuccuuugaugcuuaauuaaauuuuguuuucuuguuuguuuguguuuugaaccaaguucuguuuuagaaauaagacccaaguagccuugaacuuuugccuagugcugggauuacaggcacaugcuaccauuuccaggccaacguuaacauugcuaccugggauaaacccauccuaaucauaauguacuugaccuuuugaaaucaucacuggacuuaguuugaugauauucuucagaacuugccuuuuuuuguguucauguauaaaauuucccaguaauucuucuaaauucuuugacagauuugcauagcaagguuacacuuaccuuaaauuuggaaauuauccacucuuuuuagccaguggauuguucaggauugacauccauacuuugccaccuccucuuuccuuaccuuuccgaauagucaacccaaaaaucauuaaguaggggcaagcagacacuuacacaguagggaggccacaauggccucagaccaguuucuggaucccauuaaguugagauggaugucagugcagguuguaucagaaugguagcuuagcaauacaguuagggccuaaacaggauaaggccagccauucagcagguaggagagagggauggggggcagcggugauguccugaaauagcgaagccugaucaacuaguggaaacaguaaauugucuuacuagcagcaaagguuuaagagacaauggacaacugguuagcacauucuuauagcugggagugguggcacaccuucaauccuggcccugagggggcacagguaugcagauaucugaguuccagacucuccagggcuacagcgcuaucuaucuagagacccuaucuaaaaacaaaacaaaaccagagcaugccaguauauuaagucaguuaaguguuuguuauauugaugaccuuguucaaaguuagaggcuuuuacagcaguauaagaaguggaaaaagaucuccugaagaugccaaguucuuaaaacagugcuugguauaugaccagcucgcuugcuugcuugcuugcuugcuugcuuucuuucuuucuuucuuucuuucuuucuuucucucucuuucuuucucucucucucuuucucucuuuuuucucucucuuuuucucuuuuuucucucuuucucucucucuuucuuuucuuuccucccucccuccuccuccuccuuuuccuucuuucuucuucuucuucuucuucuucuucuucuucuccuucuccuucuccuucuccuucuccuucuccuccuccuccucuuccuccuccuccuccucucucucucacucucucucuccucccucccuccuccccuccccuuccucccuccuucucucccucccuuuccccucucuccuuucaaaacaggguuucucuguauaacagcucuggcucaccuggaaccagcuuuguagaacaggcuggccucaaacaaacagaaaucuaccugucucuuucuacucaaugcugggauuaaaggcauguacaucacugccuggcuuuagcucuuacuguauuuguuacuuuauuugagacagucuauuagcccuggaacuauauauaguccugaaacucacuauguagaccaaguaggccuugaaaucggagaucuguucugccucucaacugcuggcuaauggugugugcuccuauuccuggcuugguugguugguugguugguuauuuauuuauuuguguguuuguguguguauguguguguauguguguguguguguguguguguguguauguguguguauguguguauacaugcauguaugccuuguguacaggaggccagaagaggguauuggaugcccuggaguuggaguuauaugcaguuugagccaucuuauguagaugcuaggaacugaacuccaaacagcaguaggugcucuucaccaugaagccaucucucuagccucuuaauaaauguuaagccauagguguuacuccccacuuuucuaauuuguaggggguggggaggauguguguaguugggggucaaacccagggccuugugcauacuaggcaaguguucuuacacuuccuagaccuccaggcucaguugugucaucacugcuuaaaaugucuggaaggacaggaaagaauacagauaguucccuguccaccaaacaucgcuuuuuuuugagcugaagcucuuauaacaagagcaugcugcgguuuccaagguuugaacgugagaauguaagccagaaaugugauaaaguagggcagcaugagggaguuuuuaugaagucaauguuugcaucuuaauuuuggggguggcuaggcuauucagauauuuguguguguugaaauucgaagagccguguaccagaaccagucauauuuacuaccucuuaaucgacaauauaaaagucaaaauaaagccuuaaaaacagauauucuaaugugagguaucuaagcuggccuugguguugcugccucggugcugucugggugcccagacccggccccgcacuucuggcccaucauuacucacuggcuuuuuccuuccuuauguuagauuggagcuggaggaagcaucacugggcugaaguuuaaccaucucaauaccaaccaguuuuuugccuccucaauggagggaacaaccaggcugcaggauuuuaaaggcaacauucucagaguuuauaccagcucaaacucuugcaagugaguaguuaacuuguaagggaaauggcuucuaagcucuagaugcaguuugcugagaacauacccaguucuguuucugucacuuuggcccagcacagggaagacagggaucuuagccacuuugcaccauuccuuuuccuccuuagauucugguggcucugacuuugaccugagugggucguuacacuaggaaggcauucuggauccuuagcucuugucuuugauggaagggcuuaauuacuucuguaaguuauagcuguauuaaauuagaccuuuacuuucacaggauaaaucaacaugguauuuugcuuggaaagguauuuacagaguagagcaggaaucaaggacaaguuuagccacguguggugguauuuaccuuuaauggcagcacuugggaggcagaggcuuguggaucacuaugagcucuaagucagcuggguccgucuagaacuacauagugagggccuaucuuaagaaaagaaagaaaaaaggggggcaggaaagaaaaaaaaagaagugcaauguuauugcccuccauuuuccgggauguaauggccuugcugucuccuugguggcaguguuaacagguggaagaauccuccuaagaauaaguggcuggagaaauuacacaugcaggccacuuugaugucuagccagagacacaguuuugcuaaggaugauaugugggugugugcagugagucuaagcagcuugguuauuauucugggcugucccauaagguugagaacaacaucaggagaggggacuagauggacuuggaguucucuuggcuucgaaucagcauccaugaaauaccugcuucuugagucucuuuuuucucacauaguuuucgagaguaaaaagguucugguagucuuugauuuuuuuuuuuuuucccuaaaugcucagaaggggacagauguucacgucuagccagcuucgaggagcuccgcugaacaguuccuguuugcuuugcccucuccuuuggugcaaagacugaggagugaugagugggaauaguaaauaaaacucuucauuccugggcuguggggagcaagcuagccuuguaauuuguauucuugcucugagguuccaggaacuagcugaggauucugggcucagcaauaacuggacacauuucugaguucugucaacucuuucuguacucuuucacagcccuuuucugcaagguaaacaaggcugaaaacccuccacuggaaauuuauaguaagacaguuacucacugauucaacaaauacuugauacuggaguugucacagugacuaaacagacuaucucagucucgaagggucuuacagcacacucucucccucuagggucugguuuugcagccuugauguuucugccaagagcagaguggugguuacaggagacaauaugggacaugugauccuguugagcacagauggcaaggagguggguacuguguggcccacgccccauccccucaccccucuuugguucaacaccugaaccaaacuuuucucuguagcuuuggaaccuccgaaugcacaagaagaaaguagcccacguggcccugaaucccugcugugauuggcuucuggccacagccuccauagaucaaacagugaagauuugggaccugcgccaaauuaaagggaaagacagcuuccucuacucacugccucacaggcauccugucaaugcaggugugacaucccaaaccccaucuuccuuaugugcccugucuuucucaccaccagccaucaggucaaugguguguaggacccuuucuggcuccgaccgcuccuuuggcaguggaguugccaugguaguuuuguucauaguucagauugaucucuccuccccuaccuagaaaggaaagguauuuuggaagaucaggauaccaggggcugaggcuuccuucagcuuaagggcuuuucacuuugucagcuuguuuuagcccagauggagcucggcuccugacuacugaccagaacaaugagauucggguuuacucugccucccagugggauagcccccugaaucugaucucccacccucaccgccauuuucagcaccucacacccaucaaggugagugacaagagaaagggaucugucauuaugggaaggggacagaucuuuccauguugggggaagggucacauacacagccuacaaucucagaauaacugacacaaaauaggccccuuaauccuuuggcuuuaucuuuuccuuuuaucccauuucuguaauuccauuaagaguucugucuuuuugagguaaggucuuacuauguaucccuggcuaaccuagaauuugcuacauagacuaagcuagucuugaccuaguagagaucaucugcuucugcuucccaagugucugguguuaaaggcaugcaccaacauccacaccaaguacccacugaguuuucuuaguauaucuuaucagcuaacuuucuaaacuuuucagccuagcaucgaucuuacugugggcauuuucuaugaccuugaucuuuugcucugccuucuguuucaguuuccauguuuugcagcugacccauaaacuaaccuaacauuauuggauuuccuuacagguuuaagugguuucuaacaauagaaauaugacccuuaguuucccaauuuagaccucuguuucuucuguaagauguaccuaacugguaggguuuugugaagaugagucaggauacauaaaacaccugacaccaugauaaguacuucauaaacacuuuuaaauaaagcuuaguaucucacauacuucaaaucaaaaccaauaauaagcaauauuaagaauucuucugaagccagguauuguggcacaugccuuuaaucccugcacgugggaggcagaggcaggcggaucuaugugcguucaaggccagccaugacuacauauugagauucugucacaugcacacaaaaggauuuuucugaggcuguugcucaguaguagaguguuuaccuaguaugcaaaauauuagggguaccaugauggcauacauaaauuaucaggugugguaguauacacugguaauucuggcaccugggggguagaagcaggaguucacagccaguuaucgcucuugcuaggcugggugcucuucugucccaucauauccauugaugacaacaucuauuuuuguuucugcaacuacuuccaagccacugcacguaccaauuuucucuuaaauaucauuuauuuaauguguauggguuacuuuuuucucuuuaagagauauauauagaucauauuauauauauauauauauauaaagagaauauauauauauauauagugagagauggguacuuucuuuauguacaucuguacaccugaagauggcaucagacaguugugagcugucaugugggugcugggaauugaacucaggaccuuugaaggagcagugagugcucuuaaccauugagccaucucuccaggugcauguauggacguuuuaucugcauacaugucuguguaccaugugcauaugugcccuuggagguaagagggcaugggaucucaugaaacuggaguuacagaugauugugagcuaacauuguaggugcuaggaaaccuauguccucugaaagagccagugcauuuaaccauugaguugucucucaagccccucuucucuugaucuucucuuucuuccuucaaaacugccuuaaagccaugcaaggggcacaaaguauaauccuagcacuucagguugaggaaggauugucgauuuuaggauugcugggcuacacaguauaaccucugucucauaaaaaucaagaacugucuugaaauuaggaaaagccuaauucaauucuaucacaaaaaaacccugcuagauuuguuuugagugguauggucuagggaaugaagguuuucuuuccuuuucccuucauaccaguaacuuuauauccaagucuuuguuaugcauggauagaggaagauuaguaguggagccacuucagaaccuaaguccuuuggugguguuuaccagaggcuuuuuguucuguuauagguuuaucucuuagguuaaagucuaaauaagguugcuuggcaauaauaguaaacaccuccaauauuaacacuuaagagacagaggcaggcagaucucugaguuugaagccagccuggucugcagagggaguuccaggacaaccagggcuacacagagaaauugucuugguagaaaaaacaaacaaaacaacaacaacaacaaaagauccaaccccccuccccagcauccuuccuccaaaagaucugaacaaggcugguggaaaaacauuuguuaagagccagaggugcucagugguuaagaccgugccuagcaugcacaaagguucagccccagaauuacaaaaacaaacaaacaaacaaacaacaaaacaaaaaugcccaaguugguaucaccuuaagaaacugcaggaaaggagcuagagagauggcucagugauuaaaaacaaugcuguucuuucagaggaccugaguuuaaaucccaguaccuacaugcuagcucacaacuaccucuaacucuucuuccagugcccuuuucuggucucugccgucguacuuaacuuauaguauacuuacauacaugcaagcaaaauacucacgcauauaagaaauaagucuuuaccagguggugguggugguucaugccuuuaaucccaguaguuugaggccaucuggaucuacagagcaaguuucaggacagccaggaguacauagaguaagauauauacaaaaaucgguuuuaaaauaucuuuaaaauaaaagaagagaaaaggucugaggcauccuaaggaccuggaaagcaaguauguacaauguagggcaacucacuuuuaaguccccuccuacauaugcaauaguccuggcuagccugacuauguaaaccagggcagccagguuuacacagagaagucuuuuaaaaaccaaaaccacuuuuauuuauuaauguuaugugugugccuauacccucaugccacagugggcagaguugguuuuucccucccacaacauggacucuggggaucaaacucagguuaucaggcuugguugggaucagaugccuuuaucugcugagugaucuagucagcccucauacuugucuuauaugcaguauuggauucuucuugaccuaugagcuguuaaaaaaagagaaaaauaugcauauauacauauauugucauauacacucacuguguauguauauaguccagaagagggcacuguaucaccuggaaguggaguuacagacaguuaugagcuggcauguagguacuaggaauuaaacucagguucccucugcaagaauagcauguguucuuaaccacugagucaucucucuagcuccucucuuauaguuucuuucuuucucucucucucuuucucucucuuuuuuuuucaagacaguuucucuguguagcccuugcuguccuggaacucacuuuguagaccaggcuggccucgaacucaaauccgcuugccucugccucccaagugcugggauuaaaggcgugcaccaccacagcccagcuuuucucuugcaguuucuuaagaugauaccaacuugggcauuuuuguuuuuuuuuuuuuuugcaauucuggggacugaacacuugugcaugcuaaguaagaucuuuaccacuuaacaccucuggcucuuaacaaauguuuucccauuauccuuguucagacuuuuguuuuuucaagacaggguuucugugcagaccaggcuggccugugugugagauucugcgaucaaacauacagccuuguguaugcuauauaggugcucugccacagaacuggauauccagcccuuaaaaaauacuuugugugugaaggcuagagguugacagcaggugucuuucucaguuguucuccaucuuauuuuugaaacgguuucucacuguaccuggaacccacugauuuggcuggaguagauagcuagcaaguucugggcauccugucuccacccccagcuggaauucaggugcaucaggacaagauuuguauaggaaugcuggggauccaaacucaaguguacuuauaccaaccaaguccucgucccuaacuccaaaaaauacuuuaaauucugacugaccucucuguuuccuaggcgaccuggcauucacggcacaaccucauuguugugggccgauacccagauccuaaucuuaaaaguuguguucccuaugaacuaaggacaauagauguguuugauggaagcucagggaagaugaugugucagcucuaugauccaggauacuccgguauuacuucggugagacuugggcccccaaacagugaugggaggaagcagggaauuucucauuagaaguaguccccauuuacugccucuguacugccuucaacccagcuucacaccgauacucuuacuuuuguagcucaaugaguucaauccuaugggagacacacuggccucuacuaugggugaguaaaagcaacuguaucucaaacugucuaagccuggcccuauccgaggcugcaguggaggcugaauucaccguagcucugcccuauucgucccagggcagugggcaguaaauauaucuuggagacagugguaucuggccuaggucacccaucugguuuuauuuuagucauggcaaugucagucuguuaguuccccaagacagccccaaccucugagacagaccagcaacagaaggugucauucagacuucuuguuucuucuagguuaucauauucucauuuggagccaagaggaagaugggucacagaaagaucaugaaagacuaugaagauggugugggacagcaauacuggaccccacagaugggaacacauucugugaggaguggcagcuguuuguuaauaggccaaaaguacccaau

SEQ ID NO: 12070 - RNA, 69239 nt, Mus musculus
ucgcgaguaccagcgccggcuucucccgcuucccugcggcgggagcccgcuggccuucgacucucggagggggcgcggcgggggcgcagagggggcggggaggacccgcgacgccccgccccccuccgcgcucuggcggcucggcccgucccuugggguccgggucccgaggccgcugagacagcaggccggcgcugcccgcaggugucggcggcagcggcggagccaccggccucaugguggguuucggggccaaccggcgggccggccgccugccguccuucgugcugguggugcuacugguagucaucgucguccuugccuucaacuacuggagcaucuccucccgccacguucugcuucaggaggagguggccgagcugcagggccagguccagcgcaccgagguggcccgcgggcgcuuggagaagcgcaauucggaccucuugcucuugguggacacgcauaagaagcagaucgaccagaaggaggccgauuacggucgccucagcagccggcugcaggccaaggaaggccuggggaagagaugcgaggaugacaagguaaggucgagcccuuuccucggcccuccuagacuuuuucuuuucacuucugggugggguauuaauauucgcccgccggcgauugcuguaugccgucagcgugguagcccuggaagcuccccagacccccagcaacccuguuuguugucagacuuucccggugucagcgccacauucucuguucgcuugcagagacuguaaguucugguucucuagaguggccuauguguggauaccaccuuuccuccaagcucagcugcugagcuggcagugguuaucaucuggccuguguggccgccuucguucccggcacacaggcugccagguauauguaugggcauugucucauccaccuccugugcagacugaucaauauuaauuuauuucagaaugcggccuucuucccuucuggugcucaacauguauuugucaacaguauggcuuuuuagaaaucucuauaaauugauguauuuugcuaaguagauuuuuaaaaaaugaauuuuguguugaaaguguuguuauagaugagucaggaacccguauaugagccacacuugugacuugagugcgguuaauccauuaucuucucaauuugaauuguuaaugaaauuagccgaaaugguagaaucuaaaaauaaguucuuaggaacagaaucuuaugucugucguuauaauucuugaaagaaaauaaaauugugugugcuuaaauagcucuuagggcugcugcuuaaugcagauagaaaauacaaaauuuuaaauuuaaaaaucuuaagucuggacuaugaucauguccuacuuaauaggaucuguuuucacuauuuuauugacaguuuauaacuuaggcaacuucaguugguauaucagaauucugaagacuucuagauagguacuauaguagaugacuucuuuucuacacucuuaaaucuuuuaagauuaaauuucuucuuucuuuaucuagugugugugugcaugugcauacacauguguggagauccgagaucuggagucaaguucuuuccauccauccuguggagcugacuucuguuuaucugucuuggcagcaagugcuuuuagcugcugagccgacccuuaaauugaauuucauuuguguguguauucacccuaaugcacauguggaugucagaggauagcagucagauuucuccuucuaccaagcagguccuggggauggaacucaaguucuaugagauuuuuaaugagcuuccaaccuuccuacccucauuggccucuacuuucuuacuuaucgaaaacugagccucucaguuguuuucuuguucccuuuucuucuuuauacaguaugcacauccucugagaaggcuagagaucagcagacagauguaccuucuauacacugaacuguaaaacauggauacaguagguagagacccguaagagcuuggaguauuaaaauaagaucuucaagauggaccguuuugaucuagcauucuuugucuugugguugugccucaaaaagugagcucucgacuguuucuuuucucugucaucugauggacuuugacccuguaaaacucuuuuuuuuuuaaaaaauuauuuauuauacauaagugcacuguagcugucuucagccuucagccaugccagaagaggugucagaucucauuauagaugguugugagccaccaugugguugcugggauuuggacucaggaccuggggaagagcagucagugagugcucuuaccugcugagccaucucgccagcccgacccuguaaaacucuuaaguauuuuaguuuucuguugccauggcggaacacccugaccaaggcaacuuacaaaagauagcauuuuauuuguggcuuacauuuuuauuauuuuauauguauggguguuuugucugcauguuuuuuuuaauuugugcaacagauaaguaucugguuccugaggaggccagaaguuuuggauuccccuggaacuggaguuacaggugguuuugagccaccauguggguccuggaaauugaagccaaguccuuugcaaaagucauagaagaacacugggaaugaaguaacuccuuugaaaccucaaagccugcccccagugacacaccuccuuuaacaaggucacaccuccuaaucuuucccaaacaguuccaccaacuggagaccaaguguucaaacaugagccuauuagggcuauuauucaagccaccacauagauagaggaaccccaguucuggaaccaaaaaggugauauuuccuucuuccaguucauugugccaguucugucauuuccaggaugagagcaagagacaguguucucaucacuguccaugaaagugagaaaucagacccauuucucuagauucucucaaacuuacuauauuuuauuccgucuguaaaggauuuuaacuuggagguguauauuaguuugcuagggcagguauaacagauccaagauaccacacacgagauauaaaacuuuauuucuccacagaccuggaggcuuggaguuccaggucaagguacaggaaaggguuggguuucucugagaccucuccccgugguugcagauggcugccuucuugcugcucuaucuugucaugguauucccugauggaugcaucccagugccucaucuccuuuuuggauuguggucccucuuauacaugacuuguuaugguaucuucaggaacucacuugugccugcugggcuugcugcacuguuuacuuccccugcuuuugugaugagcaaggucacagaaucuucuccuguguguucagccacagcauacgagcuaugcuaugcaagucugcacuaauuguucaggguugcagggagggacuagaguguagagacuggugaagggcuuugauucuguggcugugggaaagcuuuuauuccuucuagguagcccuuuaccuaugugcuauaaggaaauccaauaaacucauugguuucccagggguagauguuucuugggauuccccuggggaugcauuuuugcaacagccccacacuaauagccuuauuuaaucacugcuuuaaacuccaaauauaacuguauuuugagauccuugagguugaaaccucaacguaugaguuugaguaguacaguuuacuaucauauacacaauguaguccuuuuuuuucucuucuuucuaccaaaaagacuguuuguuacauaaacuguauuuuucuuuuucuuuaagauauauuuauuuucauauaugugaguucagcagacacaccagaggagggcuucuauuacagaucuuauuacagauggcugcugggaauugaacucaagaccucuggaagaacagccagugcucuuaacugcugagccaucucuccagcccuuccuuuucuuucuauaguagacaggagucucacuguguccaaggcugguuccaagugcugguauuugugugugugcccucaaccagcuugaacuuggaugccuguuacugugucucaugcacugcaggaaauggucuagcccagggaaaggaacuauuugaguguagacaguaucuuccucaaagcugcuauuucuguuauaaauacacauacacaaagguccaguuuugaagcuaggugugguggcauaggcuuguacucacagcauggggagauggaggccagcaugaguucaaggccaaucuggauuacauaaugaaacccugucuugaaaaaagaaaaaaaaucaauuuugauauuugaagcugaacaauaaaugacuuguuuuucuguuaacugacauaauccugacugagaguauauuaaaaaggauacauaaaauauguaaaaaauuauaaauaaauagcuuuaguugaaugaagaaaggagaauggggcauauuauauuuuuccuuccaaaguuaucuucacuguauguacaccacaauguauaaguauuuaacacauacacacacaaacacacauacacacacaaaguguguguauauaaaagcuuuagcacacaacagcuacucacuuagaagcaggucugggcaguaggugugcccuuugccacacuacgaugcaccuuugcugugcuacauggcgucaguacaagucagacaaaccacuccucugugccucagguguccucaucuagaaaaggaggaggaugacguuucuuccucucuggaaguugacauuaacaaauccgugaaaaucccuaaaagagggcuggagagacgguucaucgguuaaaagcacuggcugcuuuucuagaggguguggguuugauucacagaauccauguggugcucacagccaucuguaacuccaguuccacaggaucuaaaguguucugacuuccacaagcaugaggcacauacagggcacacaggcaugcaugcagacaaaacuuuuauauacauaaaauaaauaaaucuuaaaaagagaaucuuaaaugccaucuuagcuauuauuccuuuucugcucccuaugacagacugacugccuucuuuccaggacggagcucuguuuguguuccugcccaagauccgguucuagcuccaguguccuguuugacuuuuucuuuccuuccccacuuccugguccauugucaauuaacuuuaguugguuccgucuguaguugccuucccugacucugguguuugaugguuucucuguacuuuaggaaucagccuuucaucauucuaaaugcuuccacuugugccuuuccucugacucaccugccaaaaucuggcuacuguauaacugcaauuuaauugcuacuucauguaacucaaaaucaugaaaaauugguaccuucauucugaguuuccuauccuaugauauuaguccuguguaugauauguaacuauuaauaaagcagguuagaauuuugggcucucccuaaacaauucucccccauaaacaaacccaagcauccucagaccuuacuuucagaguggcuucaugaguuacuuuaugaagcagaguguuguuuaaucguguagagugucuccaacuaucugugucuuccguuagcuccugauucagacuguuccagucugguggucugcugaguucuagcuccguuuacaguucuaugucauuagaacugagugugugucauucuuccuccuugacucauccuuuugcuucuuuuuuugucuuucccucuaauccaucugcacucacucuguagcuccuaggacuucuuaccuagaucauguguuuccuuuuuuaaguguaauuuaccuuauuauuugagcuacacuaguuuauuuguuuagcuaauagcuuccugugugcuaaccucuucucaacauuguaaguucucugaggacagacugcuugaaauucccuguaguguuucugaagaaccuaaggagcugaagggguuugcagccccauaggaagaacaacaauaugaacuagccaguaccuacagagcucccagggacuaaaccaccaaccaaagagcacacauggugggacucauggcuccagcugcauaugccuggucaaacaucagugggagaagaggcccuuugucuuaugaagacucuaugccccaguguaagggaaugccagggccaggaggccgaagugggugaguugguaagcagggggaaggagggcgggauagggggaggguguuuuucagaggagaaaccaggaaagggaauaacauuugaaauguaaauaaagcaaauagccaauuaaaaaagcaagcaaacaaaacaaaaagucaauugguguaucucguauauaccucuuuuacaaauucuguuaaagauuuaaucccuguuacugcaaugucacuuuuggaaauggauguagcuuuugacauuccuaggauauacaaucucacagcaagcuccuuguuccucuagcucuuaaaauauuucuggucucucuucugcaaugaugucuuagucuuaggugcaaggagauguguuauggauguaucaguugggacugggcuccauagcuccacauuuugauugguuguaguuuuuugguuuuuuuuuuuuucuuuguaugauauccaucuguugcaaggagaaguuuccuuaugaaggcgaggacuucacuuaauuugugguuguaaggacaaauauuuaaaguauaguuggggauuaugaugguuuaguaaaguagugacuguagguucuccuucaaggaaugugacuucacuaguccuggguaguugacuggguuuccaguaccagacaucauuucucucgcauugaaugugauaagucaauuagagaacuauugguuacuggcaagguaugugugcucauaggguucugguggugguugugguucugggauuguagguuucuuuccuucuuuguaagcuuaacauuaugccuucuggcucucugaaagcuaguucucagggagggauuuucaggucaguucuaggccaggagccucgguucugugucugaaagguaggugucuucagcaauaggaacuuaccguccaccucuagggguuuagccaugggcaguaacaagagccuauagcauuuuggagucuguuggacaacuuuggccaacaacucaagacagggcuucuuguaacugguauugggguucuuguuaaauggucuuuggcucuuggauggagcauuguaaacagauaggaaaauuccauuaaacuauauguguauuuguacaccuacuuauguguguuacagguauuuuuagguggacauuuaauaaugugauuucuuacaacuuuuuucagacaucccuucuguacuuaucuaucccucccuaauuagagcuccccuguuuucccauuuccuccuucagaucaucugugcccugcuauccuuccucucuugugcccccucuaacaaccccccacugguccccuuuuacuuucuugguuucuuuagcuacuccaagauauguacucauggcugaauauuuggagcuaggcgccucagaugagagagaacaugcaacuguugucuuucugggccuggguuacuuaacucaauauggauuuuucucuuucuguccauuuaccuggcuagaucuuggaaaaggauaggauaaucguuuugauguguuuucaccccacuuuggcaugaaaaguaacuuuuaaaaaaguuuuagaauuuauuuuuuaauuuguucuguuuucauuuuauguguuugaguguuuugcuguacauaugucuguacaccacaugcgugucugaugucuaacccagccagauggcaguguugcauccccuggaauuggaguuccagaugguuguaagcugccaugcaggugcuaggaauagaaccugucuccucuggaagagcagucagugcucuuaaaaaaacuucguugagaauuuuugcacucuauaauuuucuuuuucuguuagaucuuugucuggcuuuuuuuuuaaagauuuauuuguuuauuuauuaauuaauuaauuauauaaguacacuguagcuaucuucagacauaccagaagagcgcaucagaucucauuaaaaaugguugugagccaccacaugguugcugggauuugaacucaggaccuccggaagagcagucagugcucuuaacugcugagccaucucucuagcccaugucuggcuuuguuauuagaguaaugcgacuuugcuaaaagaauauagcaauguuacuuucuuuuuuuuauggaacauuuugaggaaugucuaguagaguucguguguuguauucaucugguucuguuacauugcagaugugcaccauuccugguuuggacuacauuuuucuuuuuuccuaaauauauacuguauggggaggauguguagcagaaugccugccuagcaugcaggaaugcaagggcuguguguguguguguguguguguguguguguguguguguguguguguguuugaguuggaguuguaaggugugugugugugugaguuugaguuugaguuguaagggguccaacccagguucuuacacauguaggcaagcaugcuacuacugagaugcauccccagcagaagcccugaguuugguccuuagcacugcaaaaacaaaaccaacuccagucugguagggcgcaggcagcugggaaaggugagcagaagaugccauguuagcuaacaggaugaauaaauucugauguucucuugcacagucagcugacugcagggaacaggaaugcauuguacauuuuaagauaaaugguaaggauuuuaagugguuuuucagcaagaaaugaaaagcacuugaggcgauacaguuugcccugguuuuagaaccaaagcauguauaaauaugugcugggcuacccaacacagauuacccacuuaucugaauacacuaccucuggaagauaugaucagaauauucuaauguaaagccacucauugucuuccuagcauggggagaauauuguuuuuguuuucuucauguuuuuccccuacacauccuccuguauuaguuuugagauggagucuugcuaugauacccaggcuggucuuaaaaucuugcuuaaaaucuuagccucccauguagcugggaccuuagguucccagggcugguuuucauuucaaaacccuaaaauaucuuuguuucaguuuaauauuuaauaaagagaagaaaguuuagggguuaguucauggaguaucaugaaaacauuuucagucaucuuauauguugcugucagaaacaguuucuuaacuacuuuuuucuuuuagauuuauuuuuuuauuuuuauuuauuuauuuuaugucugugaguacacuauagcuguacagaugguugugagccaccauguaguugcugggauuugaacuuaggaccuucggaagaacagucagugcucuuaaccacugagccaucucuguagccucuuagauuuauuuuuaugugcaugaauauuuugccuguauguauauaugugugcuguguuugugccuggugccugcagaggucagaagaguguaauggauccccuggaguuggaguuacuaaugauugugagcuaccauguuggguucuggguucucuacaagaguagcuagugcucuuaaccacugagccaucucaucugucuugccucagggacuuguuuuauaaacaagaaauaaagucuuacauugauaagaugcuuuaugauguuuaaaugugucccagaaauccagaggcagaggcaggcagaucucuugaguuugaggcuagccuggucuacaaaaugaguuccagggcaucuagggcuacuguuguugggccaccagagaagacuacucugacacauguuuaagccgauagaaagucuuuauuagugggacagugacuaaacugagugguugggaucccaguguagccugagccuuucucagagagggcuuuuaaguacagaagccauguucuggguuaacauacuucaguuaacaagaacaguuagcuagaagcagaaccacaaaaacccaaaagcaaggcuucuacauuuagagacuuucccaugacuauguacuuuuuuuuuuagauuuauuuauuuauuuaugaauauuuuuuauuaaaauaagaccccauguucacuaacucacaagaaaaacacaauuuaaaaucuuacagccucaaaguacacaaagcauaaucuaaaaaauaaaaaauuccauuuacaguaauucuuauuccaauaauuaauagacaaaagguuaaaaaauuuacuaagggucuuaagauuuaggcagcaugugguaucuugaucacaauaucuagagaauaaguagguuucauuagcauagacuuaucaaacuugaugcauguauuagaccauuuucaaccuguggguugugaccccuuuggggauugaauagcccuuucaagaggaacuguauuaaaggguuacagcauuaggaagguugagaaucacuguauuuggcuaaccuacauacaaggucagauauuuggaaauggaauauaaugcuacuuaguaauucauauaacacaggagaaaucaggauggagguuugaauacauguaaaacuuaguaaauaaaauacucaucagaaaaugugggauacauuuaaaacaauaauuugagguauuuaugaccauacauacuuucuuuagaaaaaaaaaaaaugcuuaaagccaggcagugguggcgcacgucuuuaaucccagcacuugggaggcagaggcagguagguggauuucugaguucgaggccagccuggucuacagaguaaguuccaggacagccagagcuauacagagaaacccgaucucgaaagacaaaaaaaaaaaaagaaagaaagaaggaaaauuuuuucuugauuuuuagugagcuaauauucaucuugacaaguauaaaaaacaaauuuaaauaaaguaaaagaucauuuuaaaagcagaaauaaauuuagacccugguuagccauaauugucaacuugauaccgcuuagagugaucugagagaagggucacuagaggaauugccugcaucaggcugcucuagagacaugucugugagauaucuugauuuuuaauugauguacaagggcccagccugcuguguaugauaccuaauuccuuggagguaauacugaauuguauuuaaaaaaaaaaaaagccaagagguaacucacaguuacaguaguugcugcucucucagaugacccauuucaauucugagcacucuggcucagaaccaucuguuacuccaaauccaggaccucuggccccccugagcaccaggcacacaugugguacauagacacacauucagguaaaaugcucauauacagaaaauaaaaguaaguaaauuaaaaagaaaaaaaaagcuaagugugaauaaugcaaggcagccagagugugagccuguaagcagugugaauaaugcagccagagugugagccuguaagcaguaucucuccauggguucugcuuucagugccugccuaagguccugccuugauuucccucagugauggauuaugaauuagaaauguaaaccaaauaaacccuuucuucccaaguguuuuuggucaguguuggauuacagcaacagacugaagcuaauacaacccauggaugaugaccauggguaacagaggccuauaauucccgcauacucaagaaucugaagaagacuaagcuugagcugaaggccagaguaggaggccuaaaaacaaaacaaaaagaaaucaaaccaaacaacaacaacaaaccccaaaccaaaggaauaagucaaguacagcaagaaauuaaaacucuuauuagaaagaacuaaauugauaaagguaaacacacgaguaccuguuaaaagguagucaaaaugaggagcuaguucagucaguagagugcauucccacaaggccuuaggacuuaggugcaaucccuagaacccagugagaagauugguguggucuuacaaccuuguaaucucagcacugagaaaacaaaaauauauccuugggacuugucagccaaccagcagcgcacccaaccuacucugcaaauugcagaucccagugagcaaugcuaucucgaaaauaaagguggaugacucuggaguaaugacgcccaagguugaccucuaaccuaugcaucuacaccaugacugcccucaccaugggggaaggguugucuagggagaugguucagucaccaaaguaaguggagcaguacacucaagugaucccagcacugagaaacagagacagagagaucucuggggcuugcuaaucagccacucuuaacuuaauaaauuagcgaaauucaauggcaaacccugucucagaaauaacauggagagugauuaggaagacacccaaugcugaauucuagcaaggaccauuuuuuauaaccuuuucuuguuauguuuucuaaauaucucauuauacucacauauauauuucuuacuuacauacaugaauguauacacuauagagaaguagccuuaauggagauuucuugaaaggaagcauauaaaugcauauuaaccaaaauuaaagccagaagauaaaaauaguuuauacagaucuauuauaagcaaugaaucaaugauugaucuuuuuccuguucuaaaaguuagacaggucuacuuccagagccuuuggucugucugaguuaauuucucauaucauaugauauacccuugcuuugcaugugcuuuuacucaucugucccagcauguugaagaaccuugucauggcuaaucuugucaauuuggggugaccuaggggauuaguaaagcaugucuguaguugcauccagagaucuuaauaagggcuuuaaccuaaacaauagauucaguauuugaacagacuguugggggaggaggaagcgggccauuggaagccuuuagaagauaaaucuugacccugguccauuuauguacuguucuuugcuucccacuauaagauaaacaagcuccuguguuaaaauauuuugcucuuagcuaagcccagaagcauugaagcuaacuguauugaaacuaacccaaauaaguccuacuccuuaaauuuauaacagcuauguugucacuguagaaaacacaggucucuucauuuuccauuaacugucuuggcaucuauguagaaaucaguugauuguaugaauacauguugguuuguuuugggccucuuagggccagacacuuaacagucuuaaauguuauacuaaggauuuuuaguuuauccucaaagauaaggggaauacuauaauacaguuuuuauuuugaaaagauaagagcugggcaugguggcacauaccuguaaucccaggaaauggaagcauuuagaaauaauguuuagucagguggugauggugcacacaccugacuaauccccacauuugggaagcagaggcagaugaucuaucugaguuugaggucagucugaagugaguucuaggaaagccaggguuauacagagaaacuguguccugaaaaacaaauaaacaagaaagaaagaaaaggagaaaaaagaauguuccuauugagauaauuuucugauauucaguaaaguauuugccuugcaagcaugaggaccuaaguuuggucucagaaccacauaaaagaggggugggaagcacuagaguauguaggcugcuguagacuaagggagaagggcuccaucuauacaguugcacaucucuguuugguguggucuguugagggaggagcaccagcauucaccccuguccccauaaguaaccccuuaucuauauuuuauagagaagcccaauaaacucauugacucccuagaguugaugcagucaugucucugccuuuuguugggaccuuuggagaagguauaggcauuguuuauaucuccuucugggaagaaauucuacugacagaugugucucauaauguggugguuugaauagaaacggcccccauaggcucauguguuugaaugcuuggccaauagggagaaguagcacugaguaguagggagauguggccuuguaggaggaaguaagucauuguggagaugggcuuuggggucucauauauguucaagcuaugccugauguggcaagaagucuccuucugcugccuggggaucaagauguagaacucuugucuccuccaacaucaugucugccugcaugcugccaugcuucccaccaugacaauggguuaaaccucugaaacaauaagccaacaccaauuaaauguuuuccuguauaagaguugccuuggucauggugccucuucacagcaguagaacccuaacuuaagacauggugggguacauguagaaguuagagaacuacuuguaggagguaguccucuccuuccacuaugugauuuucugggaucaaauucagauugucaggcuggaggacaagugcccuuacccacuuagccaccucacugacucguaguuuguuuuguugauacagugucucuccguguaacucugaugacuuggaacuuacucuguagaacaggcuggccucaaacgcagagauucaucugccuccugaguguugggauuuaagguuugcacugccauuuccagcucauaguugauccucuugaaggagauaauaagccacaggaaaaucauuaacuauauauuuggagugaaggauugaaguaauuagaagauaauccaaaguacuucuuuguaguauaauuaauucagaacuacuaaaaaagaguugaaaauugguugaguguggcugcauaugccuuuaaucccagcacuugggagacagaggcaaauggauguuuguaagcuugagacuagccugggguguuuaaugaguuccaggccagccagagauaugcaguaagacccuaucucaaaacaaagaauugggaauaccccccccccaaaaaaacccuccaaaacaaaccaaacagaaaaaaaggguagagcuaacaaaucugguacagcucagguuacagaaccaggacacaaaaaccaguuacgcugcuguucacaggcaguggcuuguuagagcauaucauuaacaacucuguucucauuaacaaaacaaacaaaacacuugggauuuuacaaauccuccuacacugaaaauuaaaacacugaugaaggaaauggaagaguacaaaaauaaauggaaagaugucuccuguuuauugauuggaagaagggauacuauuaaaauauugguacgacccuggagcugacccugugccacagcucuccauacccaaauucauccuggagagaacuggucucccagguguacugacacaggcuugcaggaguaacaagccacagucagagacagcaaggccagcuaacaccagagauauccagaugguaagaggcaagggcaagaacauaagcaacagaaacuaaggcuacuuaacaucaucagaacccaguucucccaccacaaugagcccuggauaccccaauacaccagaaaagcaagacucugauuuaaagucacaucucaugaugaugauagaggacguuaggaagaucauaaauaacucccuuaaagaaauacaggagaacacagguaaacagaaguccuuaaagaggaaacacaaaaguuucuuaaagaauuacaggaaaacacaaacaaacaggugaaggaauugaacaaaaccauccaggaucuaaaaacgaaacuagaaucaauaaagaaaucacaaagcgagacaaccuuuggagauagaaaaccuaggaaagagauuaagagucauagaugacaguaucacaaacagaauauaagagauagaagagagaaucucaggugcagaagauaccauagaaaacauugacauaacagucaaagaaaaugcaaaacgcaaaaagcuccuaacucaaaacauccaggaaauccaggacacaaugagaaaaccaaacuuaaaaauaauagguauaaaagagagcaaagauuccaacuuaaagggccaguaaauaucuucaacaaaaauguagaagaagugggaggcuaugccagugccugacaaauacagaaguggaugcucauagucagcuauuggauagaaaacagggccccugauggaggagcuagagaaaguaccuaaggagcugaaggggucugcaacccuauagguggagcaacaauaugaacuaaccaguacccccagagcucgugucucuagcugcauauguagcagaugauggccuagucggccauuauugggaauagaagccccuuggucuugcaaacuuuauaugccccaguacagggaaaugcuggggccaagaagugggaguggguggguaggggaggaggguggggggaggguauaggggacuuucggggauagcauuugaaauguaaaugaagaaaauaccugauaaaaaauugaaaaaaaauuguagaagaaaacuucccuaaccuaaagauagagaugcccauaaacauauaagaagcuuauagaacuccagauagacuggaccagagaagaaauuccuccugucacauaauaaucaaaacaccaaaugcacaaaacaaaaaauauuaaaagcaguaagggaaggggcuggcaagauggcucagcagguaagagcacugacugcucuucugaagguccugaguucaaaucccagcaaccacaugguggcucacaaccacccauaaugauuucugacggucucuucuuguguaucugaagacagcuacaguauacuuaauuaauaauaaauaaaucuuugggccagagcaagcagggacugagagagugaaguugacuggagcaaacagagguccuaaaauucaauucccaacaaccacaugaaggcucacauccaucuaucuguacagcuacaguguacucaccauacacauaaaauaaauaaauaaauaaauaaauaaauaaaucuauaaaaaagcaguaagggaaaaaggucaaguaacauauagaggcagaccuaucagaauuacauaagacuucucaccagaggcuaugaaagcuagaauauccugggcaaaugucauacagacuuuaagagaacacaaaugccagcccagguuacuauaccuagcaaaacucucaauuacaauagauagagaaaccaagauauugaauaacaaaaccaaauuuacacaauauaguuccacaaauccagcccuacaauggauaauauaugaaaaacuccaacacaaggagggaaacuacacccuagacaaagaaagaaaccuaaaagaagauagccacacaaacauaauuccaccucuaacaacaaaaauaacaggaagcaacaaucacuauuucuuaauaucucuuaaccucaauggacucaauuccccaauaaaaagacauagacuaacagacuggauauguaaacaggacacaacauuucguuacauacaggaaaugcaccucaaugucaacuacagacacuaugucagguaaagggcuggaaaacaauuuuccaagcaaauggucccaagaaacaagcuggaguagccaucuaauaucaaauaaaaucaacuuucagccaaaaguuaucaaaaaagauaaggaaggacacuucauacucaucaaaggaaaaaucuaccaagaagaauucucaacucugaacaucugugcuccaaaugcaaggguacccaaauuuaaaaaagaaacuacuauagcucaaagcacacauugcaccacacacaauaauagugggagacuucaacaccccacucucaucaaugaacagaugauggaaacagaaacuaaacagaggcauaguaaaacuaacagaaguuaugaaccaaauggauuuaacagauaucuauagaacauuucauccaaaacaaaagaauauaccuucuucucagcaccucaagguaccuucuccaaaauuggccauauaaucagucacaaaacaggucucaacagauacaaaagacugaaauaaucccaugcauccuaucagaucaccauggacuaaggcuggucuucaauagcaacaaaaauaacagaaagcccaaauacacauggaagcugaacaacacccuacucaaugacaacauggucaaggaagaaauaaaggaauuaaagacuuuuuagaauuuaauguaaaugagggcacaacguacccaaacuuaugagacacaaugaaagcagugcuaagaggaaaacucagcucugagugccuccaaaaagaaacuggagagagcacaccuaaaagcucuagaacaaaaaaagcaaauacacccaagaagaguagacaaacucagagcugaaucaaccaaguagaaacaaaaagaacuguacaaagaaucaacaaaaccaggagcugguucuuugagaaaaucuuuccuuccuucuuuccuuccuuucccuuccuuccuuccuuccuuccuuccuuccuuccuuccuuccuuccuuccuuccuuccuuucucuucuuuuuuuguuccuucuuucuuuuguucuuuguuuuuuuaucauuauaguuuaacaggagucaaacugaaaaaggaaacuucaguuaaaaugccuccaucagauugucuaguaggcgaaagaucauugaguauuuucuugauuaaugauuuacuauugcaagcgccaucccugaacagcuggaauaagaaaucaaucugcacaagauacuaauucuauuccuucaugaccucuucuuuaguaccugccucccaguucauguuugauuuccuguccugacuaucauucauaauguacuguaagauaaaagaggaaauaaacuuuccucaaaaaaaaaaaaaaaaaaaaaaggcguuugggccagggaggaagagaaaauaacagcauuagcauuuugagcugaaggguuuuuaaggcuuggagucuacaaaguggacacuggcuuagguauuuuauagggccacuggguccuuuccccuacuggaccuuuuuggaaacuccccaccuucugugccuucuggacauuucuucuccaagugucuucuggaaacaagaagcuucucuguuacagagcccacuuuccuuaucuaacugucccuaacucuccuucaaccugauaaccuauucugacucauauguacauacccacuuacauucauauaaaugcacauaaugaaaaacugaaauaaacuuuaaaauauguaacaaacacacaaacaacaaagacuaaaaauaagccuaaccaaggaugugaaagacuuccauaauaaacuuuaaaauguggaagauacugaagaagacauucaaaaguagaaaucuugugguggugcacgccuuuaaucccagcacuugggaggcagaggcaggagaauuucugaguucaaggccagccuggacuacagagugaguuccaggacagccagggcuacacagagaaaccuuguuucgcaaaaaaccaaaccaaacaaccaaacaaaaaacaaaaccaaaaaaaaaaaguagaaaucucccauguucaugguuuuuggcagauuuuguauuguaaaguuuauauauugccaaacgugaccuacacaugcaauacaauccuaucaaaauuucagugacauguuucacaaaauuaggggaaauuguauaaaaauauaaaagaacagucaaaagucuuccuaccccuguccccccagaccccugccccucugccucccuucccaucucacucucuguccccuacccucuuccccucuaacucucucugcccuuugcccucugccccucugcccccuuccuccugccugucuucuccucugcuccccugcuccccugccucugaaaugcuggaauuauucaugugcaacacuacacuuggcuguacucuguuucaugugcuuauuucaagcauaguuggagaaagucauauaaccauacugaugaacagucacgcuuuaaguaaauuucucugggcaguaugcacuuuaggauacuuuucauaucucuuuccuguuccaacuaacucauccucuuuucuuacuuuucccacauuuaaauuccuuuguuaccugccuguuuuaagaauuauaugguaaggccaggagguggugucacaugccuuaaaucccagcacuugggaggcagaggcaggcacaucucugaguuugaggccagccuggucuacagagugaguuucaggacagccagggcuaugcagagagauacugucucagaaauguaugguaaaacuuacucuaccaaaucugcaagcguuuugacaucugcgcuguuuuacuuuuuaguuaaagcaaaguccuucuuucugucuuucaaucuuccuacuuguucuuuggaucuaauuccucuaccaucucagagaccuuuaacaaaucucucuauaaauuuguucccuagcauuugaaaaauacuugaauucccccuuugcagucaaauauucuugaagagaauuguuuuuucucaugccugcauuuucuuuuccuacuccccaugucucagcaucuuuucuccaguccucaugcucuuggcucccaugaugccagguuuuccuguuucuuacucuccuuugccggcuuucccgcucuguuuaccacuguuuuguacugcuccgaacuuuuaguuugaauccucuuuuuuuauucuuuuccuaaguaggcauauuuacucacaaaacuucacuugugcaugccuaugacuccaaaauuuguaucauuuaaucaaaacucccuucuguuucuuguauauuucuauaucucuaaucuuuacaguauccucuaccuauugggugcccaguauuuccuggcuaauggaaugaaugauuucagugauuuaacggaccaaccaaauacuuuguaucuccaguucuagaauauagugcacucagaaaguacuuuauaaauuauugauugaaugaauuaugaauguguaccacaauguaauacaacuuuaaaacacaauuaaugaguaagugaaaaaaaaaugugguucauuguagccaaccaugaccaaggacuuugcucauuuaaaauagguaacuaauagggccaaugagaugguccagcagguaaaugcaguugaugucaagccugaugacuugaguucaaucucuggaucccauaugguaaaggaaagaaccaacuccugcagguuuuccucugccuaucacacauggacauaaacaagcacacauguaaauaaauacuauaauaaaauuaguuuuaaaaguauguaacaagaccuguaugcugcaugcuuuuaaaccaagcacucaggaagcagggacaagaagauuguuguaaguucaagugcagccugguggugagcuccaggccacccagagcuguagaagaagacuuugacuuauacaccccacuccccauguaagaaggcaugaugucuacuacuauuucaagagaaacagaucagauacuacagguguaagugcaauguaaguugugagagaucaagguuaaucucuaucagauuuaauacaugugcagagguuacaggcacaucuuuggauugguauuguuuggaagaguccacaaucuguaccugugacuuagggaacaggguucucaucugugaaauggagaauauugcuaugucuacuuuguagggugguuguaagcauuaaauaagggaucugguguaaaacaagcauuuaauauguauucauuaugcuauagcuuagcucuuucuuuaugcguauaaguuuugucugaauguauguauguguaccaugugagugucuauuguccuuggaugccagaagagacugucagauccucuguaaguuggaguuugacaguugugagcugccaugugggugcuaggaacugaaaaagguccucuggaaaaucagccagugcucuugagugcugagcuaucucucuagcucguaauuagagcuugaacauuguggaaagguccauguguugaagguuuugucuccaguccacaggugauggaacuagggguaaagccugguggaagcaagugaagucauugggaacgugcccucaagggugauguugauaucccagcccauuugcuuccacuguuuuugcuucccagcaaagagacaaacagaccuuugcucuguguccccugucacauugugcugucuugccacgggcccaaaggacaaagggacccaguagcuaugaacugaaauuuuugaaaggaaagccuaaauaaaucuuaaauuuuuguaaguugauuaucagugacauuacaguuauuaaugaugcuuuguuuucauacagcuggcuuucaggccagaaacaguauagaugaguaauugcugaacuuauuuaucagaaucucuugaguuccuguaucaucccaaggaugcuaaaucauggugaguggugacagggaaagacucuggacuuuuuguuguugguuucuuugugaauuuugaagucuggaacuugcuuuauuuauaguguaagcuggcuugaacuuuugauucuccugccuuugccucuuggcuucaaaaaugcauuuuuauuacuuuuauuuauuuugugugcauaugugagccaaagcacauuauuaagggucagagguuaucuuggaauccuucucuccuucuauccaccaugaggguucuugggaaucagacuuggguuguuaaacuuaguggcaaguuccuuaacccacugaaccaucucaccagccaaauuaaaaaauuaaacaaccgggcuggugagauggcucaguggguaagagcacccgacugcucuuucgaagguccagaguucaaaucccagcaaccacaugguggcucacaaccauccguaacaagaucugacucccucuucuggugugucugaagauagcuacaguguacuuacuauaauaauaaauaaaaaaucuuuaaaaaaaaaaaauuaaacaaccagggcuggugagauggcucugcgguuaagagugccgacugcucuuccaaagguccugaguucaagucccagcaaccacaugguggcacacaaccaucuguaaugagaucugucgcccucuucuggagugucugaagacaacuacaguguacuuacauauaauaaauaaauaaauauuuuuuuuaaauuaaacaaccaaaaauacacacguacacacacauaaaacuacuaaauauauuaaauauauuaacuaaaaaauauauuaaagaagauagaauuuuguagaagucauuugagugugaaauuguuguggaaggcccuggugcuguuauauuuuuauguuaauucuguuuuucccaggagggguuguuuggaacaaagaaucaauuacugagugaguaggugggacuuccugguuggacagaggaagagaggaagcaggagaggguuagggccuuuuggacugggauagagagagggaaagauauagcuacuugugucucccagcuagugucuccuugagcuggaggauuuuguuuuguugguuuuuugagacaggguuucucuguguagcccuggcuguccuggaacucacuuuguagaccaggcuggccacaaacacagaaauccgccugccucugccucugccucucugccucucugccucucugccucucugccucucugccucucugccucucugccucucugccucugccucccaggcuaggauuaacuggauucuaguuguugugcccagcaauugaguuaccauuguuucugaacuaaguuugugagguguuuuccuucacgcaccuguucaacuggguucaagagagaaagguaugguggcuaaguguggguuugccagauguacaccacacaaaggcuuuuuuggggguuuugaaauauggggcuggcaugguaguaacccgccaguaggaacuuagugagcuggguggagagauuuuggagcucugggccagagagucuucugagaugagaacacccagcuggagccauguggcccccagugcccugcauaucgcgggaacuugcugcuauuuuuaauauuuucugaaacauuaaauaguuuuaaaauguguggugaguaugggaggcagacagaagacugucaucuuuuugguguuugagacaaaggagaaagaaauggcaauagcuuauuaaaagcuaagugcuaaguguauguaaccucuguaguagucggucauagcugugcuaauugcccaagagcaagccauaaugaaaaugaagcagacacagcugagccauuuucagggucccccagaugaaaaggaaagcagagcgacugagcugguacagcugccagaauuaaucuagacaaaccagaugcuggagaaagcauuaaaagaauuucagaaagggcugguaaggaaaauauaggcaaaguuuuagguaguagaggaagaaaaauuaaaguauaugaaauccuuggaauaagaaguaugcuggaaaauauaaggagauaauucuuccugagaagaagagacaggaaccuguacuucaaaaaagagggcauaagaagaacagcuuuacuguuuggucaugaaguguccucagaaaaggcucugugcuuagggcuuaguacccagguaugguguuacuuugggaggucuggaaacuugaggagauggagccugacugaaggaaguaggugucuggagggugcauccauagagauauuucaaagaggaagacaggaaggggucaaccuuggaauagcucuaucccuccacagagucccgcagccacgauguucugcucaaauacauaaagccagguaacuagacuacagucacauuaauccaugguccuuguaguuugcuucuccagcgaaaguacuaaguaggccccacuuuguuuaguguccaagaucagaugagauccugugcacucagggcuguauaacuauagauucccuuagguugauguuuugucacagcagugagaaaaguaaccaguggggggggaaaagacaucgacagggcagaggccagaaaguacagugaauuggccuaguuuuuagagagacuccaaauccuagggaucaguauucuggaaaaguagaggagaaauaaacuccuaagacaacgaaaguguugaugggaauuaugugaggaaguucaaaagucugugagggguaaguaguauagcuuaguauagugcuggacuaguuuguaggcuccagguucaauccuagcacugcauaaacugaguaugaaggauaaccuguaaucccagcacuugggagguggaggcaggaugguuaauaguuucaagguuaacuggcuggugguugugcagaccuuuaaucccaaccccugggaggcagaggcaggcagauccugugaauuugaggccauccuggucuacagagaaaguuccuugacagccagggcuacuugaaaaacaaacaaacaaaaaaauccucaaaaaaaaguuucaaggucauuccuaccuacaaugucuaguuugaagccagauaggauacuagacccuucuccccacugccccccugaaaaaaaaaucuggaaagcuaauuaaaaauauucaagcaugaaugaagauaauucaaguagggaagaguacaaaguacaaagagcauggggcauacaaaucuagagagucucagcaagcauacauucgguguucuacaagugccagauguugaacacuuggggauaagaauaaagauguaauuucuuuuaugucacaguccacuagcugagacauaauucuuauacucagaauucuugauucugauaaacauugagaguuuaaaaaaaaauucugaaguagcauuagcauuggaaacagacuagauaacuuuucaagaaaguuuuguuuuuaagaacugcuuaugaggauauuacuaguagaaucugagcccaggcaaguuguuuccaacacuguaaaaguuucuuucuuucuuccuuucuuucuccccucccuucccuucccuucccuucccuucccuucccuucccuucccuucccuucccuucccuucccuucccuucccuucccuucccuucccuucccuucccuucccuucccuucccuucccuucccuucccuucccuucccuucccuucccuuccuucuuuccuucuuccuuacuucauagugucuuacuauauuuuucacauuggccuugugcuccugagcucaagcagucuuucuauugucuguccaguagcuaggaguauauaacugaaggccaauauucccagccaccauuuuagauuuuugaaaucuggauuggugacucucuuaguuacuguucuguuacugggaagagauaccaugacuaaggcaacuguuacgaagcaucuaauuaggacuugcuuauaauuucagagguuuaguucuucaucaucaucaugucagggagcauggcagcaugcaggcaggugcuggagcaguagcagagagcuacaucauaaucuguagguagaaagagaaacuucugggcuuggcauggauuuuugaaaccucaaagcccacccccagugacacacuuccucccauagggcuacaccuccuaauccuucuaauccuuuaaauucuuucaagcaguucuacucccuggugacuacacauucaacuauuugggucauucuuauucaaaccaccacaguaucugauuguagaugugauugggcaagaggugugcuguuggugacuguuaacugucuggccacccuucaacaccacucacuugcaaagaaacauguacauuaucuuucuuguauacuuuuaaguaacaauaucuugccuauuuuaaguaaaaggccugaaaguaggaccagggauauagcuauaguuuagugguagaacacuucccugauuuguggcccuggauuuaauucccagugccagaaaaaaacaagaagaucacugcaaaagcugguaaguaaggagagagagaggugacacagaacccagagaaugagaaucccuuugugagauaagugguaaauaauacuuuugagguuuugugcuauauccugucuagaaaauauuuugaagaaaagcuaaguaauuuuagaacuuucuagagcauugccuauuuaacagugaguguggaaaugugaugaaccuaaauuauuuacuaauuaauuuauaauuaaucaguaguaagaaccaaaaccaggggcugagcagagggcucagugguuaagugcaccuuguucucuauuauaggaccggaguucaauucccagcacucauguugaguugcugaugacugccuguaacucuagcuccagugauuuucaguuagcuuuucauaucuuacuacaccgcagauuauugcuuggccagcuugucugugugccuuuuugcccucucccugcccauaccauuuguguguguaucucauuuauauuuauuuauugggaauggggaacaugcucgugucacuauacuuauauagaggucagaagacaaccuuuggagucauuucucuccuaccuuguggguucuagggaucagacuugguggcaaacaccuucaaccucuuaucuaucacaaggagcugccuuucuauucuuauucugauaguuuaggaguaaucggaccuuuuuuauagaaggccagagagcaaguucuugaggccauauaauuucugucacuauggccauagcuaucacacaagcauaaacacaggcauuauagcucauuucccacaaaacuauuuagagacauuggaaguugaguuuuaugauauauuauuccuuggaaaauuuccuccaaccaauaaaguguaaccaguaauccucagcuugucaucccuguacaaacaggccugguugagagagauuuuuuucucacauauaaaaugaucugauuucauuuuguauaauuuuguccuuucuggucugcccaucauacuguagccaaauuuacuucaaaauugcaaauuggauaucauaaucuuguuugcaagccuuguaaagaauccaugaaaaugccugucaucuuugguaagacccuugugcuauagaccuugauugguuuuuuguuguuuuuuuuuuuuuuuuuuuuggugggggcgguuugagacaggguuucucuguguagcccuggcuguccuggaacucacuuuguagaccaggcuggccuugaacucagaaaucugccugccucugccucccgagugcuaggauuaaaggcgugcgccaccacacccgcuaccuugauuguuuuuaaagagauauaucuuacuauuuccccuuaauucauuauuuuccugcuacucacacuccagugaagucugcuuggcaggccgagaggccuggaagcacucacgaggcagggaguuucaaggaaacucaaccuccuggaaccaggcauucucauaacccuauccccgcauuagucugguguauggauccaagugcucucuuucaguauuguuuuauuauaagugccuuuaaagauugaauugugacauagcuaagccuucgccaguguuccaacauccuagaaaauccuugaagcccacaaacuuguaauucaguaagaagguuaucuauucaacauucaaauuuacuucuaguacagacugugaaacuaauuaggcauuacaaagagcggagccagaauagcuuagggcuggucugcagaguguuuacuugggacauaggcagucuuacucagacaagggaauuuacaauggccuggcauauagguggguuuaccaugaaagaauuagagaaucccccugagacagguuucuucccuaggcccaaagaaacagcauaaucaggcauuuacuaaggaccccugguggugggcuuaacaauagacuagcuuuacaccuggcucccuucuuagugucaguggccucguccccaccuucuuuugauguauacauuccuuuucuauugugucacuguaacucucggauguaucucgccugguuucuuguugcucuucuguauaaaaaguugaugcucgacuugaaaaauuacauucagauucuacacaaucucuccugucgcuucuguuugucauuugccaacuccuugcccaccugcaacuagaaacccguucuacgcagacagggaccaaaaaggcucugcggcauuuuccagcuccuugggacuuuuggcagaugcuagaauguugagugaauuuucuuucuuucuuucuuucuuuuuuuuuuuuuacuuccaagauuuggugcaucguuaaaugucuucuuuccucuuuaucuacccuccuuccacaugggugagagucacucuucuguaggaguuagucagacauuacugucgucuccagaagccuccuguucucuccugaggcuggauuucuaggcuguuucuacuguguuugccuguauaaaacucuuaucauuugucuugccauucuauaauugccuguuuucuucagugucucuuuugacuaaugagguccucaagcacacaguguuuguuuauuguucugucuguauuugucugugugcuguccagagcacacucagcauucguaugguccuuuucuuugugcauugaaaaugguguaaaaaauguagauguaauugauauaaaauuaacucuucuaaaguauauaauucauuggguuuuuuuaaaaguaaauuuaucccaacacuugggaggcagaggcaggcagauuucugaguucaaggccagccuggucuacagagugaguuccaggauagccagggcuacacagagaaaucgugucucaaaaaaacaaaaacaaaaaaccaaacaaacaaaaaaguaaauuuauagugucauagagcuguuguuacugucuaauucuaaaacauuuucauugcucaaaaagaaauccuguacacauuaagaagucccucuuauggcuagggacuguuaagauguagaacaugaacuugugaaagacacuggguuuauccuuagagacuucaguaaccucugcuccccagaugguagccguugucuuucugugcauuucaugugggugggaucagaauuguuuggccuuuuugugagugucuucucgaacuugccuguguaguguucucgaagaguaccuguguuaugcuauguaccaguaguguuucaucccuuuucauaacuaugcauuggccuuauuuaaacuuccuucuucaaagcccccaagacuucagugagacugcuagauuccugcucuuggaacaguccugcuuucaucugcucuuuguuucuggauggacuuucaccuuacuaacuaagccaucaggacucagguaaaggguagacccugcuugauuccuugccuuuccugcccaagcuccuuuuccuauucgucuuucuugugaaucaccagauaguacuuuggacuguucuuacauaccucaggccuucuggacucuauacauuuucuugguuauucucucuuucugaaaggcucuuuucuacuuacuucaaguuuaaauucucaaccuuaaauuccuguuucagacagaauccuuccuguaacaucuuugaauuaucauaggaauuauacuuuuuagguacuacccuaucuauccuugacacuguucuuauguuuucucuguuguuucauauucuugccaauauguuggcacuagaugguaggagaaaggaaaugagucuugacuauaaagguaguguaagaucugguaggauggcuguaagccugaugggccugcguuucaccuccuggauucaugugguugaagaaaaaguucuuuuccuggaauuguccucugaccucuguguacuuuaugugaacacauacacacaugcacacacacacacacacacgcacaaauauuauaaaacaaaauaaaauguaguauaagagaagucuuuguggugauggaauaccuucugugucuugacuauuauugugguuucacagcccaagacacaugaugaaaugacauaaaauuauucauaguuguuauguuauugcccuaauuuugaaguugaacuaauaguuauacacacugggagaaauuaugugagaguuaaaugagauaucugugcaauagucuguacuuuuuaaaaauauuauuuagaaauuguauugguauuuaucauuugccucuuauaugauugcuuuggaucauugugaaucuggccuacuuugggguaaggauacccauuuguaguggcaaaauugucuacagcaagaacaucuuugugaaaaaaauaagaguauaaagggggaaaaugaaaaaaauuuaaaacauaacaaauauuauauuguucaaguacauguuuuuacuuuuacuuucagugguaagccuuagcuucagucagguuuuguacaucuaugcucuuagcauucuuguguacugacuuuuaaaggacagugaccuuggcuuugaaucuugagcacaugccugaacacagauacuguguugccauggaaaagccugauaagcaggaaucacuuuugauuugauaguaaauguuucaaagaguuaaucuuauucuaauauugaguuagugagagaucuucuguaagaucugggguagggaaguaauaaaugauguacaauucaaacucuaaaacauggaaaauuaacauuacauacagaaucagaauuuaccucuuaauuauuuuugauguauagaguuuuuguuuacauuuaugaucacguucaaagugaauaugaguaacuaugaaugaaaugacguauucuugguggguaaaauggugcacacauauaagcacuagagguggaagcauggaaaucagggguucaagguuguccuugacuuuacagaggagagcuagguggcggcggcagacgucuuuaguuccagcacugaaagcagaggcaggcagauauaugaguuuaaggccagccugcucuacauagcaguuccagacucaccaaggcuauauaaaaagaccuugucucaaaaagaaaaacacacaccaaacaaacagcaacaacaaaaauaacauagggaguucaaggauaguuugagcuacauaggacauuguguuaagaaaauauauauauaauuauuaaaaugaaaacaauuucuuuuuuagguuaagcuacaaaacaacauaucauaucagauggcagacauacaucauuuaaaggguaagaaauuuuucuuuuagauuuauuuacuauguacgcaguguucugccugcacauagacuugcaggccagaaaaggacaccagaucucauuauagauauuuaugagccaccaugugguugcugggaauugaacucaggaccucuggaagaacaguuagugcucuuaacuucugagccaucucucuagccuccaagagacuuuuaauuauagaguaaagguaaggacuacuuuaugucugaaaucuucaagaauuaaauaguaguuggcugagccagguggugguggcacaugccuuuagucccaccauucaggaggcagaagcaaguagaucucuguacuccgaaugcauauguauacauguguacaagcacauaaacacauauaaaaaauucucaaagaaaguugaacuguagauuauguggccauuacguuucuagggggauaaaaagaugggguucuuauucuguauuguguauucagauuggaggaugcuuuggugaaguucucuugagauagaaagaaaccuggaauguagagaaauaauaaauaaauuuaaagcucuaacuuuaaaaauauuaguuaguuuucuauuucugugauaaaacaccgugaccaaaagcagccuggggaggagaggguuuguuuccuguuguagauuauagucuguuauccagggacgucaaggcagggacugaugaagaggacaucaguuugcuugcuucccaugggucaggaccaccuuccauguuguuuuucaugaaggauuaagcuuuuacagaaaagaauaggcaaagagaguaagcuccucgcuuagauuacaucacuuccucugucagcuuuggggcauguaauggcuuaaucuuuauugucaucuugacuggauuuauaaucaccugagggaaacaacucuggucgugucuguaagaguguuuucagagaaaugauaauggaggagcuaaaacuuacccugaaugugagugucacuauuccauaggauuuuuaguuaaggucuuccuguguagccaaggcuaccuucagacuuacagugacucuuauaggagcgguuucauugaacauuaucuuugagcucauacuaagaaaauacaacacagaugggcaguggugacccauaccuuuagucuacagagccaguuccagaacagcuagggcuauacagagaaaucuuaccucaaaaaacaaaacaagaaagaaaaaaagaagauacaguguaaccaggcaucuuggugcaagucuacaguccagcacucagggcagaagcugguagaucucugugagugugaguuccaggccuccagaguuacauggagagaaccccgccucccgccccaaaccaagaaagaaaaaaagaaaagaaaggagguggggggggggggagaaagaaaagaaaaaaagugggagcgcaguaccauuguagugcaaugcaagaugcaucuaacccuaccuacauacucaaguguucuguuaacguggggcugccucagaacacgguuaguaaaggagaaggaaauacagacuucaaaacugaagccaagaaauaauguuaaaaaaaaaaugacaaaguuggaaaauaaaugauguuugagauuucuggugcuccagugaugaagcaguguagguauuucuagaaauugagaaguugaacagcagcuaaagcugugguagagccaaaugggagguauucugauagacaagcaguaaaaguguguuucuacaguguguaugaauacgggguccuagguuggcagaacaaguuugauuuugagaacuggagucaucucaguguuccuuacaugagccauagucugaacaacgcaaaagguguuaauaaucccuggagcuugcuggccagccagcugagccugcucaguaagcccagagcucagugaaagaccuuggcucaaaaccucaugagaaaaggcuggagagauggcguggcacuuacgaguacuuaaugcucuuguaaaggauccagguuugguucuaggacacacaugauggcuuacagccauauguaacuccagaugcaggagaccuaacgccucuucugaccucccaaggcuccuccacauguggggcacagauaaacauucaggcacacaaaaauaacaaaaacaaccaagguggaguauuuuaaggagcuacacucaagguugaccucugacuacacauguuaucuaacuuccugagaaucuuaguagaaaaauugaaaauguacauaauuaaaagaucauucuauagauucucaaaagaaagucaugcaguaaguaaauugauucuucuuuggcuccuucccuugucugccuagagcaacuggcugagcuucgucaggaguuucuucgacaggaagaucagcuucaagacuacaggaaaaauaauaccuaccuugucaagcggcuagaauacgagagguaaggugccacacgcagcagcucugugagccuccagcuguuguccaggcuuuguaacuaacgcacuucuucccaucugcccucuacucuugcucuucauuuucuucaucuuauuuuaucuuucaaagguuguuguaaaaguauaaucuuuuauuuuaauauuuuaaacacuaugaaaacaucucuuacaugaucuagauugucaaacagaaagaucuuauaacaacaaguuuuguugaaugggauacaguaagaacuaaaaccagacuuccuuucugagggacuuccagaagaugaaaacaacucugggcaugcccucagcauugcuaaggacuguguuccugcucuugaucugucccucccucacacuucuacagagggaggagguggggaacuucuuagggucuaaucagguuuaugguaaaggguugagucuuuuuagguuuguacaccagaaguuaggcucaacaguuuuucuguuucuuaguuaucuauguauaacuacuuacuauaugaguauuuuuaaccugccaguauucaguguuuuuucuagcauaucaauuuguuaaaacuuagauucuaccaacuugugggaccacuguagaaauuuucuuuucucaguauuauuuggaccaacaagauggcucaguggguaaaagacacuuucugugcaacucugauuaccugaggguggccucuggauccugccauggaaaacagaccuaacuucuaacaucuacacguaugccauggaacacugugccacucacauggcuacaaguagauacauaaaugcacacaucauauauacagcuaugucauaguaacaauaaugcuaaaguaaaauaaauaauuguagaugguaucauuuuuauuuuauguaauuuuuugagauuuuucccucuuaauauuucacuaguauauauucauaaacauacauuuacugaaaauguuuuaucaguuagcugccuguauaaugugaaucaaagauugcuuccuaaauaauuguguuuacuuauaacagagauguuuccucauagcccuaccacauuguuuuaguuuaacuuuaauuuggucucaagauguaggaauaagauaguacaaugauaucaagauaggaaguuuaauuugugauaauaaugugaacauuaagaugugucuauguauucauuaaguuuaauugcaauaauaaugugacauuagcauauguguauuaaguucuuguuucuauuuucaagaaugucuguuuguaucuuugacuacuuccccagcagaaagucaccauuuuuacauguuuugacuuuuuuuccugacacuauacuguuucuuucuuuccuuuauuccuugguauacacuuguauuaugguauuuaaaguucgguugaagacaugaauagcugucauucuuuauuggcuccuacuucuagcauuuuucaucuguuugaugagaaccuagagguuguuuguuauuuuuuccuuuuaucacagcauuuuucucugcugugauugaaauuggccuugacaauuguuucuuuauagguauaauuuguaaaacacuugaggaaggcuugcuugcaucuaccugcuuucuguuuuuucuguuaacuuuagcaguaucuccagcugcccccgauaaagagucaaacauuuaugauauugacugcauuucacuguuucccuacugaaugauguugugucuuccuagauacaugugcugcuucuggacagacuuggagcacucagucuaauagcaucuaaagaaugacuuucuaauuuaguuuucaguguggacagcagaucaaggaguuaagagcacaacaugaagaaaauauuaaaaaauuagcagaucaguuuuugcaggaacaaaagguaaauuaaaacuaaguauuuaaauaauguaugcuuugguuauaauucauuuaauuuagaaguagaugguugucauaacacauuaagaauucuagucugccugauuuaaaagaggauguguauuuguugaguaaaauggauguguguaaaaauauaucaacuuacuguuucuuaugguuaagaaucaaaccuagggcuuugcacaggcuaggcaaauuguuauuauggugguuauugcugucaaugucagauucuaagguggacgacuuucuaccgaaaagccuuccuuuuucccuccuccuuccuuuucuguaucccauucucuuaguauauagcucaaauaccauugaauuuccaacccccuugccugagcuuuucaagugcugguguuaacaggugaauaauauccacacccagcuucauuuuuuuauuuuagucuguugagaaaacagaauugucaagcuuuuucuuauuagucucuaguagucugaugaccugucuuaaaacagaaauaacaugucuagauacuaaauaaguaauuuugauucauacuuucuuaaaguacugugggucagaucuguggcuucauaugugcaguuauauguucuguugagcuagaugaccaacucugccugauacaucuugggucagcaaaugauuuauuuauuuugaguugaguuaucauaaaggccauuguagaaauagaauuuuuuuuaaagcucacuaaccauuauggacaggaguuauuuuuuauacucuuuaaucuuaguuugguuaaaugugauuuguauaaaauuuguaauuaaaaguaaagagugacucaguaauaaagagcauuucuuuuguucuuugguaacauucuaaggacuagaagucaaggcugucugguuuuuguccuuagcucuuccuuagcuuuacagcaggauauugaggguguuauaucucuccaguuuucagucuacaguuugaaacagcugcaguuuaucugggucugcuuugaagagugugagaauggacuaguggaaagcuugaaugaucagccacugugaagguacugaguguaguuagagguaguauuaagacaccgaaaguucagaggaguacaauaguguggaaaaggaaggagagaggcuugcuguagugcuguguuauucacugaaagccuuuauuauuuuucaugguuuugacaaaaauagcugacaaaacaauuuauagcagaaaacucaaaauaauaugauauuaugacauggagauauuauuaaaaauucacaggcuaguauccauaaauaacauuuuguauuguuuuugugauacaaggacagaaagacuacagaucagaggagaauaagaaaacuugaagaccaaaacuccuuauacuagguuauauacuuauauacuagguuaaaucuuggaacagaaaaaagauauaguagaaaaacugguuuaaaagaucuacaugaggucugaaaguuuaguuaauaauuauauuuuuuuccuuucuuuuccuuuugagacaaggucuuguguagcucagacuggacuuaaauuuccuauguagccaaggguggccuuagacuuuggauuuuucugccuuugucuccugugugcucuuauuagagauguauggcaccugcccagcuuaugugcuucugggaagccagccgggccuuuauggaugguagggaagcaauccuccaucugagccagcgcuccaguccaguaacaacuguugucuuuguuuuauaagucuaucauaguaguaucaguucuaacauuaggggaaccuggguacacagagcuaauuuucuccaaaucuaaaauuauuucaugcugggcaguggugguacaagcuuuuaaucccugcacgcaggaggaagaggcagaggcaggcaggucucugaguucaaugccagucugauuuacagagugaguuccaggauagccagggcugcacagagagacuacaucuugaaaaucaagaugggcuggugagauggcucaguggguaagagcacacgacugcucuuucgaagguccagaguucaaaucccagcaaccacaugguggcucacaaccaccuguaacaagaucugacucccucuucuggugugucugaagacagcuacaguguacuuacauauaauaauaaauaaaucuuaaaaaaaaaaaaaagaaaaucaagauagauagauagauagauagauagauuuuuuucauaauaaaaacucuccuuaagcacaacaagaaguccccucacuaaauuacagaaauauuguuuuaagaaagaugcuuuauauuuaagauuacauggugucuuauuccuauaauuccagcacuugggaagcagaggcaggaaaaucaccacacauuugaagcuaaccuggucuauuuuaucuaggaaguucuaggcagcauaaaaacucugaccuuguuucuuaagagaagaaagaggugguguuacccauucgcacaaaggugauagcauuaaaaggaaaacaucuuuguuaacuuguuuguuuuguguuguuuuuacuguauuuuuuuagcccuuagaugguucaguaaguaagggcacuugucaguaagcaugaugaccugaguuugauccucacuccccacaugguagaaggaaagaaacuuguggauaacuguacuugcuugcgcccaugaacacacauauagacacacagacacacacacauuaauuguuuuaucaguggcuuaaugauucaaaacugaaaaauacuuauuguuaccaaaucuuuauccaacaacaggagacucauaagauucaaucaaaugauggaaaagaauuggguagaaacgaucauggagcaccuaaaaauauuccaaaugugccugaaaaugaugcaaauaagaaugaagaccccucaagcaaucaucuuccccaugggaaagguaaguuuuguguuuauaugagauucaccauuuuuuccuguuuugaaauauauucaaaucauuaaaaacuuguuugauacuaguucugagaugauuugauuuaaugucuguauuguuuaaauuuuugguccugugacaaaagagaaaaaaguauuuuaguuaaaaaucagggccaggaaguaggcucagaugguaaagucacuugcugugcaccaaugacaaccagaguucagguccucacaucuacauucacaaguuaauguaguggcacauauccgcaaccccagaacuacagugagguaggagauggaaacauauuuuucuggaggugaucaggccagcuagccuugucugugaagcaaagcacacacaacagaggccccuaccucagcaguggaaggaaagagcugacucccuugacugccacguuaugcacacgugcaggcacauacacgcugaagaaaguacguuuuuuaaaauauuaaaagaaaaaaacaaaacuaaguuucaagcaagguguucacuuacaaucugugacauuagaaacugauuuuuacuuuccuucaaaucuuuuuugauuuauauuugcauaaacauaguuguaccuuauuuuguuccuugggcagaacaacucaaacgaguuggugaugcagggaugccuggaguagaagagaaugaccuagcaaaaguagacgagcuuccugcugguaagugaggcuuacuggagaacugagcuaagguuaaugacacuguuuuuauguggccacauucucuuugauguuguuguuuugagagagaccucagcuguguauagcccgagcuggccuucgacuuuuccugcucagcuuucuaagugacaggagcaccaccauucucuguucuccauuaguuuaguuuuguuuuguuuuaguuuuuguagaaucuagaaaaccuauagauguauguguguuuggugcagcucauuaauugccagaauuuaaaacaaaccuuuuauugcuuuuauuuggggugucugugugugugugugcguggagauuaagugcaugccauggcauaugugugaaggucagaggacaacuuguggggauugggagaagaaucacacucagguuguuagucuuuguggcugcugccuuaacccacuggaccacuucucuggucaaugccagcauuuccuuuuuucuuuuuuaagauuuauuuuuauuuauuuaauguauaugagugcucuaucugcauguauaccugcaugcccgaagaggguaucagcccuuauuauagaugguugugagccaccaugugguugcugggaauugaacucaauaccucuggaaagaagucagugcucuuaacggcugcacuaucccuccagggccccaggauuucuuuuucaauggaguuuuuaugaaguuuuugcuaaguauacaaucaggagagagagagagagagagagagagagagagagagagagagagagagagagagagagagagagagcucuaugagcauaccuugcuccucuguuguuauauuuccaacuuucucugggaauuuuuuaaagguuuguuuguuuaacccaaccuuguuuuaccuaucuaaaccacugguucugaaccuuccuagugcugugacucuaauacaguuccuccuguuguggugaccccccccccgccccggaacuuuaaaauuauucuugcuacuucauaacuuuaauuuugcuacuguuaugaauuauaaauaucuguguuuucugaugaucuuaggugaccccuuugaaauggucauucaacccucaaaggggccacaacccacagauugagaaacacugaucuaagccaaauuuauuuuuaaagucaccuuguucuuaagcaagagacauuauaauauaaaucuuaacaugacugauuauuauuuaguaauggagauacucuugucuucugcacuugaucuuagucaaaaggugaagaagcacucucccuccaucuuaugacuugugcuaaggacagcacugaccagcagagcuauagacuaagcugcccccguccauuaacaagucacaguuaagcuguugauucuagugaagugcuauucauugaaggcuuuguguguaguuguguguguuggcuauugcagauggcaguggagacaagauguaauggugacaaagucugcggagaacagcucugugugcuugaguguuuuucucagaguaaaugccagacuucuuguauacuuaacacuauguaauaagugacauaaaaucauuuaaguaaacuguaaaagugacccaaguaaaaugugcuaguuaggauagacuaggaaguaauuccuacuagacaucuucaaauuacaacauccagcagugacgaaaguuucuuuauuuccaucuuaagccugaugauccuuuugcagaucugaagaguggcuucugucaugacuccacguguucauauuagcuuccuauguucauauuccacauguucauauuagcuuccuauguuguuguacaagaagggaaagagguuauguaugauuggaauguauuugaugacccaaauaagaugugacuuauucaagccaggcauggaggcccaugccuuuaacccuagcacucaggaggcagaggcaggcagaucucuggaguuugaggccagcuugauauacaaagcaaguuccaggacagccagagcuacagagaaacccugucucaaaaacaaacaaacaaacaaacaaacaaacaaacaaagugacauacucaguuucaucuauaucuucaaugucagaauuaaaggcccuuguccccuaaccacaagggaaagcugguuguguauccagcaaaaauaaauaggaucauauuccaucaaguuuaccacaccaaucuuuaggaaguaaaaugugcccauauuuguauguaggagcuucugguuuuuuucuuccccucuugguuuccuuuucucuuaguuuuccugugagcugucugcuuuccugccauagucuccuucugugcagggaucuauuggggugagugcugauguguaaaauguaaucuuuccuguugaucuuuguuucuuaagagagaagaaacuucuaacucuaaccuucuuguugguaaugcucuuuguacaaauaacauuucccauuuuaaaaaauaaaaauuccaggagcuggagaaaugguucagugguuaagaauacuuacuuacuacucuugcaaaggacccagguucagauuccaacauccacauggcagcucacaaccaucugcaagcucaguuccagaaaacugaccccucuucugaacuacacaggcugcacacguaaacauguacacccaaaacuaaauaaauguuuaagacauagaaaguaaauguuccagagccaaacggagugguucaugccuguaaucucagcaugaggaguguagguauagccauguuugagaacuguagguauagccauguuuugggcugaauacugaauuucaagcccacacaagcuacugaauaaaacugguauguaguuguucuaaacauacaauaaaacauacguagcuggccuuugcuacuuuguggguucuuuaucccuuuauccuucuaguuucacccaccaucacuagauaggagagaaaggaugauagaggagagaaagugagagauaccugaaucuuuuucuuuccuuuugucucuucuuugagaaugacuacuaacaaacugcaaccaacccuccugaacaaccaccacccacaccugccaggcucuagcauuuauauacccucugaaaaguacccagaauuccaaacaucacacagucucaggaacuaucugcaguuggcaaaaccaugcgucugcuagugcaugaggcaaaucauagucagcugcugugggccgucugaagcagcccauaucccacaccugagguuaaaacaaaaacauauucuuaugauguuucuguguuuuuuuaaagaaaucaaaauuccagaauugucacaauaguugugauuuguuuuguuauuuuaaauugaggguucagcaauggacucaguggguaaaagcaccugccaccaaaccuuaugauuguaguuauguccccaugagccaccuugugguagccuggcucaccugcuuccaacacacucauuacacaaaauuaguaagucccaaugccauaaaagacggcauugagcagccuagagcucuguucuuaaucgccucgccagcaaguacucauuuuugcuugcaguuauuuauagaaaagaaucucaugguuguaagucauauuugaagagacuaccuuguuuauucauaaauucuuugcuuaagugccuguuuugugccaggaacuguuugauuaugauagccagcaagacagaauagauaguacaauguauaacuuaauaaucauacaagaauuuuuaauaugccaaggauaaagauuaaaaaauuaggauacacauaguauuucugcaguauaaacugauucauaguguuuuuuagaaaucacaguauuuucuuuaaaaaaaaaaagauuuauuuauuuauuacauguaaguacacuguagcugucuucagacacaccaaaagagggggucagaucucauuaugagugguugcugggauuugaacucaggaccuucagaagagcagucauugcucuuacucacugagccaucucaccagcccagaaucacaguauuuucaauggcaauaaugugaaucuauuuuuuucuuauagcuuuaaagaagcccccuguguuagcuucucaacaugaaagucaucagacaaucucccaucuuccaacuggacagccucucucaccaaacauggcuccagguauaaagucucacuuagcauuccauuugagaaccaacuuauuguucagguguuacuauagaguaaguagaacaugccauuuagcaguguggugaaauagcauuuguucuggaaaugaauauauuuuuuaaaugauuggcauauaacacaugcacacauaaaaaauguggagauggcuggcugaggaacuuucugguuuccaaauguuuagccauuuagaguccagugggcucaggauguagcguaguaauagagcgguccuuuagcuuguauuaaaaguguaguuucucuucucaacuggaaaaaauaaagccaagauauugaugagauaaagacacagugaugaaaaaguuagaaaauaacagcugugaaucauugcauagcugaagaugacauagauauuaaacgugucaaacccugguagagcuuagagaucucuagcagcuguuuggaguuuggaaggagaagugagugucaguucuccuuguagacaccuaagacaagggaaguuggacaagcuuguagucagugguggagauaguuagcuacagauggagugucuuucauaaaacaguaaagcuuaguaacaagccagcucugugaccucugaugucagauggccaugagcuuuugcuuuuguuaagcagguuauaugcaauuguucuguuaaagaauuccgugcuugggcuggagaucuaguucaguggggugcuugcucagcaagugucaggcccuggauuugguacuugacuacaagaagggugggaaguuacauucuuagccagguggugguggcagcacaggccuugaauuuuagugcucaggaggaagaggcagguggaucucugcguuugaggccagcauggccuauagucaguuuuaggauagccaggacuacacauagaacccugucucaaaaauaaaaaaaauuuaaaaaaaauuacguucuucuuauuucgauuuuaugccacagguucacaucuaaaccagaaugaaaaucccaguacuucaaaacagaacccuucaaauccucuucagcacauaauuccaggcccaaacuuggaucgggaacccagaauucaaacagacacguuaaagcaggccaccagggacagagccaaugauuuccacaaguugaagcaaaguaaggaccgguugaugaaugcuaugaaugcuaugcuaacaggaaugcuaugcuaacagggguucuuuacauauauuucugugcgaggcugaauugugacuucauuguuaugcucuaacagauguguaagagaaaguauaguucuguuacaauuuaaaagaaaaucauuuuuaaauggacagaaaauggucuaaagaaacuguaaaagguuauuauggucaccuuguuaauucauuucaggugaguugauuucuaaaaaaaugcuuaguucuuaggcauugaaacuuuuuggagaaacaguagauacaguuugcgagucuaaugacagagacuuugauuaggagggugaaaagucguuuugaaaagugggugggugagggagagcaagcgccuggugaggcugcuguagugggagggagggaggcccagugugcuuccuccuccucccucccuuccaguugucucugccccaugugggugugaacacucagagcacuguggaaggaaguuuguuguuuaguuacuucagagacacugauucugguaaguuagcucucugaaucuguguaaugggauaaccuguaaggaaaaccugugguagcagagagaauuugcuguuggcacuuucccuuaagucagcuccuuaaacugcuuuccauuccauuuucuccucauggcuucuucucuccuucaguucuaagcagacaauguucaaaagcuccagguagggcagcaacuuucccagagacaugguacuguuugcacacagguugauuauagguugagaauuggacagcauauuucauuuauucaaagauuucuauuguuuucuagcaguuacuuauauauauauuuauaucuguauauauaauuuggacauuaauugucuuuccuuccaugauauuuuaaaguguauuugugcaccuugauuaaaaugcuacauaauguuuuauuuguaagaauguagcucacuuuuuaaaauguugggaaauuuuuuuuuucuaaagucccacuguggaauuggcuugcgugcuaguuaccuguuucauugcuguaacaaagcaccugaggaaaacaaguuaaggaaggguguguuuguuuuggaucacaguacagcccaucuaguaggggaagguuugucagcaggaguuugaggcagcugacacaguccuccucagguaagacacucuccuuuguauucagucugggaucucagcccacccacaguuagaguggaucucaaaacuuaaauuagccuaaccuggauaucuuucaccuacacgccagaggcuagugucuucaaugagucgaggucuuuucaaguugacaguaaccaucacagacugagaacuuuucucucaacaaggacuggggacauuaaacaagagguuuaaaugaauugguccuaguggcucacaccuauaguccuuggcacuuugaagucugagacagggggaucacaaauuugaagccaaccaggguuagugaguucaagaccagccuggacuguauagugaaaccuugucucacacaaaaaaguggggggggggguguccugaggaugcaucucaguugauagaguguuugccuaccaugaaugaagcccuggauugaagggauagugcacacuuguaaucccagccuuuaggagguagaagcaggaguaugaguucaaggucauccuugguacauguuguguuugggguauaugcaauucuuuaaaaaaauaaaacaggaaagaaaaaggaaaaaaauauuaauauagggcugguaggauggcucagcgaggcaaggcacuugcugacagugauguuccaaguucgauccccaggaccaacagaguggaagaaaaagagacaaauggcuuuugcaaacuuuccuuugcccuccacaugcaugugcaacaucacacaugcacucaggcacauguguacacacaaacaaauguuuaaaaagcaguuuaaaauuauaauaaagcucuuaguuugucaccuagauucucauagcauugauuuuacagaauuuuuugcuaguguugauuuauauuuuaguauacauagauuaauuuguugguacagaaugucuguaaauaaugcugggaaauuacucucuauaaguuauuuuggaaggaccccuucugagccuuaaauuauguuccauguauuaucauuagugaacauaaagaacugaaacaucggugcauguaugcuuuuguauguauuuugccuacauauauguauauguaccguguacaugcaguaccuuuggaagccaggagacaguguugggccuccuagaacuggaguuacaggcagucaugagucacuauuuggguacugagagcugaaucuuguucucugcaagaauagcaagugcucuaaaccacugaaugucucuccagcccccaaaguacuguuuuuaaauucauuucaauugacauuauuuguuagaugcccuuuguaggcugaugggagcaagaucuugcucuauagcccaggaucaccuagaacuuguggucuucgcccacucagcuucuuaagcguugauguuacaggcauauacuacuacaccagcucucuuauauaccuuuugauuuuauuuuuaauuuuauuuuauguguauggguguuuugucugcauguaugucuuuguacuaccuaugugccugguguuuguggaaaccagaagagggugucagauucauggaauaggaguuauaggcaguugugaaccaccauguugguacuaggaauugaacccagguccucuggaaaagugaccauuguaaggcugagccaucucuccaauaauuuuguauuugucguuaaaauacacacacaugcacacaaaauacauacauuguuuguaugugugcaucugugugugagugugggcccugugccacagugcuuacauggucagaggacagcuucaggacagccucacuuucacuguggcucuugccuuugccuugguaaggacaggugcucauugguuguucucuacaguguucgccaggccagcuguuccugucucugccucccaucuacccauaggaauauagucuagggucuggcaguuacaggaauccugguuuugagcuugggccuucauauuugagcauacauuuacccacugagccaucugcccagcucacauauuuuuaauaucuauauuccauugugcuuuuuacucuuacuauuuagaucauuucauuuuucuccuuuuaauugucaugcuuuuuuccagauuauuuauuccuucuacuuuaaauucaaguguagaucaaagaaguuacugagucaaaugcucaaucagccuugcagcucaugcauccuuagaguagcucucagggccacugcccugcgaucugcccgcauucauuuuuaaucucuuauaggauauuuaggauauaagaguuccuucgggguauauuagucgcuguggaugugaagcucagugguaguacacuucuaacauguacaggguccuggguucagagcuagccuugcugauagccuugguuuuuaaaaauaguauuuuauuguuugugaggcaagaucucacuauguugcccaggcugaccugaacaggaguucaguucacugggcucaagagauccuccucuuuagccuaaccacuuauauuguuuuauaugaggaauuuuauuuuaaugauuuccugguauguaaucuguauauugguuuuuuaaauaaauuacccugaauuuuuuuuuaaguuuuuguuuguuuguuuguuuuuuuagguuuuuuuuuuuuaguuuuucgagacaggguuucucuguauagcccuggcuguccugaaacucacuuuguagaccaggcuggccuugaacucagaaauccgccugccucugccucccaagugcugggaucaaaggcauacguacgccaccgccaccgccuggcuaacccugaaauuuuuauaaauuguuuguauauacuuagaucuuuuagaaaaguucagauauuagucuuuaauaaaugacuuuuaaaauguuuauccuacucuagugucuuuccugguagagggcuuuauuuauuuauuuuuguauuuucuuuaaauuuuuaaauuuauguguauuuugggaaugaagcaugugcagguccccacagaagauaagaaguggacucuggguucccugaaacuagaguuacagacaguugugagcccacgugggugcugggaguugaagucucauccccuggaagaacccggaacccauuaaauugucauuucucuguucucuucuuagagcccuggcaaccaucagucugcucuuccaguuguuucauaaaauauguggccuuagaccaaaugugguuguacacuccgaugagcucagcaucugaggguaaaggcaggagggugcaagguucaagcugcccuguaguuccaggcgucuuaaaggcuuuagcucugagagugguauagaguguauuacugguuugguuuuuuuguuuguuuguuuuuuguguauuacuguuuuauuccuuuauaaucaguguauggaugcauuuguuuauucaacuauuggugggcacuugacuucuccuuuuugaguauuuuaaggaguacugccaugaagauucaugcacagauuucuugcuaacaccugucuaaagcuuuuugaauauguaccuagauguggaauugcugagucacauaauaauucuauguuuagcuuuuugaggaacugccaggcuguuuuccauaacagcugcaccauuuuauuaauacauuccuucccaaaauauggaagaguuccaaggcaggggauaugacucaguugguagaaugcuugccuagcaugcaggaaucccuguccugucuuugaguaccagcacuacauaaaaacagacauauuuguaaucucagcuuccauagugaguuugaggccagccucggcuacauugaguuccugucuuguuuuguuuuguuuuguuuguuuguuuguuuguuuguuuuuuaauguugcagcuucuccgcccugccugcaaugcuuacuuuuuuccauccacuggcuuuaucccuuugugcugccaaccuacuggauguaaugggguauuucauuucucauucucuguguuuuucaguccugggggucagacccaggccuugcacuggcauccuaggcuucuucaguccuuuugguuuugauuugugucucuaaagacuaagcuccuuuugguguucuauuuggauauacucugggagaaauguccauuuaaaaaguccuuagcccaguuuuaaaauuggauuuguuguuguaagaguuuuuauauuggggauacuauaucuauuauuuuucuguguuuauuggaugcaagagccacuguguaugugugugucucugugucuguguguuuugagacaggguuucuuuauauaguccucacuguccugcuggaacuuauucugcagaucaggcuggccuugaacucagagauucacuuuugucugccuucugagugcugggauuaaaggcaugggcuaccaccauauagcauuuuucugauuucuaugggcugcuuucuuacuaucccuccaguuucaaacccuagcaucacaaaaggggguggggggagagacuccauugaauguucuuagcauucuuaccaaaaaucaauugaccgcuaauguauagguuuaauucuggauuaugaauuauguucuguaguaugcaugucuguccuuaaugucaagaucagacuguuaugauuaucauaauccaucaaaguaguuuagagacugugacuugagaaucauucagcaguguuuuuguuccuuagaacaaaaacaaaaaaacaaaauaaaacaaaccucccaaacaaacaguaacagcaacaaaaugaagaaguguacuucuccaaacaaaagcauaaaauccuuuugcuguuauuucagcuauucacaauccauugcaguucugugagguuguuuuuaaaggaucuguucugcucuaaaggcaguugguuaucucaguguguguguguguguguguguguguguguguguguguguguguguguguguguguguguuagggaguauauguauauacauguuuguuugugcacacguguguagaggucagagauuaaugucuucuguaauuguucucccuuauuuucugagaccaggucucucacugaaccuggagcacuccuguggcacaacuggaugaccaguuaacucaccccaggcccuauccccacuccucggcauggucuaggaaugugucuccuugcccaguuuuucuguuucuuuuuaauuugaguucuagggaucacuuuggguucuugugguuaugcaacaagcaucuuuccuggugaacuguauuccuagccccagcagugaauugcauugacuguugacccuaucugagaauauugccaucuucacaguaaucaugccuuuucauuuauuuacaucaucuuuaauuucuuucagcaguguuuguauacaaauuuugugcuaccucuguuuaaauuaucccuaucuuauucugcauauguuaguauuaauuuucauauucuucagugcuugcacuuagaaccagugcgguuuuaugugucuauuuugucucuugcugcuuugcugaauuugauacaaaagguuuuuauguuuuuguuuggagaaauucacuucuucauuuuguuguuauuguuuguuugggagguuuguuuuguuuuucaguuuugucuucuaguuuuuuuauuucuuaaagauucauuuacuuuauguguguauaugugaauguauguauauguaccauauaaauguagcuguccauggacugcagaagaggguguuagagccccugaaacuggaguuacaggcauuuguaaguugccugcuuagaugcuggauacagaaccucucaaguagauagauugcagaacagguccucuccaagaguaucaagugcucuuaaccacugagacauuucagcuccucauuguugauguuggagauguuguugcuguguagcuuuaacuugacuacaaagcagucccuaagccuccugcacauuagaaucagaagcaucagccacaauaugcaacacuugaacacauuuuuacauuuuuuuaaucuaguguguauauguguacauaugugccacaguuuguauaugagggucggaagcugacuuugcaaagccaguucucuucuuccaaggauugaauugucaaauucggugggaaguuccuuuacccauugaaccaucuucuuauugcccuaaaauaguuuuuuguuuguguuuguuuuguuuugagacaaaaucucuuccccaagcuggauuagaacuccucacuagcugaaagacccuugaacuucagauucuccuucuccccgccuucuuccucagugcuggguuguauuacagcugugcauugucauacuuagaugauuuuccuuuuuucuccccuuaaguuuaccaugauucucuuugucucuaacccuauauuuguuuauuucuccauucuuaauaaauuucauuuugccuuggaaauuguuaguaacaguuacuuuauuuugaugaaauaugguuguauuuagaguaaggagagggcuuauuccaccuaacagcuuacaaguccuucugaagggaagucagaacagaacuagaacaaaggccauggaggugugcugcuuacuggcuuauucucucuagcuugcucagccuguuuucucagacaccccaggaccacuugcccacaauuggcacuauucacagugggcugggucuuuccaagaaaaucguuuuuaucuaauggagacauuuuagcaguuguguuucaccuuuccuagcuaacugucaaguuggcaaagagcagccaggaaggggauagugcuuguggucuaauagucaaauuaaauuaucacauaaagcuuuuuauuuuuuuauuuuuuacuuuuuuugaaccagggguaguggcacauaccuuuaaucccagcauuuuagagacagggauagaaugaucuugugguuucaaagccagccuaguuuucaaagugaguucuaggccugccaaggcuacacuguaagacccuguuccaaucaaucgaucaaccaaucaauaaacaaauaaauaaggcuaaacaaugagaccuuguuuaaauaaauacauaaguaaaaaaaaacaaauuucaauauuuuugagaauuucauacaauguguuuggaucauugaccccugcccuaaaucuucagauucaugccacuuccugaccacccaguuuugucuuucauguugccuauguauucuuuguguggccuuccacuuuagugugguuuacuugguagagaacuacacucuuaaaacuuugacuucuccugccaggcaguggugguacaugccuuuggguagaagcagguggaucucagaguuugaggccagccuggucuacaaagggaguuccaggacagccagggcuauacagagaaacccuaaaccauaaaaggaaaaaaacaaaacaaaacaaacaaacaaacaaacaaacaacaccugacuucucccuuccccagcaguucucaguugccaguaguuccuuagcuguggaugugacuuggugccugucucagcucuccuuguugggauuuguuucugcugucaacaacuguuugaguucauagguuuauauauagcugcccuguuaguucauaagacacuguguccuuacagucauccuccaccuccucuuacauccuuuuuuccccauuuuccacaaugauuccagagcugugagaggaugaggaggucugauauacauugccucauuuaggguuagacauucugcagucuuacucuuugugccuugaccaaucgugaguaucugcauucaucauaaucucguaggauuuaguacuucacugaugagggcugagagacagaucaucugccuauauaaugauaagccacugggaguugguccagcacuaugucuguuuuggagaauaaugguuuuuccugucgggccuaugaccugugcagccacagguucuugucuccaguaauagugcaagguauggguuucauuuuguggaacaggccuuacaucugaucagaaaauaguuacuucuaugauguugaugucacugcuccuucugugggcuugucuugccagaccauuccuuaugguagcucucgggguucacggcuggauaagacugaugaucacaggguucacagcuggaugagaccagugaugacuugucugcuccaguagugugcauagcaccuuccugcucugugcaagcuagccaguagcgauaaagcuuccacaucagacugcuaugaggauugcaggucuugacuuacaccucauuuccguacauguuaaaccuuggacugcugcucaggugcugggaacagaguccagggcaugcacauaguaggcaugugcucuaccacccaguucauaagcccaagacugucauuuggaaguggaaauacucuuuaauagugcuuauuauguuuuuagcaagccuuuaccauauuuugaacugccacucuaugaucacgaauuugguacagcccuaacucaugucuacauuaucuguccaugucaguuucucuucucauacuacuucaagccauagagcauacuuaauuaguauauacagcuugucacguuguucuguaagucucuguuuacuuugucuucucacuacaauagugacucugauagcauuagugccucacuucuuguuuucccagccuagcaagcauuuaagcacucauaaagauguccuaucaguauuuuaacuuuauuucuuuagauaaacaaugaaauuauuaacauaaucauacuuaauguauaguuaaugucuucauuuuauauguuuuauaaagauucuuaauccugaacuuuuuguauucucuuauacuuaaaaauuauaaggcccacacuccuuuaaucuugaaacuccugaggcccagacaguucccgaacagucugauuuacaagugagcucuagaccagucagagcuacaaagugauagauagauaaccugucucaagaaaauaaaugaguguguguguguguguguguguguguguguguguguguguuuuaaucaguaggguagaggggcucacuaguggacuagccuaacugaaaugaagaacuccagaugcaguuaggggauucuuuuaucuuaaggugggagggguuuggggacagcuagggaugagcucugagguuaagagugccuacacuuuugcagaagaccugaguugguuuuccagcaccuauguuucacagccaccuauaucuccagcuccaaagaauccaacaucuucugaccuacacaggcauccuguacacaucacacucaccacacacacauacagacacacacaucacaaacacaacaaacacaauaaauaaacaaacaaaucuaaaaggggcaggggagagaugucucagcauuuaagaguacauauccccuuugaagagaaucugaauuugguuuacaguccccacaucaguaacuuacaacugccuauauggaacucugccuauauagaacccacaucaguaacuuacaacugccuauauggaacucuggcuucagaggauucccacuccuaugugcucugugaguaccaagacacaccugcacaaacauucacacacauacuacacagagagagacagagacagaaacagaaaaaagauuguuauaauucccaaguagaaaugaauuagaaauagaaaugaaauaggcgaauuuauugaggaccugaauuccaucccuaaaaggcacaugguagggguagagagggccaagcuguacuuugaccaacacguacacacugaagcaggugugugaacacacacacuaaauaaauguaaugaauauaggggauuguuggauggugguggcauacuccuuuaaucccagcacuugaaaagcagagacaguugaucucugugagguuugagacuagccugaucuacacaguucaaguauagccaggacugcacaaagaaaccuguuuugaaaaaacacaaccuccuucucccaaaaaauauugggaaucauuuccaauuuuaaaaaaaaucauguagauccacaacuccauguuaggugaauauggccacuggucauaagcuuucuaucucugcaagagauuugacaaaauuuuaugaacauauagauagagugcaauaaaacauaaauugcaaaauuuaauucaagucugguauuccuauaaauuauaaucucuaaguaaacagguaggcuuaacuuucaacuucaaucccaaauauaccuucaccuauuuggaauauaguuagaagaaaauaauuaacaaaaucauagcuggauguaguagugcacaccuuuaaucccagcacucaaagagaguuugaggccagucugguuuacacaaagaguuccaggacagacagggcucuacagagaaacccuguccagugcuguggugagaaucagagaucagaggguaacugugggaguggugcuucuccuuucacauuuuguuuuuguuuuguuuuguuuguuuuuucgagacagggcuucucuguguagcccuggcuguccuggaacucacucuguagaccaggcuggccucaaacucagaaauccaccugccucugccucccaagugcugggauuaaaggcaugcgucaccacugcccggcuccuuucaccuuuacuguggguucccagauugacucaggucaucagacuuucgcagcaagcacuuuuaccagcugaauaucucucccguccuuaacguuaauuaugguuaaauuuaauguuaaaguaguuguguggcauuuuuauugcucuguuugucauaguuguaggaguugagcacauagcauauagucacauucuagacaugugaucuaccacugagcuuaguucccggcuaaugagagcuaggaguguuuguuuugugcauuagaucuuagugcaccuaagaugcacauauauuucaguuuggaauaugugugucagagagacauacucaccauuaccugcugagccaccucacuggcccuauuuuugcuuuuaaaugugcagguauugaacaccuuuuuauguuagguauuaguuuuauuacccuucuugauuguuauaaaaaguauauaaugguuugacauagagcaacuucuuuaagcuuccauuaacauuuaaaaaccaugaacuaggagacaggaaggauaaguuaggauuuuuuucaaggcaaacacuaguagggauucuaguuugugcuaucugcuaaagccucuauagaaacucaugacuauggcgagucaguauuacuaaagaaaugugaaguagccuucagauggugguaguuugucugcauagaacuaacucuugauuacuuuaaaaauaauuuucaaauuauucaugaaugguauuucauauagccguaaaugacuauauauauaaguguauauucuauauaauacaauaauuuaucucuuuaaaguguuacuuccuuuuuuuuaaaaaaaagcuugcuuguucuuuuuuuuuccccccaaagaauaauuaacauauuuuauuuauaugaguacaguguagcugucuucagacacaccagaaaagggcaucagaucucauuacagaugguugugagccaccaugugguugcugggaauugaucucaggacuucuggaagagcagucaguguuuuguuuuguuuugguuugguuuuugguuuuucaagacaggguuucucuguguaguccuggcuguccuguaacucacucuguagaccaggcuggccucaaacuagaaauucgccugccucugacuccuaaguucugcgauuaaaggcgugugccaccacaccuggcucagucaguguucuuaacuacugagccaucucuccagcccaaagugucacuaucaaccaguacuuacauuaaagaaauuguaggucaguagaaaagggauucuaaacaagaaaccauuucuuuaagaacgccuucaaaucucgagcacuggggaaaccagccuuagcuacauaguuguaagacuuuguuugaacaaaaagacagacagcaguaacuuuuuuuuuuuuuugacuuaacucacucuguagaccaggcuggccucgaacucaaauaucuaccugccucuuccucccaagugcugggauuaacguguauuaccauggcuggcagaaaacauuagaucucaauaggaaauacuaaacacaaaagagaaaauuuagaauaaauuuuauuuugggguauaagcagagauggaguugcugcucaggccacuacucuuuuguaguaugaugaauaagcuuuuuuuaaagguauuuugauucuucauucuuaauuacuuuugucuuauguaacuuucauaaaauguguucuuuugugaccaguacccugaaaguugcuggguuucuguugccugcuuucucaucugucuucaguuuaggucccuucuuuucugcucuuuacuugaauuaauccucugccuacuucacaggccgguucuuugaugagaaugaauccccuguugauccgcagcauggcucuaaacuggcggauuauaauggggaugaugguaacguaggugaguaugaggcagacaagcaggcugagcuggcuuacaaugaggaagaagauggugaugguggagaggaagacguccaaggugagccuggccuggcuuccaugcugugaccgugaaacucaccucuuagguuuugguugaauuuguguagaauuuuccccacuuguaaucauaguaguaucuuaaucuuaacucaagagguucugugucauuuuuuagcuuugagaacuauuuuaugauaaguacaaguuaaguuuuuuccauuuuuagauuaucuuacauauauuaucgaugugauaauaugaaaugccaaguccucaaaauuuuuagaauuaaauuguuugaaaugaacguaggugucacuugaggcaaacaccuucagggaacauccuuuuuaaucucaauggaaaacauuuacuaucacaaguauguauagauauuggcuugacaggcuuguuguuaaagugaagccacaauugaaauauggccuccauaaugaacagaaaugugcucugcugcugguggaacacuagaaggccaaauguucugagaaccuaaacauuuauauuucgugaaggguuuauaagauuugucuucauguuuaauacacagauucaacacauuuuuuaacuguugcuucugaacuuuuaacuugguagaaguucagacucuuaacuguguacacaccucagaccacacugcugugcuauaguggggcuucggguuucuuuuuugccuccuuguuuucaguaguauuuuuggaaucuuuaaaaguuacuuaaggucuuagggaaaaauguaagauuuuuauauuaguacaugaguuuucugcuauaaccaguuugauuucuuauuacuuuuuauaguuauuaaaaauuuacuuagguucaggacaagaguuauauauuuuuuaacuuagagaauaauaaaacugcccuuaaauacuauagagucaggauaaaagggaaaaccagcagucgcacuucuuaggcaucaccuugugguccacccuaguuuaaggauaaauauaguuauugaugaaaagauuaauaaauacugggaguucucuaaggacaucaucuuuucucaucaauuuuccuuuccucauugcuuuuaugauuuuauugagcuacguuuguucgccacuaucugcacuacuuuauggcccucucauucauggcugucacaucaccaguuagauuguaagcucuugaagagcaggaauuuucauuuauuuuaccuuguauuuaauucguguucuuuuuuuuguccacucucccauaguauuuggacucaggacccaaacaaugcuauuagcuauuaauaccaugcuuuuuccuuggcucuauccucacaacugagcauggugaaugcucuguaacucugucacagcuugcuugcuugcacuuugaagagucuccccucccugcacuaaggaucauuagauaauuuugagguuuuuauuagaguaguuuauuucaaguauuuuuugaggggggcaugggguuucaagacaggguuucucuguguagcccuggauguccuggaacucacuuuguagaccaggcuggucucaaacucagaucgccugccucugccucucuagugcugggauuaaaggcgugugccaccacgcacugcucuuauuucaaguguuaauaauccuuacauuuugccuguguuaagccugaauuuuuaauuuuuauuuaaagaauuucauuuaauauuuguaugaguuuaugcacagugagugguuuaucuucagugacuugucuccuuuucuuguauccuccccacagccauuucucauuaccacuuugcuuuuccuuuugcaaaacaaauaauaaauucauugguuauaaggaauauaagagccuuaggaucuauuauagcccagucuauccucacauuugauacauagcugaaggcaaccuugaacucuugauccucuugccuucaccucccacgugcuggaauuaaaaacacgccaccacauccaguuuuauguggugcuggggaagaaacccagaccucacaugugaugggugagcaugcucauaaauaagguacauccccaggucuaaauuuuuacuucaguauuugcaaguaaaucuugcuuggguugagaguuguucuuuaguguuuaucuuauuuugguauccauuaguaauaguuucaggaaguacaccacuacaacgauacucacacagaacagaaagaaacaaggacagcagacccaguaaaguggaauagauuggauauacugacuuuaacaggaguauuuaaagaccuaaaauaauuucaaacauacuuguaagauuuuuuaagauccauuauuaacuguccaaagaguggggagauagaccuagcccuaaauuaauaaguuagauucagguguuauugcagggucagaauucagaguugagaucauuuugucauugugcccacauaauuacaaugcucucacaacccaagcaggccuuagaacugacaaauaggggcgggaaugacaacaaagccacauauuggaguuagaguuaaaagaaagucugugugcacuuuuucaucgagaaauuucaguggaauugcuguguauaacuuaaauacuauaggaaaauacaauuuuuauuucaaaaugccugaggcacaucuacccucaggaaagaaaaaaugauuuuuuuuccugguugggaccuuuugaccaauaauaaaaacaaacaaacacacauacaaacaacccugaaguguggcuaggcauaauagccuccacaugucaucccagcacucaggaagcugagguaggugacagagggagcacuaggcuauucugaacuacagagccacaccuuuucuuuccuuuacaauucuucccuauuauuuugugugucuuuuggaugcaugugugucugaugccggaagacagaaguaguguuauaucuccugaaacugggaguuaacauguaggugcaaggaauugaacuuggguccucuagaagagcagccaguacugucccugcuaaaccaucuugcagcagcaaaaccuugagagaaagaaaaggggaaggaaggaccucaaagcauuaauaaagcuguaagcacaggcucugcucugcugauuguggaagcaauuuuuugagauguggaauauacaggauuagagacuccagcuaaaggcuaagauucuguuaguuaaauacacucuaucaggacugugaaguggcagcucuggccauuaggccguauucugcucccugugacuuuggacucaacacuguuaccuccaguguuugcuuauaaaauuaaauaagacuucuuuuuccuguguuuauaaugacuuaguuuuauuucaaacucauagaguauucuaaaggaaauaauuuguguugauauaaaaauuugaaaagaauaaaucugaaagcaugauagacauguucuuuacuguuauaagaagguaaaaacuuggagcuggagagauggcucagcuguucuugaggaucucgauuugaugcccgcuauauacaugguaguccauaacggucuguaacucuaguuccugggaagucaauacccucuuuuugccuccagcccauguggaugguacacagacaaaacacucauaugcauaaaaucuuuaaaacuuuuuagagauuuguuauuuuuaauuuucugucugucugccugucugucucugccaccccgugugugugugugugugugugugugugugugugugugugugucgguaucagaucccuggaacuaaaguuacagauaauugugggugcugggaacugaccacucagguccucuggaagagcagcgaauguucuuaccuggugagccaucuccccagucccaaauuaacagucucuuuaaaaagaugguagaaauguguaaguuuccuuuacucuuuaaaaucaaagaaauuccccauuuauuugcuaaauauuaauaaacauuaggcacugucugcaaauggaaguucagccugcaacccagugcuaaaagccuggauuugaauugucucuccuucacuugcugacacugugagcuuguaaauacuaugguuuguaccauaauucccacaacuauaaggcagacauauauguacuuaccuaacagaaguuauauggacuacaugauuugguaucaguccacgcuuaaaacagaccaugucauucuauaaagcacuguuuaaguguuugcucaauaauuuuuuuaaguaaagaaaacuuuagaauuuucucuuuggauugccuccuuugaaggauaaugccuuguguccugaggguaauuugugacucugggaaccuuucuguauuaggagcucuuuaguugcuaguccuuucuuacauuaacaguaagcuuagcacugaugucacaaauuaugcuuauuucucugguuguauuucuuuggcuguuuccucauggcuagcuacuuacagguucugcuacuuucuguagaaauuaaacacucaguuucuguauuuauugucagagugucaguuguauucugucagguaauuguauaggcuuauaguuaaguauaaagaaguuguugauagaaacuagaaaucuggguaaaaucacuacacugaaaacagacuauaguuaguuaaaaaggugcucacugccccgggcgugguggugcacgccuuuaaucccagcacuugggaggcagaggcaggcggauuucuguguucgaagccagccuggucuacaaagugaguuccaggacagccagggcuauacaaagaaauccugucuccaaauuccaaaaaccaaaauaaauaaauagauagauagauagauagauagauagauagauagauagauagauagauagauagauaaaugaaugaugcucacugcaguauuccaaaaguccucuggaauguuugaaaacaguauaucagcauuguauuaaaauugugcuaaagaaagaagacuggggcuggauagcucagugguagagugcuuguccagcacgugccgcuccugagaucagucuuuagcugcaugcucacacaagcacacauguaugugcacaguaaagaacguagacagaaguugccaaaccucccuucuauuuauagaggacuuugcaaccagagacugcaguuccaucguuucacuuugagguaagacaguuguucuggacugagaaggcgcagggcagguccaagggguggaacuagcuccugcaguagcguuugauccagggacagaucccaguguucccuaucccuagaaccuucguuuuuuaucucagccugucuuuguauuuauucauguaaaaauucacaaaaguaauaacauuuuuccugcacuaaauuuuguguugaauuucucagaauguuccauugcuuuauagugauugucuuaaaagugauuguuuuaaaagauguacucaugggcauaaauugaagcuucguaacucagguucuccagagagcauucuacaaaagugcucccuuuaaaaucaaaauuuuuuuuucuuuuaagugugauuuuuggugagguguuugguuuuuuguuuuagugagaugcuaucucaaaauaaaaaauaaaagcaggggcuggagagauggcucagcaggugagagcacugacugcucuuuuagagaucccaaguucaauucccagcaacuacaugguggcucacaaccacccguagugagauaugacgcccucuucuggugugucugaagacagcuacaguguacucauacaaauaaaauaaauaaaucuuaaaaaaauaaaauaaaagcaaucuacggauguggcucaguaagcagguagucagagcccacagcaccacauaaaacagaugaaacagcaagugagcuaacaaguauaaacuggcugaggauggagcccugugggacaacacuugacaaguaugcagacagaguucagacccuagcacccccugugacaaaagaagugaucaauauucagauuguauuacaaaauggugguuugaauucacaauucuaugauuuuaacagggaaguuguugaaaggaaaaagaaaguuggguuguuuggucauuuuagaaagcccaaaauagcauguggaggguugaaauaggauugugaguucaagccugagcuacauaaugaaguugucucaaaaacuuacuguuauagggcaccuuggaucucaggggaggagucagagucaauaugguucauccacuguaugaaauucuccaggaauuaaugaaaaauguuaauucaauaugauuccaauucaaagauggucccuaauuuauaauaguccaguaguacauacaaaagcauauccauagagccacccugcuuuucauuuucagaugguagucaguaaauuaugagugauacuaagaaauaaguaacaaaaggaagcaaugcacaaagccaucuccuaauuaaacuuccguucauuuuuuuaaaaaaaauuuuacuaauuuuuuguuucauguauauugauugauguuuugccuacaugugugucucuguaaggguguccaaucaucuggaacuggaguuacagacaguugugagcugccaugugggugcugagaagcaaacccaguccucugaauucuccagaagaguaguggugcucuuaacugcugagccagcucucuaacacccccuccccuucauucuuauucuaacauaaucuuaauuauuuugaacaguuguauaucaaaauuuggggggcagggagagggcuauugagaaauaaacagaacuugcaaaauggcagcugacagaugagacuguaggcagagcagacugcaaggcacucacuagagucacucacuacagcugcucaaaaggcucuuggggucucgcagcuauaauuucuuuuuuggugaagaaagcucuaacuuuugguacaugugcucugauuagaaaguuaugaguaagcuauuuguagagaacuuccuggaaaugcauauugagauuggggagaauuuauauucucucuuauuuucuaauuuuuuucaugaugaguguagauuaccuuuauaguuugaaaagaugauggugguuuuuaagagugucaccuguagcuuaggcuguuuugaaacuauggagauaggaaugaccuuaaacuaggaccucacaggcacauaaaaccccauaagaccagcuaagaugaggguuuuugucuuuguuuuuauaagacuuauuuauuuuuauuuauaugaguacacuguagcugucuuuagacacacacuagaagagugcauuggaucccauuacauaugauugugagccaccaugugguugcugggaauugaacucaggaccucuggaagagcagucagugcucuuaacugcugagccaucucuccaguccauaagauaaugcacagcacuagcucuucagugcugugaguuccuaacauuuugcuagcucugucugucuauuuccccgguaccugucagaagugacucuguucuguuugaaaguuggagaugauugguguuucuuugagaugggguuucauguagcccagguagaccucaaguuuucuaugugguccaggcuggucuugaacuucuaauccuuuugccucaggcucccuagagcugggauuacaggugugagccacuauguccagcuaagaauauuuguuaaaauuaaaucuuacaaaguaaugauagacuauuuacacuucagccauguggcuaaggaacagagcacuguuuaagauaacaagcacauaugggauaaugagaaaagauugcugaaaaacuggagacacuuugaagcuggcucuuugcagcaacuuuggaacucuauucuugauacauauuauuuugcuugcagaugaugaagaacgagagcuucagauggauccugcagacuauggcaaacagcgcuucagugauguccuuuaagucuaagggauucccgaaacccaaagugcugugcaacagaucaucucuacuugucaauuuugacuuuugcuguaaagaucaguuguaucaguuguaaagauacauugagauagauuuaaggaaauuuuaaugaaggaauguaccaauguacauaugugaacuuuuucauauuauauuaucaaagcagauacuuuuuuugguuacuacacagcugggccaaaaacaguuaaucuuugcauuuuaaagcaaacuaauguaaauuucacauuuuauugagccuaauuuuuuuuucacaaagagacaaacaggaacaaaugguuguacagguuauaugcugcacauaguauaaccacaaugagaacuuauucggcugaaaaguccacauuacuacauuuuuguucccccauagguguccucuacuaccccucaguuaacacucuugaagaaguucugaauaguuacacagaaguggggaggcuggaugccagacagugggcaaauguacagaauggccuucuacuccuuuaucuuacaugggcccugaugugagugugcugaggccugaugaaaagccuaggucaccguuacauccuuaccauaucuaucaguaguuccuuacuugguucuugaaguuguggaaugcaugguugacaguguauuuuuauuuuucaaguaauaccagaacuguuuaacucuggucagcacuggcuaaaauucuuucuauuuucagagcucaagcuggugaauacauucaccaguuaagagucagacccugagagagacugaauccacuuugaaaugagucugcaaucaguacagcaaagcuuugcugguaguuuuaaugaucguauuugauuagacuuuuccagaacuacuaaguaagggauuuuaacagguuuuuauuaaugaacagaugaguagaaguaccgugaagucugcagcuauuuuauugaaauagcugaaaacuuuguaauaaaaaaugaguauuuguaauuaauguuaguuaagaacccaccaagcucauuugcuagacuuacagaauuauuuucagugcauugugucuuuuggcauuauucauuaggauauauaagcuagcuaauccuuguuuacugauuucaagcacuuuuaauuuuuuuguguucccuaaaaauuaaagguguugaucauaaggcuguuaaucccaaggcuauuauuccuuuuuuuuuuuuuaagaagggcugcuauuaauuacacauaagcaugaacuacuagagagugacuguagcucagaugugcagaggccuggguuugauucaaacacuaaaaacagcagacaaguaaguagacaugaaaaguccccacacuaaggcucuaauccaaauacuaacagaaguauuguucaccugcugacaucugaaguccuuauaguucaguccaaaguuauuuaauggccaggaaaagauggaauaauuuauuaaaauuuguuuuuucugcuaucucagauuauauaccacugggcauguaucacaacugcaauccuaguguugaggaaacagaaacaggugugucccugaggcucacugaauagccauccuggccuaauuagcaaguuccaggucccuguaagggacaguuguuccugaggaacaucuacacacacacacacacacacacacacacacacacacacacacacgcauauauaaacaaguugacccucuggcuuccacauacacucauaaacaccuguaccuacaugugcacacauguaacugcacacgcacauacccacacaccaagaaacuaaacaguucaugauuuuguuaucaguaaagcuaggccucuguaguaaaaaguaugguucacauuaaaauacagucaaaggggagugacauacaaccaugggcauuagaaaggggagcugaaccuacaaaugccuagugauacuccauacuugauacuguagaacuguacagacaaaaucauaaagaugccuguugguuccucuguuauaaaagcagucacuugauuuuaugguaccuaucuaucuuuauauggaaaaaaacuucaauuagcagccuagacauuuuauaaacugaggaaucuuggaccaauugauaauauuucugacuguauuaacauuuuagugcuauaaaauacuaugugaaucucuuuaaauugugacauucuacagucuguauuagacaugcuauuuuguucuguuuacaguguuuuacuucugccuuaagauuuaggguuuuuuuuuuauuuuguuauauuuuaauauauuuugcccugaauuaaguguuaauuugaugggaacucugcuuuuaaaaaaaucaucacuuucuggguucuaauaaauuaaaaguuaaacuuguuucacaguuuugauuauauauauauaauuacaugaauauaaacauuuacaucuugacauuaaaacuugaauaaauguuaucauuuauuuuaagguaaauuggacuaaaagacuaggguugggcuggugagauggcucaguggguaagagcacccgacugcucuuccaaagguccagaguucaaaucccagcaaccacaugguggcucacaaccauccguaaugagaucugaugcccucuucuggugugucugaagacagcuacaguguacuuacauauaauaaauaaauaaaucuuuaa

SEQ ID NO: 12071 - RNA, 36511 nt, Mus musculus
cacuucgcuccccgcaggcacugggucaccagcugguuggagcucugcgguccuugccaucgucgccgucaccggauuccugcagccgcucugcgagcuguguuccacuuggauucacaccaccuccgcugcucccgccgccaccgccucggcgcccuuccccuggcccucguccacccaaugucugacucugauucucggacugagaaacgcaagguaaacacuccgcgacucccggggcgcaggcuggggauggauagaagacaggcgccgcagcggcuucaucugucucuggugucgcacgugcggguggaggcacugguuugucccgcguggcugcaggaggcgaacgcugggagucgggucgaggucgcugcgugccaaggcacuuuuggggaaggguugucggcacugaagcugcgggcacuuagccgaagacuggguugggacgcaaugccgcacgaggggccgcugaggcaucucucgcgggcaaggagggcgcguggucucggcuuggagccgaggucccgcuucguggugccgguagugcguccagccgggaagcgucgcggcgacccagacggcccgggagaaguagccgcgcgguagcggcgggcggguagacuuaacucuucgcugacgcggguucauugcggagguuugaguauuaaaaucacacgcgcccagacuuugcuuguacccauucaagucaguuuggccauaguggucaauuuccuuuccggaugucccuggcggcccgguuccuuuugcgaccguccuguggauauugaggaacaccguaucuacaggagacaagaaaccccguaaccccccuaggaccacuuaggcuacgcguauuccaagccccagcuagccgacuacuccuagcccgauugcaccgggacccagucgcauaggcuggcggaccccugagcucgcaagccuauugcccacggggcaggcacugcuugaggaaggcuaacugaacagugggggcagaggucuggaugugcaugcccgagacccgagauggucguucauauuugguucgugucgguagcacucgguagcacauggggacacagcaggugaaguugcugagaaguucuucaggggacugcggaggcauuagggacuuggcucggaauggccuggagugcgaucguggccucgcggaucuccgaggggugcgugucucgcuuugucucuaaugucccgcugcccuggcggcgggaauucccgcaaagcgcgcgccgucccggccuggcccagggguggggcggggcgcaaagcgaagcugcccggcccccuaaguuccagccggagcugcgguggccggcacagucugagcggcgcugggcggcgaguuugucaacaaucgccuugccuucggcugccugacccguaggcgccgcccccaccgccucugcccauugguuacgauggggagcgacugcgcgcgggccaaugggggagcacuggcagccggcgccaggggcgcagggcuggcggugcccgcgcggcggcgggagcugcgcgcuaggggcggagcgggaggaggcggaggaugaucccggcggcggccggugcagcgcgggccagaggcgcggcgcgcgaaaccuucggcuccccggcggagcguggcggagggcggacgggcaggcgcggggcccuggagcccaggacccggcuuuguuucccuugccuccucgguggcgacgugcaggggucguucgaucggcgcaacacgccgcgcucggaagggaaggggcggacgugagucucggcaugguggcccggggagggaaagagucagccuugcgccggguauugccaagaacgcgcagcuagguguggaacuuucaaagggaugucucuuaaggcccucuuuggaagugugcacauuccggcaagguugcacccgagagaagugguuuaguguuugggguggcgcgcagggcaggcagcaggagggaccuugcggccgagggcgcucgacccgggcggagcugcgcucggaguuacaaacucuauugugacgcacuuacuacgacugacggccgcugccaaaccuucuccagacuugcugcccucagcauuuucggcaaacaauggggccggagcagggaaggcggccagccgccugcaaucucugcaucugcgcccgcuccugugcuccagcuccgcaucugagcccgggaaaugagagcccgcugggauuuucagacuugauucaaguuuguccugaaggaaagcacgaaauguagacgucccgcgagcugcuucuccuaaaacuucugugcuugugugugcgugagcgcacaggcugacuccacaagcuggggagcugauacuuuguuuuguuugguaguccgauuuaguuccacucugcaucaaaauaaacacaccuucauuauuuugggcgccccuuuggucuuacuuggcagauagucagaaaaguaaacaacauaacaaagaaucugagguugacucuagaauucuuaacaaauggaugaaaugauuuuaaaacuuaauuugcugaagauaaucguuuuguuguccccccucccuguuuccuugcagaaaaaaagaccaaauggccaagcaaccuucugauguaaguucugagugugacagagaagguggacaauugcagccugcugagaggccuccccagcucaggccuggggccccuaccucccuacagacagaaccgcaagguaaucccgacggcgaaggggaccgcugcccccacggcagcccucagggcccgcuggccccaccggccagcccuggcccuuuugcuaccagauccccacuuuucaucuuugugagaagaucuucucugcugucccgguccuccaguggguauuucucuuuugacacagacaggagcccggcacccaugaguugugacaagucaacacaaaccccaaguccuccuugccaggccuucaaccacuaucucagugcaauggguaagccauagcuggguaagaggcaguucaugugugcuuguuugaauaucgguuucaaggcuguggggagcauuuaaagccucauagaaucagucaagugauucauucuauauuuugauagaaacaagauguauggagaucucaacaauuuuuuuuuaacuugcaaaguuugugucgugaauuuauggauguacaaacaucaacuuacugaguugcaaaguuugaaucuguggccuucuagccaaaguuuauagccaagguacaguugguuuuaaccacuaagcuuagauguuaaugucauuguguuauaaaauaguuuaauaaccaccaggcauguaaaaggaagugauugaacaacuuggucauuucugaagacagccucugcaaagaugaacagcagagccaacuuagaaccccaaagaugaauuuaugccccaauucuccuuuaagcucauuuuugcuucaagggauuuaauuuaguauggauggaugagauuagaguguagauuuuuauuucuggggcuacagucaguuguagaauuuucuaaaaacuauauucuuaauuuugagauuucaugcauaaaauuuccucaaacucguccacuuccacaacuuuucccagaucaguuggagaaucuuaaccaaguggcacaaaauauccacggugaugccugguacaacugaugagaagacagcugauggggacaguggcacuuuggagaguguuuaucccaucagcauuaaaguugccccugauucuguccugcaggacaugaguucuuggaguacaaguguuuccauaucacaucaucaccaggcgagcagauuuugaagucagauaucccaaucuuuaaacguuaacaauuacuuuagauccuauagucacuguuaaaaggcggauugagauuugacucuuaagaccucuuagcuugugccuugggcuaugcacauuucugguacaccccucaaggaaggauggcucugcauguugcuucuccaccaaaagaaaaaccauuuauuuugauccuuaucauccacaaucauguuugguauguguccggccagucagacuuguagaugacauuaggaaccugcccauggugucaauuaaaacauguucucuaugaaccacucuggggacuguuaagcccuccuaacagaaggagcugggagucuuguguacuacucuggcuauugcuuucagacguacuucugggcaggcacuugcuaccauucuaccacgaaauacacccagcauaugggcaugugccgaguuaacaaagcucccugguauaagugcuuaaaaaccuguguauuuuaagaacccucuggaagcuauuagagucuuaauacugugagcuuaaguaauggucucugcagguggaauaaucuggggaaauauuuucuccuuuccuguucacuaggaguaguggcugaguuagggcauucucugaugugaagauagucacaauuguuuuauuuugggucccauucuauuuaggaagcuaauuacaguguaauucaucauaauuugagaugacugauaacugagcuuuaaagaucacagucuaaauucuuaggcagaguuaauggucauagcugugaagugcuaacuagauugcacuuccaguacauugggaugauguuagcuugaagguuaaugcgugaguuuacacagcgagugacugggguuaaugcacuagaguugguuucuauccguaagcucuggagagauuugcuuggggaggggguauguugggaugggauggaaugggguggggcagaaauuacugacagaauaagaggacuuagccagaugugagguuauuaaauuagacacacucaagaguuuuuguccaccacugcugguuuucugaccacccucacaaucuuaguucugccugaagacuacuuaggcucagcuaaaaagugaucucuuuaucuuuuggacuuguuuaauauuuuugacucaaccauuaaaaucuucaaugcugcuuuugauaaguuauugcaaaauacauuuucacaaaggagccuuuaugauugguaugaaccacuggucgucgcacagagguccagcuuagccaagggcucuucuucucggcuggcaauuugcgguaggagacagaguaugccuuaaaaaccaugucccccucuccucugauguguugagauuggaccuaaagcuuuccccauuaaggcagacucuccuacagagcagaaccccagguucuuguaucuuugcugcacugaggaaggaagggucucauuggagauaccuggcaagcagauaccgaauuagagaugucggcacaguuuccucugcaucccacuguuuugaaaaaaucuugcaagaacauuuuguuuacuguuuggaagucguuuuacucgauagcagccuccauauacuuuggggggaucaacuugccaaaccauuucuugaacggcugaugaucuuaauaaaaaagaaccuuccccacacccacugacugccuuuccuaguguuuuuuuaugccacauauguuucucacaccaguugaucuuugcacacgcucuccaucugaagcauaaucaguaugaacuuggaaaugcaaagcagaugaauauugauugucagcagggacuccgagguguuugugaaugucuucagcuuuggacuggcagagcagaauuccaucaucuuuacaaccccucagcguccuaugcaauuggccucggcgcuggagcgcgagcuuccugugaaaggcaggacauccugcagaugccaucguggcuaacauaagacaccuagacguuggaaccuguggcgcucugucugagccuguccgugggguuguguuuuguucuuacaguguugggaauggaacucagaccccacauaaagcacauaucuauucccagcauaucuguguuggcacgggaggugugcccccuauuauagacacaagaacauggguacauauucacaugaguaggugaaguaauuucuugggccaucuccauagacacucgggucaugugcacguuagcgggcggcucauuucuuuuucuugccuuauugcacugacuagagccuuguggucuuguuagauagaagugauaaagguugucugaaggaucgucgguuuucugcuuagagaguaaaaucauuaacuagauuaguuauagguauuuggggauacuuguuuauuuaucuuuauuaauuuuuguuuauaaucuuuauuaauauuuauuaagauuaggaaauuuuaaccaaacuccgaaguuccugagaauuuucagaguuagguuuuaaugaaauguuuguaccaugauucuguuagccuguuggcauggugugguacaguguucaaacacuguuaagugcucuuauaugcccgggauaaauucuacuugggcaaaacauaauuuguguacaaugauggauugaauugaauauuuuauuauuuuuauaccuugaaagguguuuguuggugcuguuugcuuucuguaucaaggccugaaugaguucagaaauauucccucucuuuuauuuccagaaggaacuaugaaaaagcagucuuaaguuuugaggguuuuuuuguuuuuuguuuuuuuuuuuuuuugagacagggccucauguagcccaggguagcuuugaacuuauguguagccaaaggugugcugggugcuuuaucuucugauccuccugacuccgccucccagaugcugagguuacagacaugugccacugugcuucugccagagaccugacacucggcccagagugucucuuggugauaucagagcacccuuggucuuccuggucgguuucuguguucagucauccuuucccugaggcgcccgccuuggugagaacagacaguugcuggugaauucucuuucugccuauuggggcuucccagauagaggccucugagcaaccugccugggcucuggagacagugagaagaguaggcaacugccccagagucugcugagaacccugaagcccuccccugcccuccuucucauuuuccugggcuuugcaguguuaguggucauucaaggaggagggccuggcaguggagcugcuccucccucugggaacaggucugaaucuuucaccuaggucuuguuuguuguuuguggguuuucuuacucuguuuagaugucgugacaauuccagguugccuggcucaaugguggcucacaacgccagaggcugagaaucuaaggucagguagaucuggugucugaaaagcugcuuguuccgacagcagcauccccaaggugucaucaguaggggaaagguuauggugucucugaaggcacuuagcacucccaggggaccccacauuuuaauacugaccauguaguggcuauggaacaucaauuuagacuaagguuaacuugauuggcuacagagaauucaggauuuuagaaaucaccucucuuccuuguguuuugcuauugucugcaugggauaacaguagaaagagaauuagcggcugagagugguggugcacaccuuuaaucccaggaggcagaggcagguggaucucugaguuugaggccauccuggucuacaggagcaguucuuggacagccaggacuguauacacagaaauccuaucucaaaaaaacuaaaaaagaaaagaaaaaagaaagagauuaaaauuuuagcuacaauccucuuuuucauaaccacacugccugucacuacucucacuugcccuguaugacuaguggcguaaccucaggcuauucucuguugcuuccuguauguguggauaacccggucuaauuucaaaauagauaaugccccuuggggcauuuauuaaagagaaucccaagccuuauaguugugugugauuggauucuaagauagagagaugaacuggagaggcauugguuuuacuuuguguucagggugcugguggaggcagauugcaguguaucugucugcuuauagcuggugcugugcacacacacacacacacacacacacacacagagagagagagagagagagagagaaagaaagacagagagagagagagagagagagagagagaggaugagaauaagacagccugagggacaugcccuggcuuguucuuuuaaaagaugacagacuuguuaauagcaaguuugguucuaaagaaguucuuaggacuaaaaggaagaagaaacugugcuuaacuguaaguaguacagacacagaugugugacuuuuugcuacugaaggaaagaaaauaaaaaaaucaccuggacaacuauaauagugucuacuguacaucuggcucuguaaccuuuguuucgggcaucugcagcagccugccacuggguggguaugcaugucccccuguguguuagacucuugcugcuggugaagcaacaccucgcagcagccuguauuagagguucuuccagggacacuguccccuaucaauuccuuugagggcugccuguaugugcauacugucugaauggaacaucuccagcccauggaacccugucagcugccugccuuggucaccucucucugcagccuuguacaacaaaccacucagagaagucugggcggaaucuuggcugcuccucugcugacccaaggaccacggugcaucuggcaagucuauuugagcuccaguuuucucuuccauccagugaggaccugcauucucuacgugcugugggaguuugagaauaacccagcagacacgagucaccuaggaaggaacucagcacuucuccuugccucccaggaagugucccagcuggucauaggcauggcugauaugcaguguucucuacugaccgacaucuguggaaaagaccagcccuucuggaacccacucacagggagcaguguggucgugggaaugucacgcuggguaauucagaagcccucugguuccagaguaaacaagcaaaaagggaaaauauuuucuagaaacucgcuugaauagggugggaagggaagugugaaccugcugcaggccugcugauggaccugaacaucacccugaggggaaccuuggcuuuucuggcaaaucuuuggaccguggagggacaucuggaaacccuacccacaccggcucugccugccuuggggcugagccuaggccaccugcuggagacggaccauuuguggcagaaauuugacuagaguucagaaauguguauuuugaaaagaacagucucgagacagaagcggagaagcacuuuccccugcgggucaguguucuggaacagcuuuucaaagcaagggguaugcuuuuuaucacuggaaggcccacugucugaaucgucaagacuuuaaaaaaugccucccuuccccuguaucuuuccaggugaggagcuauccuuagcuucgaguugcuauaggaaguuuccagcccuuacagaugaggcuuucccgugcugggcaaacccagcauucacagcauaaaacagcaucuacuuaauggcaagcugaacuuaggucucuaagaggccaggccucuuuguccccgaguguuacuuaggaugagucuuaagucccuggugucugugggaagcccugacuucacuuugcuuucucuaacucugaccagagccccuuguuucuucggagagcuguggucuguccccugauugauguugaugauaaagggaugcgggcuccuccuguuguugcccuggccuuuccuuuugccaaccagacaagagaggguggcacugaugacuugucuccccuuagaacccauguccuucuggcucgugugugugugugugugugugugugugugugugugugugugugugugugugauuggggcucacaguugaugccacagccauuuagaggcacgacucuaacuguguguggugugggcaugaagugucuguuuuguuuucugccuuuuccuaauguuaaagcuagggaguguguugucuaaugacgaaaccuugccuuacggucauuggcgcugcugccuggcccucugcacaguacagucuacuauguaugcuugggcuuagcucugcaucuuuaggaaugaaaguggguuugaagcugaaacugaaaaauaauaaaaaccguuucagcucaggaugaguguacauguuaaguugaaacagguugaacacuaacaguuuucagcugucagcugucuugagaccccaccccucaccgaucaauagauuauacuuucagguauggaguguaguuuccccguucuuacuccuaaaagaucuaaauauaagcaauuuaagaauaagugagaaauuugagaguuuuuaaagauuuuuuuuuugccuguaauugugugugugugugugugugugugugugugugugugugugugugugugaagagagcauuggagccccagaaauggcaggugcagacagcuaugagcugccugaugugggcucugggaacucaaccuaggcuucuucuguaaauaagagaagcaaguguuuuuaaccauugugcugucuuaaaggggaaaggaucuguuugaccuuugggaaugcuuguauaugaagaauacaggcuguacaggccguguuagauguuacuauucuauagcauaacugugcuagagaaaaugcaagggaguuucuuggggcucagugggauaacacuugucaucaaguccaaggcccuggauuugcuccccagcccuacaaauagugggguucguuucuuguugauuucuuuuguauccuugagaaauuucuuagcacaaaauagugacaaugagguuaggaggaauaugauguuaagggucuaugagaauacaaaccuugguuuuacuuaaacucguguguggauucgaagcagcucagugacuuaagaggaagauggacuguuuaggaagagcccgugcuguccugugugaugugucccguagcaguccccucgcacuuucucagcugaaagucuggccuagacaaugcaagggcuaaggguuagcuuuguguccacacucuucccgugcugauccugugaugaaaucuagugguagaaaguuuuagccugugaccccgccuccauggagucuuggucuuuccacuaugauagucccauuaucaggaaagguaacuggagcucuuaccugacucaggaggguguggaggccacucuaguggucggagcacaggagagcaacgcuccacuguuccauuacaccggggauuuuuuuuuucagaauguccucgaacugucuugcuugggucaugagucuugugcaacagagcugccagcagcugugucugcccugccuuugugggcgaguggagagacaugucaggagcuugcgcagaugaguggacugucaccauaaacucacagagaugacagccguuuuccaugucuuccugcaccugcagucgccauagccaguauuuguaaucagaacaaaccuauuaaucgugguuauaaauuucacucuuaacuuugaucuuuauuucauucuggugucuucccaacugagaagucaccuguauggaggcggggcauggagcacaguuauguuauauuuguacacuuuggacuguuucucugcagccucccucagacuagugucacaaaguuggcccgucaggucagcggugaaggaacuuggcucucgccuccucucugacuaauuuuauacucccucugucaccacaagaauuggcaagcuuucuuugacagcagcguuuaguuuaguucuuccuacgucguuguugucguggucgucaucgucguugucguuguuuguugguacaggacuggcuggcauuggccuguguugugucucuucgcggaaaggugucaccuucagccuggaugugucuaauaauaugcuucugggguugucugggggaagagucucaaagcccagcugagacagacauuuaaaccauuaacuguccaagcacagugauugucuuugcaguuaugcaaagcagugucuggaauuaagguagaaggcuuauucuuuucuucccacaagauggguauaaaggaagcagcugccuguguuaagugggaaguuuucguugucuguccucacagcgaguuagccgcgacgaccguacaucuguguugaauuacugcuucaguuuguauauggcuauuauaaaugcuaaguuaguaacuaaggccuucauuagaagaaaaaacaaaaaaaggggggaaaaaaagcccaggggugacuuguagaugcugguugacccuuguugucauccggugucuuggucucuguugucacugggauaaaaacaugauuggaaccguacaugaauuuagggggaaauuauuguugcuuguuuucugccacugguuuuaaguuacauacaggaagccauaguuaacucugaaaacccaggagucuuuauuuuauagugugaauucuuagcuucccucacccucggcccaauaugauuuuugucuagaagcaauuuauagguuacuguaacuuggggcuuuugcauccuuuguuucuggagucuuuaaguguguugauguauagggggguugcauguuugucuugggguuagacuuuucauacauagcucagguuugccucaaacacacccuauaguccaggcuuuccuaguguuugggguugucugugugagcuaccagcaaggaucucaaccccaggccucacucaugccaaguggguagguguccuccugcugagcugugucuucaguccaggccguacuugugguccagggguggaaccgaggguuuuaggcucacucgauuaggagugucccccuaugcuacagcugcagcccuaguguuuaaaggaucccuaugugguucuuuugauuaaugaaguaaaucaugacaugcgcugucuggcuagaacaggauauugguuucagguuuuuguacuaaaucaaguacaaaaucaacccuauuuauuguauugaguuuugacguuauuuuugcuuauucaaguaagaugcagucagaugccuguaaccuucugaacauaaacaaugacugugggcagagauggagcuguucaaagacuuaguggcacaggacugaagagauggaggcacaggagcacccaggguccugacauaacuggcgagugugaagugcugccaugugcuguucagagcagugacgucagcacggcgugauuggaggcaccgucuguuauggugguacuauuccccgaggcauguuaaugagaggagcuggcuuaggaucagguuugggaaguguggcagcuuuguuuauuaaaaagaaagguacuaugcuggcgagaugaguccagugguuaaaagcacuggcugcucuugcagaggacuagggguucaguucccagugcccauguggugacucacccccuaccucgcuccaguuccagaagguucaaugcccauuuuucucuaccacaugcuuaugguacaaacagacauuccuuacauaugcaccuguauaugcaaaauaaaaauaaguaaaauccaaaauaauaauaacaaaaagaguuggggguugagaggucccgguacaccuugagaacaggacaucugacccuggaagugagcaaaaaagccaagaaaccagguagucugucaccaacaggcucccagccaugcuuccccugugcuucugggacugagaugucccuggaugugggcccugcagcucaggcuccggacauaaccuccugugucuaaugucuuuuagugugaguuugggggacagcucagauggaagccguaaugagagaccuucugauguaggauggaaugaaugagaagguacuggaucuuaguugccgccagguuuggucuuuauugcaugaaacagaccuuggugaaggggaaaggccuugugaauacuaguuuccacgucucuguccagcuucagccugggacuagggcuuugcaaaccgucugucuggaaauggaugaaagcagcccguuccgaccuauuagcucagggcuacaugacagcagcggggaggacacgccggaagagcgaguggggaagcucuggcuuugggucgugcacuucauuaucgagcauuuuauuccagcagcuguuuguaaggcgccggcuugaauucaugugacaacucaggcuugacacaaaugugcgccagagaaaaacagacugagggaaaccugagcucuuaggcugcagcgugcuguugcuuuauuuuuaugucuuucuuuuuacuuuuauggauauguuauuuguaugugcaccuguuuguggugugguuguguguguguguacacgcugguaugcagaugugcagagaccagagguguuaaguguuuuccuccauucaucugagccuuagaccuugaaacagggaucucucacuaaccugaaggucacagauuccacuaggcugguuagccagugaguccuggggaauccuucugucuccaucucccuagggcuagggacucagccucaccugcacagcccccucuuaacugauggcgcccucuuccuacagacaccugcauuuuuauuacuaauagcuuuuauuuucgucaaguggcucagugggacuaguagauuugucuuaucaagaaauaaaaugaugugaguaaaaauguugaccuggaaggagcuugaggcuggggaguggggggauugaggggcggggugcgcagggagacugacugguucugggugggauuucugaguacaaguuucaaaaggagcuucuggugacauugugcguccccucacugguggcuacggagaucucuuugccuugggcugacugggaagagacaggacaacuuggucccuuuaaggugucuuugaaagcugccugagcacaccagccugucacuucauuccuucuguggguaugucuaaguagagauuacaucugcagguauuuaagugagcagauuauuguauuaaaccaacaucccagaauuuuuuuauuugccccacugaaaacugagcaucaaagcggcugcuuguagacauuuccacgcccaacccaccauacuugaaguauuucuuagggcuuuauuuuauagcugguuugaguccacaaggaagugguucuuuguagaggccuuuauaagugugagugguccccucagagcguccucggggacagagauacacagcccugauauggcugaugagagguguuuuuuuuuuuucuuccuacaguccaugggccaauugcccucgacugucugguguguucuguuguguguuugaacgaucaauacuuucuucaaagacacacauuccaucuacuuggacaucaggaaauccuuucucuguucugaguugaauauugauuuggcuuaauucauugcugguuacuuucacaucuaaucuuuggggauuacugaccaucuaaagacagcugaaauucuccugcagguuuugaguuggcuccugcuauugcuacaacuguaaugccaaugguaaugggaguaggagcugcccuguaguuaaggagacugagcuagccagcucccaagcugaaaaugcaagccagugugcuaggaugugugcuuguguuguuucacugcgcugcugcgacagcacaggacaacuggcagaauggcugugaaugucacaaugugaccauggugcuuugaacccauugcugcucacugcaacaaagucucagcuugaucugcuagcagccacuuccccuugauauuaauagguacugaguuuugaagauaccuuguauuaccucaugacuugaaaaaguguuagccaagugggugacccacaucuugcaccacuaaggcccuuuggcaucaggaauguccuccuuucucuuccccugaaaaaugaauugguauggugccauagaaaaucacguuacugauaccaguuuuuggauuucaaaaagguuauuuuuugaaguuuggaugaaaacucagugggcagaggacacuuggcaaagugucugauccagcacauaagaaaguuuaauaauggcauuuguuaaaagugaggaggaagaaauguggcccuggcccugggaaguccccucuggugcaguuuaguggccugcaggcuuggagccuugcugcaagucucagcuucacaguauaucuguggucgcaagcacucuguuucgucugcuuggggugugcaugugcgugugugugcacacacacucaugcaugcacacucaugucaaguucccagaaugaaaguuccuuaaauacugaaacuauguucugagggugaaaauuuuuauguguguguaaaauuuccuccuugguuuaaaaguguggcccuccuuagaaaagcuuuuguaaacagcuuucuugcgaacacauaucaacacuugggauucucaggcucaucacuaaucacagaauaaacuacuugugguugguucuuaaccgucuuagacugcauuaucuuugugaugggcugacugugggaguaaguggaugcaugcaggacagagugacaggagucaggaaggugggguggcaugucuucugggcacuguguccccagcccacaggcgccaggugcaucuucagaagaucgacaauugggaugucuacauacuguggucgccugugcuuaggguggcugugaaaggggacaaagccacgucguguugggaauggaaaucucacgucuggcucacucuaugcuguagaguggaccgaggggcccuauucuuugcucuacuuguucucucguggcacaggaccaacuaugggacucacuagcauuaggcuguugggggagcucaguggaaagcuucccuacaccccaucccuguaccucaaagaaaauaguuugucaucugagaaauaauguuugaagauuucgucaaacagcauaccauaugaguuacagcuaguguaccuuaaauacagaagaagaagaugccuucuaaaguacucucaauagaauuuuuauuauauaaacuuaguauauuguggcugaaggaaugguucagugguuaagagcacuugcagcaaaaucaugaagacuggaguucgaauccuggcacccaaguaccaauccagacaucugcccacagauaccagcucagaguccaagcagagaagacaggauugcugagauuugcagacuuccagcauaauggaggaaaaugugagucccaggcucagagagagacccugccuuaaaacguaguaggcagagagggauggagaauggcacuccacccacccuucuggacucuacacacaccaacagaaacauguguacucgugcacauagacaaacauacgccaaucuuuuuacaaaauguacagcuagcuauaguauuuagcuuggugcauaucuacugugugcaugcuacuugugccuuguggaguggguacuagccuuaauuuucaguuuuguaccucaaaaaaaaaaaaaaaaaaaacaacaacaaaaaaaaaaaaaaacaaccagaggagggccagagagauugcucagcaguuaggaguacuggcuguucuugccgaagaccuugguuugauucccagcauccacauggcaugcacauaaauccauacaggcaaaauaguuccugaaacuauuuuaaagcacaccuauccaggaggcuguggcuccgugauagaacacuugcccaucauacuagcaucacagacagggagaaauaaauauuccugauccuuauaaaaauaaaacaccagccagguaugauggugcaugcuuuuaaucccagcaccuggugggugagggcagauagaucugaguuugaguccagcuuguccuaugucgccaguuccagcucagccagggaccgggcagccucuaagacagaccagccuccucggcaagugguguuuauauuguaacagcuuuuuaauauuacaccaaaguacagcugauagucuuuugguaacccagagcuauugccagccaauuacaguuugggcuaagccugaccuaaccauuaucuuggguuaauacacuguccugacaccaccagcacagaucagggccccaggccuaaccacuguuucugguccuuuguucugugucuuuucaggaucugguguguggaucuuagcaccuccaucaucccucccacccuaagccuccuugcagggauguggggaucuguuuauaucugcacaccuacuuguacuaacagccucugaacuuuuuuuuuuuuuuaugggagaaacagacugucuucuuaucuccccaaacaacagggcauuuaucuguaaacaaguugagcuuggccaccaaagauccauagcugcuggcagcaucugugugcuugcuaagugcuaguuuugauaagucaaguugugacccaggauagcuccuucaagugguguacuucagcucccuggaccucaucugagccucccuagaacaaccuggcucauggucauuuguuguacaucacugaauaugaccacacaguaaacacuggguaagugacuugggucacgccaccugacuuugaucuauuuuuuacccauugucuucuaguacuuggcuuuucuuugcuuccaaccccaaaggugaagcuagauagcucucuucgguguguauggggagaaagagugaacugugaaggugggagaggugggugacaggaccugucauggcggcguggugccucccagaccugcucagcuggguaggugugcaucccggugaggacacaacagagccccuagagaguucuugacggucaguacuuacaaccacucgucaugacccagcuggugcugguccgugcuugccaccccagcacuuaggaaagugagacaggaggggugagagagaccugggcugcacagugagauggugauuugccacuugugacaccaacgccucacaaagcugacaacccagaaggacauggaacugauggcuugcuccauucaccugacauagugucaaccuuuggguuucuuuuuuccaauuaaacuguaguuuuaauagacuuaauaauagugcuaauauuagaaauauuugugcuuaaaagaaaguauggccaguguaauuuuuugugauuggaugugacuuccuggucugacuuagccuaaaaauuuaauuccuccaugagacuucugucuccuguguagugauguccccucugauacugagaguagguagcuuaauggaacacagaucucccccuuacugaggacuuaucugcucuuuuaagcucuuaguaguuucucucucucucucucucucucucucucucucucucucucucucucucucucccucccucccucccucccucccucccuuccucccucccucccucuguuucuccucucccucugagaaauccucucagugcagcccagcauuauccuccugccucggguucuggagugcugggauugcagcugggaucaucauuaacucuacuggaccaugggcaacccuuggucagggaagagguggcaagcguuuugaaaagaauuagcuaagucacuugcauauacuuuugccuaguugugagucugcaguuuauggaucuuuuacaaauaaaaaagcaagauguaauguuuuuaucaacaguagguuuuuucuacuuuacugaguggggaauuuaguugugaguugcuugugcuuuaaaaauuggagagguaaauggaagcccagggcgggugacuaaugugcucuuacaguguuacaacauaacauuaacauuaacuugguguuaugguucagugugggggcgggggaaggaggacaggaucucacuaaauaggaucucccagguugaccuggaacucauagacguauauguguagaucaggcuggccucagacucacaaauacaccugccucugccucugccucugccucugccuccugcaaccuuccccaauccaaucuuuuucucuuuucucaaaaauaccuuuaacucccaaacccaaaacacuuccagccuacgugugguguuugcagacuugagucccucuuuguugacugaguuaauauucagucagagcaugcaguuagcaugcaguuaugcucccaucuggaugauuuacugacuccacugagccuggagacagccaccuuccaggcaucucugauuucuccuuacuaggcuuuggaacggacaaacauuucuucagguuugaauuuuuccuaggaauuuauaucuuguucuaagaccaaaaguggguauuucacugagagauuaaaaugguauguucucugaugguuuguguauuuuuuuuucuaguguaguucuagggauggaccuuaggacuucaugcaaacugcccccuuaaaucucucucucucucucucucucucucucucucucucucucucucucacacacacacacacacacacacacacacacacacuauaauaauaauuaaauaaagaaaucagugaaaguuaguucucugccuucaccauguggguuuugcaccagucccugcuguguuucuuuggugaucuucauugaacuauccuuuugagaugggagugugugaggcugggccgggguguuuuuucauucucguaaguccgagucuccaauuccugccaucacucuguaaucaccuacacacugacugcugguuccccuuuguuuugcucaucaacuggacacaagcuagagucuucuagcaagagggaaucuuaauugagggguuaccuacaucagguugccuguagguaaaucuguggggguauuuucuugcuguggaaaggcugagcucgcugcaggcagggccacccugguaugaaagcaagcugagcagccuguggugagcaagccaggcaggagugcucccgcgcacugcuucuugcuccugcaucucuucuugcacuuucucccugacuucugucugauggacugugaucaacugugugagccaaguaacccuucucccuaaucugguuucaguuagcacuuuaucgcagcaacaggacauagccagcuaagacaguaucuaaaaugauaccguuuucacaguucuaaacacagggucgagaguucccaaggccagggagcuuccagaagaccagaguguguuagguggguuuguuccuggaaacuugugugugguguucuaaguguuguggaccucggugugauuucugguuucuuugccucccgagcagcuuccauacgacagucucaggaggaaccugaagaucugcgcccggagauacggauugcacaggagcugcggcggaucggagacgaguucaacgaaacuuacacaaggaggguaaggaccucuccccauccccagagaaagugcaacugcggagauauggcccccuucugcaccuuacguuaucucucuccuaauucugcucugaccuggugcaucuaaggguuuggcuuuaacugagauagagugugaaguugcaagagguauuuuaugugcaagagaccucaacauauuagugcuuagaauucuuuuaaaagguuauugauacacaugaaauagcuccauguagcuaugggcacauggucuucaguuccuguaaggugcuucuccacguaggcagagccauuaaauucuguagucacucagccagggcucgcagcaagagagccuuguccugcugcuggcuuuucccauuugauuauuaaacuguguuaggagacgagucaucaauagcuauaaugugaaccuaguggaggcugaauaaggguagcuggcuguccuguugguauuuauuuaaauaauaacgaugacaacaauaacauaguccagcaucuucagaagcaguguguuuaaaaacaguuuugauauggaacaaagacacuugucuguuugagguccugcuuccuguggacuacacuuuuggggauguaggcuuugacucugagguacaggacugcugugagugggugaccaguuagcaaagagucuggagguaacuuuggcuccuuuucaaauucauucaaauguaaccucucgccucucuggagagaugccagucaagggacccugagauguuucugucuuuacauagacaucucccguggagcuaccggcccacacuaaguggcugcuccccagacugcuugagcagccuuguuccuuuugaguagcagaucuaucagggagucccggaucucgagaauaaucucagccccacuuccugcucuucugugggacguguugggggacgaaugugugugcuauagucuggcuucugucauaaugggcacuguccuguugaugaauggacugaggaguuuuucaugaaacuguguguagcccacacaggcuuccucucccugacguggaucaugucacagaauaugaauuccuucuuagccuagguccaaaauggcagucuuuugggaagaaugguugauuuuauaauucaccacuaaugcuacauccacuaauccaucugccuuguuuucuuuaaagagauuuuaguguuuguguuggugauugggcugguuaacuauaagaggccauaguauguuugggagccugguccuucuguugagggcagggguaggggacaugagacuauuugaagagaguaaggggcuacaucugagucuugggcuggagcuggggccagaguccaggaggauaugccauuuuugaugaguuuggagagacauggaaguguagguaugaacuggcuaugaugcugugucugucuuacuguaaaugcccucagggcuggaccugguggguggguacgccccaggagggacgcagcugugggcaggccuuuguacugcugggacauguacaccgagcugagcuggcgcaacaccccacucggguugugucagcuccuuugucugcagagccaggcacgcugauggaucuuucguacaaguuugauuuuaaaccauaagguaaggacaggggacuaggaggccuuccccgaugggagugauggucggugcagcucccuggggacugugagugguuagugaugacauugucagagugaguagucacauucuauggcccgcccucaggaaggguaucaggguaaugagugauucgaguccugugcagcuaaaauacggacugccccagauucuucucuagcucagcuugccuuauagaaggugagacuauggcugcaugugguuugccuccuaccuucuucccaauguuauuuuauaguuucgugcuuauguaugcauuuuguggugguugcaucgguuguuuuuuguuuuuuuuaaacaagccacauuuauauauccuauccuuuuaaauauaauaaaugucaauaaauacuguuguacuauuuugcaagauuuuauacuuuauuuuguaugucuuuuuuuauuucucucuguguguguguguguguguguguguguguguguguguguguguguguguacauuugcaggcuacugugcauguuauagaagucugacgauaaccugugggaguuaguucucugcuuccaacuagcagaccugcaaacuucucagcaguuuuccguccuuugccucccgucucaccaguccugggauuacagaugcacauacccccacuuccggggcucuuaugugggucucaggaguccaacucagaccaugaagcuccugagucggggugcuguugcuagaugagccaucuugccaagccuuagcauaucuuaagcaauggguuaagauccacugcugaaauccggucacuaauaaaggacuuuagcuuucuuaguaggcucgagaaagggauagauuccaggcuaggcccuaauuccucuaaacugaaggcaaauauucuccagauggugguuaucagcggccagaacacagugaccccuaaagccacaggcaccagcccagcuaguuagaagagcagcauugucugucaucacaccagugguccaugguugaacccuggggacaggaagccaggccggaaguggggggaugaugacuucaauggcuucaccuaccugaccggauucacugaagucucuaaaagauuuaaagucuacacuggggugauuucuucucccaggguuguuagcauguauuacuuaccucacagagccugacaggauaucuucccaaguuaccagguagggaauuagagacacuauuuuguaguuguauguuuaguccauuuaagagcagcggggcagcgugagauggugcuguggaggccgaggcaggaggucagaagugaaugcccaggccuguaugccccugacugcuggacucccagagccccacugcagucagcuaucacuaggagcaugcaugcucuauagcaugggaauuuggagacagcuuuucacuuggaaaaacuucaagaaacauuuagagaacuuuguuaacauguagccccggcaccccccaguaugucuugucaacaugcgcuuucaauguguggguuguuuuauccaugccccaccuuagcuuauucuuaaaaaugguuuuauugauucuuugagaccuccauacaguguuuugaucuuauuccuucccccucccccaccucccuacacucacccaauuucauguucucuuuauaacucauacaaguauucacaagaugaucaggaaacaaggcuggggcagggggagcaaccacgggagcauuugccaugagguuguaucaucugcauagaacagggaagcugcauccgagaagucucaguauggucgccuaaacaagaucugagcaaggacaacccugccugacgugcgggugugcacggggggggggcacucucacgagaugccaccccgcauuagcacugcagugugugcuuucugagagugugaauauccucucauaccuacaugucaccacauguaacagucauaaucagcaaauggauaguguccccaugcugucuuagaacugcagaccuaaacuucuucucuauccugaaaugucccuagacauuggaggagggaaacccggccuaaacucaugcauugcauuaaggaacacucuggccugguaacuccucugucuuuggagaggcgacauuugugcaggauucagguaguuugagucuaaagacucccuguauuucuuuuaccuggugcuugcaugggucgaggguuagguuuuaugcucccguaggaacggugcagaggcaagcugucuuugguuccuuccaccgagaggugugcgguggcugccgcugacaguguagagccaagguggcgucuucaguguagaaguauucguuuucuccagaauggacuccagagcuuaagacagaggagaugaagccgcacuagggagaggcugugccuucugaaagauuuuccugauuguuaugcccaggcgcuguaccaagccuucuaaaccuuggugucuacucugcagugugguacccaucuggaagacuuaggaggauggcaggggcucuucggggagcuguucagggagucaguggguccagagagaagcucagagggacugguuguuggaaggucauggagaaagcaggcaguuugcguuuagcugagugcugaagggucauucauaucuugcagccuauguuugaagccucuucgucuucgugucagggaugcgucaauguucgacaaccccauuucacacucaucucccauagcugucaucagggccgucuccauggcucagcugccgcucuuauacccauaccugggccaggugacaucaagugcaugucacauaguccucagcaccugugggcacuaauuaugaaagauguccacuuguggguauuuuggccaugggcuagguugcugggaaaggccugucagcccuuuaggguagcuguugaggggauguccuccaagugcccagccuaaagcuaagaccccugcagaugggacagugagugaguggaaacccuuugucugaucacaagaaacaccuuuugguuuacacugcuuccuucccccuuggucugggacaugugcaggcaugaguugauuggaguguacacagacaacaggagaacccagcaucagauaaaguggagcuaaaacggggguccacacagaucagcuuugauaaaacacaaguuucacuaaagcaauaugcacaggagcauuuguauacuuuaaacuugaagccuguccgucucgcuuuccuaagaaagggagcccacuaugcuaucugacuccgugcuuuuagaaaugacggugguuccuauaaaucaccaacaagggagaggccgaaauuauagcuugcuuggaugaaaccaaccagagauguguggccucgggccauguucuccagaggcccucauuaauugaaagcuggaguuuaauaagauaaguugcuuucuuaaacuguugccauuaaaggcaugaauaucaauguaaaaucacacuagaucugacucacggaaggauggggucucuucacaugguagucgcaggucccucuuguagcaaacgcagucacuaggagguaaggugaacuguuaucugcucuugucugugacacaauugugugucgcaguuggagggagcgguugggcauuuugguuuuaggcuuuguucauaucugaacugaaccacacaugccaccucuguuuagugacuggagguggcgagugcuucgguuucuccccugaggcaagcggaaagagcuguguuauucacuccauagcauugagcugcuuuucugaaugaggguucccuguagcuacugagggagggcagcuuggcucgucagcaagugcaccccauccagagccacggggucuacucuagugucggaugcugaacccugcgugcucgagaaucugggugccauuaucaccccguucucugucacguugaguggugccaggaacccuguccaccuggcugccuuuacaugcuucggacaugcuuuugaagcaagugcguuggacccuacaggcgcaggcugcaucugucuggguguaggcaaauaugagaggagacugaagcacugggguguguucgaauggcuggcgggguguugggcuagacauccuuguguugaucuacaccacacaccacgugugagggugcuguggggccuggcaggugcuacaccugcagggcuacccggccguugugggauagggagccgugaacgugcaaccaagaggaggugcaggugcccggaggggaacuucaggcagguucucaggguaauuuuuuuuuuuuuuaaaucucuggaggaggaaaugaagaugcaaagaaaggacgguuuggcccuucugcagacacauaaaaauaauaaggugauugcaucaucccuugccuagacuucaccucgcugaaccaaagcaggagguuuuaguugugguuaaaguguguuacaucccacuuagcauuucagaacagcauguuccugcccugaguugaguauuuugucccucguagcucucacaggagacauacuaccaaucuugaacccuguuuggcuggcuguagagcaggacccgcuucugguucugaggccagccuggcaggauccccaccaagcagaacugugugucacaccuccaggguggguggagagauagccucccgcugugagugagauugugaagugguuucugugucccuauaaaaggccuccacuuuuaacaguuacugcuauacgacgcagaggagauaggauacacguuugguccuugagaauauuugcagucuguacauaacugucaagccagcguggccaugguagaucugugacgaccgcucagcuugcuugcugugcugggggguuguggggggagcacauuuguuccucugauguucagaggcauuacgucauaccgguagggugccucuugugcacugucuccagccgucucgugaucgcuaagcuaugagacccaggcuguuuagaugcacauguucucuuuguggcaaaugggaagugaaugcagucccugggcagccguugccuggccucgaggcagccgugggcauugaaccagcauggaaaucucaguaaauucucugucugaggguggagagaggggaaaggccucauggcugcuauacucaacauuguuuagacggcuggguuaggaucccauagaggcgugguauagcuguguuguggguaccccucagccuccuggauggcucacucaguggugaggauggaggccggugcaccauccaggaggacguuggcauugccuucucaggagucagcaccuacagcagagacugccagaguccuuccuggucucacaguccaaaauucaguuuccuaugauuacuugccuuacaugcaaaccuguuagaaguuuaagacucuucagugugggcauuguauguaaaacacccauccaacggagggugugccuauucucggacgcuuuugucucuaagaacuugggauaggauacugucagucuauaaaaaggacuuauuuauucaucuuuuauuuauguguaugugcgcaucaugugugugcagguuguucucaggacagagggcaguggagccccuaaaacuagauguacaggcaguuaugagccaucugagggugcaaagaacccagguacacaagaagagcaguauaugcucacagccguugagcugucuuuccagcccaacaccaccauuuuugccccacuaccuugacugccaggaaacaggacuugagguuauguugccacaggucucaccucugggucuucuugaugugauuugaaaucucucucaaccuuuaccuuuaguugugaugugguuguuacuccaagccccccucgcuggggucagcucucugcauagugcugugucgcgugcgagcucuacacaggagguuggcauuugcgcucuacuguagcagaaucugagcugcauugcugagcuuacucgcagggucuggucucgcaucccacuccacagauccagucuggaauucccagccucaaucguugagaggcagcgcuguguggacuccagagucgccucuguccacaaucauugcucuccauucugggaauuugagugugagguccuaggugucacaugccuucuaggugugaguuggauccagcuuaccuguccuggcccugccaccucuuguccugacaccuccagccauuuguagucuggggcaaccacacgggcccugugggguugcuuuaaaggcuuaaaagccugaaauuuauuuuucagcuggcaguggcagugggugacucuuagacacacaguccuaagggcacuagaacaucuuuucagggggcugcuugucucugaugccuuaaaaaaaaaaaaaaacccuucccacaacugcaucaggauaauagaucgcccaaguaucuuuaugacuuaguaguuaaugucuccgcagcucuacggaccucaagucgaacaucagucucggcagcaauggugucuucacauucccccucuuugacuuauuuaugcugugccucucaguguuuauagucacaccuuaaccccgccccagccagugaguucaucuuagccaccuugguggagguccugccccguagacagccauaccugagaauuuggaggacucuguggcccauguagagggguugccaggagggagaccuuauuguacuuucuuuucugcuucaagagguuuuaaucaggaggagcggucugucuuguaccaggcagcauaggugugguacugagcuguaccccaguccgcagaugccucugggagugccugcgugugaguuacugaugcagacacgcuggacacaggccaaaagauggcucugccaagagcugagggcccagggaaaagaagcugaugcccucacucuugcuguguuuucuguuguugucucucuaguucuacauaagcugugagggaccuugcagcacauagaugucuuuuccccugaacagugacauuuaacugaugacacccaccccgcccccacugcagaugauggucauuuugaggcuugacauguccuggcccaagcacccaggggccuguacuuccuccagccugccagccugucaccaggugugugugugugugugugugugugugugcgcgcgcgugcgcgcgugcuugcucacuggugguugugggacgcuuggcaugauccuuucaacucuccugcuccuuaaaucaaagguuaagguuaacugaaggcuaagcucagccuuggguucccuuguaggugucaaggagcacucucucccucacacccugauccugagcauuaagcccuggcuuccuggcuuuauucugcuucagcuuucaacucuccugccacaccacacugcuggcaccacagcacacagcagcaccacacaccacagcacacggcagcaccacaccgcuggcaccacagcacaugcaccacacugcugacaccacagcacacggcagcaaacaccaggcucagaaugaggugcaccugcagcagccucauugccgaaucugauguaagguagaaccaccccuccuccagcuguuuucuguugugugggccacaugugcugggccagaggagcagcuccagccaccgugccagcugucaagggauuucuggacuggcacugugcucugaaucaguacuaauggcuuccuccauugaauguuguccaaaagcaauuguuugcuuguuagaggcucgugccgugcugucacaccagcccgagagggcggcacuucccccaacucucacccccaccccugcuccaaggacugggccuucccuuugccaaaauuuccugcauucccaugucaguugccgccuuuguacaugucuucucguuaaccuugacugcagucaccaugguccaccugucaaccucaaaugguuagccagucacugucuccccaguuguugcuagaauuugaagcuuaucaaguguaagcaguugaggccccucacuugggugacccauucuggguguguugacugucaccacccagucagccccagugccugguuaugcagagggcugcggugacauaggucgguuacaagucuucccaccuuggauugaugguuuagucagucguagcacaugcuuucuuuguuuuagugaauugugguucuauuuugaauaagccucuuucggccuauuaauauucguccucaccaaaaugaacuuuccccagaguuagucucacacaaaaggggcaaaguaauuuugaaaguuaaaucaaaacaaagcaaucuuguguguguggagccgauaaaaucgcagccuguggucaugggagcaccuccacaggaaucgcugacauaaggcugauuuccucccaucuuguuauggaaggagaaggggaaaugcccuggccccuugagcuuaagagcuguguaaacaguggggugaggagagcuccccucacagcuggugucugcggggaccuauggagucugagaaggaacagacagucccagucugauucauggucauucccagacaguccuugggaaccuuucccaccaaaaugaaaggggggggggggugucggaggcugggauagccacacagccagguccuguuuguggguuagucauuuaggaaacaacuagggccugcuucagccuugacuuugaaccagguuguggccgauggcauugaggcaaauguauuccuuugccuuucguuguccaaugagaugagugagaaccagaugugagcacucuggaacucucugaagggcgcucugaagucuucacaugaacccgagguuucguucuaaacagucuucagauuguaaccaaccuacacacgucacaacuaaugacuccuucuuaacugcccuuuccuuccugggccugaugugggagggugggguugacucagacccugucuuccacagugggcagccccucugggaucauuguuuauccuuugcagccagaggcacaucccuuccacuuuauuuaguuucuuuggggcacauuacccccaaaucacugcuucgucaagucaaucacaguggccagacuccaccucugagagaguccuaaccugucuaaauaucagugaacguggcuggcaguacagaaacccaaguucauucuuuucuuuuccucugcucccucccacacccucagucacgucuccugagacaccaaucaucagugaccuggcguggcuccuguccaguacccaugugaagguucacaguuccgggauagcuuuggaauaguuuggucuucuguucgcucuguuuccccagugauggagaguucacucgguacacuuguacuccaugaugucacauccuuccccccuggaauuugagucucccugcaauucagaugggcuaugucucuugccuugcauacgcgccuucuccagauuacgagagaguugcuaagaacucugcuucuguuguugcagguguuugcaaaugauuaccgcgaggcugaagaccacccucaaaugguuaucuuacaacuguuacgcuuuaucuuccgucugguauggagaaggcauugacaggaucuacaugcagccaggauacguggcggacauggcucuuguucagacugggagaacccccacgcgucaugucccucucuuggugcugcgacaguguguccagugguucuaucccagagagaugugcugagcauggacagcgcucugcacugugucgaugugaacggaaccucuguucaucaccacauggccgaguuuucaguaaauauuuguugugaauguaaacaagggagggcuuuucucuuuuuaauguacagauccuaggaacagagaaauaugcaagagagguguuuacauguggcguguuaauuuuuuuaaacccacuuucuuugauaacuguuuuugggguuuuuuuuuuuugucucauuuucuuucagaaaguaaagcuuuuuagccaauuuauggaugauuuuuauacucaaauucuuaacccacuaccuacucagaggauuccauaacccugcagugggaacugagccagcugauuuauaaggcugccuuaguuuauuuuuagaaauuacuguacagaauuuuuuaaacaggaagaguaugguguugcccucucuccucugccauggccucuuugaguuuccuuuugaguuauuacuaccaaaacaguucuuaggaaauggaaugaguucgagcggcagagguucuguucugguacgccacuuccacuuuguaaauauuuaccuccuuagcucaguugcuccuguagcagaaauucacacuuuuccugcuucccucaacuccucagaccccucggucugucuccacacggaugcgcagcuucagcccaggguaucuucaaguguauugugucagcaagggcuaggggcugcccggauugugcccagcuccaucaaucaagcugacucacgggaagggcucucgugcgcuucacugcacugcgguggcuguguuugccucuuuuauccugagaggacgugggcucacacaccgcuugcugaagccgcuagcuccacugguugcuggcuuugcugccgccacaggcucugcuuugcuguguguaucaggugagcuggagcccacgcuuucucggggacuggccaggucauuucaggagcaaggagcucaggugauccuuuuccaugcuucuugggauguagcccugcucaccccaccuggccugugauuccugaauuucaucucuauucccuugaguuaggggcuggcucuacuuccaucaguucccagacauaggaagcuuccauuaugccgaguaaagcacuugucuuccacaagaugucugccugcuuugcucucuccauuuucuuaauacuuggaucuuguugggcuuacuugugucuggggugggggugaggugcucuuucuuggucccugccccuuaggaccacagcccagacauuuggucaguuauuucaagaccaggcaggacuggaagugcacagccugguggaggagcacuuucuaaccuguggagagcuguggcccagcuccagcuccucccaaaacaaacggcacacguguaggcagacagccaggggagauacaaaaaaggaccaagaggaaagagcaugggaggaguggggauggcaagcccucucacuucugagaacuucagacgucaggcagcuugcucaggaagcuuuaugaguuuccucgcaagucagcagugccaacgacuguuugcuuuuggccuguagaaagccagugguuuuucuuauguuaugaaguagagaaauccguuuguucauacuuuccucugugugugugugcaugugugugugugugugcauaugcgugguuguguguguuuauauguauauguauauuaccuauaagcuuccuucuagauugagaucaucugauuccaaauauccuuauacauuucccagcuucguuagauuuggugugguuugaaagcuguuuuggcauucuccuccuuuccugauguauugagccugcucaugguucccaugaggcccugugguuauuauaaguugguguuaaaacugcaaccauggcucucacacacacacacacacacacacacacacaccaaagacauacuugguccugggccaugccccccuccuaggaccuccauucucaugugccagucuccccgacuggagcacuuuacugucucagccccauggcucuguggcagugccugagcaggugcagaagcuccagagccaggucccagugacauguguggcccccaacgcaugcuuaccuccagccuggggcuggccgcugaagcagcucauagggaaauaagagauucuaugaauuguagaaguauucaagaacaggaugcggcacccagaacguaaacaugacuggaugucccuguacuguaucuguuuguuagagugcaaacgucgccugcagacagacagugccccugcuuacuguggguaggccuuuguacuuaaauauauucucucucguuuuugguaggacagaaacuagaucucccucccccucguguguguguguguguguguguguguguguguguguguguguguguguguaaacauaaugcggguuuugugccuugacaaccuccccaugugagguuuguaaauaguguccugugacuucaccucaaguuguaauaaacauacaaaaugguguccugagugauucuucaaauuucuuuuccagaaaagaauugaugaauugggggaaggggcaggggucugaaaaaucaguuuaaagucucucuauuaaaguauguaauggguaaugucugcuucuccuauuuccuuccaguguuguauauauuuugacuauuuauuagauuagaaagucauguuucacucgucaacugagccaaaugucucugugcaauuguguucccuuuaccuuucuuuguaaaauauuguacagcauaaaugaguaaaaaaaaaaaaaucacuguuuuuccaaacuucucauaauuaaggauuuguaaauaccauagguucuucuucuguguaaugugcccuacuguuucauaaugcuguaacuuguagagauguuguauauuuauuuuccgcuuauuuaaaugucuuaaguucuugaaaguguugacaucccuaucccugacagcccugccaugccaugaauugcuucagcuccugauaaaggagggguaguggcugguucucuucccacaaggcggcuucugcuuuggcuucuggcauucagugcuuggguucugccgccuuucugaugaaaugaguguuuugcugccggugagauacccuaagaugcuagccuggaagauuggacucuaagaaaauacccaucaaacccauuuuugaagcagcuggcuucugagaaaaaucagacucaccaguaaguuggccacaucuuuagagaaguauuagcagcagauggggaagaauuuuuuuuuccuuaaauugaaagaguaucuuugacaacucaguguugagagaaauauuauccugcugccucuugagguacugcugaauggcuguccuggguaagagaagggcuggugggaccuguuucuagagcauuugccaaggccacuugugucaccaggacacucgcuggcuaccguccccaccugcugugugcuuccuaguuugaggucuguggacugaacuuaccuauaccauucggcucccuucccguucacugcuuuaggccagcccacuccugcuucccucuacagagguucuggcacccacgucaagauggcucacugaagcucuagagccaugugacuucauggaaaugguuuugucuuccugcugauucagccuggugccuguguguguccauccgcucagcacgucugcaugcggguccuguccacacgugucgcuaaaucggcggggaauugccucucaaacagcguugcacaaagcacccucaaguucccagcaaaguacuugaucucuuucaaauguguguuauugucuagguucugugaccacugguuucuguacccagaccugucagguauccuuuagugaacagcacugaucucuguauaguccccaucacuaaugucagaacccagcguauguagcauuuguauugcaguuucccuggcuuccuuuacguuuugcacugaugaauuuugacaggguaauugccacuguaccugugcaauacugcuguaaauaacugcagauuuuuuuaagaaacucaaucuuuuauguucuuaaugaauuuuauauaaauaaaacuugcgacuagcuuuca

SEQ ID NO: 12072 - RNA, 1138 nt, Mus musculus
aacuucuuguucucuucccacacucuguucucagccuccuccgcuccccuccgccuguucucaggaucaugaaggucgccaguggcagugccgcagccgcugcaggcccuagcuguucgcugaaggcgggcaggacagcgggcgaggugguacuuggucugucggagcaaagcguggccaucucgcgcugcgcugggacgcgccugcccgccuugcuggacgagcagcaggugaacguccugcucuacgacaugaacggcugcuacucacgccucaaggagcuggugcccacccugccccagaaccgcaaagugagcaagguggagauccugcagcauguaaucgacuacaucagggaccugcagcuggagcugaacucggagucugaagucgggaccaccggaggccggggacugccuguccgcgccccgcucagcacccugaacggcgagaucagugccuuggcggccgaggugagguccgaggcagaguauuacauuauucuucagugggaaaccgaggccacgggaggcgggugucccccuuccuuacuuuucaggcgcauagcuauuuaggggcgacuaauaggaaaaagcucgcauuuucaucgugccuccuggaguagagaaaugggaacgccucuccccuccuuguccuuuccagugggucucaucccuuaucucgcucugguguucacaggcggcauguguuccagccgacgaucgcaucuugugucgcugaggcggcgcacugagggaccagauggacuccagcccuucaggaggcaagaggaaaaaagugcucucgguuccccaggggaucucugggaaagacacuaccgcagccaccggacucuuggcggaucgguccaguggguagaggguuugaucaacagagccucacccucuccaccuuucagccuccagagacuuuggggaggggguuaaucaaccccgcguguuucuguuuuauugaaaaagcagacauuuuuuuuuaaauggucacauuucgugcuucucggauuucugaggaaauauuuuguauuguauauuacaaugaucacuggcugaaaauauuguuuuacaauaguucuaugggggugaguuuuuuguuguuauuaaacaaacacuuuagauaa

SEQ ID NO: 12073 - RNA, 1138 nt, Mus musculus
uuaucuaaaguguuuguuuaauaacaacaaaaaacucacccccauagaacuauuguaaaacaauauuuucagccagugaucauuguaauauacaauacaaaauauuuccucagaaauccgagaagcacgaaaugugaccauuuaaaaaaaaaugucugcuuuuucaauaaaacagaaacacgcgggguugauuaacccccuccccaaagucucuggaggcugaaagguggagagggugaggcucuguugaucaaacccucuacccacuggaccgauccgccaagaguccgguggcugcgguagugucuuucccagagauccccuggggaaccgagagcacuuuuuuccucuugccuccugaagggcuggaguccaucuggucccucagugcgccgccucagcgacacaagaugcgaucgucggcuggaacacaugccgccugugaacaccagagcgagauaagggaugagacccacuggaaaggacaaggaggggagaggcguucccauuucucuacuccaggaggcacgaugaaaaugcgagcuuuuuccuauuagucgccccuaaauagcuaugcgccugaaaaguaaggaagggggacacccgccucccguggccucgguuucccacugaagaauaauguaauacucugccucggaccucaccucggccgccaaggcacugaucucgccguucagggugcugagcggggcgcggacaggcaguccccggccuccgguggucccgacuucagacuccgaguucagcuccagcugcaggucccugauguagucgauuacaugcugcaggaucuccaccuugcucacuuugcgguucuggggcagggugggcaccagcuccuugaggcgugaguagcagccguucaugucguagagcaggacguucaccugcugcucguccagcaaggcgggcaggcgcgucccagcgcagcgcgagauggccacgcuuugcuccgacagaccaaguaccaccucgcccgcuguccugcccgccuucagcgaacagcuagggccugcagcggcugcggcacugccacuggcgaccuucaugauccugagaacaggcggaggggagcggaggaggcugagaacagagugugggaagagaacaagaaguu

SEQ ID NO: 12074 - RNA, 75081 nt, Mus musculus
gggguggggacugcgcgggcggccgcgggcggagcgcggagaggcgcggaggagcgcggcaggccgagcgccgggagcgagguggcucagacauggaccgcggcgagcaagguagguggugacuggcuccugguggccgugcggagccucggagccgcgucugggucaucccgacccgguccgguucgguggccgagcccccggagccucuuacgagcgcggagagggaggaggggccgcgccgugggagccggagugugagcgaguguguucaggcgugcccgagcgagugugcgcgaucgcgugcgagggugcggggaggaguaggguggcgagaggccacagagguguuaggaugcgcgcagcgagggccaccccggcagcgcgcuggccucgggggucaccggcagauccuggaagugauggcguucagaugggaccauggcuugugaagacuuccugcucgccaguuggaauuguugguggccuuugagcccguagccacaguguuuggguguagauauuugcaguaagaggaguccccaaacuaaugaguguagagugcagccuguggguuugguugggggaagggagcuuucacuaucugggucuuaguuuccagccaggugaaucacacagcagggaaccuuugguuuccggcaccaagcuguuccuuuuacuuccuaagauggcuagucaagugaaauugcccggaauagaaucuacggagauguggccagaagcaggugaugguuuucaauugaaauauugccuacguggaagagcucugcuaugaaacugguauggguggcaggcuugaaaggguauagaaugcuaaggaaaauacuaaguauuuuggaagugguuuuagggaucauuccugaugcaagccccuguagaaauccuuauuuucugcuuauuugcuuccgguguuugcaccugguaugaguaucaauaaugaguuuuugaaaauguaaauaaaaccguauuucacaaguaccguguguauuuuaccuaugauuaauuuguaagguagauuuuuuuuaaaccuaguaaucucuccuuucuuuuuucccucaagauaauuucacguucacucuaugugcuuauaauauagccuugcugcuacucgugaaccuacgcaugcugucuagacuuuuggcuucuggggucgcacuucgaguugccucuuugagccugugugguuggcugaguuacuucuucguaggucagugaguaaguuuguaucggaaaaccugggaccauucccucugacuuuccaugugggcugugucaggguauauacgugugugucuguuuugugugcuguguaugacuguuuuugccauguuuaauauacugaugguuuucagucacagcuugcuacuuucaaguaugcugaagugcuguuugguuccaugucugugugauuguucuaaugaacugugcguuucagcccagcagcugucuccgccuuccaacaggcuaauguacucugugugguuuuaugggacuuguuuuuuuuuuuaaguuuuuaauccuaggacuuguaaagugagucuuugcaggcuucacuuugguguuuucugugugaugugcucacuugccaugguaccacagcugucagcugugcacccuguccccaccgggaagagugcagggucccuggguccuccggagaaggccugcugccauauucuugcuggauuucuuaguaccuugugacagguggccuaccuguaucuuaucacaguccccagggaacuggguagggacucggcagagcugaaaaguguuuguguagcuucugccagcugcugaccucugucugcuugguuccuacuuccuuuuuuccuggcaucuggcuguguugggcgguacaagugacuuuaucuguaauuaccuguaaagggccuuugaauugguagugcaagcgcuuugacauuuaaugggucuguggugggacuccuugcuucuugugaaggagugggagggacagggacaggugcaguuuuaaaccagcaaacuguguuggcugggauagaguguagcaaaccgagauugugucuuuaauugcaaggacuuuuuguuguucuaucugucuguuuaucuauguaucuaucuaucuaucgugauugugucuuuaauuuugaggacuuuuuguuguucugucugucuagcuaucaucuaucuguuuauauauuugcagaacuauauuuuaauuuauaucagaaacugucuugauuuauauuuauaugcuuggaguuuaacccuugucccuuauaacgucaccaauagcugugacaauaaauguccucuuucuugucuuacaugaacuuccuugaaaaggucuuacauuuucuuguuuguuggugccccaaaucuacuuuuugcugcugauuuucuuagcagaccuuuaaacuuaaagaugaacaguguuguguucuuugauacuuuguaguauguggcccgaauucuacuguuuucuuuuucuacuuucuguuuagacucugggcccugugcaucccuucuguuggugcacagcgccuuucaggcguuuucaggcacuaacgggcacaggagacuccaugugugugguguuucccauguugccacuugcuaacuggagcgugccugugugaagacaaagccuuccugucuccuuuuaugggcugaauacauauuuguaagcaaggacucccuaugucauuaagaacccagcacuguaauaugucagcagcaguuacccaccggcucagcauguuguuugcuuaaacagaauaauaauuuaaagggaaagagggaaggcugccagggccagaaaccugaaagagaaccguguguggggaaagaacaauagagugauguguugcuacuauuugacugguuagccuuagaguuaggauagaucugggaugcccuuuauuuaaacuugaagcaggcguagagcagagaaggauggauacuucaaaaggucugggcccuagacccugggaguggccugccugaguuaguaaccucucugucaucugcucaguacuccugcuucccuacuggguggauaucuguuacucauccucuccuuccugccuuuuuuuuuuuuuuuuuuuuuuuuuugacaaccugccuggucccuaagggaaaagccaguagugaaaguggcuguggucucuuagcagauucuuaaaacagaagaaccuauguguauaguaaaaacacauuagacacucacaguucagagcagaacagagcaaggugugugccacggagcccuuucuagcaggcuaaguucauuuucuacccucuugagguuaguuuacuguuuuaaugguugacucuuguaaacucucuuuugagacucucccaaacauuauuuaaacugguuggguaccaguugugcagagaccauaguuuuuacaucuuuacauuguuucuuuuuaaauuaaaaaaagaaaucaaaggauuuauugguuguuugauugauuuagauagggcuuugcuauguagcccaggcuagccuagaacuugcagucuuucugacuguguucugaggucauagguguaggucaucaugucuguugaaggggguacuuaagauguuaauacaaacugaaaaaagauuaagaucuaaaaauacauuuucugcuacuaaaauaguuguuuauuuuagaagaauugaaaaugugguagaagaaaaagaaaauaaaacuacuuuuaauaccauucugacaauucauaguaugcuuguuuguguaucuaccccuuuaaacuggcaagucauaaagccagagcauugagcauaugugaaaguaucuuuuauucaccuauguaauugucucguaggcuuucugccuuagucgcuaaccugggccuaguccuggaagcuucuagccuccauacagucuugucuaaaguguuuucagccacugagacuuauuguggacuagguaggugcaucccuuccuaguucuuucugagcucugacugcugaucugacucagcuguucugucucauacuccucuuuacggugagugauuuaaucuggcuucccugcuggccucugacugaauaacucugcuuggccucauacuaacgcuagcaaucuuuucuaaucuucuggcuccgucucauucucucauucucauucuaucuuccuucaccugugucucugcaaccugccuuuguacaacugucccagugaaccugccucuccuuucccuucucugcacucucucuuuuuuuuuuucucucucucucucucucuuuuuuuuuuuuuuugguuuuucgagacaggguuucucuguauagcccuggcuguccuggaacucacuuuguagaccaggcuggccucgaacucagaaaucugccugccucugccucccgagugcugggauuaaaggcgugcaccaccacgcccagcugcccugcucucuuaaguagccucucuuuucucuuuguucucaugagaguugggcguagucuauucugucaacucuuucucugauucgucacuuugucugccauucaauuagacguggcuuccaaacgugggugcuuucuucuacaaacuaacuuuaccucuauuguuugggauuaaaaguguguacuaagggugugucuguauuccaggcagagggauuaaaggcacgucauaaggcugagucacaccccacaacuagaaacagguuuuuuaaguaacuaacauaaucucaggguucauggugcaacagcauccuauuuuacaacuagcccuuuaaaaacaaacucuguauuuuaaccaagcuguggguccaguuuggcauaucggccucucaguaguuugaggcaggaggaucucaaguucaaggccugccuggaccacuugugugaguucaaagccagucuaucuuaaaguaaaaaguaaaaaccaggcaaaguaggcuagcucagcgccgguuacucuuccuaaccuggcaaggcugcggauuuauucucuaguacugccaaucaaaagaaacccucggccuuggccucggcugagagcaccacacggccgauguccuuuucugauaggaaagugcauccacucuuuuuggauguuucaaauuuagauuucauuuucagcaaaacguuuagcgauaaucauggcuggcuuuccuguuguguuuucugcauuccccgccuugaucuguaaagcccugccgccuucugucugcuaggugagaggccgguugccuucccuacauuccaaguaggaauacuaaccaacgacccuuuucauuuauagcuucuagcuuaugaaucauuccuagaaaugccuucucacucugacuucacauuuuauggcuuuauuuuuuacauuuaagucugccauccaucuggaguuuauuuuaacuagaggugugaaguaagacucugaaaaccucggcuggguggugguggcgcacuccuuuaaucccagcacuggagaggaagggggcagacagaucucuggguuugaggucagccuggccugcagagaaaguucuaggacagccagggcuacauagaggaaaccuguuuccaaaagccagaggaagaggacaauauauauauaucuucuucaaauucugccuuccccucagauauaugugacacccauuagcaauaucgcuagccagccuuuuaaguuuuggaaaagccuguguauuguuuucugaagugaccgcacccgugcugcccagggcuguggucucuccacauguccccagcaccugcucuuuuccugugguucucaggguuaguggugcuggcugcaccugacuauagcuuggauuugcaucucugguggugaggaauggucugcaucuuugcauauuguuucucagagaaauguuuacugaagcccugugccuguuguuguuguugacuugaagaguucuuuauauauuauagauacuggucuucuauugucaugguuugucaguauauuuuccuguuauauaacuuggcuuuuuacuuccuuaauuguuuguuccccucuuuuguugauucccugccuuaaaaauaauaaaacuuaagguugaaaaaugucauuuuuauguuucacaugucuguuuccuaggagguauggaugacuuagcuauuugugauuccuuuugagaugguuuuaagcgccucacuuuucauaauaaaucucgcaccucccaucgccuuuccccuucccuuacaccucaccuuuguucucuguggcucaaagcauuuuacacauguacacauuccuucguucccaccaaaccaucaucucccccuaauucuuagccguuuauuuuguucauguuuuucuuaccauuuaggcuauguuguauuaaaaaaaaaagauuuauuuuauguauaugaaugaguacacuguagcucucuucagacacaucagagggcaucggaucccauuacagauggcugugagccaccaugugguugcugggaauugaacucuggaccuccggaagagcagucagugcucuuaacugcugagccaucuggagagccccuauguuguacuuuuuuuuuuuucccgagacaggguuucucuguguaguccugucuguucugaacucgcucuguagaccagguggccuugaacucagaaauccacuaccucugcuucacaggugcugggauuaaaggcgugugccaccacugccuggcuuauguuguacuuuuaaaugcuaacuuaacuaacaaaauauaguauuaagaguaaauaccugaggaauaccgaauggcugagaagcaccugaaaaaauguucaacauccuuaaucaucagggaaaugcaaaucaaaccaacccugagauucuacgucacacuaguccgaauggcuaagauugaaaauucaggugacagcagaugcuggcgaggauguggagaaagaggaacacuccuccauuguugguggguuugcaagcuuguacaaccacucuggaaaucagucuggcgguuccucagaaaauuggauguaguacuacuggaggaacccuuaauaccucuccugggcauauauccagaagauguuccaacugguaauaaggacacaugcuucacuauguucauagcagccuuauuuauaauagccaggagcuggaaagaacccaguuguuccucaacagaggaauggauacaaaaaaugguacauuuacacaauggaguacuacucagcuauuaaaaacaaugaauuuaugaaauuuugggcaaauggauggaucuggaggguaccauucuuagugagguaacccaaucacaaaagaagucauuagauaugcacucacugauaaauggauauuagcccagaaacuuagaauacccaagauacaauuugcuaaacacaggaaaaucaagaaggaggaagaccaacguguggauacuucauuccuccuuagaauagggaacaaaauacccaugaaaggaguuacagagacaaaguuuggagcuaagaagaaaggaugaaccauccagagacugccucacccggggaucccauaaucagccaccaaacccagacacuauugcauaugccagcaagauuuugcugaagggacccugauauagcugucucauaugaggcuaugccagugccugguaaauacagaaguggaugcucacagucaucuaugggaugaaauacagggcccccaauggagaagcuagagaaaguacccaaggagcugaaggggucugcaacccuauagguggaacaacaauaugaacuaaccaguaccccccagagcuugugucuagcugcauauguagcagaagauggccuagucggccauuaguggaaagagagaccuauuggucgugcaaacuuuaucugccucaguacaggggaacgccagggccaagaagugggagugggaggguaguggagcagggcuguggggaggguguauagggaacuuucggaauagcauuugaaauguaaauaaagaaaauaucuaauaaaaaaaagaguaaaugucaccuuuaggugacauuuuggagacacugagcugucucugaguugcuuuugauacuuauuucuuggauuuugugucuucugaauuuaaaggcuuugguagucagugcuaaaaacagugcuuuccgcuauuuauuuauauaccuuaacucacgaacacucauggucgagaaaaauggaaauuaaguuuuaaaaauugccuguaugaaguuuuggacuggaaacucaauggguuaugugaucccugcugcauccucaggcuguuggagucagugugggugggcacggaggguguggcucugucugucagcaggcccgggacaggauugaaugugguuuguccagccugccagggucucugggaugcggcuccauggucgguguggguguuucuaggaggcagacuagaagcacaucacagaguacuggcuggagagacuucagcauggauggagucagacgggaguaaaggauuagggagagaaacuggcucggcagcgagacaggaauauauguucaaauaugcuucuagcuuuauauaaaucaccgaaaaauguguuucguaaauagaagaaaacugguucuuuccuucucaguguguuuguaaaaaugccaugucuacauaaaauggauagugaugcuuaagcuuguauugggcaaagguuguuagacauagugccuugucauuuaacaaaccagguccugucaguguuacuaaugucugcagagcuuagagugcguggauggccuuguuuguuuauuacaucccaggcuguccuggaucugaguguugcccagaaacaccuggaguaccuguuccucuggccugucuuuuaaucugcuaggauuacaggugugugacacugaccuucauuuaugcagugcuggagcucaaauccagagccuccugugugcugcacaaauguucuacccacugcgccacagcuccagaccccucaauacauguuagaguaguuccuuugaauguugcugugaaggacauagcgcucuggugaccaugccuagcugggauuuuuccauuuacuauuuucagaucaugguuguccgugaacuccuaaagccguggauaacgaacccacaccuagcagcggcuugcaugggacccccaguggcauugccuacaggagcgccaggcgucccgagguguucugcacguugcuuucucugugucucucagcccuaccaccauuuucaguuguuuaugggggcauaguugcaguggucacagcuucccaagaucuacuguccuggaugcggagagccguacaaaaaccauuacccuaauuaaaccuauuguuucuaagaaaauagcccuggguccaagaccaauuuacuauaugauugcugagcaggacgcugugcuuuuuagaaauguuuuccccacagcuaauuaaaacaaaauuggaauucagaggaacaaggugugagcccugcuucccaguugcaggcauuucuggaguccuuuagucugauagcauuuccggagugucugcugugcgccagccuucaguauaagugcguccaagcucaucuuuuuuuuuuuaagacucuugacaaguccugggagcaggugcuggugugaccccgcuuuacaggguaauuucucuagagcacagugcuuggcacagacagaucuggggucugggcuucugaucugugaugucaggcugaggcauacaagucauguccaacugaacaucaucuagaacuuauccggugucccuuuucccuuggagggcaguagcauaguuaccguggagcaugaaagguagcuaagaagugagagccugucucucucuguccuuggaaucagagcuaguuggaaauguuaagggcaaagaauguuggguaugaagucguaucuggguuccagguuucaugugacuuuuccugguucaccaucugacugacacugaugaugccccaggugguaccgcguuacggauacagaagccgagcguugggugagucuggagugcuugaacucagcggaucccaaugacuauccaacggcauggauuuagagacauuucuauagugugaccaccuacaggcuggcggauggauguauggccugagagacauggggugcagauauuguguaagcuauaucaccuugccagggaggaagccagccacucugggcugcgucuacacugagaccucaaaguagaccgugccauuugaacuuggcuggaaugcauuggagguuugcgugcucuaggguggggugguaucuggagaugaggacuuugggaggcaauuuagucauggaggcuaaacucauggguagaguugaugcaccuuucucucucccccuacccccucuguguguguguguguguguguguguguguguguguguguauguauguaugcacaugcacauggaggcuagaaguaaaguuccaauguuguuuuucaggugcuaagucuaccuugcuuuuagagacagggucucugacuggauugaauuucuucauauuggcuaggcugucugccaaugagcuccaaugauucccagguggcauuacacaacaccuuggcuggcuuuuuuuuuuuuuuuaaacaaucaaaacaccccaaaaacauagguucugaggauugaucucugucucccacaggaagauagaguaacaccaaucugugaaccggaaaucacugcuugcgcuugguucccagucugcugccacauccauuuugggcuuuagccaagagccuaagaagugaugucauugaagccguucuguggacuuugaagggcuugagcugacagaccaaguacggugggaagaagugauggagagaagggaggaaagaggaguuuguaaggaggacuuggagcgcaagcaggggacuuggcaagccucagaaauggccugggccugggguuuaaggugaccuugggaguauaaaugcagugucucgugagugagcaucaggaauuggauuaagaaauguugcucggcugaugcacaggaaguaugaaagccagauagggugagucacuuuguucuaggcccgaguugagaaugcuguagacauugagugugcuggguuccugggaggcgucagggagaguaaguccggugucuagagacucaggugggaaaaaaaagaaggguaaggguuucauauugcauguagaaagaacugugcuaguuggaaaacacagaaaggucuagacaccaggagggagaccaaggguacgagagcugagcugcucgcuuugaggucggcucccauuccaacacuguguaaccagcucacccuugcccaccugcugcucucagcugggcuggagaacggaugccucagguugggucucccagagccccggcucucagcugggcuggaggaccgaugccucaggaugggucucccagagcccuggcucuccagugggggaggggcggugcuagaagacuccaacugcuggguuccuuggaugccuguuucuguuggccaugucucucuugugugucuuacaagcuuccccagagcuccuuaggaggaguccugggagagaugggcuggcuggagcuauguggcuuuucauagccuugcuuuguaagucacaugauuuuacaucgugccuguaguuagaacugugucacugagcgcagcugggagagagaguagacuucagcuuuggaugggaagcaggucagugagugagcacuucuaucuuaagacgaccacaucuucaggugugacauccaugcagauguguucagagaaaggugggccaauugucaaaguucaggauaccugacaaugggcagaaugaugaccacagagaaacuaaagcaaaagcgagaagcaagccuggucugcgaaccuucccagugucaguugugagaucgguaggcuccgacaggaguggagauggcgguaggggaggugaacaggucgaagcuagccucucugacaagauugccagaauauucccugugaggcuucggagaauggggaggacggguagguacaggccgagucugugggaauggaggaagagagguagccaaacaaggaugcuccuuugggaagaguccagauguguucgaacagaaauuuuggauuacaugauagugcuuguccuguguuuagugauguuuuuaacuaucaaaguggagaggaugaaaaguguggcuuuugcaagugaguagaaaccagaggugaagggaauaacuagauuugcaguccagcagcugcagcugccucuaucuuagucagggugcuucucaugcaaugggcauuuucauggugguaucgcagagucugaccuucaguagcccaaguauauaggcgguaauuaauuuucaugugcauugcaaagcagagacauuuauuaaauauugguccugaggaaguaugauccauccccuggguauuccuauugucagagaagcaguuuaaccugguggugacaucugagcaaagguggagaugcugugaucuugcagauuuggacagugguugcugagcugagagaauuuguguucacagcaugggauggguugugccaagugcaaacuuaucagauacucuuguaagcucgcucgcucgcucgcuugcuugcuugcuugaucacuugcucagauccuuuccagaaaccaccuuuauucagcauccugacccagaguuggucauagcucgcugugaagccuccaugccccaauggccagaaauggaugguucugcccucugcuucagggguucaguaagauugaacaucuccauucggagcagagacagccggacgucucucuggauugagcagcuuuccuuugguucuguguuacagucuccuugcagaucuucuguagacaguggauuugagacgcugagauagucagcuagcauccacuuuuuaaacuugcuggacaacauguccccgugugcucuaagcacaugccuuuugaggcuucuugcucccugucuuucucccaauuuccuuuuucucuuccagaucuucuccacuugcaagagugacuuaugcauuuauuuaauaauaugcuuuaugugagguuuuuuuuuuuuuuuuuuucaagacaggguuucucuacauagccccagcuguccuggaacucacucuguagaccaggcuggccuugaacucagaaauccgccugccucugccuccugagugcugggauuaaaggcgugugccacuaugcccaacauuuuuuuuuuuuuuucaguaggaguaauaaaacauucccagaaaccugcuuuguuaacuuuguucauuuauuauuaauguccugguuauuucaaggcuaaauuuguugcauauauacauaugaugcuucuaaauauagacaaaacuuuugaaaggauugggaauuuaaaaauaucgcacucagggccaguagagaaacaaggaaccauuguggcuccuuucucuuccugacuuaaaggugucaugauuaagggaaaaccacuguuagacguuauauaaggaaguuuagauuuaucuuuccuaaagggauugcggaagccgugagucagugacuguaacccugucccuccuaggcugugggccccuguggaauugucauguccagcauggaugcucccugccuugcaguccgcccuguuauccccuccagucuugcugguucccuggaggcaccaggcucucauccuuguguuccccuuucccagauguuggcccacucagacacacuuuccuuucggcaguaacaguaucuguuugcuuucaguguuuagauguagccauucccccuucccacaacugucaguaccugcucuugaguucugaauagguggauaccccggaggcuucccugggggcgcagugcugugcgcgugcaguggugggagggggcucagacagugcacaggggacagcuuggacucuggagugucuggagaauuugaaguuuuuaauucuuuucagucaguacuguguagaacagaaagcauuuuuauuugcugaugaugcuaacuuuuaucaaaugcuuucaaaguccuaguuucugucccgugaucuuuuccgguuuacugguggccgaguuuaaaguuuacaggguguaaggaguucuccaacaucagaaaguaagacugcaguauuuuaucaccugcuauugaugucggaacccuuugucuaaaugggguugccaaaaugaaacugguuuacuuaaaaaacagcaauguguguucauguguucaagguguguaugugcacacguggaggcagaggccagccugagcucuugcugccucugcacuggccaucuggguguuuuggggaugucuuucacuggccuggagcucaccaaacaggcugagcugguuggccagugagucucgggaucugccugguuccaccucccacagaugggguugcauguaugcgcuagcauguaugcuagcauguaugcgcuagcaugcccacccagcuuuuuacaucagagugggggggggggucuuacucagauccucggacugccagggcacgcccuuugcugacccaggcaucucccaguccagaaaccgaaucuuaagggaucuggccuuggcauucugaguuaucuauuaauguuaccaguggagcaaauuuugcuggugcuguuuuggagagagaaguucugaggccuaggaguggggaaagggcaaaaaggaugggccagugcagaggaggcucugugcgucucuccagcugcugaggaaggauuuucccuagggagacagcaaacuugcugcugguucuaccauugagcaguuuucaccuuccauguuaggauggcugaccuugugggcauuagaaaaucaaagcaguugcauuucauguauuuuuuuguguguuagugcugguuacgguggugguggagguggugaugucuuauagagucaaaucuggccucagauucauuauauagcucuggcuggacuugaacuccugaucugcuugcuucuaggaaguuacucuucaccucuuuuccguuuucaccaugaguuaucuguaucuguuguauagaaacagauaggaaagcauagcaauaaugcauuuaauaggaaaucauauuuuaaaaccuuuauuuaugcaaauuuauuuaaauaaaucaagaauauuaauuuuagaauuaauuaauacaauauauuuuauguauaacauuguauuuuauuauaugcaauauauaaaauuuauauauuuauauguaauuuacaauauagucuuauguuuauauauaagugaauaaaauuaaaaauuucauauuuuaucaauuaauuaagcauaucaguuuacuuuucugccacuguggccaaaaugcuuggcagagucaacuuacaugaagaaaguuuguuuauuuacuuaggcucacaguuucagagcauuuugauccuuccuguaggggagccgagggacaggggcaggcaggcuccucuaucaggaggaggaagugaggcaggaaccagauggccuacuucugccagcaaggucaccuucuaagguuucuacagcccuuuaaaauagagucacagacugggagcaggcauuuaaaacgaagcuggugggggaccuuccugcuucaacucacagccuuaagugucuuacugaaaccucagcaugcuuaaacacuucuccuacucuuggguuggcuguacguguacagcaagggguagaggugcuaacagaagcuucagaccaugcuaauaaaagucauuuucuccacucacuacauuucucucccucuccugcacacacccugucaggucaauguucaaguucuuaaucacaggccuuucccugaaacacugggugcuuuguuuggccguccuucaaggaucagauuuccugcguucaaagggaaccuggaaccugcuugugcuugccuuuugucuccuaagacacccucugacauccucugaggucugcaguaugaugaacauucuuuugaagaaugguguugaggaaggcuauuuucuuucuuucuuuuuuuuuuaaagauuuauuuauuuauuuauuauauguaaguacacuguagcugucuuuagacacuccaggagagggcaucagauuucguuacggaugguugugagccaccaugugguugcugggauuugaacucgggaccuucggaagagcagucuuaaccacuaagccaucuugccagcccggcuauuuucauaaaagguuuguauuccugccuuggugcuucuguggcuuauuucugcucacgugaccuugucaguuauguuagggugcauccaacuucgguaggcuguucucuucccugcuucucuaacaaaagguuuuccuuuccccuuccccuccuucccuuucucucucucucacucucucucucuuucucucucuccccuuucuccccuuucuccccuuucuccccuuucuuccuuuuucucgagacagggucgcuacauaguccuggcuguccuggaauucuauagaccaggcugguucuugaauucccagacauucugugucugccuccuaaaugcugggauuaaagaugugguccuccacaccugacaguuuauuuuaucuuacauuuccacguuuaucacugaggaaagucgaggcaggaaccuggaagcaggaacugaagcagagacugggggaggagugauguuuaucaucucacucagcaugcucuaugcacccaagcccgccuaccuaggagaucuccccuaucagucacuaagaaaaugacccacagacuugacuauaggcaaguuugauagccacaacucaacucacaauccuacuucccagauacguccagauuugugugugucagguugacagggaagauuuuguuuuuuccuucuuuaaacuauuaaugcuaaucagauauguuucagaaggugccccagaaaccccagaguugcagcauucugcuuugaaguaacugagacacaggguucuuguuuauacagaaagcugcuugccuggagacuuggcaucaccucaaaguacugauacaaggaugucacuuccggcgucugccgucacuuccggcgucuggcaucaugucuggcgucugacaucaugcuaggugccaugcuuuuuacuugccguuaacuccguaaggauggauaaaucauauaaagaucauuuggugugugcaccuuucagaagacaaaauagcagcaaacauaacucuaauugacuuugauuucccaaaaacaaaauggaacagacauuccaaugggcacuguuuggacacccagcccccuuaauuuuucaguuugacugcauggcacuuaaggccagugacuccauuucuguuugaucuggccuuaugcaauagcugggucuaaaacaaagacuuccuggaauuuuucuuugucaugccuuaaaaaauaucacuugcacuguuuuucuuaaguuuuagaucuagucuguagagacaaagaauaauccuucuacugcuguuguugagaguugagcucuguguuugcucuuaggcuguaagagaauuauauauauuucuguagagugaagacucgaggcuuggaaagugacucgcagcuguuccucuacaguuugacuguggcuucaagcagggcuccuuugcugugucagaguacaagugggcggcgauggccucccguacccacgagaagaaaagguugaacgccaaccacugauauggccaaagccagacaugaaaaugguuuuagcuuuuucccaguggaaucugcagaguucuuuuucgagagaaacuuugcuuguucuuuaucagagagugaagcaggguauccagguuguucuagaaaccagcuuuuaaaguccuugccuguggugucggugguaaugccaugcaccccugaggucuagaucaauucgguuuucacuuuuuaaaugcuucagggcuggggauguagcucagaugcuagcaugcaugagaacccaaguucgaucccuagcaccauauaaaccuggcaugguggugcaggcagugggaggggcccaaguuugauuucuuuuuuuuccccucucccauuucuggcugugaaguuaauggaggaaacuguguguguguguaugguguuuuguugugugugugugugugguaugugggguguguguguguguguguggcaugugguguguguguauuugugugugugguguguguguguacuugugugugugauguguguguggggugugguguguguacuugugugugugaugugugugugguguggugugugugugugugugugugugguaugugauguguguguguggugugguguguguguguaugugugugugauguguguguguggggggugugguguguguguguguguguguguguguguggugugguguguguguguggucuuaggcucugcugugcugaaccugcuugcucaggauuuucggguaccucuguaaggcucauuacuucucccucaagucuccugcucuugugaccuuugcccugcggccccacaacacagcuccagaaagugcaaggacggcagcugggacuggcagcggggacugggagccagcugcuugcugcugccuguaauucaaagcuucaacaaacagaacaacaaaagacauucuaaauagcuguucuuaaacaaggccuguacuguucagccuccccucgccaugguugcuggcccuucuuccuguuacaguuagccauuugucaugugcuugcucuucagaagacaucaggaggaccaguugaacuguugucaguuaggaggggaauccuucccgacucaguagccacuagggaauguuaaucucccauccagagcuuuccauguguuacaggagcagccaaccauuuaccugucccuugcuggcaucugcagcaucaucuaacuuagaggacccaugcauagagagaggacccaugcauagaggacccaugcauggaggacccaugcauagagagaggacccaugcauagaggacccaugcauggaggacccaugcauagagagaggacccaugcauagaggacccaugcauagaggacccaugcauagaggacccaugcauagaggacccaugcauagaggacccaugcauagagagaggacccaugcauagaggacccaugcauggaggacccaugcauagagagaggacccaugcauagaggacccaugcauagaggacccaugcauagaggacccaugcauagagagaggacccaugcauagaggacccaugcauagaggacccaugcauggaggacccaugcauagaggacccaugcauagagagaggacccaugcauagaggacccaugcauagagagaggacccaugcauagaggacccaugcauagaggacccaugcauggaggacccaugcauggaggacccaugcauagagagaggacccaugcauagaggacccaugcauagagagaggacccaugcauagaggacccaugcauagaggacccaugcauggaggacccaugcauggaggacccaugcauagagagaggacccaugcauagaggacccaugcauagaggacccaugcauggaggacccaugcauagagagaggacccaugcauagaggacccaugcauagagugcuuauggaaagcagagugagcauaaauacgggugaagcccgggaaccucaggugacaguuguccuacugugaucucugccuguaugaaccaggccuccccaagccuagacuucucugacaggcagaugguagcacuauccagagucugacucugcaggucaaaggucaggccugguaguagauauuuuaagcaagauugcaugugucacuguucagggaccacuuuuggucacauuauauggaauagaauuuuuuuacgggggagggguguugcuguuuuaguuguuguuuucuugcuguuugagagucagucuuuguguagacuuggcuggccuggaacuugcuauguauuuugcucuguccuugaacuuucaguauucauacagccucuacuacugacuucugggaugagcuuguaugugccguaugucugugucgaugggaggucgaacccauggcuucauguaucuucagcaaguauucuacacugagucacauccccagcucuugugugcccuuuuauuuuauuuauuaguauggcuaucuugucagcaugccugucuguacaucacuugccuggagugcccuuggagaccagaugagggggucagauucccuggaucugggcggagucacagacaguugugagcugccaugugggugcugggaaucgaacccagaucuuuuggaagcacagccagugagccuaaucaaugagccauuccaguccccuugugugcuguuuuagaaaaacaaauguuacugagcuauauauacacauguguauuuuccauuuccucugggucaugcagagcucuguauaaguaccugcuggucacuucauccuccucagcuggugcauggcauuacagaguauuuaugugcuaugacuucaugucaggcugcaguuauuuugguucuuuccagugguuugugugugugugugugugugugugugugaauuauuauaagcaagugcuuuguuuaguuuccugcaugaagugugcuugucaaggauaauaugcagaagugaaauugaugaucaugugaaacuuuaguuuagacgcugacuuccugguacucacaugguaaugcccaaccauacgcaguuugccuuauucaccuuccaguucgcagcuaauucagugcaguggaauuggaaugcgccaauuggaccuuucacacuguguguaguagccuucggauuacugacgugugagagugugugugugugugugugugugugugugugcguguguugacauauuuaaaacccuuuuuaauacucaaaaguuuuccuuucuaacaacugcagacugguaagaacuauguucagcagcagugggucauauacauagagggcugagugucuguuguucuguaguucagguuggccuccaauuagugauccuccugccucagucuccuuaaugcugggauuguagggaugcaccaacguagcaguuucaguuggacugagagagggacacugugagcuagcugcauccuuucuguccaugucucagagcuggauuucaggcacacaccaccagcaucuucagcaucuucagcaucuucagaguuuuccuacgucaugccgaacucugaugcccaugaccaagaucaguguugacugcgguguccugcugagggguucuccccacccccaugccuuggcagcacugccacaagaaguagggaggccuguagucaugggugggcuauagagggcccacuguguuuuuaguuuuaccaauaaccaguuccaaauuuucagaaaccaugggaugguaaaauuaggaaggaaagagaagggaggaggugagggagggaggugaagaggauggggggggggaggaagagaggcagagagaggaggagggagaggggcguggacagggagaaggaagagauggaauguagguucauacacaguuuucagccuccuuuugccuaaauuauuaaaaccagccccucaaagcugcugcuauuuuaaaaauaagagauucuucucccaacaaaacaaagcaaacaaaccaaucagggcacauauuccacaagaaaagguauuacuuuucaguuugauuugagggggaaaauugcuuuuccuuuugccucacgcagauguugagugcagagcugcccgcucccccuacgcgagugcugaggugucugucagugagggcuuccucuuugccucaugcccugggccugggaacugcagagcuccucaggaaggaagggaugcugcugccggucuaagaggcuggcucugccccugagcaccugugggaaggugucaguccacgugagcagcuuccucagcagcccugcagcacacagaugaucuucccgugcgcacaugucaccaucuguggugacaaauguggcauuuaaagaaucacuuacuugccuuucgggucuuagcagaaggucaccauguuuggccacaaggauggugguuuuaucuuccuuccggcuucuggcaagucugguuuuccuuucgcuugaggcacaguuggugaagcacccacaugguggcuaacauccauugguaacuccaggucugggagugaagggugggggcuauguucucuucugacagccgcaggcaccugguacacuugugcuacacagacagaaauguaggcaagacacucauauagauaacaacuauucuuaaaaauagagauaacuuacuuuaugagguuuuugguggucuaauuuccugggaucaggaguugaggaaguugaagugugccagacacuuugauaauucuuaaguuuggucaaaauggacacagaauaccuugaaacaaguggacauaaaagcuaugcaaaaggucuauaguuucagugcauacccaucucacagaucggagacauccucuuuguggacaucaccuuucuuaugugguuucagggaaucuaacaaaaaccgugguuuugaagaaaggaucugagauuuguguguggugccuggccuuccccagucacuuccuggucugagaccuaauaaauauuuaaugugaggaggccucugcugagcuugcugguugccauggagaggugacugcgguguggaagacaggccuucagugacaggggugaucaggaaaggucauucggcuucagcuggaggugacuuccuguucuggcuugaugaguuucaguagggccuccacguguaacguucccaguucccaguucacguauugcuuugucuuagagcucugauuucagcucuaacuguacaaugacagccuuggauauugagacaaugaagacagauguuaagcauuguuucugcuauaauugugaaagaaugaaguguuaugcucuacagagcgauauagaacaccaagaaaaccuuacuuggcgauagcuuucauuugaagaaacaugaacauucuuccugagucugaccaucccuucacccaguucuaaaucuguuugcaacaucugucaugugugaugugucucacuugaaagaucagccaguaaauggaugugacuuucaugaugauauaaaaccucuauauuuuaugaauauuauaaggauguaccguaagugaguuuuuaaauuaaaauccuggagaaagggccuugcuguguuguccagacuuaugacaaacuucugggcucuagccgucugucuuaguuguguguguugcucugauuucacacuaacgaaagcagcuuggggaggaaaggguuuguuucagcuuacaggucucaggucacacgcuccaucacugagguaaaucagggcaggagcuacagcagaggccgggccagggcugcuuacuggccuguuccuccugacuugcucagccugcuuucuuagagaauuuaggucugccagcccaggggugguaccauacacagugggugacccacaucaaucauuagucaagaaggugaccuugcagacuugccuacaggcuacucugauggaagcauuagggcuuccucuuccagcaggguggugguuagugcacacuuuuaaucccagcaaauguaguuguaucucuggucuacagagugaguuccaggacagccagggcuacacagaaaaacucuuauuuuaaaaauaacagcagcagccgggcgugguggcgcacgccuuuaaucccagcacucgggaggcagaggcaggcggauuucugaguucgaggccagccuggucuacaaagugaguuccaggacagccagggcuacacagagaaacccugucucaaaaaaaaagaaaaaaaaaaaaaacauaaaaaaaaaaaauaacagcagcagcagcagaaaguuaccuucccucuagaaauauccaggcuugugucaaguugacaaacccagccaggacaccucuugugcuagcuuaccaaauagcugggaccacagcuacaugcuacugcgccuagcauaaacaacaucuuucugaaaagcaguuugcuuccauuugacuacuucuguggcacuacagugguguguauauuacaaucuuaacauuuaacaaacauacuucguguugaaaguggaacugucuaacccuuagugauuucuuuuuccuccuuauuuuccugaguaggguuaaaugauuguacugguuauuuuuauauggcugugauaaaacaucauggcaaaguauggugguucggaugagaguggccccauaagcucuuaugcuugaauacuggaugcccauugauggagcuguuugggaaggguuaggaggugugguauuguuggaggaggugugucacugggggugggcuuuaaaguuucaaaagcccauaccauucucagucucagagauguugucucaagguguggccugccuaccuaccuguggccuugcuuccugccauugauggcuguagauuuuuaauucucuaaaacuauaugcaaggucucaguagacucuuucuucaucuuccuuggucauggugccuuuaaacaaaucccaacauaauauuuguauugguccuuuggggauuucacaccacacaccccuaucacauauauuuauuucccuguccuuccgugauguccccacacuggaugauugucaccuccccagcaaacacaaaggccauguuguguuaucuguauacuccccagagcauggucaaacucuuaguggccugccauuagagcagaguccuuccccucccccaacccugauggaagccaucuguuguggaaagugacacuucagcagacugucacagcuuuuaagaguucucuuugggggcuggagagauggcucagcgguuaagggcauugacugcucuucuagagguccugaguucaauucccagcaaccacguagguaaaguguccaaucacaagagaggcaugugcugaacaagcuggacaaacccauguguuuucauagaggcacauaaacaaauaacaaaagccaguuguaaugaaagauccacagcaaacucacaccuaucugcuacaccugaaagggacacuggacgauaaucaaagaacagcuccauggucgugaagaaacuggggucacaacacucaugucuuguuucuuggaguguucucacaagcacucagaacucggcacacacaacuccacaccugcacuuuaccuacgugacuuuucuuuucuuuuuuuuuuuuuuuuuuuuuuuuuuuuuuuuuuuugagucaggguuucucuguuuagcccuggcuguccuggaacucacuuuguagaccagacuggccuugaacucagaaaucugccugccucugccucccgagugcugggauuaaaggcgugcgccaccacacccggccuacgugacuuucuuaaccuuuagaguauuaauuuucugaagcucuaaauaaaguuggccaucucaugagacuuuagauugccucguuuaucagcucuguucucccagguuacagcaucaacuagagcaauuguauaugcugaacucuuuaccaaggcguuaauacagucaguuuucagccucugugggauugugacccacgauugaagaagcuuugacaugguuugacuuaggaccguagaggaggggccugccaggagucccuugcagugguccuuggggaccauuguucaucuggcuauaauguuagggagaagggacuuagguggucaggagcuauacuggugacaugaacuuggugcugauguguuuuggguguucuccguggcauuaacaugucaugggaucaaccucuaagcugcuuagucugguagggaugauucauacuguaugcaacugugauccaagguagaaaaaggcauuugcccacagaggcuuggauugauggugggaauauucacggagccaggguuguggggaugggguguugaaggaggugaaccaagguuugcuaacauugaggguguggggcucauccauguuuugcagugcugggaauggacacgagagcgcgcacacacgcacacacacucugaaaaugucucagcugcucuccuuaaaugucaggagaauagaauagaauggaauagaaugaggcucauuuaaugugggaucuuaagugaugcugcugcuggguuuuaugguguugaccuuuucaagaaaaacagaccccccuccccccucccccucccugcccccacccccgcccccgcccccguuuuggaguggugcuggcaucagagcuggcaggaaugcauacuucccuagaguucaguacagcuaagucuuuuacuuacauuguauuguuuagaauucaggaccauaugcaauugagucuuccaaaaauagguuccacauggguguuuacgugugcauucacccagcguuagcucugagacaaguuuccuguauacugggacaccucagccgcguaauuuaggauggauugcuguuccauagcugguuaaucuccuuuaggucauuaacagccuagaaacuaauaagcagacccucuaaauacuacuuuaugccugaaaagaaaacaaaaaggagucaguauuccugggacacugagauguuuucucgccuaaccaggugcagccaugugccccaugggucggguucuggggagacucguugagucaggagggauguuacuccagggacaguuguaauuagagcuuugcuccauuuugauuaaaggauucuaguuaacaugagcuuucagucuggguaaggcucaggcucuuuuaacuuucaggguggcuucgggagaaucaggacuuggguucuggggaggguucaugcucucaccaccaaagcaagccggaggccaugaggccagcggcggggcugcggcccagccagagcugaggcagucucucuaucaugcaguguuauaucaugcauggccugguuuuauuuucauuuuuuucucagauagauaagaaauuggaauuguuugugguaguucugagccugcucaucgccugugucacuucaugcccaggcagagcaaggcaggcggcucugccugagcgacuggggucaggcaucuuccgaaacaccaggcuucccacuuguaaauauaccaggaggauggagucaacggaaaagacaccauguuuacaauuguuauuuuauaguugggcgugguggugcacaccuuuaaucccagcacucaggaggcagaggcagguggaucugaguuugaggccagucugaucuacagagugaguuccacgucagccagaccuacacagagaaacugucuaaaaacacaaaaacgaggacugggagagauggcucagugguuaagagcacugacugcucuuccagagguccugaguucaauucccagcaaccacauggugacucacaaccaucuguaauaggaucugaugcccucuucuggugugucugaagacagcaacaguauacucacauauauaaaaauaaauaaaucuuuaaaagaaauaaccccccucucccacacacaaacaaaacauuuauuuuguggucagacugcucccaugagauguagucuaacagaauuuugaagguccgauccaguauuguuagcaguuaguauuugaauccauuuugguaugugcgugcucgugugugugcagggccaagacagccuugaguguucuucauacaucaucuaccuugauuguuuuuucuucuugagaugaagucucacucuguagcacugguuggccuggaacucccuuugucagccguucuaaagcuuuggaucucaaccucuuuggaaauugaaucauccucucacaggggacuccccagaccaucggaaaacacagauauuuacuuauguuaagauucauaacagcaggacaaauuacaguuaugaaguaggacggagauaccuuuaugguuggggucacuacaaccugaggaacuguguuuaagggucucggcauuagcugcuuuguguagcucacgcugagugcgucuggcccucuggagguagaauuauagaaagaagguuguaguccaccguguggguuccaggaagugagcccaguuccucuggaagaaccgucaguccucucagcugcugagccaccucuucagccccaccuugacuuuugcgacagucucucacuggguagggagcuuguggaacaggcugagggcugaacccagggaucugccucuuuccuccucugggguugcaggggacaaaccgccacacccagcuuucuuuuuaccugagugccccgagacagcguucaccccuggguuucugcucagcccucgugcaauucccugagugcccagaagcuggggcugcucugcucccguccuuuguuccauuaguagacuuaaggcugagguuucuauccagagaaagguuugccucugcccuuuaaguggcaucugcucuacaguggauaauuguuaacuaugugagucuacaucacauacugggcagcuuuuagauagcauagccaguguguaguuuucaaaguuguaaaagcgugcuaauuggaaacucagaaaaaaagauccuuuuauugaaacauugucuuagaacgcaagugaguaccgguuucuccucaggcgacugaaguguuccuagaguuagauuguggugguuagcagcugagcagcucugaagcuaucagaaaccucugaacuguacugcuuauaaacucuacuccucaaacuggcagcagucccccugccucaucuucauggggcuacagagcuaagcuaccauaaauggcaaacuguucauuauaaagaguuaauaucauggaauuggaauuaugccggaguaaggcuguuacuaagaaacaaagcaugaucuuaaauguuacuaugacagucucccgucccuccuucagcucuuuguccaaggcauggcuggcauuuguuguacacagguuagugugugugaaaagauacugugguccauuuucugauguacugacagcaucuuugagaguauguaauugugaggcggcugggaagucuaagaaggugccagccugugucuaggagcuuggugcuguauuauuccauguuggaagggggcagggcaggagaggaccacacgcucucagaggcgugcauccccucugguagccuuaugccgacucuagugguaagagcagugcguucaugcagcagcucucucacaagcugauaacgccuucgcaggccccaccuuccaagcacuguuggacugcagaucguuuccaacacaugaguuuuggaagacaaagucagaccguagcaaguaaguaguuaaaauaaugcguaaauaguugagacgggcugcagggcgugguggugguaguggugguuuggcagggacaaaguacaccagagaaccggggagccuccagggggagggacucccagugagucuggugcaggccagaugcaagccuuguaguugaauguuggcuacaauaguauuuuaugacccagauugcccuggccauuugcaucaggaagcgauuuuguuggggcuuaagcuuaggagauggaugcauuuggaggaugugagagagaggaugguguggagagcaagaaguucuucaauuuucacagugacagguuugcaguaaggugauagccaaggaaugagaggagacagaaagauagaaccaggccuugaucagggcagccaaggaggugcuggcuucuagcucugagagugugauguucacuucucuuugggggcuuggguucaauuuuuucucuuguaguucaggcuguucuugauguugagcauccuguauauuugggggauaaacuuuagcuccugaucuuccugccucugccucuucuuccagagugcugguauuauaggcauggucccaugcuggcucuuagaaguuuuggguagacacaucuggaaaggagauucaaugucaucaucucaggaguucacguagaaaguggucaugaccccugcuuuguacuuugcuaguuugaacaaguaccuuuguagcccagguuggccucaagcucacuauguagcugaggguggucuugauaauuggaucccccugccucugcuuucugagugcuggaauuagagcaugcagcaucauuccugguucacguggugcuggagaaaggacccagggccuugugcacuuuaggcaagcacuguggucacggagccauaccccugcccucacugcaucuugaacuuauauggggcacauagaaauccguuauuuuuuccagucauguaacugaugugauuuugugcacauuauuccuauauaauuuaccucccagccucagcuugcuaucuuagagaacucgaaccaccagcuaggguggcacuacccauaaugacugggcccucccccaucaaucauuaauuaagaaaaugccuuacaggcgugccuacagcucaucuuauggaggcauuuuccuaauugaggcuccuuccucucagguuccuuuagcuugugacauaaagucaacacacucaacuguuauuuuaaguaaugcuuucaguuucuuuugacacuguugucaaaaguucacuguauagcaguuuucauuucuugaugugagcagucugccacgugugucuggccucugggcuggccucggggccaagcuggcugucagcugcauucuuugcugcugucagauaggcucuugaacacaagaaaacauuaugugugguuucccucagguuggguucugccgacuucuuagaaaaugguaaaagcaggaaaggccauguuuuggagaaaaaguagccaugcaggacuugaucagugcucugugcucugcagggagcuuguuacgcuaucugcguugucuuggauaacccaacccaacccaaccaaacccaaccaaaccagcaaccagccaacccauuaacuaaccaaccaaucaacaaaacaaaacaaaucagccagccagccagccaaugaaguguuugucuucucagcaacaauguuucuucuucuccaccuugacacccuauagcuaaguccuucccucaugccuccugcugcucugaccuccucaggucauggagaccuugaggccucugcuuguugagcucaccaugucaccuuggcuucccuucuccucaggaggcaugggccuuuugugucuccacugaagagcucagauagacuuggguuggugaacuuucccugucaagccuagcuuuggugcauggauggaugaaggguggcggcaccucuacuuauaggcgauuaaaaugguguacucgacaagacuuucugaaaggacggccuggucugacuagaaagcuguucuguagaaagcuguggugucccagauccacucggugaagcuuuuggaggagauacaaugcagacacacagugcagggcggcaugggaaggcaacaguugggguaguugcuucagguuccaccaauucaaguugucaaccacaggagccuguaggggacacuucccauucacacucaauacuaccgguacggauccugcaaaaauaauuguacaaucuuaaaacuccugucccccacuuacuuauauuccagucuccugaucccuggcagccagguggucaagacugauuuuuuuuuuccuuccucgagacaggguuucucuauguagcccuggcuguccuggaacucacucuguagaccaagcuggccuugaacucagaaauccgccugccucugccuccuaagcgcugggauuaaaggcgugcgccaccacagccugucuuggucgccauaguuuugcuuguugcggaauguugagcuguuguggcacgacugacuucugucacuuaguaaugccuguuuacaguuccuucauacaucuguccaugauuuguuggguggcccuguucucucuaauguuccguugucugcucauuauuauuauauuauucugucaucugcuggaagacagcucugugcaguugagggugaccauagcuuuaguaagcuaugaugauugcaggguggaaacagguguuguacccuuucuguucacagugucuguuugggugacaacugccuuccuucccugcgacauccugaccagcucugccucaccccagacuugaugaccuguacuguucugucugaugaugggaaugacuuucuccagucauauccuuccucuccuucucucccacucuuccucccucccuccucucccuccuccucccuuuguccuuccccccaucccuuccuuccuccauagagagggucuuccaacauagcccugacuguucgggaacucauuauguagagcaggcugggcucucaaacuccaagagcuccuccugcuucugauuccuaagugcugugguuaaaggugugcgccacugugccugggaugccguguguggagcccagugcucucaauuccagcuaugcugcucugauucagugccauuuguguuuuuguuuuugggcagccaacaccaugauguucaucuggggguaagaaaagaaauuuacaaaaucuaccugaaaaucuauauguguguuaguaggcuuauguuauaucuugcuauagcaauacucuccaaaagcucaguaccuaugaacaauucuuuuucuuuaggcuagaaccuacuacccugguagcugcaggggaagcuggguaauguaguuuugcuguguagacacauggccacaucuagcuucaggggauacuggguaguguaguuuaagcuguguagucauguggcucuucaggggauacuggguaauguagucuagcuguguaggcacauagccauaucuagcugcaagggaacaagcaauguagucuggcuguguacauaagaauaagaggcguauuggucugguucuuugccauacaaaguauugucuuugauggaugauauggcugccaagcucuugauacuuuuuuugggaaagugauuaucuuuuuuaaaaaauucuucuuacagugcgugccuggaggugugugugugugugugugugugugugugugugugugugcgcacacgugcacaugcaaacacgcgcgugccuguggaggucaggggacagcuuucaggaauuacucucuuuauguggguucuggggcucagguacaggucaucaaguuuucaaggcaggcguuugaccugcugagcccccucgcuggcccugggaagcauuuuucuaugauggugccuccuuccccaagccuuuguggucuuuucucuaaugcuaagagagacuucguaauaaaucaggccuaccucauauauacuauuagagaaauaguugagaggaagccaucaaugucuucacaguaauuaaugcagguaugguaguuagauacuuucacgaugucaggccuuguacuugcuagccauuggcuugaagguaauugucgcuguggcucugguaguccgcucuuguuuuaagagggaaaggguguguaauguggaguuggguaaggcauuucucuaccagagagacaugcuauaagaaauaaaacuuuuaaaaauaaaauucaagaggaaaauggcaguuaguuucuuuguuuugagacggugugagugacucgggugggucccaagcucguggugguguugagagcuccuggcccuccugccuuuaccugcagagucugagcuuacaggaacugcucccugcgccuccaggcugugcuguggauuuucucaauggcugaccucuggauccagcccgcagaguucuguuuucugcagugcucccucauuuugggggcaguuugcugugccucagcuugcuggugacuggaguuuguggucgacauuaauuuucaguaagugcccacuauccugagaaacuccacuucucagggagggcggcuucguccagggcgccaggggccgggaauagcuuuguaaguggcauggaaguuuuuccuaaugacaguuaugucuccucucaagccugccaguuggagguuuuggauuucugcugagcacucuuugaagucagccaauuggcaacuuucagcucggcaaucucuuuaucuccugauaaucuccccaucagaccacggugcucucgauacaccacuaacagcuuagacuagcucacaccacuaacagcuuagacuagcucucaccccuuuuuucuaggcacuuuguacuuuuauaauucaagacucagaaauaguuacaggaagguaggcagguagauguuuacauagcaguuugugaaucaucauugucggaggagaacaaacacacgccauagccaaacuccuuuggcuacacagucccguaaguccaagcguaucuguguagaaggugcuggugagacgcaggccagauagugugccagcuaacaacagaagcguuucagcucuggaguguccccaagguuucuugcguugaauaccgcacggagacaccaggucauggagaguguuccuuucaagggaaucaugggaccccagcgcucucucucucucucucucucucucucucucucucucucucucucucucucuccuuccuggcuuucagcuguaagcugggcagccugcacgaugagagaguucaccaaaucugugagccaaaacucuuucccucuaggucccuaauauaacaauggguccacgcaucuguaagugagauuuagugcacucugauguucacacagacacgacauuaccuaggacccagugugcccacaguguguucccuagccaagugacaaaggccugggaagucaaggccuccucucagauggcucaucagcuacuaguugaaguugacucuggcugcuuccucauuguguauggguaugugcacacacacaguacucuuauuuuccgaagucaucugaaaggaaguugcauaugcuaggcgccagaucucucaagacuucaguauuucuccagggguugugggggcagcuguucucucagacaacaguagucugugggcacuuccaauuuuagaucugucugucugucugccugccugccugccugccugccugucuauuugucuuuuguggugcugcauaucaaacucagaaacuuaugcaguuggcaaguaucacaccacugagcuacauccccagcacuuguuuugagacugacucucagugugaacuucagguugacuuugaacucuguaucccgggcugcuauggaaucaugguccuucugucucugccuccagaaugaaagcaucgcucucaggcuggugcugccauaccuggucaaagaugugguguuuucuuccuucauuauaggacaaauucuaugauuaaguguaauauuuaguuagcacuguuuggucuucuauaauacagaucauuguuauagucucuaccuagcuuuggcaagguugaugguuucuuugaagaaugcugcccugagcucucuaagggcagaauuaaaugaaugucucuggcauugguuuccuucugggcagcccuguacucucaccuugagguaccuuucaggggccugccauaaaagguccuaacuuuggacauacguggcucacauauagagggacuauuccgacccacuaggcugugcacaagcagggagacagaaacuggauuuucuuuauaauucuuugcccuacuugccuuucugcuugggaaacuuaagguuucaggcccuuagcacacgccucacucccuacuccucguagauuucugcacuguccuugggcgcccucuucaggugcugcucugcaugagcgagugucugagguuguucuuuugguggcuggcuuccuaaaacagguuugucaggaccggaaagauggcucagagggaagagcaaugacugcucuuccggugaacccugggccaccacccucuacaacuccaguucagggaauccagugcccucgucuggccucuguggacaccaggcaugcauguggugcacagacaugcaugcaggcaaaacacugauacauaugacauaagaagaaguacaucuuuaaggaaauuguuugauuacaaauauaucaagaguauuuucuuggggcuggagaguuugcucagugguuaagagcagcuguuucuguaaaggccccagguuuuguucccagcacucccauggaggcucaacaccucuucgggcaccagaaaugcauauguucacagauauauacgcagugaaacucuuacacaaauucacagaauguaaaaacuaaaaaguuauguuccgugguaaauauguauuuuucccagugccauguuacuaucuguguguguucugcugcacacaccuguuccuuuuagcauuuaagccauccacucagaaggcaguuguguuguuucucagguauggucuaaaaugagcaucuucuuaaguauacuguuuguaauagcguguagauuacgacaaacugguaaaugagucagauaaguauaaaauauagagaaaagauagguaaaguagagagguaaaucuauagaggaaaaucaagucugagaaaacaucggacaagcugagguggugcaggcagcaauccaggcccucaggaggcccugguaggaugcucuguguuagaggccagccugugcaagauggugaaaccuugucucacaacaacaacaacaacaacaacaacaacaacaaucaaccaagggcuggugacacagcucggugauagggugugcaagccuguggguuugauccauagcaccccaaaaccaaccaacacuaaaacuuuggaaaaucaaguugguuggaaaccagugucaguuguaugauagugagaaaagaggcagugaguacccagagcccuugacacuggcuccagccccaagaggagcauacucguugggaucacuguacacgcagggcucgcauugugugguaccguuccuuucuuucccagucgggucacugggcucucccucuuggcacguggugggaagacgcccuggccccucucaucagugucuaacagcuucggcuccagagaaggucccugucuucugcugcucaguaaguguguuagggaugguacugauugaggcucuuccggucagcuagcuacccuuaggcacaccugaacaacucaguaucucugggccacaucugaaacaggagaucaaguggggacucagguggucuuuuuucagagcuaaugaucuaaguggucaggaauucuucaaggaaaagacacagacaaggcggaagauggccacccuggggccucaagagcacuccuggcaggucgcagaaggguguggcagaggacagcucuccauguacuacugacuagaauccaugugaggucaaaacugggagauuugggugaaaauaaugccaauuuugaaguauuuuccagacagcccuguggaaauaccuuuugcgcagggccagcucuuccuugggcuagguagcuuucuuaggguuucuauuccugcacaaacaucaugaccaagaagcaaguuggggaggaaaggguuuauucggcuuacacuuccauacugcuguucaaaaucaccaaggaagucaggacucaagcaggucaggaagcaggagcugaugcagaggccauggagagauguucuuuacuggcuugcuuccccuggcuugcucagccugcucucugauagaaccaagauuaccagcccagagauggucccacccacaaggggccuuucugccuugaucacuaauugagaaaaugacuuacaguuggaucucauggaggcaucuccucaacugaagcuccuuucucugugauauccccagcugugucaaguugacacacagccagccaguacaguagccauucagggaauggaaaggccugcuguggccccgaggcuccccugaugcuugcuuggcugggcccagggcuuucugagcauccuuuccgguugucugugugcaccacugcacugugcacacggcacagaguggccuguacagcaguccugucugucauuuccauccggcugucaggacuacacaccuggcaggcaggugcuuucugcucagccucacgucuucuaauguuugaugcucucuuugucuacuucagcauccuugaguuuguuccuuauaaaagcacacaguacauguaaaggcuuauuaucauucuggcucuuuuauuggucgagucccaagcuacauuccuagucuuuuauuuuuauuuucagccccacucucuguuauccagaccacaaacccaccauuccaggaacccacccuugcccuuucuggggcugcuugacuguguucgccauucucagggcuggaaugucugaucugggucugcccgaagauagggaggggagcuguucuccagagcugggacucguggcgcugaccuaaaaggggcuuuagcaggucagacuuuaagacaguuacuuagauucuuagcccucauauuuaaaaauaaggcuguuuuuauucuccacugauuauaagucccauauucagauaaggccggcagaaauguagccaugaggucuggcuggcagagaguucuucacaggugagugccgugggugggggagagaugggagaugggaacuagaaagacuucugagaagaggugauggucuugaaggauggugcauggccucagcuagagaaaauacaguacagcagguuggguacaggaugcaggguggaugucaccagaggcuguagugugucuguggcagagcuaggugaccuuuccauaggaaggaggcuagaacagcaguggacagaccuucccacuaacucugacugggcccugucagagggaaugacguaguggacuguagaaaaccugacguuugaaagaaaacagaauuauuguccuuucugugcagggcuucacuacauagcccaagcuguaguaguccuccugccucagccucuuugggucugggauuucaaggaugagccauugcaccucuuugugacaauucaugguuucaauuaaacagcaagcauucguaacugccaaaaucuuguugucuuuaaggaggaaacuauaaauauuuuuguuaaaaauaaauucucaaaaaguuuaaauuagacaaaggcauucccuagaguacacacgacuaccuaaaaagaacagaaacgagaaucagucauaaauugagaugaauauggaucaucuuagagauuuugaagacuagucauacacuggaauuucugcucaucauuaaaaugguuugcuuuugggggcuggagagauggcccuggguuaagauuguuuacugcucuuacagaggacccagguucaguucccugacuucauauagugcgucauaacugcguguugguccuaggggauucugucaaccuguucugacuccuacugacaugaacucgagcccacacaaacaacacaauagaaagcucaggccuuacauuucagagacuauaaauagauuccagagauuauguauuguuuuuguguuuuugagauggggucucucauugaagucccagcuagcuucauggcaaucccccugucucagguuucugaguaaugugauuauggcaugagccaccaugccuggcuugaccuauuuccuccuuuuaacuuaguuccaccaagggccugcaagcgcuguugggucacagcaauagccauggagagagcaugagcagggucucuggaggccugggauggaggaaguggacuuggugauuguaaaguuuuaccagccagcucccuuucugccuggagggugugccaaagaaacaaguucuuuguagagcccugagggcaugccugacuuugcuuaaacaaaggagcugaaacacccccugcccccagcugugggaguuucagcccccccaccccccaccccggaagcggugggagcugccugcaccuuccagcuacuuccuaugaaaaccucauucuuccaaagagucaguuuaaaauuguuugacaguuauucagauucugcuuuagaaaaaaaaaaaaggaugaugggucuagcuuuauuuuuguauuagguucugcuuaaaaggcugcuugcuaaacacgggaugccaagcucucagaauccuguauaauauagggugcaagaaaaguaucacccagauggcauuuucggggagauuacugacagauaauccucucuuguccuagaagauuaagucugccccgccgacgauguggucagaugaccggucuaaaaaaguuguauuuuaaacaauauuccugcuagugucuaguguuuguacaacugaauggggcuccagaguggggggccuccuuuguguacagagggaaggccacucccucugccccgguuauucuuuguucagugaauuagcgacagguggugacuagggcccuccuaagggaggagucacuacagaccugcucgugggagccggagccacgccggggccggagcugggcggggcuuuaagcccgguuccucugggccggagcugggcggggcuuuaagcccgguuccucugggccggagcugggcggggcuuuaagcccgguuccucuucucaccugggcugcacaggucagccggaucucccucagcccggggcucccaggcugccgcagcgccaugcucgccuugcucgcugccuucagcuagcauggagugcagagauauggaguuggcugaugauuaccaaucccccuuugauuuugauucuggagugaacaagaacuaccucuaccucucuccaagcgggaacaccucgccgccugguucaccuacacagaacguugguaacuauuuguguagugaguucccucugcuguguucuucaacaugggaaguuauuuuugguuguuaacuguuuagagugggacaaugaauuuuaaaguuggcaccgucuguuucuaugcuccuuagaggucuguggaugugcggugauggugaaugacacggagggucuuggggucaaauaguggguacaguuuuaaaaucugccuaggcagugucuuaguaaaggaugcuuaggcauucaaaaccguucaccacacucaagggccuggugagugugcuacaauaacaccacaaguaucaaggugaagauaggcuuggguuuucccuugggagaccaaaagccauguagacaaauagcuauguacaccucacaguuuccaaaagggaaaaugaaaaaccaccacaccuuuggaagcagcuguuucuucccaugugggacacggauuuguucacaaggcggaaaccaggcugugacagucugaauugauccccacauaggguccagcagaaguggggacagccuccuucccagcuugcaggaaggauccuauugcuugccaagaagaggagauggcuuaaugaacuccucugucagagucaaggaagcaacuuggcuuucccagaagaaguuaauuauuuccuuacuguggagaauugguuacguuuuguucuuuuuaaacaguagagcuugggaaaccuagaagacagugaaggacagacuguggcaccucugauccaagcugcuggggguuuggacguuugcagggcacaggugugugcuaacacagcaugcuucagugcuugguuauagcagccaccuuugagguauagucuggauuuucagaaacccacauauguugauaguuucaggcuaacacugcccucuagaaguuggaagcuguuaguaaugucugugggagacagggcaugggaaaagcauuuuucuucucauuuucacacuucccuugccugugacccaugugggaucucugggcuuccccguuacccagcacuuaagaggggggaugaccuaguucuaacuugugggcuugugaaucagagcagggcucacaguggggacgguggggcugucauuaaggcuugagagugggcggaguggcaggguccccagcagggacuggggaagaugcccugcauccuuuaguucuugccggcugcguuauuaguguggccacuucucagugcucucuguuagaacagcagccagcauggcugagcgugcuuuuggguggugggguuaaugaagucuguaauugaaaagagggaccuggaaccugcuacuuaaaaguuaaucuggauuuuggccaauguguaccucuucccucccuuucaucguccucucuccucccucccucccucucccuuccccccuccuccucucucucucccucaaucucucucucuccuacccucccucccuuucucccacccucccucccucccucccucccucucucucucucucccucccucccucucccuccuucucucucucucucccucccuuccucucucccucccuuccuuucucccucccuccgguuuuucaagacaguauuucucuguguagccuuggauguccuggaacucacucuguagaucaggcuggccaugaauucagagaucccacugucucugccucccaagugcugggauuaaagacaugcaucccuaccaccuggccauuguauuuucugaauaagcagguagcuugugcaggcaaaggggacugaugcaaaaagguauccuacucacaaaugccaggaacacuuaucuaaacaagaaguauccuuugaauuguauccaaaugcugucucugggcaaaggugaaagcuuggugugcagauguccugaagcagugugagcgguggcugggcggacugggagcugaaacaccgugcaguuugccugucuacccuuugguauuuccuagugugcuccugcuaaguggcuuucacagucuaguuugaaaacguggaugugugaucuguguugguaucuggaauacaaaccuaugaaacucaugugccuuggcguuugaugcaggagaaucaugaggcccaguacuuggggugcugacucaguagacuaguuuugagguuagccuugucuacaauaguuagacuguuguuguugugguugucgucgucgucaucgucaucacaacaauaauaaauacaaacaaagcaaagcaaauguuuguugaacaaacagcugaguggaauugucccaggaggacccguccugguuuuuuacagaugugagaguauugaugcaggaaagguuuggugugcccucaucuguuagccuagcuggcgcuaacacuaagcuuucaguucccaaaccagggcuuugcuuuguacugugcugaggaucuacagagccuagagcaugcuaccuacuugcuccaucacaaaagcuggcgacagcucuugcagaacaggcugaucagccaagcacaucuuuucuggucagggauuuuacuguugguuuguuuuuauguaccacugggacaugucugcuggaucauucuuugccugucaacaccaccugcauuaaguuggugaccuucaccguccuuuccauucuacgagagcuugugggguuacucuccuagcuacuguuuguguggaaucucuuccccuuaagaauuuccaggaagacuaaggaaguuacaggcccuuaacacccuugguucugcucugacuuggaaaugaugugcagugcagaugauccaagcuggggcuguagcuccguggugaggucuugccuagcaggcguaagggccuagguucaauccccagaaccggcaggaaaacaaagauaaucuuguauuuaaugcugucaaaucuggaacucugaagagagugacaaguccagcugcagcuccccagcucagagcucaugucuuacucugcauuacucuuugauuucuugugagucaaccuuucccuuucagggaauucagugcuugcugacucuuacaggguuuuuuaugauugugagaucuuuuuuuuaauauuuuauuuuauuuuuuaauauuuauuuauuuauuuuauguaugugaguacacuguagcuguacagaugauugugagccuucaugugguuguugggaauugaauuuugucagcacugcuugcucuggucaacuccacuagcucagucccugcuugcuccagcccauuuaucuauuuauuauuauacaaguacacuguaguugucuucagacacaucagaagagggcgucagaucucauuacgugugguugugagccaccuugugguugcugggauuugaacucaugaccuucagaagagcagucagugcucuuacccacugagcuaucucacgagucagauugcaagaucuuuuuuuuuuuuuuuuuuuaaauuuauuuauuuauuauauguaaauacacuguagcugucuucagacacaccagaagagggagucagaucuuguuacggaugguugugagccaccaugugguugcugggauuugaacucuggaccuucggaagaacagucgggugcucuuacccacugagccaucucaccagcccagauugcaagaucuuaaagaacaacuuaucugucauuuacaaaugaaaacuagaguaggcuuguagagagcucuauccguggagagggaauuuaaugguagaggagacgucucuccagacaccguaagugucucccuggccugacagccugugugucuucaauagauggucucagguaucaguuuugucugugguguuuggagggaggaagaggagaugcucugaaguaacuggagacuuaaagauggcucaccccccuuggaagauuaaagauuuaaugaggcagguuucuaggaagagggcagugagcuguuuggaacagugaauguguuuugccagugugugugugugugugugugugugugugucugugucugugucugugucugucugucugucugucugucugucuucucccugagugagguacugacggaugcuacgaauccacaccccucaucuucucuuguuaccaugucccuuccugcuuugucuccuuucuuccucagugaccccaaugucacucaguucugcucuauccuggaucuucugccaaaugaaaugggucauuuccuuagcuuccguuguuccuggccaccucgaacagguuccgaguucauuuugccccaagguuuucuucuuuucagugagcugaucacgggggcacggcagccuuugacagcucuccacagccacugcuucuggucccacagugccacacucccauuuaggaacacuguguauucucccacacagugucucuguugaaccuuguuuaaauggggccucuguaaaauuaccugggauugucuaugcuacugaaguccaguuuccagauuucaaacugucugaagguggugugcuacugcuguucagugaugaccuagccuuguagcuguaccucaagacgaggcacagaaaacugcaguggugccauguggucagccaccgccacccuccauccugaggugguuccgcugccauccacgccuccagcuggcuguugggcaguguguagcuuucguguucuccccagcccgugcuauugacuacccugcugcuggagggacucuguagaugagcccuguacccuggccauggcuccaugcuaagcacagcaggggcccccugguuaguacugaagacggaagcuucaauacugcugcugaguagauaaguaaggaaguagcuaaacuuagcaguaagcccaggaggggugggguagugaugcccaguguuagucaccugcauucaauccugcugaugccgacucccagccagagacacagaaagcuuccauggaccaagcauuaggccuggcgcucuacccugcgugcauguugguauuucucuaagacaaacugaauggagcacacaaguguguagaaucaaaaagacuuucaaguuuuaaacuaugcaaccuuggaggaccuuaguuuucuacuagaaaucacuguucucauuagauguugauuuaauuuugcuuguuugcuucuauggaauauguucauaaugaauacaaaugauuccagugcagcaugcuuuaggcaggaagauggacuaucacauggggaccugaaggucuggagggcucagauaguaaggagggggcucugcuuaacugccuuaguauguuuguuugcucagacugggcuuuaccaagaaguacgaagguggccugagagaagguucaggggccugacuaacauuugaucaagcagagacucucuugccaauuuccccucaagguggcugguguggaaaaaccugaauagucacauugucauuuaaaauagcuuccauuggauuuuaggaaagaauauuaaaaucaaagaacaaauguuuguuggcuuguuuguaguagucucauuucuuaccuuuugugauuugcaugaaaaagcaauauauuuucucccccaaacuagauuguccuuccauacuaaguccauuagugaguuuauagaagacauguauguucaggaccacggaagagucggcuugaagacugcuccugaccucaucuccaggguuuguagcguugccaugguuaccagauugcagagguccagguauugcuuucugcuuuucaggguugcuuuuagaucaaugacuuggagggccuccugcgcuggugugugacucugguggccgcacagccucugcaagccacuuuccuuaugucuaaguggugauagaaauccccauacaguuacugaacugcaguguaaaugacuguguuuggaccuccuagcuccuggccgaccagcugugguuagcaguuucucugagauaagagauggcugcauaguucacuugugauuugagcaucuucuauuugguucuucugugccuacauuuuucugccccagcugaggaucuuaaauuaacaaccugcuccuuucaagucuaaugucagugauuugcugcccccugcagguuaaagugagaaaagcuggcugacuuugcuagaucaggucaucucaguugucccgaagccaaguauggcauuaucuuucuugaugguuuaaugaacuauuucaauauuccuugucugaaauuuugggccacaaguauuucagguuuuucauuuuuuucauuuuucugauuagggaauauuuguguguggacuuuacugauugaaaaagccugauuuaaaaauccagaacgcaaaauccugaaacauuacaauguuuucggauuaaguauuuccacccuuugucagccccccucuuagauuguuuuuggaguugaagauccuugugcguuagcaguuggauacugcauugauccccuugccuguuuaggcgugcacaguucuguuuauuuaaaagcauggaagagcuuuugcuacagaaggcagaguuuagcacuugaguucuguagcuccucuuugauuugaguccuguugucaucaugaaccuaaucuggagccacuuguuaggaucaagccacaugacuucagcucugcguugcgucugcggugguggugcucaugcuuggugguuugcgucugcaggcccucgcugcguuugcgaggcagucugagauggaggaugagcccgggaacacacacaggcugggcaaaaggcaggagcugcccccauggcuggaugcugaccuacgggcuggacugaguuucuaaaacaaggaagugcugaaggauuuaaaaguagggaucagauuucugcugugcagauaguacuugcgcaauccucguggggacucuaggacaucuuagauacuguccuauugcugugaagagacacuaugacuaaggcaacucuuaaaaggaagcguuuaauugggguugcuuacagguucaagcacagaagcagucagaccugaugcuacagcaguaacugagagcuuuaacauccucaucuguaggcagccagcagcagccagcagcagccagcacagauacuggccuuggaaggggcuuuugaagccugaaagcucgcccccagugacacacccccuccagcuaggccauacuaacugaucuuucccaaauaauuccacagacauggggccaaacauucaaacauaugagccuaugggggccauucccgcuccagcagccaccucccucucccgccccccacaggcggguagccauagcauauggaaagugcuuucaguccaacuucaaaaguucccauagucuuucacagucucaacgguuuaaaaguccaacucaaauuaaaaucaaaaugcagaugacauacuuugagcauaggggacugaauauauauuacauuccgggggugggguuggggggugagggagcagaguguggugaagaaacacuggaccagagcaaggccaaagcccagaggagaagcaaacucuaaaacccacaaugcugucugauuuagaagguaucggccggcucuuccuuccagccuucugacugcagcacgcgucccucucuugggcuggcuccacaggcugugugcagcucuccuugagugguaccccacagcucuagccucgaguccccugccacagggcugugcgcuuuggcuuucucuaguggacagaagccuccucacggagcuucccucgauugucucugcaguaucggcuccgcuucgggaaaccgugaauaauucugcuuguuggcgcacugugaauagacuuguuuguauuacucuugcuccauuaguaacucuuucacaucuugugcgugggccacuauuuugguacugucaugcuagugauuaugauaauuauuaauugccuuuaaaaguuaguacacaagaaagcccaugucaagugcuucuggaaugugcacgcuacacguggcucuuguugcuucguguauucuuguacacgcguauuguggugccggcuaccugucuggcagugucuccguuuccugccaacccucuuccucgucugcugggaggguaccgagucagccacacgaguguggugggcugaagaacuuacaggcagagaaggaucuucucuggcagcaaagucugugaccugggaaugaugagaauggguggguagacgggcuagggugagucacuaggguaaaguuuaagaaggcgccagaaauucaguaaucaaaucaugugucaacacaacauuuugaaaaagucaaagucaaugccaacaagaucuaugauaacagcauggugaaguuaaagguggaaggucagugcuggaugacccacacagagccacuucggugccugcggcaggggacaaacacgucagcgggacugaugauuucuguuuaaaguuugacauaugugcuguuggcacaggccuuuaaucccagcacgguggggggcggggacugucuuugugaguuugaggccagccuggucuacguagugaguuccggaacagccagggcuacacagugagaccaagaaauggauucuuugaauucacuuugauuuuagaaauuagauuaaaauauguauuuguuuucuuguugcuggugauaaauacccgagaaaagcagcgugaggcgggaaggaugcacuucaggucagagguugagagguaacacuugggcuugguguuagcacgagguggcggguccuaacugcauccguagucgggaagccaagagcacagaagcaggucaggcuaugaacccccaagcaccccacuccugacacuuccuuuguugaggcucugucuucuaaaagcuccaugaccuaucagaaacagccaucagauaggggccaaagguccagacauaaaaucaauaaaccccauguaugauaucugacacugaaaccuuaauaaaauagaauugaggggcuugguggcuucuuuagguuuucuaccugauguuuuagcugggcagggcagggggaucugaagacagugcuggccacucuguuuaguaauguggucuucauagcaggcucuguucagagaaugaauacaguggguuuggaagucuccgugcugucguuggcccugucuccuuaagacagggccucggggcuggugagauggcucaguggguaagagcacccgacugcucuucugaagguccggagcucaaaucccagcaaccacaugguggcucacaaccauccguaaugugaucugacucccucuucuggagugucugaagacagcuacaguguaccuacauaaaauaaauaaauaaauaaauaaauaaauaaauaaaucuguuuaaaaaaaaaaaaaaaaaagacagggccucacugugucaccccaggcuggcuuggaacucccagcucuccugucgcagccucccgggcacugggagugcaggcacguguaucccggggaggugcagucuuaauaaaagcuaugacuuuccgacuuuagcugccaggcaggaagaagcagcagcagaaccagcuuuuguuagggcaucugauuugcucccugguuccuuuaugcagaugucugcacggggagcaaugaguacacagucuucuguaugggccagugugcaggguugaaaguccuucgucuacucucugcugauuuuucugugcaguguuuuagagguuuguguuguugagacaugaucuccugucacccaggcugggcuugagcuuauucuuagccaaagauggccuuggcuagugaccguccugugccugucugagugcuggaauuaaggcauguguugaauguaguauaaagggggucauggugauccccacucuucugcucugcuguaauuagccugaggcugaaguaugaguggaagcagagggaagggaauuguuuuaguucauuuguuagcgugcuauguugguggcuuuuauugguuaucccugguuuuucuuuuaucuuucccugauuucucuugagcacaccuacagaaagaaagaggacggcuacaaccucaauggcuguucucguugggacaguggggcagcuacagaggaauuuaguuucgcauucacacuugacaugauucucuuuuuuucuccuugacccuaaggucugcugaagacagagccgguggccgaggaaggagaggaugcuguuaccaugcucagugcuccagaggcgcugacggaagaggagcaagaggagcugaggcgggagcuuacuaaggugagggacguaguuugugggcccugugcuuuacuaaggugagggacguaguuugugggcccugugcuuuacuaaggugagggucguaguuugugggcccugugcuuuacuaaggugagggacguaguuugugggcccugugcuuugccuugugaguuugcagagcaccucaugguaaaaggcucaaggugaaagaaagcuuacacagcccagagucucaaaggacagaggagacaaagugaucuuagauggcuuucauaugacagcaugggugaguugggugagcacgggagucggacggguaggagagaguggggagagcugcguuguccgccucuggccccuggcgcguggguucagcagccucgugcucaccuuugcuugcguuauggaucucggcuagccuccucccccuuuuccuuucuucuuugcuucaggcuucagcccaacuucuggacacauuucagcucccuucuuuccuagcuuccuucuguaacaucauagaauggucugucucacagugcacagucaguauccugcugcugucauucgucugagcaucuuucuccaguccgcaugagcccuguacuugcugaggaccgcucccacuccccucucucagcugccuuucuucucuuaugaauuuaacuguugucuggauaguucacauacaaugcuuggccuugguauuuugacuuauuucaucagugaacguuguaguaugcuuuuaggggucauuccuguuggaucaucugccaggaacugguucccuuuuuguggguguauguguguguguguguguguguguguguguguguguauguauguguauguauauaugugugguguguguguauguauguguguguauguauguguauguguguguguguauguauguauguguguguguguguauguauguguguguguaugugugugugugugugggcacacagauggaguucagaggacaauuugcaggagucacuucuucucuccagagaugcuacucagguuugguggcaaagcccacguuuaacuuuuccccccaacauaauauuuuuauugauucuucugggaguucacaucuuacaccccuaucacauuugcuucccagucccucccuguucaacccuaccccugcccuugugagcucccuugaagaaaaaaaaaggccauguuauguuaucugcauacucaccgcauggucaaacucccaguggccugcaauuagaucagaguccuucuccucccccaucccugccagaagccaucuguuguggagagugacacuucagcagacugucauagcuuuuaagaguucucuucaaugguguacugcuuaggcuguuucuguuuuuuuuuggggggguaggugggauggaggucgggguugucaagucuuccauguccaugugcaucuguguugcgggccguccagcggcucgcgaggaacagguacagcugagauggcaggcucgagcugaaagauaggaacuagacggacggaagaaagaacggagcuaagucaaaucagauucugaccaaagcucaauuuuaaugucagcaaaccgcuuuauaaagaagaggggaggcccgucccuggccaugcaaaguuccuuugaaguagauaggucagccuucuagugggaacagccuucuagugggaagaucgcagcaguucgguguuaacuccggaaaauucuuggaagagaauuggaagagaaccgguuggccucaggcagguugggccucgggcagguaguggcacaucaaaggagcagcacagcagguggcuccgcuuaagcgguggauggucacagccagccuugcuaggcuggaaggagguaacacaucugcagucucugaugucacugccaauaaguagcuuauuuacucugugcucugcgcaagugugggucuugggcuucugcuuggucucuggcaucggcaccagccaggaacaggacuccugguugcaguugggccauggacccagacaagguccugcgaugcaacugggaucacggacaucagcaugguuuuaggccacagcaaacgccauggccuccaccuggccuauguagguaacaugggccacagacauuaacacagacugggcuccauaugaucauggacccagagauggcucuuggcagugaaagauccugacagaauguauaaggucacagaagcccugaaauuggcaagauagaugucacuguuagcagaacuagcuucacugauuuagaaaaauagaggugcacaaugcucuggccacuccuugaaccugugugucugccaauguuuugaccauuccuugaacucauguguguacccacugaugacgcccauugccagguguuugugauauugguugcugagaaagagucagaaaaucuccccagcaaccacagcccagccaauccugaguugcuacaccugcaccagacucuuuccuuguaccccuccuauacccauuucuugagaauagacauuguuuagaucuggaaauccccuacucccccccuucuccuuacuucccugagggccuauaaaaacugggaccucuuuccccucgaggucgacuccucuaccccugcgugggauaugagucauccccagagcucuggcuuuccccgaauaaagccucaugugguuuacaucaagcucgaucuauugugaguucuuggguguccgcuauuguccugaggccugagcgaggggcuccucucggagucuuucagcagcaucaaacuuggcuggucugagccucuuuuaugcaguucaguugauuuguaucuucuaggcagcugggauuuucugagcaacucacaguagucuuuacugcuucuaugugcuuggggagagagggaccgagugaaucugcucaguuucagggacuuccugaagcugucuugagcuguuccuguauuucagggcuucccacuaagauggaaaguuucacccuucuuccuguuauuccaccuuccccuuuaacauccaguauuuuaaggaguuucccuccaagguuuuaaucuaggaggaaacugcuuauguaaggccaucuuuuugaugauuucuuugacuuacugugaugugcccacauuuccuccuuucuugugguguagagcaguauuucuuacagcggaaugacguuccauuauuggacauauuuuuuauaguguuucuaaaguggguguaggguggcuuuuccauugacauguuuccugucacuaauggaugaugcucaucacccuuccauuugccucuuaucauuuuuauauuuccuugugagcacugucuaauuccuuggcccauuuaaaaaucccaucauuugccucuuuuugauggaguuuuguaaguuucuucacguguucuggacacaagauacauuuaccacaggcuuugaagauaguuuccucuauucuguugguuucuuuuuaucucacugugaagugcaguaguuguuacauuuuuggaaguuggguggguuugagauauuguguccuguagcccagcuuggcuugaagacuucaaccuccugauucucuuugccaaacuuugguuuuuaauccugauaagcuaugcuuucucucccugguugcuuguacuguguuauaucuuaaaaaaaagaagccuaacuaagguuuugaagauuugacuccauguuuuacucuuagggucaaacagguuagcaguuauauacagguuagcaguuauauacagguuagcaguuauauacagcuuccugagcaaugugagguguguguguguguguguguguguguguguacaccuuuauucuuuugcauauggaaaccaguuaucugaguuguauuuguugggacaaaaauccuuguuuuaccccaccaaggucucuugacgcauuugucaaaagcauuugauuucugacucugacuuguguccccuugcuguguguuuauccuuggugcucagcaccacacccucccuugcugcaccacccccacagccaacuuucucauacacguuucuuuccaccacuuacauucaccuacacucaaguucgugcccuccuuugcccacccuaucgaaagaagagauuaaagcugucagguauguuguagcagcagcauacgauagggugcgugacacugcgagccuugaugggaaaggcugaggggagucguuuaucccugcugcugaggucugaaaaccugggcgaggcucuggcuccgcauugcuguuacugacugagugaaucugaccacugccugauuuuggacuauauuuguuccuacucucuugcccuuuccuucucauggucugucuacucuucaguauauaacugagcaaccuacaguuaugucuaagauugagcacagagaaucaugccuuuauuuuguacucucuugcccauuagugcagucucagugcugugcugacauacuugucauauuuauucucccucccucccucccucccccccucuuuagauucuauuuacucuucucuccauuguuaaacagcauaucacuugagucuaguagauguacuuuuugguugaaacugacucagcaaagcuguuuguuguuuuucuaaauccucuuggcuuuggaauuacugccuugugcuguagaucccguggggcaggggcgggggcggagggugagggugagguggaggcggaggccgaggugaggcugaggcggaggcugugcagcagccucggacgagcuuguacaggggucuugaugaauaggccucaggaucccucuuuucaauguucuguuuccacauggugugucugucucaugcugcgacacugccuuucuggugcagccuucucuccuccuuuggguguuaaagcuccuaugucucaagaucucacucacacucagugcuucugccuucagcuucuuccuucauuaucuuguccuuucaaagucuccuaagagagacagucugcuaaggccaacuccucuuucuuaucaggcuaacccuuucauaucauaucauuucauaucauugcuagcccuuagcugugagaugccuauucuaggguggggacucacauggugcaaggccccaguggaugcugcuuaauucauacgacugugguuuugucagauccacuaugaaagaagacugguuguacaucuuuugaugggagacggagauaacuugauauaaacagcagcuuuugcgggcaggcagccuaguagcagcaucugguagggaagaagucagcacaguggugcucaggugacucgaguuaacagagcaggacagccagggacagacagaguagaucggcuggagacaacugaacaacuuuguuuauaaagagacagcuaaaucaaugaaaaaauuaaguguagucauguguggugguacaaaacuuuaauccuaggacggcagaggcagaggggcagaggggcagagggacagaggcagagaggcagaggggcagaggcagagggacagagggacagagggacagaggcagaggggcagagggacagaggcagagaggcagaggcagaggggcagagggacagaggcagaggggcagagggacagaggcagagggauagaggcagaggggcagagggacagaggcagaggggcagagggacagaggcagaggggcagaggcagaggggcagagggacagaggcagagaggcagaggcagaggggcagagggacagaggcagaggggcagagggacagagggacagaggcagagaggcagagggacagaggcauaggggcagaggcauaggggcagaggcagagaggcagagggacagaggcagaggggcagagggacagaggcagagaggcagaggcagaggcagguggaucucugugaauuugaggccaaccuggucuacauagagaguuccauccagccaaagacgcauggugggacucuuugccucaaaugaacaaacauaccacccccagaggcgacgauagcaucagugcauggcuugcuuugauguccuuaauaauuuacagaaccgcucucacuguguuuccuccucgacccugcucccuguagguggaagaagaaauccagacucugucccaaguauuggccgcaaaagagaagcaucucgccgagcucaagcggaagcucggcaucuccucgcuucaggaguucaagcagaacauugccaaaggguggcaagacgugacggcaaccaaugcguauguucccccgauugucacgcuucuaggcggcagaaagggcuuugucgucuugucuuuggggagaggagaaggauguuucugugcuuucucuguggcccacacagccuuuucuuuccaguucuuucaaaguacccgacucguuucuaauuuugguuuuccagaacauucuaaggaauagaaucucauguacagguugagggaacuguuuucaaguuugaaaaauguuggguaguugucuuucccuuucuguguuguugucuucuccuccuuccucuuccuucuccuccuccuccuccuucucucuucuuccugagguuuuaguuccacacggccagaaaauauuaaauggaaaauuuuagacauaaaaugaauacguuuuaaauuccaugcuguaaacaugacgaaaucuccugacaucuugcguacagcuugggacacauucaucuccuuucgaguguuuccgugguguauauuccacccaucuuaguaaggguuccaucucuguggagagacacaccgcgacacacacgcucuuagaaaggacaacauuuaaucagggcuggcuuacaguuucagagguucaguccauugccaucauggugagaagcauggcagcgugcaggcaggcauagugcuggagaaggagcugagaguucuccaucuugauccacaggcagcggaagugaaaaggacccuaggccuaguuugagcaucuaagaccuugaagcccaacccuacuucccccaacaagaccacaccuccuaauagccacucccuacagcaaggcauuuaauuaaauacaugagccugaggagggacguuccuagucaaaccaccauauugccuggcccuuaguuacuuaguggucauguaggagaagacauggaguugauuggggucagugugagcugugacuguuggcauccacuggugaucuuagaacuaucaauucuaucaguaucaguauagggagggguccauauuacguuucuacucugcugagaguguuauuagugcucaguguaagccagcagauugggugaugagauaacuccauauaaggaaugggcucaauuaagugacauuuggagaugacagucacacagagugguggaaucgaacucgguucuggccaucugcggagauggccauuauuuuccuuugcucuaauaacucaagguucucccaccacagugucucacaugugcuaagagcagaggccagucccuacgauuuuugcuuuugugaucacacagauuaugaucuagcaucauuacugugcuggugggggaggggcaggcuucuggcaguaggugccuuucguguuugaucgcgacaacaguuacaguaagugcccacuugacaguacaugcagggauccugaccaccuccuccucuuccuucguccuguacugggacucaaacccguggccuugcucaucuaggcaaugcucuaucacuacguugucuuuuuaaaaaucuuuucucauguuaguuggcagagaagaacacccgaggaacucaucuuugacuguacuaaccgggagcaguguuuguucccaguauuugauccagauguagaaagaaacaaaacaaaacaaacaaaaauaaacacaacaaaaaaaucacaacaauagcaaaaacaaugccccagcacuaauuucugaaguggagaggguugaccguuuugauagauuccauguuugguggguaugaaguggagugaccauucccauuuuaguguuacaguaaaugucauacuauaauaguuuucuguauuaguaucuuauuuauacauugaaagucagucaagagcuuacguggcagcuccaccaagccagcgcucgugacauuuguuuggaugcuacaguacaugugcgcucuccguuugcuccugacgacuuucugugagguaacacugucaaagcaucugaggaaccagauucacaaugugcuuuguuuggcugauguggaaagggugagagaaaggggagguuucaaacucuggcucauguucaguuuuguuuugugauugguuuuagccuguugaccuaaaauacagcuuuucucuagagggaaagaaaagauaauuuauuuuugagccagacauaagcaacuguggccuggaaacagagccucagguugccccgaaaaauucguucuaauauugaagugaucacagaggauuucccuggucucagaaugccugcagcauucacaagugcgagggaagaggacagcuucagugcauuuccucaggggacagccaucugcaguuuuuggccuggaacucaucaaguggcuggccagugaaccugagacccuuuuguccgacucucccaacacuuggauuacaggccagaacuaccaugcccagcuuuuuuaaaacguggguucugggggcucaaacucaggcccuuggguuuggaaggcaagcacuuuauugccugaccugcuugcucaggcccuggccuuauagaauuuuuaguauguaugcugcuuuucuuuugaggggagggaacacuugaguuuugccagccccacucuaacugcucgguucauuccuuucuugccucuauccaggguaccagaagaacaugauggaaggacuguuguugccugaugguuauagagaacguuagaaguucuuaaaacuguuuuguucuugaguucuuccaaggugaugaccacuguaccagaaagaauuuacagaaaagccuagcuaacauuucuccccccuguucuucauucauaauugacuauagauacaagaagaccucugaaacucuaucgcaagcugggcagaaggccuccgcugcauuuucaucgguuggcucagucaucaccaaaaagcuggaagacgugaaguaugugugccuuucccuuccuugcugaguccuguggcaaacugaaccgguugcuguuggucccucucugccucugggucuggguacugcuggguucuccucuguuagagagagggugggugcuccuucagaccaaggccugaagugcuugccugacuucuucaaggccuaguacucuaaccuccaaaaugagcaucuugugagucccuuuaagggcugcugaaaaauucugguugcaaacugaugcaucucaguccucgauccugcuauaaguacgucugugguguuugcaaaugugugguggugggcagagccaggugccuuuccggggaugaguacaagagcaugggagugcacgcuugggcuucacugucugugugugacauuugugugucaugauguggcuccaaggugcucaugugagcacugguguguacuaacccagaagcuuugccaacguuugcacucagguuccgguguugauuuugaguuucuuuuuuaaaauuguguguuuguauuugagauuaguuugcggaguuuuccuugucauuuugguaaaaccacuucauggugcuuuugugccuccaucuaccccuguggcuaaauagcgcggaacauagucaacaugcuuauaucggcugugccugcguuagugugugcacuuucuguuugucuuuuucugugccuagauugcaugagucuguaugcucuauuuguggagaaaaauagguuuuacaaccagaauuuguuaguugaaugaguuuguugcaucaguauauuauacuguguauuaaaaucuguuuccucaugcuuuauauuugagaguuacauuguucuaagccuaauaucauaaugacacauuuucugaggggggggcaccugcuaggugcccuuacuuuuuuuaauguugaucaaaucuguaguguuguaggggcuauguaaaucaugcacccuuaggaaagcagguuauuuaauugugauagauccaucagaacuuccuuucuguuuuaacgcuuccucuggcuucuuacagauugcaagcuuucucacauucauuuagguaaggagaguuugaaccccugcugcugccuggcagucgugugaaaugugugugagguuagaugugcugccucuguggacacucccauguauccucugugggaucuuccucuugagugcauucuaauucccaggagggucgcuuguguaccauguaugaugaacccuuaaaagaagaaucugacaccauggcacgagggcuauggaaaugccuuuugaaguuuuaauuauuuuuaucaauuuuaccuuggcauacagaauuucucccuuuucaagucugauaguuugcuucugaugcuuuuguaaggauauuggaauucuccuucccguggguccuguuguguaauucuaauagacugcgcguguacugucuggagguauugacucuucuaucuuguaaagguuacaagaugcucuugacaugugagaucuugcucacuguguacuuuuccauauuugguuuauuagaguacuuuacuguuuuaucauuugugcacacgggaugaugugucagugagcaagugccaguugugccuguggggguccugugaugcugagcccaccuucccucucuugugcagacucuggguauaugugcagguauuggagaagacaagugggagaugcuuaaagaauaacaggaugggcaucucgguuuccaucucucuucugaguggggcgcaucaucauuuuaggggagccuuguucucacugcagcccaugagcagcugcuacuguuuuuuuuuuccuuugucucccuuuuccaguuguuauuuuuauuuauuuauuuauuuauuuauuuuuugcuuuuuauugacucuuugugacuuucacaccaugcaucccaaccccucccagucccccaucuccuugcauccgcccucuaccccugcaucaucccccacuaaaacaaaacagaaaauggaauuuugcugugaaagcugcagugugucacagugugccacacaguguacccuuugguccacacagcuuuacuacaaaugcucauugcagugagucugguuggaggccucuggcuucugcuacaccaccaauacuagaucccuaccuggacuccucucagauguacuguuguugccuugugucaugagauacuucagcuuuggaucuguaggaccggccccuucacuugcuccagcagcucauagaugggguagauauggggggugguccaaagcccuggaucugggccuaguagccgaguugaucaguccaccggcucucccuaaccugugccaccagcaccuguucucaggcuuuguccagaaaacacagcuucaugaacacuuucuaguuuaauauuuagaccucaaagaggccaucaguaacuccauuaucgggaguagaaacaagaauaugcaaugaacugcaaggauguucacaagcacagaggguuuuguuauauuuuugucuucacaugcaugaugggaaaagaagucagaaagaauaagacaauaauaagaauaagaaagaaauaauaagaagcaaaauugagauuaaacaccuacagcauucauuuauucugaaacuauaaauauuuauaugggagccacucuccuguucuuggugugguggugguguggugguggugugguguggugggguguggugggguggugguguggugugguguggugugguggugguguggugguggugugguggugguguggugugguguggugugguguguuggggugggguggggugugguggggugguggugugguguggugguguggugguguggugguggugugguggugugguggugugguggugggguggugguguggagggacaccccacugcaaggcauagcucaccaccagggccagcucuacugugcugcccaggugaggugcaggccugcucuuuccagugugauagccagugagggguagagucagcugugaucagccauuggacaucaacauggucucagguugcagcccagaguaggaauguccgaaugcccuuuggugguuccauggucuguggagaucaacacgggucccagguggcagcucacuucaggcuguuucucagcguccucaugucucuagcuucuucacugccaguagcccggcacgggccccaugggcuccucgcugcugcaguggcugucaggaaggugaaggucuaguaguaguagccauagcuccugugaguuagugaaugccaucauagguccaggcuuacaaaauggcauuucacagccuucucccaguccucauauucuuucugucuccucucccacaaugcuccgugaacuuucagggaguguugccaaugcuugucuugguuuuacugacaguguguaucagucuguagaagucaaggcuucuggugaaagcuuggaaacgagagaaaagguucuucuucagguuuuguaauccuuacaggucacucagucugcuuccaugguuucugacauacagggaaaaugacagcuuuaggaucaugagggccagcaagauaaauuccggccacauuucuccaggaguuacccaaggagauagggcuguuacugggcccuggcagccugaccgcuucuggggguugggguggggagcuaagaggguggacccccaagaucccuuuuaccagcuacucugaagcagaugguuaaucccauuaacuguuucccccaagcuccucaacauccauagauucaacaucagcuuugcuucuuaaaacaugauaaaguuagugaguuaacauucgagauuuccuaguuuagggaggagggaugguagagaggcagggaaggagaggagagauggagucgggugggaaggaaguaugaggaugggugguuuggagggcuugaaaguaagagcucagccgggcugguuuccuggugagaccagauagugggcacugacccucgaggccccuggcgauaaucauagacaaccccuagaggcauguuuccagcuuuuguuuuuugcuguguucuauccaggcagcgcguuugaguuaugcuuuuguuaauguggagaaaccuugacaagacucuccugauauuaaccacugcuacauugcaacacacucacgcgauggucucauagcauccugggaggauucacuguuucauuucuuauagauuuaagaagaaaugcuaauccauaacucauuuguguuauggauuagcauuucauaauucacaagaaauuucccuuucagaugagugugugugugucuguguguguauguaucucaauauuuuuauuuguuuuggggguuuauuaagguuauucuagacaguuccuuuuugcugaaagcuuccacccuuccugagaaaagaaaccucucccauccucuguggaaggguaucuuuugguugggaacuaaaucaguguaaucuuuccguaccuuucccauucacauuucccaguuuuaguuaacaaauugauucugcuguacuugugaaauguugacuauguaucagacucauuguaggcuauagggcuagaacugagcaugcugauacugacgaugggggggggguugaggaggagggagaaggagggagggggagggggaggggggggggagagaaacacacaccaugaagacaaugucaguuucuguuucagccaaaaccagcaguguaauaauaguagcuacggguugccugcuggguaagaccacacugagcgcguccaaagcauauaugguaaggcuugauaacguagcugggaaggcauugagcucugggaggcuaaaugacgucaagguuucaaagccagugugaguggcuggcugaugauuagauuuagacccacuacccuuggucccagagcugacaccuuccccagagcaaugagguugggagugacuccugaccccugggcuuugccuagcacuuuuguuccuguauggguuaaaucagaagagauugugggagcaaugugggacugguuucacaggugcccacccugucucggacaugucagcguugcucuuucuuugcacaauccuccuaucucuuccuugcucuguacuaucagagauggaaagcuuaaauaacaaagucagaaucuagaaaaaaaaauucaaacaguucagguuuuuaaagagcaagaguuguggacguaagagugcgugugugaucgagaagccugcagagagaaccagccacaugcucuacugcgucuccucccaguggaguucggagaugcguagcuaugaguccugcuuugagggcuacucucccaagcugggagaguucuaauagauuuugcuuuguagauaugacgggucucuguagccucucuguuaauuggugacuuugacuuuuugcuguggaaggucccauauuguggucagcuuuggacaaaauugggaaugauacaucaguugaagacgcuuuguauaaguuuguguagaggagccagaaaugaagggacagcugcccacuguacucagugcagccucgauauccaccacgugaaauuccaucugguugugaguguggaugggauuagauaguggggugcgguggcgggaauugaugugcucgccaguucuucccaguaagaugguugaagaucuugucuucaaaacuguuucuagcaauucauuuuuuuuucuguuuuaaaugauuuuuuuuuaaauuaugaaguauagcuacagaaauguacucaaauuuaucucagugauuuuuuuuuuuaauauacaaaauaagccuucuuauaaacagguccuugccuuuucuucugucuugucucggguguacuuaguguguuagcuugugugcugcccagagagcccaaccgccuggcacugggaggggaaggaaaggaaagccucuugcaugagugcaggaagaguagccagguuugucugugacuuacacacugaagcuucgccuauaaguucucaguuuguuaauaucaucaaacgaugugcuaaucagugaacgauaagcuuauggguuuuggccacuccucgccuccuguggccagaggcuucuccugaagugugcauucuagggaauaacguuuuuguugaggagcagaaacugaugugccuucacucagugcaaaaagagaauguuuugcauaaauacaaaacuguuuuguagaucgaagaguggggagagacgagcccagcccuacugaaacuggccgacuucucggaaagccuuggcaacugaggcgguugccuaggaaaugggaaagucugucuucuccuucccugccguccccugcaugaccgucucucgcuccauucucauccugccugugcucccaagcaggcuuucucucaguucuuacggcucuuccuccacagccuuuaaguuggauuggcucuccagcuccgagauccaucugagagggccacuuccugucccaugucagggugaugaucuuguugcagcucccacaucccauacagugccaacagucugcagacugacaggggagaaguggugggugguguccacugcucugucauaggaguuagggucucaggcgucuugugguagugugacuuccaggcuguuucuccuccuccuccuuuuuuuuuuuuuuuuugguuagaagggcccaagguaauccaugugaugauucaaguucuguuguuaagcauuuagaaggaucauuuuucauucucuauuuuauugugggaacaguguguuuccuaaggccaacuagaagaacuguuggcuuccuccucccgugcauuccagccgcagcacucucugagaacuuacuguugugugacaggagagagcacaacccgagguguccugacucugaacacagagcuuucuuauucugcuguaccucaggaucauaaauuacguaggaauauccagguagacuggaugaaauaauacauugcugucuguagcaucgaagacacacaguaaaaagcacacacaguauuuuaaaugguauugaagauuaauacuugaacuguucgcuuuauccaaaggaaagauuacuuaccaaaaagcuaugcuaguaagccgggcgugguggcgcaugccuuuaaucccagcacuugggaggcagaggcaggcggauuucugaguucgaggccagccuggucuauaaagugaguuccaggacagccagggcuacacagagaaacccugucucgaaaaaccaaaaaaaaaaaaaaaaaaaaaaaaagcuaugcuagugaccaaaauauucugaauauuuugaaauauagugaaauagcacuauagcacucuggguuuuguuuuguuuuuaauagaagcccaaaaaugaagaucuuuuuuagcugguaagauggugucuaggaaaaccuaggggcgaucaggcuuacggcuuugucagucagugggcugugugugcucuugugggguacaaguuagaccccagaauauggagaacucugugguacuugagugucuucuaggaagucuugagaucaaggcuaacugucucuuacugaagagcagcuauuguuauugcuaaggagugcuguguggaauuuguaauagcuuagagucaucaaaucccggggguggggguugggggguggguuuagaaaccggccuguuccagccuagaaacaaauaccuagagaaagaugaccccuguggccuuucagaggcuugcuuguguguguguguguguguguguguguacacgcgugugcauguacacucacacuuuugaggggaggugauggacacccaggaugucuaaagagccaugcucccaucuccguuuccugcuguuaccucugcuucccaccucucuuccgagcuaugcugcuguguagagccgggaaagcacaucuuugcagcucucgcagcgcaagggcugucuucuuggcucucagaaugagcgggaugcauuuggcucaugaauagcccaaaaaguaaauuccuuuagaauaacuuugacaucucccugccaccucaaaaaagcagaucauuauucacagugccaggacaaugaacugucagaaagcuuuauuuaucagaaaguguggugagcgucucgugucgaaaugcuauacacuaaccuguuucugucucucucuaacgcugccucucaguauccgcuccauucagcauucgauuagcaugccugcuaugagguaaaguaugucuuuacaacaugcucccugccuuuguuuuuuuuuuuuuuuuuuuuuuuuuuuuuggauguuuaacccaagccacugaguagaaaacuagaauaugcugugccuuuaauaccguugaaguuugcaguuauuguucuuccauguugggauagauucacgagauccaaaaugugaaauucuguuuguuuuugauuuuguuuuuuuuuucuagacaggguugcucuguguagcccuggcuguccugggacucacuuuguagaccaggcuggccucgaacucagaaauaagccugccucugccuccuaagugcugggauuaaaggcaugugucaccaccgcccagcuguuuuuguuuuuuuuccccuuaaagaauuacuauuucaauuucauuuuauaaaaucuuugccagaaagcauuugaguuggaaaacacaugccagugaagaaggaagucccccuguggcucagggugauuuuggcucuucucugucuacggcagcuuugguuacaacccccucaacucccugcuucuacccuccacugcccccaucaucccuggauggccuuagagccagcugucaucugugggccuuggcagagccuagccauauaaauccuuggcuuggacuugagucuuuguuggaaucacccagaaggguagacacagugcugcaugcugagcacaccccuaggguuucugacucuacaacaggguggggccugagaauucacuuuccuaggaaguccuugagagcugcagcugccgcuggccuggcguuggggugggguggggauggccauguugcacagacuggguauuuaaggucccauggauaggaggaacccaugggugagagacaaaagcccaaaguuucugaacucugaucucuuuugguccuuuucuucucggacaauggucuguggaauugagguucuaguaugggaaccucacacaguugcuuguccugcugguguggugugugcaaaugccuugcaagaggaguugcuaaagcagaguucuaaagcacagggccuggguucaugguggccuuuccuugcuuucugaugcauugucagggaaggaaaugacagcgcuggucuugccuggcuucuuucuuucuguacaugucuguauggcagcaucacuuauagcucggaguagccauuuucaugaacuuaaaagcagucugguggacaugcuagcucaaaagcuggucuuccaugguaagugugcaugcugacaccugugcacacacaucuggauaagucccuggccuguugcuaauugugaaugacagcaaagagaaauguggucacucacugcugcuucagauagcuaacuuuuucauagugcuuguaauuuuacuuuuuuuuuuuuucuguuuucauagaaacuccccaacuuucaagucauuugaagaaaaaguugaaaauuuaaaggcaaguaaaaagauaaauggucucacgacacacuggugucugucacagcacacggcugccuuaggucucacgacacacuggugucacagcacacugcugcccuaggucucugcuguguauuaucgacauaaagcuauagagaacuuuaggagucacacucuguguuucacuaauggacauugcacgguuuuguagguuuuuuguuuuuugcuuuugagcauguguuguagcaugcuacgcagaauggauaacuuaaaacaacaauuauuuagucauuugcuuuauuucaaauauucuucgaauugcacaaaauuugcgcuagcuuuuuuuuuugucuagaaaguacagaauauugaaaaguuagauuuuccacacagccugagcuguuaaugcuuugaaacccacacaaacauuuuccuuugcuauugaauauugugcaucuucguuguauaugaugucuguuuacauaugccuuauauuggauacuuuaucuuuaauuguuguauaaucuguuaauucuguugacuucaugaaugucauuuaguagucacugacuuauuuuauuauuuuuaaagauauuuauuuacugucuagcaauuuugcacauuauaaaguaucucuugaucauaccuaccuccuuuagucccucuauuggaggcacauauucuuuuauaaugauuaccuuuauaaauugcauuauuuccaagaugauuauaaagucaucagcucugagcacuggggaugguggcucaugcauguaaucugagccuuuggaggcugagugugaggauugccgagaguggaaugcuagccugggcugcagagagagauccugucacaaaaccaaacaacagacacacagacaaaaccaagcaaacaaaaacuuagcagcugagcugagcaguggcggcgcacgcuuuuaaucccagcacuugggaggcagaggcaggcagaugucugaguucgaggccagccuggucuacagagugaguuccagaacagucagggaugcacagagaaacccuguuucgagaacaaaacaaagcaaagcaaaacaaaacaacacaaaacaaaacaaacuuagcagcuguuagaaucacaccugauauccaggugauagaauugcugauguucuauuguauaguauuguguauggucuguaugauuauuucuuuaucuaguccugagcaguguaguggguaugcuuggagcugauuacuauuauuauuaaaugagccugcuggguaguacuacaaagucagaccuuauucaaggaaauaccuuuuaaagcucauauuucguguagucuucaggacauuagaagagucacuuaucuuuaaaagcgucugacauuacaaaggcaggggcugccuacugagcggggauaauccaguggucuggacucuucucguggacuuccucgccuccguguaaaugcaucuguuuucugagaucacacugcauacacagucuuccagcuuuguguaugugagcccaugauugcaggagcccuuccuuuuguucagcaauacugauuaggguccucacauaauucuuggcauguugcucagcauguaagugucacacucguguuuccagagcggcccacgagacuggcuuuaugcggaaucucagggccgagucauacaucugaaaagaagccacagugaagagucaaguugcugugacucagaucucaagacugucaacuccucugccuccccucccgucuguccugagaguuaguguuugaaauagcucgucagaaaucaggaacuaauguucauuugauuccagagauagugaggacugcccaguugcuugcuguauuaacauucuguagacuguaguccacuggucaaauaugacuuaacaucauguagaugaugucuuagucagaguuacuauuguugugacgaagcaccaugacccaaagcaaggguuuauuuggcuuacauuuucagaccauagacccucauugaaggaagccaggacaggaauucaaacaggacagagaccauagcuugcucagacuguuuucucauagaacccagggguggcaccauccauggugggcuggguccucucccaucagucauuaaguaagaagaugucccgccaucuugccuacagucuguuuuuauagaggcacuuuguuaauugagauucccuccccucagaugacugcaguuugugccaaguugacauaaaacuguccagcucugaugaaaacauaaaaaguaacuuuacaaaguguauugagcugcuguugcuaaagaaacuugugguugcaugcuugggaaaauuuugccaaauuauacuuacauucccuuaagucuaggaucaccaugccugugcccugagauuucuggaguguuugagcaugugaccgugacaggcaaagcagaggguaccaugcaaaccuggaggaaguccucaccuacugacaggaagggacagucagggaaggccucaguaauaucauuggagacguguaaggcuguaacgucuuuuugaggaaucgcaaucuggucuuguggcagugggaagccagucaggaccuucuucuguccguuuuacaagcaucacuggcagcacaaugaagggaguguggugagagguaggaguugagauccaggcagaagaggauaguggaugagcucagauaccauaaugggaguaaauacagacacauuuagaaguuagacgaagaugaaggaaggcggaugcuguggagccaaaggacgauggcuccacgugcugggucagacaacgauguaggugcugcugcuguacauuuuuuaaaacacaucuuuacauuuaauauuauggcacauaacauuuuaagcacuucuacuuagaauguaauggagcaaacagugaaaugaaaccauguaaagauuauuguuuugauggaagggucucauugguucuccuggagaggcaaugugaaugaugaauggaaagggggccaguuguugggaguucgcuuuuacauagcuggauugcaaggaguuguaacaguuucuuacaguuaaaaaauauaguucagugaauuuaauaauggauacaaaugcaaauuuauccaacaauuuaaagauuggauaggacguuuuagacucugcccagucaauaaagacugggggaacaggacaggcaaguuugaauccacugagcauguauucuuggucacgagcuaguucccgaguguuagcuguuauguaguguucaaacaaauacagguugacucuuucagaccugguacauuggaguguggcuuuacccauuuccaguacacaugaagucacucaggguccuucuggcacuaagaguucagugcugacauccucagugucugccaagcccccugacgaugcuuagucuguaggcuagacuagguaagggcugaaaagcuuacaguguaccuggagaaauccaauuuauuuccuccauuuguuguacucaguaauauuucuggaugaaugaaauugauagacaacaagauguuuauuaauuaucuacagaggccaguagauaauuugggauaauagagugcaaaguucuugaaguaaauuuucuggugaagagcaauuaguugaugguggcaggguggaguguggggcaagcauuucagcaagguagaaagcagauguugggcuguuacgauacccggagcacuaaaguacauacauccauauguaaugagcugggccaggagaggcccuguguggucuugaaaguaaauuuaaaggucuuuucugcaggggcaguuaacguuguuucaugaugucuuuccuguuucacacuuuuuaaaaagucuaaaguaggaggagccaagccugcuggcggcgauuuuggagaaguccugaauuccacagccaacgcuaccaguaccaugaccacagagccuccuccagaacagaugacagagagccccugagcugccgaccuguguccugcugcccacugccaggugcugccggcgagagccaaguacaucuugacaacgcucauggcugcggauuuccaccagaugugcuuuuauuuagcuuuacuuauuucuuugaccaaauaguugaugaaugaaacaaagugaaaucacuugaccuccacuccagggaaacacuguuagcaugcauggaaggcccuuuguauaggaaacagcaucauagagccucugguagaucccugcaggcaacuacuguguuucuccuuaaaaucacuguacaucuggauucuaguuugaucuuucuuuacuaucuacaugaaucauuguuuuugggucucuguacacuuaaucaauuucuaacaaacuguccuuuucuaaauucugguuauuaaaagucuuggaauuauuucauuccuuucaaaggagaaacuaccagcuacauuuuuuuucucggauaaacaguucugugaggaccauaucuuggguuucuaaagacaccagacuaaaguagacagguguguaugcaguucuauaguucuguaaauuaaaaacaugcagacacucaaacuuccaguggggagaguguggguccugcucuugccuugguaacugucauuuguagcuacaucuauuugagcucaaauaugcuuaucaguuauuuauuauaccauucucacacauuuuuuuacaagauuaaaauuuaauuucagguaaauugagagaauaacauugugaguuaaguauaugauauuacaguaaguuggaauguucccacauucaucacugauaauuccaaaagucuaaacgucuuuaggucuauacaguuauaaaaaugcuaaaaaaaauucaccauaggggaaauuacugccuccauuaaauccauuuaacaccuuuaggaaggacagaaaguucuaugagaaauacaacuugaauauuuuuuauacuaagggauuguugauaacuccgaaagcugcgaggcguuacuaugacugagcugaucaggcaguuucuguucucaguguguuagugccugagcuguucuguauguagaaaucguucccacucuaagaacugucggggcugugagucaaagcuucccaguggcucugcuaagccccucuguuaacuguggucacuccugacucacuccugcuuccuuugcuguguauguuuauggccuaugagguuguaucuguuacuucuuucucuauugugguuuuaccaguguccaugccaaauguuaacugccaagcuuggagugaccuaaagccuuuuucagagcauggcuagauuuaauugaggauaagguuucugcaaaccagaauugaaaagccacagugucgguugucacaaaaugacaugcugccauuccugguugcugcucggaugcaauggaaacuaugcuugauuacaugugaaaaucuuaauaaagucugugucucaguaguauagguuucaauauuuauuaagaggacaguggucuggacaaaacuuguuauauucuaaaaucaacugguauucuggaagcauuuuccuagaggacuggaacuguagaaauuugucucuagagaaauauugugauuauccaauauaaugauuuuucuacca

SEQ ID NO: 12075 - RNA, 56612 nt, Mus musculus
gaaucggaggcggcagccucucucgagccauggcggcgccugugagggggagacuuaguguuugagaaggauaagcgaggacugcgccgucgugguuccuuuuuaaaaucucugagcguggugaggacugcggggugagugggggacgggaagggauucgggaacccggaacugagcacgggccguggcgaccaaggccggcgcccccgccgcggugagcucccacggcugcguaccugucugucccgcuccccuccauccuccuuccccacauccgccuccuguccugcccucugcucucgucccggcccuuccuugcgggaggcugggcucucuaucuauucugcuucuguccggcgccucagggugaagggcgcaguugggaccgggauuuuggccucccgcccgcccgccgcagccccgagcugccuugauuguuuugugguuucccucuggaauuccuguagaauuccgauuuucaauuuuuaaaaauauaaaacacaggccgccccgccccuuccuggccacagaugugugugguuagcgguuaacuuagcucccucaguuagacccggcuaggagucgcugugugagcaacuuccuuagccacaaacuggauaugacagugacauuugucuuuuaggauggcugcaagcguuaaaaaguggcaagggaaagauuuaagauagugacuaaaauauugagcucuaaguaaaugagaaucgcuaauugcacuguuaucaauaacguauacacuauuguaguuuggguuccuuacucuggugugacguguuuauggaaaaaaaaaagguuuauuuaaaagaaaagcugaaaugacuauuuguuuaaaagaauccauguguuugugagacaagaucucagguaccccagcauagacuugaauuguggagccuagggugacaaggaacucugucugccucuacccccucuucugggugcucggauuacagguguacuuucaccuuaccugguuucugaggugcccgcggaugacuucaugcacacugacugcagcugagucacaucccgagucaaagauagauuguuuuuaugaucacgauuccguuguguuuauuuuuaaaaggucuguagaauaugugaaaaggaagaaagugaccuggugcacuuaaguuugcggugauguugggugcuagaugcugguuguaucacuaguguagcguguagcucuuuugcuguauauuauggagcuguuuugguaauaaaugaucuguguauuuaagcauuuccaguguuuugggguguagugagaaaggguuuaguuauguaucuccucccucuguuuugugggugcuggaauuuuaggccacacauugucaguuguuuggugauuuuuuuuuuuaagaggaucauguaaacuaaaaguauccuuaaaggugcauuguaaagcuuuggcacacaguugcacauaauuguaggcuguguuaccacacuuuucccccuuuggacugggagauugaaaaacaaauaaaaauacauguuuuuuuuuuuucuccuggaaaaaaaagcaaacaugguagugaacacuucagaaggcuaaggcauauuuguuuguuugggcagggaugcacuauagcucugcugguccuggaauucgcuguguagacuagacuggccuugaacucagagcuccaccugugucugacucccaagcucugagauuaaaaacaugugccacuauaccugacucuuaguuuuuuuuuuuaaaggggaaauuuuuuuuuucuaaacauugaaaauaguucucucccucccucccucccucccucccuccuucucuccuucucucccucucucccucuuucccucuccugguuuccccuuccccucacucccucucccccucucaucucacagguucaagcuucucuaauggcugaucaagacacugauuuauggguaucuggcagaauguugauagaagucauguuguaacauuucuuuaagugacuuagagccguguauuuuauccuagagaugaguuuuaggggagguaggagggcuguaugaaguuggucauuugcuucugaguaaggacaccauuggagcucuccuguggagacuuaaaaaugauugccguggauaagacaaacaauaccaaguuaugaauauuguaugaaugaauaguuauuuguccuuucaauaccuauugaguuucuuucccaaccugcauuugagucuuagugcuaugucugcuuccuucauuuggaaacugagacgagacuuccugcagagucuugaggaggcagaguggagccaggaagcaggugucugacuuaagcaucugaguuuuacaacucuguguaggucuguacuguguaccuguacacauagacucaccgccuagaaauggagaguuguacuuuacuguuuccucagggcagacagcuuaaacugugucucuacuaagaaucugagcgcucucugacuacuuuaucaaucugaaaaaguggaucagacacuuuugaauaaagugagauuaagcucugagguaaaggugagacuguugguuauauuuguuugauauuuaagauauuuacuacccacuccaguuagguauagaacccagggcccucagcaggacuuaccccugaguuacaacaaacucaagcuccauacuucaauuaaacuuucucucuucccuacuugccuaacuuuccaguucuuagguccuagaggucgaagagagcuuucuuucauaguccagauuuauaaugguacuaguuuauauacauuugucuugucaagucuuggagauguuugggaauuaauauaaaaauggcagcuuacaguguaagcuguacagugaucuaugaaagauucugagaauccacauaaaggugaagucaagagugaugaaugaaguugacguucucuguagaauauuccugcugcggugaaauauacccaguuauaaacuacauugcaguuugggcuggaaaacugcucagaaacucauugcuggcacagagaaagauuagacauuggaguaccuugguuagagacagcaggggauuugggcaggaggaggaggugaagaguaaagcugggcuuauugggagguaaauguuguguagacacuuugcaagagaaguggguugaagacagauguagaagaaagguagaaaaacacuuguaccuuuugugugcagggagcuuucuguguuauuuauauuuuauuguauguuuauaacucaugcucgaguuuuauagaaaagaaaacuuagucuuauggagguuuugagacaggcccuuguaccccacauuugcuuugaauucgcguuuccaggggugaccuccaccuccugugugcugacugaccaucuagccuaccuccugggcccagcuuacaaauucuagauccacaaguacaguaucuaagucaguggcccagucugugggucucgaucccuuuggucaucacauauccugcauaucugauauuuaugcuaaugauagcaaaauuagagugaaguagcaaugaagcgaauuuacaguuggggaggagcuguauugaagguucgcagcaucagggcgcuugaaccacuguuguaaaguuucuugcucagugaccauguuugucucauguauucucauuucaaguuuuacuguuucagccuucaucaaguagugcaaacaauggcugacgacagcguguuaccaucuccuucugagauaacuagcuuggcagacucuucaguguuugauucuaaaguugcugaaauguccaaggaaaacuugugcuuggcgucuacuucaaauguugaugguaaguuuaguaccugcuuuuuuuucuucuuugguuuuuugagacaggguuucucuguguaacgcuggcuauccucuguguagcccuggcuguccuggaacucauuuuguagaccaggcuggccuucaacucagaaaucugccugccucugccucccgagucuuggguucaaagucgugugccaccaccacccagcaguaccugcuuuuaaaaacacacaauuguuaacuuaaaucaaagaauacuuacuagugaauuuuuuguauugagugauuagggcucuaugucuacauucucuguccaugcuuugggauaaugcuuccccacuuugaaaaagggcgugucuuaguguugauccugcuuucuugguauugaggcacucucacuauaacauugguaagcuggaguuuauucuugcuuaagugaggagcuacugugguuuauugcuuuguacuguuuuauucuaaaguuccauguacuuuaaggaggagggucaugcuucauaaugcuucuuuaaagggaguuguuucuuugauguaugccuuuugcuacaauguauauagccuuuuuaaaaaugauauguggucaaauauuuuuguagaaaauucagaauuagguuacuuuuuuuuuucuuuuuaaagauuuauuauuuuuuaauuuuauguaaguacacuguagcugucuucagacacuucagaagagggcaucauauuucguuauggaugguugugagccaccaugugguugcugggauuugaacucaggaccuuuggaagagcaguuggcacucuuaaccacugagccaucucaccagcucccagaacuagguuacuuuaacuucuggggauuuucuguucuccucagacauagacuuucuagcuagaaagagggucuaggaacuacuaaugugcuguugguaccuuauaaccacauugaaacauuuuccaucuuaauagaagaaaugccgcagguugaagcaagagugauaaugguccaggaugcugggaaacaagaagaacuucuaaaggccuuaaagguaaggaguugggguuuguaauucauuucuaaagagauucuucacccagcuuuguaaauacuuuccuccgcuucuuaaucuuacacguaagucucuuuucuacagacuauuaagauaauggaagucccuguuauaaagauaaaagaaaguuguccuggaaaaucggaggaaaaauuaauaaaaaguauuauuaauaugguaggucaagcaucucauugcauguggcaugcuucacuucccucgauugaauuacuucacucuggugacuggaaucaggcacgagcacugaauuagaaauguuggaaguagcuuauuuuagaauaaguuguuucugaacccuuaaauuauagcaucuauuagaaauucaaguuuucgagacuuggucauuauuuaagaaaaggaugcaauggguacaaaggucuggucauuuucuuacacauuuaaggacuuuuccccauuagcuuucuguuuaguuuaaauucgugcuauucuccaguguguaaccaguuugucuucauaauaauuucuauuuauauuuugucagauugaaccuagguucucguacauuccaggcaagcauuuuacuacugagcuagugcccugaccuuccauuacauuaguuugcuagggcuguuaaacaaaguaucagaccaugcaaauaauccugacagauuaaacaacagaacuuagagucuaaaaugagugccaguggguccaguguccugaggucugcauaggacuuccuugcugcaccccgcacggcccuguuucccuguacuccaucuuugcuguugauguucagacuucugagcaccugagucagguugggugaggccugcccuggacaccucguuuaacuugaaucgucucuguaauggccuuaggaccuuagcugcguacagucacauugagagagaagguuucauuuuucauuuuagguuagcuuucagcauaugaauuucagggauagaugauuugguccaucacuccagccuuucaaauaaaagcccaaauaauuuauuaauauauucagaguucuuuguuccguucuguucacacaggaauuauguaggcuguucagguuuguuuuuuuuuuguuuuuguuuuuguuuuuuuuuccaggguuucuguauagcccuggcuauccugcacuugcuuuguagaccaggcuggccucgaauuuagaucugcccuccucugccucccaagugcuggaauuaaaggcauucacuaucacaucuggccugguucuuuuuuuuuuuuuuaaaugaagauacuuuuaauaagauacuugccuuuguaugucauauauguguccugaugcagccaaauuagcucaugaccucucuauagcauauguauugaaaugagaaugucaaucaguaaccuuuuacuaaguguuaaacggcgggguuuuuucuuuuuuuuuuuuuuaagauagcugcauauguagauuaucauuuuucuugcucagaauaaaaacugguggauauauaccuaaaucaaaauacauguacuuacauuuuuuuaaaaguguagccuaguggcucauaucuauaauuuuaucacucaguaguucauggguagagugcuugccuagcaugcucugaguucuagguuugaucccuauuacuaccaacaacuaaaacuacaacccuggaaaggaaaguaccugguguucuauucuaguaccuggaacuuacugugcaugcuagguggcuuauagaccagagucagagagccugugcuuaugucuucagagcaaggucuuaauguguaugggguuauaugacguauaaaguagagaaauaugauucuacacuguuauauguuauguugguaauuauagacuuuaacaguuaaaauuucuaaaaagaugucaaaaaaauacaggagucaauuuuagggagucguauauuauuuuauaugaccuaugaauuauuuuuauuuguaauaacuaugaaaaaauccaggaaaugaaagugcccuguguaaagauggacucaauggaagaauuugaaaguuuggauuccccagaauuugagaauauauuuguaguuacugacuuccagaauucugucuucaaugacuuauacaaggcugauuguaggauuguugggccaccaguuauacucaacugugcacaaaggggagagguaagaaacguacguuugucaucucaagaauacauuuuuauuaaugcauucuuugaaaauuuauaauuagaaaaugcuguuaauugucgaguacacguagcacuuaggauaagaauaauuuguuguugcuggguaugguggcucaugccaugaguccuggcuuccaagaaggugcacacauaagccauucucuuuuccacuuaaaacuaguauuauauccauuaucauacgauuuaaauuagaaaaauuauuuuagguuuuuucuuuuuccuuuucuucuucuucuucuuuuuuuguuuuuguuuuuguuuuuguuuuuuuggaacaggguuucucuguauggcccuggcuguccuguaacucacucuguagaccaggcuggccuugaacucagagauucaccugccucugucugugagugcugggauuaaaggugagcgcuaccacgcccagcgcuuuuuauuucuuuuugauguguauuugaaugaguaugaagguguaugugagugugugaaccuuggguauugaaaaguuaacuggugccaggugugguggcacaugccuuuaaucccagcacuugggaggcagaggcaggccuggucuacagagugagcuccagaacagccagggcuacacagagaaauccugucuugaaaaaacaaacaaacaaacaaaccaaaacaaaagacagaaaaguuaacggguaaagagugaaaucuuuaagcaugaggaaaugcuuucucaaugcuaacggagaaggaggcucaugaguuuggaauuguguccuccagcccuugccguuuuccugccggccgcuguauuguacgaguaugcugaaccuggugcucugcuucacuggauucaggaagaaggaggagcuuguaaguaugagacccugaccuaguaacgcaggguuagauugcauccagccaucauuucuguuugguguugugacgucauuuaaaaacucauguuuguaagugauaguuggcccaugaauuccuagaaaguugcauaacugugaacucuuuuacucucuuguuaauuauuaguuauacuggucaacugaagguuuguaacaaaaugaauacugcuuuaaagcaagcuaaacuuuaaaguacuuuuaccuugaugaauaagccauagaaacuuuuuuugguucacaauuauuuccuaaguuggaacuaguaaguauuacuguaauuuugugggaagaauguugauguuauauaaccugauauuaaaacucaauauuuuggugcuggagagauggcucagugguuaagagcacuugcugcucauuagaggacaaaaguuugguucccagcacccgugucuggucucagagcugccuauaauagcagcucugggggacgcugcuucuggccucuguggguaccuacuuguguguguguauacucucagacacauaaauaaagauaaaguguaagaaaagaaauugauauauuuguuuguggguauauggcuuuggcuucaauucccaauauuguuaaaaaaaaauagaaggugaauaaaugaaaauacuacaucuguguguuuaggcaguaucagaguugguugccuauuauuagcuuaauacucuguguauugcuuaucuuuguuauagauuuacauguagcaagaacuacuuuuuuuuaacaagcuacucuuuuaaaaguguuuuuuuaaaguuuuguaaaguaguuaaugcuaaaugacuuaguacaaauuuugcucaaauuaauuaaaaucaauuuuguuuaauuuuucuuuugaggucaaauuggugacguugguucaucauauggguggaguuauucgaaaagaguguaauuccaaaguaacacaucugguggcaaauuguacacaaggcgaaaaauuuaggguauguaagcuuacuguuuuugucuuuucaguauaguauuacucuguaauguuuauuuugagacgaucauauaccauuuagaaacgauuguguaggccagguuagccuugaacucauuaguauccuccaguucccagcuccuucauaggcaugaucuaccaagccuggcuugugucuaauaaugucacuccucuguugaugguacguuuuuuugaggaucagauggagguugucauuggaaagucaguaaaggguuugugacauagcuuagcuacugagugcuugcuuagcacacauagcccagcauaccuguccugauagugcacgaguauaaucccagcauggagaccacuguggagacaggagaaucaguuaaauacugccuuuuccugcuguuugcaguuagccgguguuauguaagucccugucucaaagauaaaaccuugaaggagacugaaguuagauguugaaaugugugaugugggcugggcaugguggcgcacgccuuuaaucccagcacuugggaggcagaggcagguagauuucugaguucgaggccaaccuggucugcaaagugaguuccaggacagccaaggcuacacagagaaacccugucucaaaaagccaaaaaaaaaaaaaaaaagaaaagaaaagaaaugugugaugugaggggugguugguagguaguauugguaguaaaggcuguaugaccagcaguggcagcuaggucaaggagugagaacagauauuucacuguuggcuuuaugaaaagaaagcccucuuagaaaacaaaccugugucuuugaaugucuaaauuaucuauauauuuucuuaaaaagaauuuuuuaaaaaggagaaaauauuuuauauuuuucucucaagagagggucuuuuuauguuuggauuuuguuugugauagggucucuauuuuuguaacccugguuguggauagaccaggggguccugaaacucagagaacccccccuucuucucaaguucugggaugacagguaugcaucgugucugcccauguugccuagccuagccgcagacucguuaucuuuugccucagccucccagggguugggauuauuguacuaugcuacugugucaccugacacuaacuuacuuggguaggaaucuauugucagcugcaguugaguugugcauucgauuuauuuugggugugucuguguuugcaugugggugugugcuugugccauggcccauauauggucagaagacagcacugcggguacagguuuucuccacuccauggguccuggggacugcauggggacuucuuaacaacugauuuaugucaccgaaguagcuuaacgggaauuuuucauucauugucacauucucaguguauuuauauaagaaauuuccccuaauuuuuauguauacacacacacacacacacacacacacacacacaccuacaccugaaaggauggaagccaucauagguacauuugaaaauuaaauucauuuaccuuauucauuccuauguacuuaguaauaucguucaauguuacuaguagacuuuguaguacguuuguuuacugugguaaaauauagcuaaaagcuauuucauucauuuacauucaugguucauugccauuaucuacagccacuuuacugugugcaguuauuguuacaauccuucuauuaaaccuuuuguuucaggucuugagggcuacucauaccucagauaaacucuuguucucugguuuuguaaaugccaguguucugaguaacuuguuacgagaaaucuugucuuuaauuguauaguaagugucaaauaguccaguaucauaguuaugacagcucaccuccacccaagaauaugugugcaaacaguaucaaaaucuuccagagucaaacucuuguauugguaaagguaauucauuugcaggucacuuuuagguguacgugggaggcuuuucguuguccauucuauaaguacucuauaaggaauaagugcacuacugauaaaaccuaaggaauauauacuaucuuuguuucaagauuggaauauuguaaaaaauaaaaaaagcaucauucuaucuacauuaaguaacagcaagauuauucugauaacuacaagaucacacauaggugucuucauauuugccuuaaugguaucaaggucauagucagugccuagcuagucaugguuagcuaaagugccauggccccuccagguugagaacugcuacuaaagauguuugguucucuuugcucuagacguuccugaaaaacguauucauauucuacgaguuuagugauguaacuguuucguguuucuccccguaagcuccaauagacugcucagggcggggaaacugaaaccuaagcugcggcaggccaaagcuggggguuccugacuccugcguguccacuugcugcugggaaccacgcagaggagucgggaauugagggucaggguccaugggccugugaugaggccugagccaggguuccucagacuccugggcacccagaugccgcuggaagucgaggacgcugaggaggagccugcagagaccaggccguggggaugggaacucagggucagcucaggaguggugagucugggagcagagcggccuucugcagagacuuaggauggugaggcucuguagacaaaggguuucuccauguuccccacagugcuucuugaugagaaaguccuuggcuccaaauuguuuauugguuguucaguguggaaaaugguuucauaccaccuccuccggguggaccagagauuaaauaccuuuugcauguaggaauguuuagggagggaaguuuauuggcuaaacccucuagauaccucauuagcauggagaacucuguucugauccacgugaucauaggucguguuccuaugcugguaguauggucaugugacaguggccuggcaggaggcaggugaagcuccuaccauccucucagaggcuuccucagaggcuccggggcuuccagucugcucaaugcccacagucauuacuuguuuucuuuuguagucuuguuuuagccaauucuuccaaggugugaacagaacaaaaggagaaaucaaagagcuauaauuauagaaaauagcauaagaguuggguaccauggaacuuauuuuagagucaccauaacuguaagaaaauagaaugugaaauugugcuaauaauuuuauaaguaguucuuuagaagcacuuccuugagucccacuguaacugguguuaauauucccagguugcugugagccugggcacuccaauuaugaagccagaauggauuuauaaagcgugggaaagacgcaaugaacaguaagugcuuaggaauccauaguuaauuauugugugaauucaacauguucauucguucguucuuucuuucuuugaaauauuuguuuuuuuguguuuguuuuuguauauuuguguacuuggaugaauauuuuuguaccacauguauacagugucugaugaaccccaagguugcaggcaucaaauccacugggacuagaguugcucagagucaaaccugggcccuggaauagcagccaggguuuuuaacuacugagccaucucucuacccaacauauuguuauuauuuuuuaaagugugguuaacauuuguuuuaaagauaaagccaugugccaacaaaaacuaaauuugaaaauaguauagaaaacaugaauucuuugaauggcuuagggaauaaaacauagguuauaaaacucauuuauaauaagcauauaaguaagacagguuuuugaaacaauuaaaauuguaagauuugauaucauuggguuuuauuuuauaaaaucauuucucagaauuaagcacuuugugcgugauuguaugugugggcagauuuggaggauggagggugucuuagucaggguuucuauuccugcacaaacaucaugaccaagaagcaaguuggggaggaaagggguuauucagcuuucaauuccauacugcuguucaucaccaaggaagucaggacuggaacucaaacaggucaggaagcaggagcugaugcagaggccauggagggauguuucuuacugacuugccucuccuggcuugcucagccugcucucuuauagaaccaagacuaccagcccagagauggucccacccacaaggggucuuucccccuugaucacuaauugagaaaaugucuuacagcuggaucucauggaggcauuuccucaucugaagcuccuuucucugugauaacuccagcugugucaaguugacacuaaaccagccagugcagagggugauguggauuuguguucuccaucuacuguaugugcacuuuagggauuuagucaccuuagguuguuuggaaugguugcauguacuuuuaccugcucagcuagcucauggggcugauuuuuguuuguuuguuuguuuguuuguuuguuuguuugagacaggguuucucuguguagcccuggcuguccuggaacucacucuguagaccaggcuggccucgaacucagaaauccgccugccucugccuucccagugcugggauuaaaggcgugcgccaccacugcccugcggggcugauuuuuguuaagugaauuugacugagcaguccagaagcuuuggugggcggagguacuugcucccaagccugaugacuuauguuggauucccagggcucccacgagggggagauuagacuugugggcauugucugcugacuuccauguuugcacuacagcacccacgugcacacauaccaauacauuuuuuccauugucauaaacauucuaaaauuuauuagauaauaguuuaaugcuuucagguauuuagauuauguuuuuuucuacuuuauguguagauacauuuaaauugguccuuaaaacuuaacguuuuuugcuaacccuccaggugugcauugucugcucugguucuucuuuauguaaaaguucaugaaaucagagaaugucuguguuacagagugucaaacgcccagccaggauuugaaugaugggaagguugucugugauuauuuugucaggugcagugaaugacucccaggccugcacguguuaauuucaacuucuacuaagcagcauccugggcgaccuccucuuuuacuaaacaaaacaaagcagacaaaacuaacuuuuuaggacuuuauguaauauauuuuucaauaaaugaacucauucuuguaagaccuugaaaauuuacugagauuucacaaacuaauuucccuagcugauggaauugaagcugguuuuagaaaugcacauuuuguuuuuagguguuucugugcagcaguugaugacuuuagaaaugaauuuaaaguuccuccauuccaagauugcauuuuaaguuuccugggauuuucagaugaagagaaacauaguauggaagaaaugacugaaaugcaaggucagguaacaugaugucugugguggucgacacuggccugaggcgagcaccugagcaugucugugagggaguuuccagacuggguuaguggacguagaagacccauucuaaaugggggugguaccauuccgugcacacaaaggccaaagugaacugaaugccugcauuuaucucugcuuauuguggugugacuagcuagcuaccuuaugcuuuuccugcuguggcuuaccagucaucacuggacuguacuuugucugacccgaguaaaacaaacccuuuaaguccuuguuagaaauaacugauauccuauaaauagacacuucauaauaaauagcugcuuuagagauggaucuuuggagaacaguuguuuggcugaucuaucugugucccuguucucuuuaggagguagcuauuuaccaguuggggaugaaaggugcacucaccuuauuguugaagagaauacaguaaaggaccuuccauucgaaccuucaaagaaacuuuuuguugucaagcaagaggcaaguaacuccagaaugaaguuacuuagcuuuaguaauaaauacuauagcuucucugcuaaggucaauuuaaaaucuuaauuaauauuguucucucuuuuagugguucuggggaagcauucagauggacgcucgugcaggagagacuauguauuuguaugaaaagguguguuucuacucuugguucugugaaauugcaaaaucgauacuguuguguccagagcauuuauauauguauaacaagaaccaucauaguaaaaauuaaacacuuuugugcuuuugauuucaggcuaauacuccugagcucaagaaaucggugucucugcuuucucuaaguacuccaaacagcaaccgcaagagacggagauugaaagagacccuggcucagcucuccagggagacugaccucucuccuuucccuccccggaagcggcccucagcugagcacucucuuucuauuggcucacuccuggauaucuccaacacacccgaguccagcauccacuauggagguaguaauucacguuucauggaauuagucuuuaagauggaguauacugggauaacuaguagaauaaaucccugcuacagugaaugaacugggaaggcuuuucucuuaauagucuuggucuaguugaguaaacaagacaguucaaaacaaaagcugagcguagcuggguagucuacccuuauaauuccuagauugggcaaguggagcccagaagguggguuagagacacucuggccauuaugagacugggccucaaaacaaaagcaaaaacaaaacaacagaaacccugaagagagaaaucuuguaaaaaauaucaguugcacaguaaugcuuuuguugggugauuguuuacucuaugcuuuugugugauugucugugugucugucuugcaggccacugaacuucagaacaggaguuaggaauuguccagggcuauagcugaagagugacugauaauuguucuguuuuucuuuuugagacaaggucccauagcugaggcuagucuuaagugcuggguguaacgcuacaccugcguuaauucuaguauuaaacgguuauaagaaguccuggggaagugagguagaauaggugggagucaggaggaugaugucacuuuguguugaacagacaaagacuccuauagucaaaccuguuaugaucaccagcauuucucuugucuguaaauauguaggauuugcuagauuuaagauacagaaaguaaaagccuuugacuucauaguguucuguacuaauugucacucaugcuagggaggugcccuuccucuacauuaccagcccaugcuuugagacagaaaggggaauauugcuguguggccaggguguccuugaacuuacggcuuuucuucagcauccugaauaaugagauuauauaugugcacucugaaguauuuuagauuucucuaguugucuuaaucauguccugauuucuaacccuccucucccccaaacaagaagcucuuguaguuuaguuuaggauuuaaucuaggguaccuguuuucaccguuuaguuucuucucauugaggggauuuccuuuaauauaauaaccuugguaaaucugaagaguguaggccacuuaccuguacacugucagcuuuuuaauugguauugugguugagccuagaacuucacacgugccaggugagcaguuucccauugacucauguucucagcucugaaucaaugaccuuuuuggucauuguauuuuccuagccuuaucccaugaggaaguuuuacuuuaacagaaagcucuauugcugugcuuuauaaugucuuuauaguguuuagaucugccuucugauggaaccuuucuucuuucccagaaacaccgaaguccugugcuaagucuucuagaaguucuacuccaguuccuccaaagcagucagccagguggcagguggcgaaagagcucuaccagacugagagcaauuaugucaauauacuggccacaaucauucaagugaguagggugugcuuguagagugauuccuguuguuugaaacucucuccccucuugucuuccuuucugugacuuuguguuuuguucuuuuaaagaguauugguguuguuuugggugguagugguggauauaggguugagauaaaucuugcuguguauuucuggcugggcugguacuuaacacauagcauagacugaccucagacuuaaaguuaucuuccuugcucugccuccugaguacuccgauaaugggugugagugccagccccacaggaggaugacuuagagacuaaaccaauaguccuuaacugcaguguuuuuucuuaagaauagugccagucaggcugccaugcacuugguuucuagaugugcuuuuucuauguuacaccacagccuuuguguaaccuuguggcagugucuuguguuaauuacuaccaggcacuugugcuuaaacccuuuugaaaaggugugugucaccgccccccccccccuuccccaacuggguugaaccagcaccgacuacauuuggauucuuacaacuuccaccuuguuaagguacugcuuuauguuuagaagcgguaggauuuucugaaaaguguguucuagagaaauugcucuauuuaaugcugcauauauggacaacagauagucuguacuccggcugagaagcuguacaauacugacaucaguaaucuguuucggcuuuucaugauaccuuuggacuugugauccuccuguuuguaccucuuaagugcuagacugaaggugugcacugucugccaggcuuauguggugcuggggauggaacacggcuuccugcaugcucugccuguuaggcaaacacugcuaacugaauuacaucccuaguccuaguuuuuuacugacauuuaugaaaacuacauuugaggugcaguuuuacacacaaacccaaaaaugagaaaaguacagucaguauacaguaaagggcaagagaggcuggggguccugcucagagggugaaguucuugcuggguggcauggggccugcaacuuggaucagcagagcccuguaaugcugggugagcuuagcuccugacugugaguccagccucagaaguuaauguggaucccagagugucugacuaguaacauuagccacauagucuagcuuuugguuaggccaagaggaccugcuucauuucagugaaugcauaagaugggagagccauggagggugauucucaacauuaggcucccacgugcacaugcacagacagacagacagacacauacacucguacuauacacauguacauguuaccauuacagggacagguaaggcauaugcaguauacaugaggcacagauuuuaguguccauaucauuaauacaauuugucuuagucaggguuucuauuccugcacaaacaucaugaccacgaagcaaguuggggaggaaaggguuuauucagcuuacauuuccauacuacuguuaucaccaaaggauaucaggacuggaacucaagcaggucaggaagcaggagcugaugcagaggccauggagggauguuccuuacuggcuugccuccccuggcuugcucagccugcucucuuauagaaacaagacugccagcccagagauggucccacccacaaggggccuuucccccuugaucacuaauugagaaaaugccuuacaguuggaucucauggaggcauuuccucaacugaagcuccuuucucugugauaacuccagcugugucaaguugacacagaacuagccaguacacaacuuaaccaaagcuucuaacuugccaaacaguuuauccuuucuaaaacacagauucacaccucgcccccaauuuuugugaucaggaugaacuugaucuacuaaaaacaaauaaacauacuuaaaaaaccacagcugggcauaguacaaaccugaaaccccgauacuugguagguuaagguaggaggaaaacaaauucuaggccagccuggacuaccaugcuguaguaagagccuuccuucuuccaaagagagaggcaaguuuuggguauuuguuugaucuaaguggauaagguaaaauuaagugauuuugaaauuguuuccaacaaaagaaacacaaguccuaaaagcugucuuaaagagaacguucucggacugggguuugcucauuggucaagcuguagauuaacacacaaccugcacuuaauccggaauuaacccuguaggaaggagggaggaaaagagaacagucauaguaaaugcaggucacaggccuuagaaccucugcucaguuuauguaagcaaaguggcccgagacguguaauuucacaugcguaauuaaacaguuucaguuaacugggcauggugacccuuaggaguaggccaguucucuggaggcuacggcaguuggauugcuacgagugcauaugcacaaauauagaggucagaagaggacuuugaaggguuggaugucuccguccuuccuguggaucuguagauggagauugacagguuugguggugagcaucuaccugcucagucaucccgaguuaacaucuaagcuaacuuagaaucacucacuucuuucuguccuuuauguuaagaaccgaacaauuuguuaucuuacuguuacuuaacuaguaacuuuaaauauguacuuguucuuggagggguuuaccugacugcagucuggaaucagaacugacuguacucucacaucuccccggguuucuuuuuaggguaucuuauaauuggaguccuggugugcacccccugaggccuggguuccuucagaaucaucuaacuaguguguaucuauagucucuucccuuccuccccccaccccccuuucucuucccuguuuuccucuuucugacaguuugacuauguaggaugucugagauccaauguuugauucuuuagcgucucuuugcucuugcuaaaacacaccgacaucuuagugcacaaagagcucucaggguuuuuauguugugucguuucuuuccugaguuuuaagaguucuuuguauguaauuuugaguuuuaguccuuugucaagugugugauuuuuaaaauauuuuuuuaaaacaguauauaaauaagacaguugcuaauuaucuuauuagaauuuuuaaaauucuuauuaaaugucuguuuuucuguuuucauuguaguccacauuuuugaggucaugucuaaggauucuaccuaaaacuaaaucaugaauauugucuucuagaaauucaugaaguuagauuuuacuuuccaugaacugcuuugaguuaauuuuugcaaacagguuuuuauucaggcugauguucauugguauaacaggguugaaagaccauucuuugcgugguuaagacuugcuccuuguuguuuguuuguuuguuuguuguuuuccuucugguuuugccucaguguugaucuaguugaccuugaacucagcucuuucuguuugcuucugauacguugggauugcuacugugguuuuuauauuuauauaaauugugucaauuuucauuucuugguuuaguuauacuguaccauaccaucuuuaauauuguuuucuauuaugaaauaauuuuuuauuucuugagaaauucuagaaucagauuuucucucuauagaaaguccuaggacuuugauugguauuaucuugaaacaccuugaucaacuaacaagauaauugucauucuuucuguguccaguguuuccaucugcgacuguguggcuucuuuccuuaugucuuuaucucaccugucagaucugcuuuugagcaugugcacccuauacccaaauguuuaguuucuauuuuagaaauagauggcacagcuuuuuacaucauuacauuuucuuuuugccuggugugguggcgcacaccuuuuaucgcagcagaggcacgggaauuucugaguuugaggccagccugaguuccaggacagccagggcuacacagagaaacccugucucgaaaaaacaaaaaacaaaaaaauaaaaauuuuuuuuuuaaacuugugggacagaguguuacuauauagcacuggcuauccugacacuugcuauucagaccaggauggccuugauaucacagacuccacuuaccucugccuucaccuugcagugucaccaaaguccugugaguaaggugugcaugcuuuuuguguuuaugugugugcugcccuuuuauccugugaccuugcuggaccgacuuauucucuauaugagguuuuuuuucuuuccuuuuuuuuuuuccucuuuuaugauugauacagcuggcccagggagauggcucaguguggguaaaagcacuugccucagacacccuaauguccugaguuugaucccagcaccccaugauagaaggagaaauagacuucugaaaguuguucucuggccuccaaaugugcguuugcauguguacacccauguuuucucccccuuccucgucuucgccaucccucccuucucucauauacagccauguacaauaauaauaauagcaaacaugaugaugaugaugucuguagcaauaaguggauagaguucaggucucuucaugugagaugaagauaucuaguuucuuugcaacuggguuucuaugccaccauuucuaaaacauuuaguuuuuuauuauuauguauuuagaaagcuuauugcuuccuuaaaaauucaauuaaaaaagccucuucuaauucuaauaauuuauuuguuugguuccuuuuuuuaaaaaaugauauauuuuuauuuuauauauauugaguuuuggcacagugccuguggaaaucagaagaguucauuggauuuccugggacuggaguuguaaaccaccuugugggggcugggaaccgaaccuggguccccuggaagagcagcagugcacuuacuuaccuucuguccaccccccccccccgucccccccccgucccccaccucccaccuuguaugugcgugcgcacaaguacaucauucuauagaugggaaggaaaauguaaugagaaaagauggcuaaguuuagggagcacacuuuccuuggcucuuucuaggguugccaucgcuguuuaucauagcuauuuacauuucagccuucguuuccucacaguuugccuaacccugauccccccuccuccucuaguuauuucaggugcccuuagaagaagaaggacagcguggugggccuauucuugcaccugaggagaucaagacuauuuuugggagcaucccagauaucuuugaugugcauaugaagaucaagguaaguuuguauuagaggucaauaucauucuuuuugugggcuguguguaguuacuguaacauuuccgguauuucaaccuagcuacguaaaucaguacuguauguaaaacguagaucucacaauguuucuggcuuucccuuauggugguccuccuuguuuaggcuuuaagacacuacucuaggcucaaauaugguaaauaucuucaauaaaaauuuuugacaugcuguauguguauaaauauugccuacauguuugucuguauaccacgugcaugcuugguacucaaagaggcagaaguugguacuggauccucuauaacuggaguuagaguugugggugcuggaaauggcacauggguucuuucgaucccugagccaucucucuagcccauucaaguuuuuaugacuauuuuguguuuuagggcgacugaggaauuuuaagaacuagggguuagcagauaugguuuauaggcugcaucaggcccucugucucggggaagagugauagcagagcccguguccucauacucuccuuuccucauacuuucuauuuugaucucauucuuuccccuuccuccucccagagggcuccgcaccucccuaccacccagcuucauguuccuugucucuuuuuuaaaaagaugaauauaacaagucaagaaaaaacaaaagacagacaaaaaaaucaagaagacaagaaauacacuaaagcaagacaaaagagcccagaaaaaaagaaaaaaaaaaccauggcuccuauuugggguugaccaacugcuucugguauggcgccuucccuggagugugguugcuaaacccagugucacuccauugcagaaaaccaauucucuguuucccgggaaguaucaguuccuaauaacuucuucguuaggguaggacucacuuaagucucuuuccccuucucagugcucggguucugucuggcuuagacaugugcagguauuauguacaccgccacagucucugagcuuauaugugcucaguucuguuauaguuuugcaagaugcugcuuuuuuuuuggacucauccaagauggcucuuaaaaauauuucugccuuccacauacaucucugaggcccgagaguggagguuuguaaaggcaucccauuuaggacucaagguuccagucucuccucuccccauuuguuacuuuguaugguugcuucucaucguauucaaauucugcagacuugaauacuaaugacagaagacauauggccuuggaauauuuuccaucugucccuuuuaguaagauuugcuugaacccugcuacagguuauaauuuuuaaugacuuguguuaaauuaguugcuacagcagcaggauuaaaaauagccuuuucauaauuaauaaggucgaucaacuuucauagcuaguaagacaaaacaucgaucuaucagucauauaggggaauuaggauuggucugucugacagugcuauuuauguuuucuuaauuaauccaaaggcuguugucuuuguagacaaaaauuuaauucuuuguugugauaagaaguuugcacauaacauuaugguacugcauaagguguuuuuuuuuucccagcagaagaucucauaaauagauguuaagauguuuaaggagcuguuggauuuaaauguuugauuuuuuuucccccuuuuucaggaugaucuugaagaccuuauugcuaacugggaugagagcagaaguauuggugacaucuuucuuaaauauguaaguguuuauuguagaguucacauuuauuuaagugguaucucauuaaggacugacagggaaggaaaugugaaaaugccauuucccaugguuuuaaaaucugcuaggauuguucaugacuuuuaaacuuuuaauaugcccaacgcaacacaagaucauuguucgaacacaguugcauagugacuuuaguguaaaguugucugcuauccccaaaugguguguguguguguguguguguguguguguguguguguguguauagauauauauguauauguguguguauuauaauuuauaaaccuguauauauauuuauauguacacacacaaaaacguauuguuuaucucuuugucugccucuguggaauuugauuucuuaggauuaaggccacauauaugagucaggcaaggauguuuguugaguauucauuacacauuguacuaggggaggaagaaaccuuuuuauuaguucauguuucauuuaaggcuggagguuaggguaguucguguugguguuugccuauugugaauggggacuggauccaaucuuuagaacuauagaaguccuuuaacagagaauaaacaaaucaagagguagguuauagauacauacaccucuccuucuaacacuuaggaaauuaaggcaagaaaauuguaagucagaggccuucaaagccugucccaacaaaaggccuacaaaaaucuguguagcuuacauuuaguaaguaaaucauguguucuagguugugugguuuauaucuguagugcuagcacuuggagacugaggcaggaaaauugguagccugaacuuaaagugaaacccugucucaaaacaaaaacaauacaaaaaucccgaaacuauuuuccuuuuccugaaguccugugacuauaagcugcuuuuguuugaaucccugaggcugggguuaugcaucugagugcaugauguucuuucugcaacagugcuuuuguuuucugaggccuuuuccucauguuuauauauguuuguucagguuguugaggacuagaaacauaggaauuuguuuauuugauggcuuuuaacauguuuaauuggcuaaaacauuuuaaaaauuuaugcaugagugcucuuugcaugugugcuugccugacagaagaagccaucagauccuaauguaggugguugugagccaccgugugguugcugggauuugaacucaggaucucucuggaagaacagucaguguucuuaaccaccgagccauuucuccagcucuagccaagaaacuuucuucauguuuuguuugcaaagauagaguguuuugauuuuaaugguauuucuaugugugcccggguauaugcaggcagguucuugcagaggccagaaggcacacuagauuuccugggauuggaguuacaggguguuaugagcacucuugccuugugugggcacuggguacugaauucucauuugcuacaagagcaauaaauucucucaacagcuauucuaucucuucagaccaaaauuuuuccuuccuuaaguugcauguuuuagguaauaggauugguguuuaguagugguuuggauucuucagcaaacaauaaaugcaauuuuagacucuguacagaccaaccuuaauuucauuuuauguauucugaaaacagauuucaaaugccaaguucauagauaggugucaucauguguagauuauauugugcugggguggaaccccaagguuuuaugugcuuggcacacacuaucaacugagacucaaaaauguguccuuuuuuaaugugugugucguguguguguguguguauguguguguguguguguguguguguguguguguguacauaugugucuuuauuugcuguuuuaugucuuagguuguggauaccaguugaugcaugguuugaauagcaaugaaaaacagaguuugagaugaacucccacucuaacgcugagggugcccuggagcuugggaggccagugugcucuauuacuggaaaucuuggcagucucuugauuuccugagggcugaggccugugccauuguguccagcaucaauuuguuuguaaaggaaaguuguauuaacagaaauugugaggaaacuuuaaacuuuuuuuucuuuugaauauaaaucuuaauugugauugucaauugugucacaaagauuauuuguccaagggugacguucauaaccagcaguuucucuuuuuuguuucuaggcaaaagauuugguaaaaaccuacccuccguuuguaaacuucuuugaaaugagcaaggaaaugaucauuaaaugugagaaacaaaagcccagauuucaugcuuuccucaagguaauauacacuccuaucauacagaauucugagucacuucugaaagaacucauuaaaauagucuuuuaaaguaaauuaaaauagucuuuuaaaguuuuaaaguaaauuuaaaguaaaggaaaauucuacacauauaagaacgccuuaauacuugucuuaaaaucaguuguaucugggaguguuuaugauguuuaggccuagaaauuuggaauuuuauacagcagaggacaagagguaguuaagugaauagggauguuguuuugacugguuuuguauugguggggauugagcccagggccuugcauaugguugguugcccauaugugguuauuuucaaaagaacuaauguugucgguguaguugauaugguacguccucauaggaacuuagaaaggcccgugcauauaacucuguagaggaucacacuuuguaacacgccagccuucccucagcaagggaaaauuguaggucuuggagaauuauugagucauggugaugggccugagagcagcucccguccuguaugaguucuuaauuuacuuggugauuucucugugugcgcgugugugcuugcacagaugugcucaugccagggcuugugcaugcaugugcaggucagaaguucguuaaccuuugacccuguggauucuggggcuuggcauggcagcagcugccuuuaccuucagagucacugucaacugcuggcucuuuucuauuaaaauauuuuugcguuuaacaaauuaauuacuuccuuuuagauaaaucaagcuaaaccagaauguggacgacagagccuuguggaacuucucauccggccagugcagaggcuacccagugucgcuuuacuuuuaaacgguacuuguuuuacugggguuugguugguuuuuuggggguuuauguuguuugcuuaauuuuguuaucuuagauguuuuuauccaauaguuuuccccccuucuuugagagggcaagucuucuguagcccagcugaucaugaucucauagauaugacgacgaccgugaauaucugccucuccagucuccugaaugcagucacuaaugucugauuuauauuaguguuggaguuccaucccacagcuucccgcugcagccagcagcgccauccucagucugcugcauuuuuuccugaagaguugauauccuuauuuucaaaguucauaagguuuuuaagcauuaaaguuuuuuauagauaucaauuuuaugauaaucuugaaaaacagucucuaaagcuacaaauucugaguuuugccugacagucuuuguuguaauagcuguguccuucugcuuauauuuccuggugucacuaugucuaaaucuauuuauucaaguaacaaaauuccuacagagacuucacaggaagaggacucauacccaaguuucuaguccucugaauuuuagcuaaguuuuuuuaauugaguuuucuauuuagccuuuuuuagcaucuuaggauuggcagagugcacaaucccuaaguuugauugauugucuccagaccccaggcauggugcaguccuuuguagucagcacagguuccagggacuggcauagaaaguuugagccugccuaguauauauccgacccugucucaaauuaaucagucucagauugucuaguguacacuugcaauacucuauuauuuuacacuuaaaacuucaggucucaauaggauugucuaucacagcuuuaugauuucaauuauauuucuggcuaaaaaggauauguuuaucauuuauauuugguugacuaaauuaaaguagaaauucagaaaucuaauuuauugauuguuuaccuuuuuucaacaguuuuaguuaguauaaauuauaggacuaacaaaaaagggagauuuuuuuuccccuuacagauuacuuuucuaguugaaauuguuuuaggcuccccugaucuuuaaaccuauccauucuguagacuguggugauggucuuuaaauaauccaaccuuuagguuuucaaaauugaguuuuuaaaagucaauuugcauauccaaauucuucauuccuugauucauuuuuggaaguagagucucacuuuagagcaggcauucuuccagucuaacccugcugaggugggagcagauuccuagcucacaguagggcuuuuuauuaaguagaaguuuaucagauguuaccacgacuaacaugacuaagcaucuuuguguuacuccacauaaacauuagguugauguggugcuagcuuggguauggcuuggguaaggaugucucaagugaggcauagggaacaaagaaagagccugagaaaucugggcauagugguguccugaugucagcauuugagagguggggcaggcagguuggaugaguuagaggcaggccucuuaaacuuagagugaccuguaacaaacuaacaacagcaagaacgccacagaaggagaacccaagcagaacaaaaacuccagagucuuggagaagcaggguuagcauguuagacaugaaugucuccaguaaauaacacagagcuugcucaugaagugugcagaugcucucuauagugggguccuauguuccuauccauacuuaaaaacauguagcaguguaugagauacugggucauucagcauuguaggggaagcuugagaaaucuacaagucucccagagugacugaaaggcaugugacagcaaugguuuugguggugguggugguggugguuguuguuuuaaaaggucaguacuacauauucugaaaauuuaaucaguaaaguaguuuggaaucuuuuuuuuuuuuuuuuuuuuuuuuuuugguuuuuuugagacagggugucucuguguagcccuggcuguccugguacucacuuuguagaccaggcuggcuuggaacuccagaaauccaccugccucugccucccaaguaguagcuuggacucuuuaauggaagaagacaguguuauuagagaacuuugguuaaaacuuuuuuuuuuaaaguguaugcuugugaguagugguaguggugcacaugugaguuugagugcccauagaggccagcagaggcuaucagauucauugcuguuggaguuguaagugugagcagucuaaccuggguacuggcacugaaguaggcccucugcaaaaaagagcucuuagcugcugagcgccauuguuuuaugaaagacacugcggucugggaaauccugacacucacagugcaguuuugcauauaaguuaaguuuuaauucucuuuaauuguaucuugaaaauaucuuaugcugaguaauaauuuuugguuuaauguaauuaaagcaguuggugaacugauagauauuaauacuaauguggcauauccaauuagguguauuaaugggugacaauaauggguguaauaauguuuucaucugugucucucaaguguuaggagucaaagcaugcaccaauagugcugaggaauaagcagaccuaggacucugcuccuauuaagcaagcauucgaccucuaaccuacacauuaagccauuggugugagaauacgccguuacugugcagucaaguguugcuccaaacuugcaguccuccuucucuuaagguuagggauugcagaucugcuguacuguaccuggccacagacuucugcucaaaauaagggcuagauguugucuuugaaaacaguuaaccuauauuaaaaagagugauguauuuuuaaggcguagguggaaaaccacugacuucuuuuugaucauggaaaaaaaaaaccauuuuauuauuacagaucuuaaaaagcauacagcugaugaaaauccagacaaaagcacuuuagaaaaagcuauuggaucacuaaaagaaguaaugacguaagcaguuuauauuuuacuuugugugugugagagaaagagagagagacagacagagauugaguguguggugaacauguggcuuuuaucauaggcaaguggaagucaggagacaacgggagguuguuuccuccguccacuuuuacaugggauucugguauauggggcuguaugcuuuuaccuguagauccaucuugcuggcauguuuuuauuagauuaggcuggaagugauaaucuuugucauaaaugauagaaaaguaucaauaacauacuuuauaaagugucuaaguucuuucucuaguaguaugauuacaguuaaaaugauaaguauuguaagaauauguugaucaaaauauuuauuucugacuuaauuauauguacagagccaguaauggaaauuugaaaauaaacgugaaugcacuuucuugugcuccagagaaaggcuuuuccauguuauucacaugcauauggucuuuuucauggggauuuucugauuucaauuaaaaucugucuacaaaccuugcauucauagguccucucaccagcugaauuuucuuuuucguacuuuuuauauuucuugaauaaauuuucucaugugaauuaaacuucauucagugaaggcuuuacacauuccuuaaauucaggaaguucuuucauagaacauucucccauugaaccagauccuaaccccaugcaagcuuugcauuccgaaggcucccugcugauguugagcagggcaugagcucuagcuagagccucccugccccacuucccagugguguuucuccgugacaguaacuucaguaaguuugcaccgugagcagagguguuccucaccucuuagcagugaaaguucccacacucuuacauucauaaacuguucaccgcguaaauucucaggguccaguuagacgugauuguuaaaugagagccuaguccaauaaacacaauuuugggcuuuuaaccguuauguguuuucuaauuuuaagaaaaauguuugacugauuuuuaguuuugaacccaaggguaaaaggcaggcggcgucuaagccacccugucuaguagccgucgcccuuguggcuguucggaaaugacugccguaugacuugagaggaaaauauaaagccuaaugcaaaguauguuucaaaccugagaauuuuguuaacaucaaguauuauacaggcuaacuguauuuuagaagguguaaauccugaguaagauguuccauaguaagguauaacaauucugaaagauuccuuggaauaauuuuuaauaucaggauguuuugaaggaauauuuaucugauucauguuucacaauuaaggcacccgcaugaaaguugggcuuugugacaugagauuuauuuguauacugauuucaaugucuauauuaaaagaaauuuuaugaaacaaccauuaauuuuccagacauaucaaugaggauaagagaaaaacagaagcacagaagcaaauuuuugauguuguuuaugaaguagauggaugcccaguaaguagcuuuugucgauggccauugaauuuucuguuuuagugagguuucugugguuugaauguaaacagucucaggcugcagagaugccucuggcuaugugcacuugcuguccacugacucacuaccuaugacuccagcuacagaggacuggaugcccucugcuggguucuagagugcaguaagcuacacagagaaaacauauacacgaagagacaacaugcauauaaacagauuaacagucagagugccacuuuugaauggcagcuuguaaaagcugcuugauaacauuugacuacuucuuuacuguucacaggcuaaucucuuaucuucucaucggagccuggugcaacgaguggaaacgguuucccuuggugagcacccuugcgaccgaggagaacaagucacucucuuccucuucaaugacugccucgagguaaauuuguacucauugaaguuuaacacugcuguauuuugugaucucccuaauuauuuaaaauaaagcuuuaaucgaaguacaauauagaaauuugagguauauucaguuauuuuucaaaaaaaaaauugcugauuucauaaugcggaauacuuuuggggagaaagucuaauacuaacuuugauacaaauuuccagaaugcaaaccaagucagaauuccuuacaaguaaauuagaugaugaguucuggggaaccuuguuuuuauguauauuuauucaagauacacaaggugggguuuuguuuuguuuuguuuuuaaugaaaauggaaguaggcuuuagcagcuaagaugaaggcaauugaggaacuaauuugcuaacuuaguacugugacuccuugauuucucuuuccuauguugguagugucucacucacucuauagccccaaacuggccuugauuccugggcagcccuuccacuccagccuccccaagugcugggaugacagcaugagccacagugccaaauugaagucuuuaaaauaagguuuuagugauaagauguaguaauucuaauucuaaaacucucaccuguguauguucaguauuuucuuuccaaugguaccccacaggcaaauaaugaguuuuuuaacaauuagcgaauauaaugaggggauguuucuuaggguuucuauugcugcaaugaagcaccauuuucaaagcaaacuugggggggggggagggucuauuuggcuuacauuuccagagcacuguucaucaccaaaggaagucagggcaggaaccugaggucagaagcugacucagaggccacuucguggcuugcucagccuccuccuccuccucuucuucuuuuuuuccuuuuuaagagcccaggacuaccagcccaggcauggcaggaauagcaccaccgacagugggcuggacccucccacaucggucaccgaggaaaauacccuauaggcuugccuacacccugaucuuauggaggcauuuucuucauucgguuucuuccucucagaugacuuuagcuugugucagguuaacauuaaacuaucuagcacagguagaaaggaauacaguguucuuuauuucaaaaaagaaaagauguucauuuggacauuaacaagaauacucuuugacauguuuguuccuggguaacuuucuguugcccucaucaaagugucugcgggcuuugcuuuuuccuuuaaguccgugcuacuucucuuaaagagcuccucucuuccauuaugcacauuauuauuuaaaguauaaaacacuagcagucuuagaaaccacagcaugcacagaguggauuaaagggcaguggaaucucaaggaagaccuaccucugauaaagggccuuguacuuagagguucagaagugauacuuucauuuagcuaguaauguuuaaaagucacacacugggugacugaauugcccgaaucucacccugcaauaaccacucagccugcucugcuuuugaaaacaaggucaggugucaaucuuaaucccauuuuaccugaaggugcguucauuagcaggggccugacugguuuucuuuguuucuguuaauaguuuuugagguuuuuuccuguugaaaucucuaggucugcuggccucauuuuguuagguuggguuauuuagguuucuuuaacaauugcuuauggaauuuaucuuugcuuuuaguacagcugugauuuguuuuuuaauuuuauauccccuucauauuuuaccauaauuggcucccaagaucccuugugcuuuaauucuuauuguggccaucucuguaccuuuucaagcccuggccucagucucuuaaccuucaugaguccagugacuuuuuguccuccuccguucuagucaggguuaauaaugcugugaugaaacaccacgaacaaaagcaacucagggaagaaaggguauuuggcauguauacuuucauaucauuguucaucaucaaaagaacucggggcaggaaccugaaggcaggagcugaugcagaggccauggagagugcugcuuacugccuugcuccacaugacuuggcucaguugcuuucuuacagaaccuaggaccuccaguccagggauggcaccacccacaauagaccaggccgucccacaucaaucacuaauguuuuauaggcuugccuguagcggaguauuauggaggcauuuucucaguugagguucccuccucucugaugacucuagcuuguuucagguuaacauaaaugccgucagcaguccuauuagcuucuaucucaguagcuugacuagaaacggcuauuuguucuuguuuauauuauuuugagucuggcaaggacuggccuuguaaucuguuugccucuuccuuuucagugcauucauuaccaguauguguacccacagcccagcugcuuuaguuuaagacaggaucuugcuaugccuccuaggcugguguaaacuaccucagccucugaaaugcuggauuagagacaugugucaccaugccuguucagcuaccguauuucugauaauaaguuugcacuucaggauucauacuccuagguagacccuuaguauuucacucacuuaagaaaaauaaaauucaguaaaauugaaauuaaaaaguuacuuuuaauacuucuauauaauauaaaaccaagagcaaucacuauaccuguacauuaagaacaguugaauauuaguacaucuguauuuucuuaaauaugacagaugacuuugaggaauuuauuuuccauuugaauauuuuaucugugcuuuggguuuuuauuuuuauccuugguuuauuaguacuuguacuaucaauuuuaauacucuucuuuccuuuuuaaaaauuaaucuuaaaauaauauauuucauuuagccaaacaaaaagaaagcauaucuguucauugcacaggaaucaguauccgcugcuuacuuuucacgauaugugugugagccuuuguauuuguuuuauacacaaaugcauauauaauuuauauauaagauauguauauaauuuauuauaauauaugugugacauguggaauagacacaucugugucugcuuuaguguaguuguaguauacugacuaccuuaucuuauucauuagcucaauaccagguaauacauuuuuaacugugucucucauauucaugaugaccgaucucaauucaaguacauauuuauguucauuuaguguuaauaaugccuuucaguaaaaucugaauuacugcaaaggagauuucuucuuucuuuccuuuuucuuuccuuuuggcaaaaucucacuauaucacgaaucacaagcucuuucugauuucgcucuucuccaguucccuauuucuuccuuuugcauggguauccaguuaagguaaaguuauagccuaauacagcacuguggauuuauaauuccuauugcuucuguguguguuguuguuguugcuguuguugaucuguugagacagccucacuguguagcucgagguggccuggaacugaaagucccgcucuccugcagugcccccuagagcugggguuucggguggaugcuuaucuuucugcagcuucccuuuggcaggcuucuguaagcaagccugaggacaggaccgaucucacacuucuuguguguucuguuacuaggagagauuucaaauuuuuuaacuuaaacuaaaauuaacaccauuuugagcccuagacuccugccccagaacaacuguuccccuguggggcugggacuguuauucuagaccucuguugcugucccucguggucuuguccuuucaugcucuggagucucucugcgcucucuaucccuaggccugcuuuucugauugugaacuuuccuaauauggacaugagcaucuggcuacauaauuacaugugugcuuuuucgucagucucuugcuuuuauugcauaguaacuggcauggcuaaucuucagauuaguugccuauacauuuaugugauugacgcuguuauuuuuaaauguuugaaauuuggcuuuauuacaauaaugauugacuuucccccuacaaucagauagcaagaaagcggcacaagguuauuggcacuuuuagaaguccucacgaccgcacccggccccccgcuucucugaagcacauucaucucaugccucuuucucagauuaagaaggugcuggacauccgagagacagaagguaagcucauggaggaagcguuccuuaacuuaacucgcuuguccucguugagccuuagcuuuauuacuguaauuucucuauguauacauuaauguauccauuuucuucacacguggcuccccaucagcuccuucccuaggugcagacugaugucuucaugguuucuaaugaaaguguuacaccaucuugaggaauauccucucuuaaaagucaaacaacuuuuacauggcuaugcuuuaaaauagcaccuuagcuugucuuauucccacaucaaaacuuacuaauaauucuucaaaauccaacauaaacgaccaguuuuauucaggaccauauauuuuaauacuuuuuuuucaccaauggugcauuuuggguucuuucuuuuucccauuauguauggauguuuauuuaguguccaugucugugugccucauccauacagugcucacggaggccgacagaggacacacauccccgugggaguggaguuaagauggcugugagccauguggaugcugggaaugaacccagguucucuggcagagcagccuaugaggucuuaaccacugagccauuucuccugcuccaggaaugucuuuaagauuugggaaggggguugugggagugauuacaagacgguccaauguguaaaggugccugcugccaagagugaccugaguucagucucugucacccacauaguggaggaaaagaacucauucccacaauuuguucacuaaaguccacauacucuagcaugagagugugcauaggaauagacaaucacaccauuuuuuuuuuaaagaaaagagagauuauuaguagauguauaucaaauaaauagcccacaguaucugguaacuuggcauaggauuaaguacauacacauacauaugaaaaagaugggugucuuggcucacuccgauccuagcauuugggaggcagaagaaagcagauuucugaguuugaguccaguuauagguacguaaugagucacucaaaaacaaauaauaaaauacaaguaggcauguguacaugugugcuaguuuucucuugcaacaagaguccugagauaaugcauuucuaaagauacuuuggcugaugauuuuggagaguucaauccauucuuuggucucacugcugugaaugguggugacaugguucaucaugucugagagcacaugauggggccucauggcugagcugugaaauggcauguccuuagccaucuagaaccucccacucuugcccagcuggagacugagccuguaaacgcuuuuggugacauccugucccaagggaaaguuuuccuuuuuuaacuugacuaguauuugauuuuucuguaggucugaaaaggccccacuacacaucuaccuuaaguugugcuuucuaguuaagcaguacuaguguuguguggucauggucuugguuuaggaaaucuuuucuuuuuucuuuaaauaaaugaagugcuuuaggugaucugcuccugaguuuguaagacaugagcagcuccucuuucuccuguguguugcuacuaaucagacccagggcuuugcaccuacuugucaauuccccuaucccugagccacuucuccagugcacaguaacuuacaaaacugguuuucaccuguucaauucuguuuuguagagccuaugaugaggcauuuacuuaaauuugguggaguugugguugugaaaguguucaaaacacacgagugaguaucuguaagaugcagaucagggagauagagagcacuugauuaucugaguucagucccagggacccugugcuggagagagcaguccucccacagcugcccuggccuccacauggucauucauuguaauuuuaaaauguuauuuuagcaucucaauuacaaagcaauuauguuuugauauuuguacccuuugaauuugauuuauguauguuagugauacaugcucucauuuuacuuuugaaauuacuagaaugcuaagcaauguuaccuauuuuuuauuaaccuaucagugagacacuucacagucacagaacccugcuuacuuguucucagguuccuuugguugcuaauaugugguuaauucuucccagucuucaaaugacugcacugaugcucccuuugaguugaaaaaagcagggcagagagaggagggaggugauuuugguguucgguggaaacgaaugucuaauagcuaaggacuaacauuguuuaugguuguucuggaacccuagauugucacaaugccuuugccuugcuuguaaggccaccaacagaacaggccaauguacugcucagcuuccagaugacgucagaggagcuuccaaaggagagcuggcugaagaugcugugccgacauguagccaacaccauuuguaaggcagaugcuguaaguucuuaaaccugugucacauacaggugugagcgugcacagugcaaccagagugaaugacuacauuuccaguggccacuuaaucauacaucggagagagccuuuaguuuuacucagaauacugaaaaccuacguuguuuccugaaggguuuuuaaauuuuuaggcccaugaaauaucccaagucccugauucccagauggucaguuuuaacuuucuagcucuguggcugcacuuuuauagugaggcuuuugggcacuuggaaugcacggugugcuuuuuguagaugcuuuuccuuuuaaucagggaguuuaguagauuuauauuaagguaauuuugcauauguaaugucuuuuuguuuuuuggguuuuuuguuuguuuguuuguuuguuuuuugucuuucgagacaggguuucucuguguagcccuggcuguccuggaacuguguagaccaggcuggccucgaacucagaaauccaccugccucugccuccugagugaugggauuaaaggcgugcgccaccaggccuggcaauauaaugucuuuuuuuuuuuuuaauuuuuuuuuauuacguauuuuccucaauuacauuuccaaugcuaucccaaaagccccccccccacacucccccccacacuccccccccccacacuccccuacccacccauuuccauuuuuuuggcccuggcguuccccuguacuagggcauauaaaguuugccugaccaaugggccucucuuuccagugauggccgacuaggccaucuuuugauacauaugcagcuagagucaagagcuccgggguauugguuaguucauaauuuuguuccaccgauaggguugcagaucucuuuagcuccuuggguacuuucucuagcuccuccauugggggcccugugauccauccaauaguugacugugagcauccacuucuguuuuugcuaggccccagccuagucucacaagggacagcuauaucacgguccuugcaacaaaggcuugcuaguguauggaauggugucauuguuuggaggcuaauuaugggauggaucccuggauauagcagucucuagaugguccauccuuucaucucagcuccaaacuuugucucuguaacuccuuccauggguaauuguuuccaauucuaagaaggagcaaaguauccacacuuuggucuucguucuucuucaguuucauguguuuugcaucuuguaccuuauaucucgcuauacuaaguuucugggcuaauauccacuuaucagugaguacauuucauuugaguucuuuugugauuggguuaccucacucaggaugaugcccuccagguccaaccauuugccuaggaauuuuguaaauucauucuuuuuaauagcugaguaguacuccauuguguaaauguaccacguuuuuuguauccauuccucuguugaggggcaucuggguucuuuccaguuucugucuauuauaaauaaggcugcuaugaacauaguggagcauguguccuucuuaccgguuggaacaucuucuggauauaugcccagaagagguauugcgggauccucugguaguacuauguccaauuuucugaggaaccgccagacugauuuccagagugguuguacaagcuugcaaucccaccaacaaugaaggaguguuccucuuucuccacauccacgccagcaucugcugucaccugaauuuuugaucuuagccauucugacuggugugagauggaauaucaggguuguuuugauuugcauuucucuaauaauuaaggauguugaacauuuuuucaggugcuucucagccauucgguauuccucgggugagaauucuuugugaauucucacccgaggaauaccgaauucucaggugauuaaguuagccucuaucagcagaccugggagacuagcucuauccuuaguuucaguggucagaguacucucugcaugcaagcucuccucuugcagggauggugaucagauaucugguguuugaaccugccuccugguagaaguuguguuccacucaccagaggccuuaggaucccguggcugauccuguguggguccuugcggguguccggagacuccccugggccagggaccacggugcugcagugggccggccggaagggacuugagccccauaucaggccggguuaccugcuuccuuaauuacugcagucucagguccugugcgauuggauuggagcaggcgcuguguuccacucaccagaggucuuaggaucccguggcagauucuguguggguccuugcggguguccgcagacucccccaguccagggaccucggugcagcagugggccggcuggaagggacuugagccccguaucaggcaauauaaugucuuauguagcuguuuuacaaguuguuuucuaacuuuuuuuuuuuuaauuaaaaaaauuaccauuuuguguucaccaguguuuugccugcauguauguuuguggccugacuggacuuggaguuacagaugguugugagccaccaugugggugcugggaaucacacucagguucuuugaaagagccaccagugccaucucuucagccccuucaaaugaaaacccuucugaaauccaguaaugaaagucuuugcucagcggugugccaaaguuguugcaagcucucuucauuccuguuuuuuuucuuccugugacuguacuuuugagauggccugccuuugaacuuugaacucaguauuuuauuuuuguuauuugacuuaaccugacauugaugcuuuuuucuguuaucuuuguaacauggugaauuuuuuucugcacagugaucuuuuuuaauugcucccaucacuauuuagugucugcugaguguugaaucuuuucugucuucuugaaacuugaguuuucuuaaaacaguuuuucuuaaguuguagaguguguaguccauccuaguggugaagccaaggcaguaggagcucugaguggcuggucacggccucgcacagugaggaggccgugaugcgugugcucgcuuuuccuucucuuuccauaggucagcaucccagcgugcugcagcagaagagugccacccacaguagacaggccuuaccacauccuaacccaaauaacccuccaaaggccugggcuccguaggaucuggcucagauuaagcauccuggugguagaggcagucuuucugcuguugguuagcaugguucuucaguauagccccugguuuuggaacuuugcucaguauugguuucaucaugguaugcccuuuggugaguuucaaguccagggccugaacuuaauucuuccuaggccagaggcaucuucccccuuugcuucaaguggaggagagagugcugcaccuugccucuugguuaaguuaaaagcagacacuguacccacucgucugacuuuccuuagcacuuaggaugaccuuguuuccuaucacugugccgucuugcuugccaccucagccucuggcuuccuucgcuccuaucccguaauuuccaucggccuucuuagguauggauaguauuggcagaauauuccucuuucaaaaugcuuggaaccaaaagugucucacauguuggcaaaguuuuucagaugugggguaucuguagacuuuccuggucagauauaucucucgucugaaguuaugagacaaguugcuccaagauucaguauuaagugcacacugcuucauggagcauuggauuaugauuucacauuguuagauuaggggagcuugacuguaguaaaagaaagagcauuuuguuuucuuucuuacugaaagcaguaccuuucccgacacguugccuguccagguuucucacagcaacucuuaaaguaccuuuauacuagacagauuacaaugagaugacuggaaguaaaugaauugccaguuauuugagauucuaucguagcucuuggaugaauucaaggccccuuggaagauaacgugaucuugucagguuguuagauagagagcccuuacucugcagaaaugauacagcgaauagaucuguugcugaaagaaauugacacuguguaguaauaguauuaagaguuucuugggccuucccaggggaauaacauuuuaccaaauuuacacuugccuuauaaugauauuacauauaucaggguaaguaacagaauggcuuaugcagucuuuucuagguggauaacuuuguaacauugaaaugcaaagcuaaugaaaaguuuugcuuaaaguguaauuauuggcuauaagaugaauaaucauauuagaacugaacuauaagcaacaaaugcagaaaauuucagauaauauaauuauccacaagauggcagcaaacauuuaccuauguucugauacagcacaaaauuauuccaguuuguugaaauuuuuuugccuuaagauuugcuuaugcauugaaaaauuuggugacaucaguaagcucuuuucugaguuuaaggcuucacacauaguaaaauaauuuaaagccccucauuuaaugucuuauuugagaauauuuugccauauugaagaaaguauguuucuaaauauguauguucaaaugauauaaauauauguacaacuggucauuuuuaaaaaagcaauucugauuuuuuuuaaucaauaguuuuugacuuuaaaaaaaaaauucccuaaauaauagcugcuugcucauuuuguuguugaagucuccuuugguauguaaucccagggaguccucagaccuguuaggauuaccacaccagcuuaaggcuguuuaacugaguaaaauaaguaugauuauuuuauuguauauacuguuucauuuauucugaccauuuguaaaugaguuaacaaagcuuucaggaugaaagaaaacuuuaaaacaauaugugugaaacuaaagccaagaauaauaacugaugguuguauagccaacucuaggacucaggcaucuuuauuuucagucagaccuuuuaucugugugaauuucaggcuguacccuagucccacucuuuucuucucguaccugccuuucacccuuacagccuccccuacaacagagaaaaaaaaaucuugugggagcuguaguuuuucacagugugucucacaguagacucuuuugucuacauuucuuugcuugcaaauguucauuuuaaugacuuugguuugggucaaggcuuuugacuucugcugaacuaucaauauuggaagcacugggacuccucucaaauauccuguugucacccugugucauggggauccucugguuuugggucuauaggacugguccccucaugcacuccagcaguuuauugcugggguagauguuagggagggcaaauucaaaguccuggguugggcccugagcuggccugccugcugacuuuucagucucacuucauugggccagcucuuggccuuccacccaacccucaucagggucagcucuacucuuguagcaggugaggaguagggccagcucuccuuaugcuccuccucuggcuagcuuaucugcaacuacugcauuuuuauggggaagggugcucauccaaguauggcaucaggcuaggguugggggucagcucuuuuacuuucauaacccaaaaaacaguucugcaaacccucagauaucaacaugucccuaagaggcagcccagaucagggacauccaccuggccuuugguaacagaccccugcugcugcaaggccaccuacccccccccccccccaaaguugcagcacuguccaggauccaggugacgucacuggccgcucacaucaggcuguuccuaccccugagucuccaguucugucucuucauugugcccacguccuuccguuucucuuucucuuccaagucuccaccaccuacuugcucuacuuaguggcuccuuggucgcugagugucugggguuaucucugaaguggucucaggagcacgugcucugcccagcucauguguuauagugcugggcagggguccucucaggcauggucuacucccccaggccuuuguggugccagacuggugcucaucuaaggcuagcucccugaccaggcccuaccggcacuggucugguggucagcuugggcucaucuccuuacuggguccaccugaguggccccauguaaggcuaaucugucgugggcucacuccugcccagggcucaugguccuagguguaguucuucuaguauccaguuugcuuuccacccuggaugcccaucugggccuuggaggugccagacuggugaucgucucaagcuagcuccccaucuggcacuggacuggugaucaugccagacuuaguuuuuuucagggaauguuaaggaauguuaaucaaucauuuaaauguucacaaaucagaacagagugaagaaauagccugucucucugccaccuacugaugcacaugugacauagcagccacacuuguaggggcagggcagucaaaucgcuguguuaucucugcuuccuaauuauaugauuccccauguucuguguuuucagaauguaauguguaaaguuuagucugcuuaaaguguuaacucagaauauauacagcaacguuuccagucucuucccaccauguauauuuucagucagggagguguuuuuuugugacacacauacacacacacacaaacacacacacacacucauacacucuacacacccuauacacucuacacacccuauacacauaccuuuaauaccaaugguauaguuuuaugaauacaugaacuuaagcauuguuaucuuuggccaauauaguuaagucuagaagaaguaacuugagaguuaaaugcuguaugccauuauuuaguauuuuugacacuaacucagaguuucuaauaaaaaauaaaaaccguauucuauaucuuggcaggagagguggcucaguggcuaagaguacuggcuguucuugcauagcacucaggugcuguucccagcacccacaugccagcuuaaaacacucuguguccaguucccagggauucaaugcccauguccaucuucugugugggcacuaggcaugcauguaguguacacacauacauuuauucauacaugcauauaggcaaaauacccauacacauuaaauauauucuauaucuuaacuuuaauuauugccacugauugcuuaugaauaacaguauuuugauuuuuuaauaauuuuguaagcagaauuauaacuaaaggggaauagacauaggaacuguaggaagauauuuauucuugugagccaguauuauuuauaaugaaguuaauauaugauuuuuauuaacuauucuguagauuauauauaagaugcauauaucacuuagaauucaaaacuauuggauccuaaauguuaagaucccaaguauuccagauuuuagauuuuuuucuacauuuugaaauauuugcauauguauaaugugauaaauuggguauuaugcaaguuuaaaccugcaguucuuuuguuucuuauagucuaaagauaauuuguuuugugccugugggagccagggaguuaagcuuaaggaagggaaagaaggaggacuggguaacucauguguuagguacuuuuaucguccuuagauaccagaaaugugagaucagucugugugugcacguuaacuagcauuccuguguaaacuuguaagccauaacugacucccuuucacuuacaguuggcucuguaccucaggagaggcuaguguuuuucagucguaaauucagcacuuguuucuguguuccucuggggucuauaggcauugggcgguaauugaaaaacugccuucccauagcuucuucucugugugacacacuugacucaacuguaaauguuuucagaauuacggaauuauuucaggaaauaggagcugagcuuugcuuuagauuucguucauauuuuauuugagaaacucagagaaaacgauuaaaaauaaaggauauuuuugaaagugcuguaauuacuaaugagagguaacaggaucucccccacgagcacguuugccugcuccucucacuuuucuccauguuugagagcugggagagugcuuccuuccuccuuggaucucagcgaacagcuuguuguuauucaguccucuaguggaguaccugggcauuucuccuuugcuucaucuugaaggaaagccuucuccgguugcaaaagagcuuaugguuuaucuucucaacucagaaggauuuauuucuuugagaaaauaaccaugaaacuacuuucccccuucuuaguucuuagguaguuauuauauacucauuaauuguuauagcaaaaagaaaagguuuaaaaaauaaaugaaagaauuaaagaaauaguuauugcaauaggaaaauagaucaugaacuugcuaacaccaccuuuuuuguuuguuuguuuuuguuuuguucuuugagacaggguuucucuguguaguccuggcuguccuggaacucacuuuguagaccaggcuggccucgaacucagaaaucugccucugccucugccuccuaagugcugggauuaaaggcgugcaccaccacugcccggcgagacaccacccuuuucacucacuuauaucaauugcuacaguuuauuauuugugugucaauguuuugccugcaugccugugcaugugugugcagugccuggagaggcccagagaggccaccugauccccagaaguggaguugaaagaugaaagucccaugugggugcugggaaacacuggguccugagggcgaucaguagaugcucuuacugcugagccagcccucagaccccagagucuacaguucccagcuccuccacuguaaagagcaguuuacagaaauggggcauagguggaguuugcuucauuauaugaacugaggcuuuuuuaauucaagaaauaaauuuuaguuauauauuuaugcuaugacuuuuuaaaaaugauauuuguacauaaaaguaaagacaaauaaaauagauacgcugcaguaauacagcauaccuuuucccuaucccauuggucuuuccguucaggagugugugguuuuguuaugcuuuguccuuccagaaacaaaagauuagguguaugcuuucuuugaaaauauauguuuauuagaaucaccugggcgauuuucucuauaauaucaugcauugguaccuagguuguuucugguuuucuuucuuucuuuuuuuuucuuuuuuucccuguaaauaggugaaucucuaauacauuaaguuuuuggccagccauacuauuuuacauaguccuuguucacauaauuuucuacuauucuccauuguaauuuucagcuuucugauuuuaaaacagugcugcaaguugaacaagucaaaugcacagaaauuauauuuaaauguuuggacuucccaaugaagaguaggaauauguguguguugaugccagggagucagucccuggcaucuuuuuagccaguaguacgcugcacaccaucgugguccuucuguaagguagcauugugguuuuguuugcacagcuaugaaauuacauccccguugggaagcagcgcagcgcuucagugcgcacguaauugguggugcuauguguaaagcagggcagggagcagaaccucacuguuaccuggagcaggagguguguggcacucacuuagggugccagucacugcugaggagauuagaggagccucagaccuguuaggaccuucaacuguuugguaaaguagugagagcacacgccugugucaguaguuauccuuaaugacaucucagugucaucuguuaggaaauguguaggaaucgucuguuaagaaacaugcaagcuauuuuaagauguuuguguuuggcuaggauuauaguucagugguagcaauuucuaagaccugcugucaauauccagcauaaaaagaaugaaacagaaaucugcaguauugagcccuugauaagauauuccugagugagaauguuaauaaacagguguugauucaucuucaguuaguuuauggauuucuuuugucucuaaaauccuauagaaaacuuuuggaauuugacagaaugaucccuaagagaauuucuaaagaaaauacaaugauaccuagaaauuuuaguagugcuaauaccauuugaaauaguaacuuauacuuaagguuugauugggacguuuguuuauuugggagaguggauguggauggcacugugcacuggagcaggaagcccagaggauagcuugugggaguguguugcuuuuccaccacaguugguucugggaucgaucggauacaggcaucaggcuugcagacagacgccacacucacugguuucaucuuucuggcccugaaauuguacuuuaaaaagugauagugaucagaguguaucgcccuguuuuaacguuuauacaugaaccuauaggaagaggaaacuuacagaaaguaauuuacacagauggguauuuugccguuugugugucggggcauucagugcacagggaggccagagggggcauuggauccuaggcacuguaguuacccgcgguugggaacugacagguggggguuuggaaucaaacucaggaccucugcaaagcaguccucuuuacuacuguugggccauuucuuuagcuccagaauacauggucuugaaauaaggcugucauauuaguguagacuuuaauuaaaguuauuagcccauggcacuacaacaagaacuuagauguauauccuauuucuuuccacguauauuauaaauaagugugaaaagaugagagaccauuucaaaagcaaauauauguggcauguauuaucucuuuuaagcaguaaguacuugguaagacaggaggaacauaaguuacagaguuuaacaaaagagguguccauauguuaauaaggaauguaaaauaaaaauggacaaaaauaaguaauaaaauacacuuguuauuuuuugacuuuaacuucccuuuaagggacauauaucuacaaauacuguuaucuguuggagauuggauuagucuguaauuuaacagaugugucaaaugaaacaagugguuugaaggcggccaaaugacuuugucuuguuuuuaauuuuaaaagguucaucuuauuucuagcuauaugcauguagggcaaauaugugcgugugggggaggcagaggacagaggaacagggcagaugggagucuuccaaugggugcugaggacugcacgcuggcuucugcuacagcaguguaucaguuaaugccugggcgacaucuucggccccaagugugaagaaacgugaagaaacuaagaaagcuuuagcaaaauaagcuguuuggcugcuaaugguggagagcaaaauaggcauacauaguuaacuuuuguuuuauuuuaaauagccuuuuaaaauaaauagccauuguaauuguaggacauauuguuuaauaauuugcuuguaguuuggcauuucagucaguucugaguuuuaucaggcuuucuccuuguacuuuaaaagaugguauucacaguucugcaguuacaggccuggucaugcuaacuuguggcuucucagugccugaagaaugaggucauugaucuuuuucagucuagauuuauggauuuaaaggggaaacccuucauaggaauaauggguagacuuccccuuugaaaguccaaaguaauauuuguaauuauuuggagaagggcugucugguacuuuagauguugugagaucugggaaaauggagccaauaaaugaggagucucauacaauagcuuuauucagagcaucagacaauuuauaauaacugaagguuaagaacaguccugugggggcuggcgagauggcucagcggguaagagcacugacugcucuuccguagguccugaguucaauuuccagcaacaugguggcucacaaccaaccaucuguaaugagaucuaaugcccucuucuggugcgacggaagucagcuacaguguacuuauguauaguaaauaaaucuuaaaaaaaaaaaagguccugugaguaaauuguacaaucauacagauaagcuccaggaggcaaaaacaugguuuuccauagagacauaaaaacaauagccaguuguacugaaaaaucugaaguaaacucacucaaauccacgcaccugggagggacacggaaacacauucuaagaacaaguccguguucugaagaaacugaggucagaagacucuugaguugcuuucuuggaguuuucucacaagcacucagcauuccauucacaugucuccauucuuggacguguucugacaaagguuaucuuguuuuaaggguaauuuuuggugcaugguucuuugcuugcucuaggagggcuuuugcuccuuggggaauguacucuauaaucugugaacccucuuuuuuggaaagagcacuucacucauauuuacacaaaauauuugcaguuuccaggguguuacauauacccugauaucuagcugcuuuuuccguagggacucaggaugucgggccagaacuucuaauuuagauuucuuccagacacaaacugaggaagaaagucaggugugcgucucuuaagggaagugugugguuuuuuuuggcuuugagggauaaauuuaaaagaacauucacuguuuuaaauaauguucaguuuuaggguagguaguaagauuuuguauggauguauucccuguuugaauuauguggucuauaguaaacuguucguuuacauaauuauuuuucauuaucuccaaguuacuguuuuucaggguagaaauuaaguacacuguugucgauagugggguaggguggcacgauggucagauccaggacauaugugcuuuaccacugagccacauccuagcccaugucacacgucugagguagcuucaucuauaaauguuaccaugugugggaaugggcaugagugcuuaaugguuugauuuuagaaacaguugguuuuugaacuuuauuuuucaacaggagaaucuuauguauguggcugauccagaauccuuugaaguaaauacaaaagauauggauaguacauugagucgagcaucuagagcaauaaagaagacuucaaaaaaggugaguucuagugaaauucugaggauaucucuaaaugugcuuuucacauuaaauuaaaggaacguugccuucaacaccaauaacagaauggucuagagcuguugugaggaccugagugaguucucucuuuagaaccuacggagcugcggcagagucgggagcacuccuggaguuuggugucagcuaguguagccgacuuggugaaguccaugcuaggagagaucccaucuuuagcaagaaaaaaguagaaagcaccugccugauacacaucagggggcccuguacuguacccgcauaaguacacucgugcaugcacguguaaacacacaaacacacacauaccccaguuuacaacaaagcugaccuacaguacuuggaaaugacucacagauuacauuuuauaauggucagugacuucuuugucacagugcuuacaaauagcuugcuguugcauucuuuuuuugguuugguuugguuugguuugguucuuuuuguuuuuuuuuuuuuuuugagacaagguuucucuguguagcccuggcuguccuggaacucacuuuguagaacucagaaauccgccugccucugccucccaagugccgagauuaaaggcgugcaccaucacagcccggcuugcuguugcauucuuguugcagugacuauuguaugaaccagacgugagugaguuguuggugauuuagguauaagugcauuuacauucaucuuaaugcccaaaacaguuuucagcaaagcaugacuugaguuaggaaaucuaggcucuguucauguuaucaucuuauauuaguaacggaaaguagaagugagcugggugugcuggcgcacaccuuuauuaucaguacuugagaggcaggcagaggcaggugggucucugaguuccaggccugacugggcgagguagagagaauauguuucaacaaaaccaaaaaagaguagaaguagaguuucagagagccacagagcacuugcagccuuagagcuguguuuuguucccuuugagagggaggcccuguucuaccuuuacauacacccucacucaacaaugcagcauaggagacgaccuagacaguaugauucagagggagccuucacuugcacugaaggcacuaggguuuaagugguguuggauuacacgucuacacugugccagaguaagagaaaacccuuagcagggguuuagcugaggauaaagcuuuuuagcacacagaauuccuggguccaaccccagcccuacaaacaggaaaacagaaaacaagcaccacagcaagcccuaaguucuugugucccaggcuagcuaccauccuuuuuguggaaagugauagauugggcuuucuuuguguagacacauuuuuauggaccaucuuaaguuugucuagcuauaacuaauguuaauacuuuuaaacuucagguuacaagggcauucucuuuuuccaaaacucccaagagagcccugcggauggcucuuucaucaucccauagcucagagggaaggaguccuccgagcaguggcaagcuugcugugagccgucuguccagcacaucauccuuagcaguaaguauuggguaauguggucaaggccuugcuuagaugcauagguugcugcacuuugauaauguuaagcaaucuauuuuuaaaaaacuuucuaaauuuuuuuaauugaaaguuuuagcuuagcuuacaaaguaauggaguuguuuuacugucuaaaccucuaacuuuuauuuuacuuauaaaagcaauugaaagauccugccccccucccaauuuuuuuggggguggugguggugguagacagggucuauguagccuuggcugucauggagcuacuauguagaccaagcuggccucaaacucucaagaugccugucuaccuuagccuuccaagugcugaaacuaaagguaugcgcucccaugcccagcuaagagucuccuuuuauuggguuagcuacauaccuacuauguagcuuauuggaugugaaacuuuuacuauaacugaggcauucuaauuuccguaagaagagaagcuuguuuuggccuggcuucuuacuuuauaaauguuauauuucuguuugaugaguuccaguaacauuggacuaagguuuauuuuuuuuucaauuggcuugauguauauauacuaaaguauagaaauuucucuggaauccgaagucgggcacauacuuaaguguuucugaacagucugcaauucaguuuuagaaugcuuaaggcaccguccugccuccccagcuaggggcuuuagaauuacuagaggaaaguuacguauugucuuuucuuuuccaaauuucaaaaaaacaaaacaaaaaaaaaaaacccguuagucaacacugacauuugugaagaauuaggagcuauggcaaacaguaauggagacaagucucaugaaguuuaaugggagcucauuguauuuauagaagaaaagaaaacacuuucuagauccaaucucuuucuguggguuuggucuucugaauucacaacuuuacuguugcuuugaauugauaguaaguuagguuaaauagguuuugcauauugccaaauaaagaugguuuuacaaaaauuaaguucacaagaagcagguuuuuacaaaauuucucuuaggagaaggaucaucuaaaggagaaugguauucuagugguguacguccauuguggccuuuucuaguaaaucagaccucugcccggggaggaguuccuguggaagcccuuguaucacuugagugcaaguguuuuagugcuuuuacucgccuggauggggacagagcccguuagcuuacaagcccugaguuuagauauaguuagcuguuuauaugcauuuuaaaaagguagacuuuuaguuuaucuugauuauacccacucuugggcuuuaagcuucugcguguuuugggcguaguuuaagauucuaacgaugauuaacuuugaccuuugaaagaauaaguuuagauugcucagcaauuuaauaauuauuguuacuuagaaugcugcaguucuguucgguuuucauguggagugaaauauacacccaugagaaugcacaccuauacauauaguaguugggcauauaauuaauacaacacucugggaauauaugacuuaauuuuagauuauuuccaugaugucauuuuuauccucucuaauuuugcuuuaaaaauuaagaagaggggucuggagaagggggcucagcaguuacaaacauuuccugcucuuucagaguacccaaguuugguucccagggcccauaugacauagcacacacauacucacacucacacuuaucuuuaaaauaagaauucagagagaaucaauaggaugacucaggaggucuaaggugcugccuccaaccaagccugaggacccgagguuuuaacuaaagaaccuacugacucucacagacuuaacaccaagccaucaguaccucauagaaaagccagcgacuucucgggaaguuaauuaacaucugcugaggccuagucagccaucacugggaggagaggcccuugguauugcgaagaucauaugccccagcacuggggaaugccagggcaaggaagccagagugggugguuggggagcagggcagcgggagggcauagggggcuuugaggauagcauuugaaauguaaaugaaggaaauaucuaauaaaucugcugaaucagucaguugucuagcuuuuguuugagaaugcuaaacuaguuuuaguuguguuuuauuccgacuccauuccucugaucauaaguuauacauuuaaagagucuggaacuguuagugucuugauugucauguuaauaguagaaggggagaauggcaggcauggcugugaacucugcuacaaguuuugagaagaaaacuguaaauucuauuugcuuugucuuuuauaggguauuccaucucccucccuugucagccucccuucuuucuuugaacggagaagucauacauuaagucgaucuacaacucacuugauaugaaacuuaaguccugugggaccuaugcuucaacaagacgcugacuuaagugguacuuugaauuagcacuugguaaaguuguagagaagauuaguaacacuaaccaacgccguuuuauuuucuugaaauacaauuuucaagauggucuauguaaaaaaaauauggauuuugauguaauuuaucuuuauuugaaucucacaucugaagaccagugacuuaaguuauuccugauaaucaguagcuuuguaacccugauacaguaaacaguuggugggugcaaaauacuauuguguauuuguauaguaucuugaauuuuuggaaguacauauuuguguaucucaauuugugcaaagacugaacagcaaugcaacacuugcugaauaaaacccucugauuaaauucuagaggcuuguucaguucgauuguuugauguacuuaacugcgcuuuugcaguuuauuuucuuuuaaaauaagagaucuaacacaugaauuuuaaaggauacaccauuauuaaccauacaauuacgaucguuuggaauuuucuuuugcaaauugagauaagaagagaaagauuacaaaacauuguauauguugcgaagauaagauauuaguauguacuuuauaauuguuucagagacuuuuauuuuuauuuuauuuucuuauucuagacacuagcaaaucuugauuuaguuuugacuacuguauugaauuuauuucaaaggauaagaccacgugaaaacuguguuaagaauugcuucuguucuuuguacaguucugaaguugucuucaguuuugcuaaucgccugugaaaagcauagauauaauguguggugaacuuuuuauuguggucauaucauuaaaauaagauuggaaauuuauugucaaaaauuuugugaaucugccauuaucuucuacugcaauauuucuuuuagucaguaauacagaaugacugggcuacuauggccaagaauauuuuauuucuuacacguucagaggaguguuacaggucuccuuguuacauaauuuucaauaaucugcuuuaauaguuuaacugacuggauuuuuuucuauaccauguauguaccaauucacacguuaguaaaugaccuuguuuugcuauauuuuaaaagcaguuauauuagcaagaacuuuguaaauaaauagcuuuaaaauacaa

SEQ ID NO: 12076 - RNA, 56971 nt, Mus musculus
gggaggcguguugugccgggcggagggaggagcgcuggggcucgggcuuggcggcgaagcgaccccuugcucgcuccgcgccgcgggcuaggcguguuggucggcgaggcgggcggccacggcuucccgacaggcucgggaggccgagacccucgcggcgcccggcgcugccccggcccccucggccuccugcggcgaggcgggggagugaggagaugccgacccagagggacagcagcaccaugucccacacggucgcgugcggcggcggcggggaccauucccaccagguccgggugaaagccuacuaccgcgggugaguguuggcggucagggacccgagcgaucgugggggcggcgagaggugcgguugguggcacccuggacguaugaguguaggucgccaggagucggcggaggagagugggcgcaaccggaggggaggacaaaucagcugacggagaaauuugcaacuguuucgggacuggguggauugaagauuucgagggaagccucuguucacucacuacugugggcacgcaagccuggacugcuucguuagguggcuccuuucauugcagacaggccugaagccuccgucuuauaaaucagguuuacaucuauccuucgccgugggagaguucaugaaauaagucuggacuauggucagagagccgcuauagguguuagaguuaguaccaaagucgauacuuuuuaauaggaugugcacuggauccuggguggucagaauuaaggugcaaaugugcugacccacauuuuggaaguuagggugagcuaucgaaaggugagaagccaaggcuuuaaauucuagaaacgaucuuuaccccacuugauuaccaaacguuuaaacuaaugucucugccaaaaguaauccaguucugagcauagcccaaaucauuuucuaucgugacuuaucauaaaguucuuccucuccuuugacuucagugugugguuugagauaauuuaggaucucugcugaggugaaaggccagcgugagcauaaagacuggagagcagggauuaacagaagaccucucugcuugucuaggcagaaauaaauugcuuuuaaaagcuucaagugcuacaagguuaaaagagcugugcgugcuuucacauuccugaggggaucagugaagauagcagaccuucccgguucuuucuuguuuuccuuucaagagaacugaagcugcacaugucuuaauguguacauguaaggccuuagauuuguguguuaucuuccagccucugacauugacugauuugggacuaauucguagaauuugcaguagacaauguucuuuucacuuaaaacagagaaaaugagguuaaaauagucuccgcaaacgcacuaauuuuuuuuuuuuuugaaauuuuuaaaaaguugguaguugucauaauaauugcuuuaggcauuuugguucauggucagccaugaacaaacuuugcaagauuggaagagccacagcccauccuuccgaggacaaacacacaacuuucugauaauuugagagacauuuguuuuagagcagugguucucaaugcugcaacuguuuaauacucuuccucauguuguggugaccccaauuuauuuugcuacuaccuguaacuguaauuuuucuacuguuaugaauguaacaugaauaucuguguuuucggaugcucuuagaccccucccaaagggaucuagaucuacggauugagaaacguugcuuuugaguagguuccacuuauaaaguuagcagccuguggcguauuagguguagaggaggaaaugccguggauucuaaagaagcugucuaguugacagguuuacagacgagaguucaguguaaaugcgugugcuugguaagagagugcauauuguguacaugugucaguagcacuguggcuuuucacccuccagucuccaaaggcucuguuguggguaacuucuucugcagcuugcauuuacuguuuuaaagguuguacuuauggagcuggagagagggcucagccaugaagaacacucgaugcucuuccaguguauccagauuguguuugaagaaccuguguuaggugacccacaauacugcaauucuaguuccaggaccccaauacccucuccuggccacuguggcacccccaccccaccccccauacauaucacaugugugugugugugcaugugugugcgugcacacagacacaucaaucucaaaaaaguugcauuuauguuucuuuauuuaaauuuauuuuauuuuuaugaguacacuauagcugucuucagacacaccagaagagggcauuggaucccauuacagaugguugugagccacccaugugauugcugggaauugaacucaagaccucugaagagcagucagugcucuucaccacugagccaucucuccagcccacauuuauguuucuugagagaucaucuguagauaguauuuaucgauuacuuccacugaaagaugaacauuauguuguauagugccuucugucuccuguuuccugugggucuuaaauguugauuguucagcgauugauuuuaguuuuugacuuuauacuuagcuuccagugacuuggugaaagaccaaggaauuaaugcuuuuucauuuuuccauauuuuuauuaguaaauaggcgcaucauauaaaucauuuccaaaauuuccuuggaaagaaaucaauacgucgaacucuagaaauucagguauuccauauggauuuucuuuauuuauugcucuaauuauuaagauaaagaaaaugagaauauggauauacgauuuauuuugucuaaaaauuucucgagguacuuuaauauuaucuuuuaaaguuuaggaaauuuuacuaaagauaggcacacauaaccccaugucuucaguagucaguggaaccguccuaauacuacaugguuuuucaagcuuccucugaggacagccucagcacucuuaaccgugccauuuucuuuuuucugaguuagacguuaagauuauauguuuauuaacaguaaucuaaacugguaguuauauuacagccagcugcuuauuagcguugaugagacuaaaaugcgucaccagcaaggagagcuaauaaauguguugguuaacaagucccauacaugacuccaaaguagacucccuuucccuugugcugggaaacaggaggguuugcaauuggaaaaugugguuuggggcuggggaucugguuagaggagugcuugcuuaacgcgcacaggccaagguuucgucuccagcacugcagaaaccugguacauggcgcgcuguaauccuccacucagaagguggaggaaggaagagcagaagggugaguuugggaccagcuugggcuacaugagguuuuuaccuuagcaacaaaaacaaccucacagagaccauuuucuuuucacccccucuuucuguagcuuuccccugccuccuccuaacaguaguucuucccagugaagcuugacuaugaauauuuccagugaaugaacuauccucuccuuuuaaauagguuucauuuuugggaaaguauuugucuuccuauauauaagaggcaugugauuugacuuuuuuccaguuuuuaaaagcaagagacuuuucuaguuuguaaaggcacugagaaucuggcgugaguagagugccugucucauggucugcgccccuuuuucccaacaugggaacucuggagucagcggcccuuuuccuuacagugcuguuagguuggaggaagagaaacagguuuuuuugguuagugauagauugccauugugugcuaaucccuguauaaagguacuugugggauagaauuuaaugagguaaugacugggccgcgcauaccuugacauuguauguguacaggacuuuggcagaaagcuuguaaaaaagugaguuauaagccauugucguugaucagugaucgcagcccagaggauuccuucugugaacaguaacugguuuggcagcacaagggauccuaccccuguuugcagccucucugcugcugagcuauguccacagcccaggacugacucugcauauucggaaugucgaguuguuugcauuuuuccucuuagagugaacaagcccugucaggucuuguuuuuuaaaguauugcaaaaugaguugugugcucucgguuguuggagcugaguguaguucagcuggugcagugcuugccuagugugcacaaagcccuggguucaauccaaaccccucauuaaaucaaguaugauggugccugccugcaaucccaguacagaguggaagcaggagggucaggacuucucaagcucauccuuggcuacauagucaguuagaggacagcacggaccguguaaaacccucagaaagcuugacuuuguaaugcugagcucaacagcuggccagcagcacugaggccugaaagugaggaguuggaggaacuggggaggcccgagaggagcucacugaaaggcugaagcagcagcagaaggcagcagcugcuuagaaacuccccagagggagaggugcuuccugccucccuaccccuccccuccuugauggucuuuaccugguuagcaggccucaaacucacuaguaacccaggcuagccuugaccucuccuccauccucugggcguggugccugagugcugagauuauaagguguuuggucacauuuuugguauguguucucucaccuucccucccuccuucuaccccugagccccccccuucuuuucuuacacagggucccauguuacaugccgacucugacauguaacuuacucugaacuucugauguuccugccugcaucucacuagaggugggauaacaggugugugcuaccacaucuugguuuuaugccauguugggcauaacccgggaccucaugcaggccaggcagucauuucuccagcuuagcuauuuuuccuuuaaauuuguugaugacacauugauuugucuauuaaaauuggcaggcauuucucaaucuauuguuuaccugaagauuuuaagauuuauguaauuaaaccuccuuuuuauuuuuucugugagugugguuccuugguuuguugccuuagauagaugaguuuucauuuacaaguagucuacaguucuguacugugcagaguuuuaaguaaccaucuucucaauauuauguuuugagguauagucauuaguaguuuucugcuaauauuuuuaaaaaagagguuucuuaucacuacuuguuugaaauaacuuuuacacgcuguauuucucauaguguagauagauaauugucuauucugugccauuguuuggggagagagcuuuuuguuuugguugaauauugugcauuucaccaagaauuucuugcuuuuacaagugggaacuuuuauuuccuguuauuuguaucacuauggccaaaauaucugaccacaacuccagggauaaguuguuuaggcugcuggucucagaggguucagcucaugauuucuuggucccaugcaauugagugaaacaucacuguggcagaagauuugaggcaaaggacagcugcucacauccuaguguacccagaagcacagagcaaggcuagaagugaccauagauaaacugucacacagaucucuuccccaacgaccucuggguaggggucaccuuuuaauguucccagaacuggucagaauggugccucccgcuguguacuacacauucagacugugagucuguagggcgcacugcuguucaaacuuaacuuucucuuaggguuacuguauccuuucuuauguugguggagucuugcugugcucccugacugcugcacacuccuagccuccugggauuuucuugccucaacuucccaagcugcuggaauugcagggcaugccacugugcucagcuuuaugucaccagcuuucuguuuuuguuuuaaagacaggaucuuacuguguagaccaugcuggccucaaacucaguuugucuaugucugccuccuaagugcuggaauuagagaggugcaccaccaggccuggccuaucagguuuguaugcuuacacugaauugucauuuauuaaccauuucuuaguuaacuauccuggaguuuauaggauaauaacgucucugacugacagucuugcuggggguuuguagacaguguuggauugcaguaaugcuuuuaucuuaaugaaguauaauugcuacugagaauguuuaccaacuacuuaaaaaauguaguguaccuaugccuuugaagaauugcagauacauuguaaucgcuguuuuuaauauucacaacaguucucagggaguuugucaugauguccauguuauagacaauauugacacuuagaaaacacugauacaaaauugaguauaacuuucaaagaacuccuuucccuuuuaugugcuucuuggcuuuaugcuuuucuugucaacuuuuuuuauuucaguuguugcuuuuauguucauucucuauuuuaugaaaaauggaaauugcuuugugaguuuuuacuuaauuuuuuuuacuuaauuuuuauuuccuuuuaagguugguuuauuuuuguauuguauguaagauguaugccuacauuucaguauuuguaccauguucgugucuggugcccguggaagcuaaaaagagugugucggaugcccuggaacuggaguuacugauggccaugagcguccacgggggugcugggaacugaauccugguccucuggaaggacaacuggugcucuuaaccacugagucuucucucagacuccucugcuuaauguuuagaauuaggauuuaacagaaugggucuauuacggcauuuucauacgaaugcugucuguguuuuucuggauugucccccucacuacccucucguuccucuugcccuucccugcugguucccuuccuaaagucacugccuuccuucucaucgcucuugacuucuaugacacauaccaccccaccgaucacauaaauuaaaaauaaguucuucauaugggagaaauuaugaguuaauugucugagucuuacaucuuucccucaguguaguaauuucuaguucugucuauucuccugcagauguuauaauuuccuuuuucuuuauggcuaaguaaaauuucauuauguauauguaccauguuuucuuuauccauucaucuguuacuggauguggugguuagaauagaaauggccucuauagacucaaaaaugcacugcuuguagggaggcacuuuccuaauccaaaguccauauuccuccaaaccaaagcauggucaggccuaucacagcaauuccccaguuccugguaccaacuucuaagacaugaccaaggcagcucuuauaaaggaaaacauuuaauuggggcuggcuuacagguucagagcuuuagaccauuaucauggagggaagcauggcaacgugcaggcagacacggugcuggagaaggagcugagaauucuacaucuugaucaacaggcagcagaaggggacuaugagucccacuagguguagcuggacuguccucugacaaggccacaccuucuaauagugccacucccuauggcccaagcauucaaacacuugagucucugggggccacaucuacucaaaccaccgcaggcucagaaaugcagugucaugagggagggagcagcgcugccugagaggguuaggagguguguguuggcgauugguucuaaugcucugaaucaaccggaaucuguguccaaacccuaaaggucccuugucugcaauuguuuuuugauggaucaauaaagaugccaacacggccaauggcugggcacugggcgggacccuuacaguugggcuggcuaggaugcagcuggggagaagaaaggagggucaccaugacggggagggaaauggaugagauuuagagcugcaggagagagagccaaccagccauguaagaauucacuucccugauugggccagggguagcaggggaagguuuaggaauguccagucuuugagguagccaaggcauuuuaaaauuaacuggugugugugggucuuccauucuccaauccagauaguuccugggcaguugcguguauaugauucuuaaggagccaaagcaguguagcccaaacucaacgcuacagguguggccuuauaggaggaagugugucacugggaguggucuuuagggauuucaaaagcacaagccaggccucuuuuccugcuaccuauggauccaguuggagaguucuuagcuccuucuguaccaugucugccugccuucuuccauguuucccaccaugcugauaaugcacuaaaccucugaaguuguaagacagccccaauuaaauccuuuuccuuguaagaguugacuuggucaugguaucucuucacagcaguagaucaguggcuaagacaguggacaucugggcugauuuccucccuccgggacuuacuuucuuuucuuuuuuuuuuuuuuaaagauuuauuuuauuuaucauauguaaguacacuguagcugucuucagacaccagaagagggaaucgggucuuguugcagaugauugugagccacauugugguugcugagauuugaacucaagaccucugaaagaacauugagugcucuuaaccgcugagccaucucucuagcccccacugugacuuucuuuuucugauugauaacuguuauaagcagugugcuagugaacauguaugugcugcucuuccuguggugugcugacuuagacgccuuuagguguacgcccaagcaugguggucauacccuaguucccuuuugaguuucugaggaacauacugauaccuguaguaucacaccaguugacaguguuaucaguaguguacaaggcuucaccccccccccacacacacacacacacucuaacagcaguuguugcuuuuuuuucuuuuuuaaaaauuaauuaauuaauuaauuaauuauuguuguguuugaaacagaguucuguagaccaggcuagccuugacucugccugguuccaccucccaaguucuggguguggcauauuuauuauuuauauauuuuaugugugugagugcugugccugcaugggcccacagaggucaggagaggucaucagaugccuggaagaugaguuaguugugagccaccaugugugugcuaggacugggacccaggacuucuguaaaaucagcaagugcucauaauggcugagcuaucucucucuccagcccuccggcuuguuuucuugaugguggcauugcugacuggggugacugggaucucaaagcaguuguaauuugcauucuccugaugccuagcaugcugugcauuuucuguguacuuauugucauuuugauuucuucugagaacuuuguucaguucguagcuccucccuuucuugauggggugauguuuugaaguuuaauucguguuuauccucacauauucuagacauuaaucuccuguccuguccuguguggucagcaaaggcuguuguuuuccacucugugggcugugucuucacucagguauuguuuccuuuguuaaagagguuuuuaauuucauguaucccugccuaucaauucuugggauuauucccuguguuuuuggagucuuuuucagaaaguuuuugcuucuguguauauuuuaaagucuuuuucuguagcauuuuaagaguucuaggucggacauuaagguuuuuugauucauuuuaaguuaauuugaaaauguuuacauuuauuuuuugucugugcgguguguguuguuuguguguugugugugagggaguacacacaugcuaucacagauguguggagguagaggauaauucucaggaguuaguucucucuaccauguggguucuggggauggcauucaggcuuaggcuuggcagcaagccccuuuaugugcugagccaucucacaggcuuccauuuucaauggaguuuuauacagaauuacagguagagaucuuaguuuucuacuauuuauuauauuuuacuacaugcuaaauguggaaauacaauuuccuaggaccauuuuaaaauuuuuuucuuaaaauuaaaguuuaauuacaucauuuccuccuucucuuuacuucuuccgaccaguaccauguuucccacccuccccucuugcuccuucucaaaucuaugaucucuuuuucuuuguuacuguuacacacacacaauacauguauacauagaugcauuaaauauguaauaugcugaaucugcucaauguuacuuauauguauaagguuuccaguuugaccacuuuguuuuggauaaccaauuagagccucaucuugggaagacuacaucuaccucucucagcaagccuuaauucccuaauugccuguaguucauuguucugggugggcucagguaagauuucccucuuccaugcuaacauguugguagcguccuuaaggucuccguuggucagccauauuauuugagguuuagcuucucugucauuuguaggaaagagcugguucucuggacuugagucuuuccaaucccucuucugucuucuguggugguguucccugggccuuuggccuaggaccacuuggugaagaggcuauccuuucccaguguauguuagacuaagguggcaacugcugugagagcucauuucugcugucuugguucugucccaguaacuauggucugcugcuguggcucugugguguguaguguagaggucagacacugugauacaguuauugucauucucucugccuaggacugcuuuggcuauugcggggggcggggagggguguuucuguaugaauuccaggauuguaauuucuaguugguugagaaauguaacuggaauuugaugggaauucuguugaaucuggauauagugauauagucauccuuuauuaauuucgccaguuuuugaagauggaagucuucccgucuucucaggcuaccuuuaauguugacuguagaagucuuuuacauucuuggcuaaaauuacauuuaggauuauuuauuuguuuacuuauuuagaagacacuauggaugguuuuuuuuuuuccccuccugauuuauuucugauauauagaaaaaccgcugauuuuguaguuguuuuucuucuuuuaauuucugccaguuugcuguggaaaugcuauaauuuauaugauuuugacucuuggcucgccugcuugagccacuuuuuucucuuaugacuuuugugcagacauaauguuauugugcacuauguaaaguuuacccuugcguuauucaaaugcugauuugucaugccuugcugcagucugggcgcagcauuguaaugcuuaugucaagagucuccugucccaaguuuguguaaacaauucucauuaugcucugccuuaucaguaaaagcuggaaaagccaauaacuaugcaauauaaagaauagggcaguacuucugcugccaagggcggugggagaggaagagggaugucacugugaggaagggguccagagaggcaucaaagcagaacacaccugaagcccagagggacaaaacaauacaaaaaugccaguaucucggggauuuuggcugggagguagccagauuagaggauuaugauauaauuauaaugccuaguuguugugauuuuaaguugaagauaaaucuuggggcacuaacuaggauaaagaaaaacagccgcuguauuaacuuacuguguacauuuauuuuaaaguuaccauuacagcucuagcuuaaagauggaauacuucuaaauaggaauaugagcauaugucuuguucuuauuuuagaggaaauguucucucuauaauauugggugauuugucauacacagccccuuuucauucuuuguuuauucauuuauguguguguguguguuguauguguaaauguaugugagggagugcucaccuaugcauguacacauggaucagaugaugucaaguggcuuccucgauugcucgccaccucauuuuugagacagggucuaaccugucucaucuugagacuagagcuuguuguuuugguagagugguagagcagcagacccuuggacccuccuguccaagggugcuugguccucuucuccacaggugcuugcugucaugcucaggguuuguuuuguguuguuaacauggguucuggggauuaaaauucagguccucuuacagguauggcagccaccgcugagccaucuucacagaacccauuuacaggcuuguuauucacuucugcuccuaguuuccucagggcuuuuaucaucaaggugcguuaaacuuuguugagggccuuuuuuaugacuauugggaugaucaugugacuucuguccuuaagucuacuuauguguuguauuauaguuaauaauuugggugugcugaaccaacauugcaucuuugggauuaaaccagcuuggucucagccucugaucuuaauguguccuuaaauucaguauacagguuuuuuguuggaaagucuuaugucuaugcucaucaaggaucuuuagucuucgcuguugcauccugauugucaggaugguccuguggugcuggccuccuagaaugaggaugggagcgcgccauguuuccguuguguaagcagguucugaggguaugggggacccuccuuagagguucgauaggacugagcagugaauccauccacuccugagcuuuucugcugcuucagccugguugcuuaagucguucaugucuucuugauuuaauucugauaagucauguguguguaguuauccauuucuuguagguuuucuaucuuuuuccaguguauguuucaaaguacucucuaaucaucuagaucucuaggagagucuuaacugcgcccugcuuuaucuccguuuuauuaauuugaggcuuccuuugguuaguuuguugucuuacugauuuguucagauugcuccgauuuuuuugguuugguugguuugcuuugguuugcuuuuaguugagacaguuucuuuguguagcccuaacuguccuggaacucacucuguagacuaggcuagccuugaacucugccuccugagugcugggauuaaaggcauguaacaccauugucuggcagauaguucuaauuuuuaauggcuauagacuuccuuaucucuuuccuggaaguucugguaaaucgugcuuucauuuuuaaacaucaccuagauuuccucaguaucucacuggucauacaagaguauauuguucuguuuugaaguaauugaguacuuuuuguaguuucaguugcuauugauuucuacuuucuuccacuaugauaugaaaaguaaauaguauugccuuuucuuuuuuuuuuuuuuuuuuuuccauuuuuuauuagguauuucgcucauuuacauuugcaaugcuauaccaaaagucccccauagccacccacccccucuccccuacccacccacuccccuuuuauggcccuggcguuccccuguacuggggcauauaaaguuugcguguccaaugggccucucuuuccagugauggccgacuaggccaucuuuugaugcauaugcagcuagagucaagagcuccgggguacugguuaguucauaauguuguuccaccuauaguguugcagaucccuuuagcuucuuugguacuuucucuagcuccuucauugggggccaugugauccauccaauagccgacugugagcauccacuucuaugcuugcuaggcccaggcauacucugacaagagacagcuauaucaggguccucucagcauaaucuugcuaguguaugcaauggugucagcauuuggaagcugauuaugggauggauccccggauaugguagugucuacaugguccauccuuuuaucucagcucuaaacuuuuauuguauugccuuuucuaagacuugcucugguauggauugugcuccguuucugaaaaugcuuuucuuuucuguucaaugggauagucuguacaucugcaaaggccauuuguucuguagucuaguuuaauugaaguuuauuuauugguuauuuuuaauuuguauggccucucuaaagaugcaauugggguagugaaguuacccucuguuggcauucugucuaagcuccuccccacaguuaccuggcaacagccagguaugccugacucacuauaaaaggggcugcuugcccccuccuugcucucuuguuccucucuuacucuuggguuucccuucugcucccguuuucucaccauucucuuccccucuuucuccaugugcucauagccugccucuucuccucuauuccucuuauucucucucccuccuuccuccccucucucccuccccccaucccccuuucuccgccucuccuacucucuugacuccccuccccauguccuaaauaaacucuguacuauacugucauggcuggucccccauaccucaccacaccuccauagaacauacucccccucucuuuaucuuuuuauaaacacaucauacucuauuguauccggacuucugggaccauuuguaaccaauaguauuuuuuauaaaauucggaaccccaguauuuaguguauaugcaacuacaguuuuuccauccauccauccauccauccauccauccauccauccauccccgcccgguuccagguaucccagggugaucuggaaaccugcuguagcugcaggugaucuugacucugaccuuccugucucugccucacccaccauaccuugguuugagugguaugguuaccaaauccagggcuuugaaaacuguuuuuaaauuuuaugaguauuuugccugcuuuguauauauguacauaccacguuugccucuuguacaaagggaggccagaaaaggguggugucagauccucuagaucugagagucaccugguauggguauugggaacugaacucugccccucuggaagagcagcagaugcucuuagggcagagccauuucuccacucaaggcuuagugcaugcuaauuaaacacuaucaacucaacuacauacccaaccucguuuuauccuuuugauuaguuauuccuuuuauuaauaugugguggccuuguuuaucuuuaauuuugcuuugaagucuacuuuaucugauaucagaacaguuguacccacuugcuuucaauucauuugcuuguuaggucuuucucagucuguggcgucuacacacacacacacacacacacacacacacacacacaccucaccucaagcucaaggccaccaagcuucugaccuauucucuguuggugaaauccgcauucagacugaggcugugucuaagcuugacagcauccagccuuccugcucuccaccacugagaccugagguuguggcggguuaauccccggcuuucugauugugggguccaggucucugguguagauccccaggguaacucagcauucaucagcaaauucccucuugacauagcaucuuaccucugcccucuaaaucaugcaaacuguagagagauuucugauguaauguagagcugaccugucagccauauucucaccuguuugaccaaaaccugcaagggauuugaggcuugugaguggagccugugggcagacagccaguguuuucugaauggagcuuguuuccucucuuccuguuaggaguggcacuagccuccauaccuuucuccuauucugucacuauuuaaauuuuuuauuuuuuuuguuuuucgagacaggguuccucuguguagcccuggcuguccuggaacucacuuuguagaccaggcuggccucgaacucagaaauccugccucugccucccgaguccugggauuaagggcgugcaccaccaccuccacccggcucuauuugaauuuuugaagagccucuuccacuguuggaacagaguaaauuuuauuuugugcguguauuuugccugcauguauuauguaaguggcaccacgugugugccuuauaccuacagaggucagaagagggcaccauuagaugcccuggagcuggggcuaugguuggccaugagcuuucauauggcugcuaaaaacugaaucugggucuucugcaagggcagcaaguacuuuuaacuacugagcuaucuugccagccucuuauuauuuuuuuaauccaugugugguugcauauauauggguguaugcugcaauacuccuuuggacaacauugggugucaguauuucaacuucauugcagacaggugcaccccaugcuggucugcaacugacagagauccaucuuccucugccucccaagugcugggauuaaaguggugucucuaaguggacacuuagagagacagagucuccggaucacuccuguguacccuggauccugccagcguccgaaguuucucccaucuccccuccagucucaauauagguuaccacgaccugcuuuaggugaaaucuggagauuggaacuucuaucugagccaucucccgagcccucgucuguugcauuacuucgaagacaucaaugacauuuuacauaauuacuaauuugagauuaugugacucuuuucuacuuugaauacuuugauccaaugauuuuaccauauuuggguaauccugugaggccaauuauuacugaugaauucaaauaaaacauuuucuaaauaauuuauauuucagaagaaaaguuuauauuuaaauagcagaacucaauguugcuuuuaagcaaagggacuuuuuuuuuuuuuuaauuuauuucacguaugugaguacacuugucacugucuucagauacagagaggagggcaucggauguccauuacagaugguugugagccaccaugugguugcuggaaacugaacucaggaccucuggaagagcagucagugcucuuaacuguugagccaucuuuccagcauguugcuucuugcauuuacuuuuaaaaucagcccccaggaaagcuuuagcuuuauauuuuacagaauaguuuguugagcgccugaccaguuagucugaagcccacuaacauaguuaaugaugucccaccuuuuuuccuuuaagaauuaaguuaaacuaugccuaaauuuaccauuuagggaaucuuugcaguaaaacacuuuugaucuguggccaucaauaaaauaauuuaugcuaaugacagagugaagacagaagaaucccgaguccaaucuguuuucuaccuucugagugcagugucuucauccgcagccugugccugacuugguuauuguaauagcgaucugggagcugaggaguauuguagacauggugcuuucuuaagcagagaaguguuuacacagacguuccuuaaaugcuuuaguuccugggacuuacggaacgacgguugauaaaccaccaccuucauuuagucucuuaaggaaguucguacuuaggcuuucuaaauauuacacauacaguaugugguauugugauuaucccuaucuguaaaccuuucauuugggaggcucagcagaaggaucaagaauucaaagccagccuggguuguuuuuuaaacaugauuuuuaaaaauauaucggauaauugacuucugcauucugagugcuggugugacuugcugagaggaaggagugcuuguguccgugaaggcucuccgauucuucucaccuggaugguuuggccugcucuaaucugggcugaauguguccuggcuagcaugagccguccagaccugucucauacucuccuuugaugcugguacuuuuuaguuuccugcaaccuugcuaauuauugucuccuauuucugucacacgggggcucugaggggaaaaguggggaauacacacauuugcauucuacuaacuuaaguaggugcaucccucuguuaaccuuuccgaaggugggguacuuuuuaaaaugacguuucacuuguuuaaaguacuguauaaauauguaauuaaaauuauuaaauacauaguguguuauaucuuagugguauuuuaagugcuaacauuaauuacagguuggaauuuauaccugagugauagagugcuugucuaccauguuugagaccuuggguucaaaccccagcacaauaacaagggaaaauauucuuuaauuuaaucuauuaaaucuauaacaucaucugagguauuauuaucccauuuuauggaugagacaagucacagggaaggcaaauaacuugcuucaggucacacagcaauauggaaaaagauagaguuuagauuuaaacauagucuccuggguuugcaugucaaggucuuaccuguuuuacagugacuacguacuguguucuagucauucaguauggagcacugacaccuuuguuuguucaacauuuauucacuggagauccgcuauaggcagacauugcuucagguguugguaauauacaacaaaaugcuguccuccuugauagcauguuuagucaugggagacacuagaaacucuguauacuuuauguguguuuauauacauauauguauguauauguguuuaugugugugugugugugugaucacuuuauuuuaacugaagaauaaagauuaacaucauguauuuaaauggacuaaauuauuuuuuuaaaagauuugcuuaaaacacuuagauuuacuuuauuuuauguguauaagaguauauuugccugcauguauguauguguaucaugugcaggccuggaggucagacaucagcuuucccuggaacuagauuguaaagauaaucaugugguuguugggcacugaacccaaguccuuugcaagagcaacaagugcucccugcugagccaucucugagcccuaauauuuauuugauuauuuauguauguguacauaccuacaugaguuuaugugugcccaugaagaggccagaggcaucagaucgccugggauuaguuacuggcagcuuugagucaugggaaaccaaccugaguccucuggaagagcagcaagugcucuuaaccacagagccauggcuccaugcccaaaacuaagguuuuaaaucaaggauuaaauuauucacuagccaggcucuuaaaaacagagcuguauccauugcgcuuuuuguugacaaauauaaauauaaaucuuuuauauacuguaguggucuaaauauuuguguccaucccccacccccagucccagcauuuauuguagaaauugacauaaaaugucuuagaaggugaagggucuacuggaaguugcauuggcucucaugaaugggauuaguaccuguguggaauggcgcagcuaaggccuguuucugaggacacaacuagaagcugcaagucuuucaaacagaagguagcuaaggcgcuuucaucuuggacuugucuccagauagacauaauaaacucauucuuguuguuugugaguauugcauguguggaguuuauuaaaccagagaacuaagcauugccuggcaucugcuguggaaaggcauggugcaggguaugagcgcggcaugggugagugcuccuaugauugacaguuauggaggagaagggaagggagggggcuuugagagucugucugugcuuccguagcaauauuacagaaagcauaagcuaugccggacaguagugucucaguucggaagcuggaagguauggcaccaacggguuugcuaucuaguuaaaggccuuauuucucugugcaggacagcacuggcuugcucuguuuuccagugaaagagauauccucacauuagugguaggcacagaggauguguaggauagcugggugaguaagguguacuucaggguuaaucuguauggaguuuucuuuugguguuuugucuugcugguuuuuggucuugauuuuugggguuuuuuuuugugguuguuugaggaggggugggaaacuuaaagagcaugacauuaggugggaaggaucuaggggagaggaaacaugauccagguauaguguaaggagaacuuuuguuguucguguuucuuugauugaaaauagacccuuuaacaagguacuuagauuauaguccggccccccccccccccguucuuuccuccuuuuauccagauccauagccuuucugucucucagaaaacagccaucuaaggaauaguaauaaaauacaguagaauaaaucaaacaaacaagucaaauaugacaaaacacaggcaucccaucagaacccaaaccagaagccauaacaguauuggcagagggucuguaaguguaaacaaugaaagcccugcuuaaaaccuccagagcggcucuugaguuggguuguauuucccucuacugucggggauagggccugcccuugagagugcuuucccugugaaaaaacugauuuuuccuucacaagcagcuaugaguuggagcuagcuucuggguuagggauggggacgggcucuguuccuucucuuucagcucuaggacccaucgggugcagacccaugcaggcccugugcacgcugccgcagucucugggagcucaugugcgugccagcccuguugugucuaggucuugauuucuugaugccccccacucccucuggcucuuacacucuugcugucuccucuuccucgguucccugaguucucagggcagggauuggacggaggcaucucauuuagggcugaguuccaaagacucccucagugccuaaugccuggcuguggcacucuguacuuguucugucuggugccggaggaagcuucucugaugaugacugagcagagcacagauuuaggaggaguugagggaggggaaaacaugaucaaaauauauauaaaauauuuaaguaaaaauagugucuuguguuuuguuaauaaagacgggagaguaaguguuuagacuacuagcuggauugccaagaagcaagcacauuguuagggaagccauggcgagaggcgugcgugugaccgucccugaagaggcaauccaguuucucuguccucuuggcuaucugcuuaccuucuguagcuccugaagacuacaggcagcugucgcuucuuuggcagagagcacguggcagcucugcgguuccuuggaggcaucaguaggccucaacugcccaagucuguuuuucacguuuccuuucugucgucauuuccucccuuucaccagugaacaggcaucuauugugugagugagagagaguuccuggaaagagcaguaccuuccaccacaccuucugcaagccuguuaauuauuggugacccucagugauaguggagagguuggaacacugcaggugcagagcccaauaguuuauuuggaacucuuuuuagaagcucccuaagcagccauuccuugcccaucucuguaucugaccucacguccugugucuagcaagugaaacauuuggaauuuauuagcuugacugaccacuaacuuugaucauccagaaggcuaagaaugugcucagcuggaaucugaagccaagagaaggggguggcccguuuuguuguaagcugccucugugaugguccucugguguauuugaaaagugcauuugauugaagacuuucuuucuucuguuacuaagagaauuucacgaaaauguuaccguguugaaacauggaauuugggguagcuugaaucugugaccccuggucauggcacucacauuuagcuccagauaaggaucucuuacgaauuuugaggugagagcuguguuuugacaguaaaguauuauucugugcuaggaacugcauugaccucuaggaguauaauggggaaaaaaacaacaacaacaacaacaacaaaacaaaaaaccacaucucugccuucacuucaccaaguuucauuguguuccauuugggacaggggguaauacaagcacacguuugugugccauuggagaaguaggccuggcagguagccagggacagcuccugaggggccuguagaccccgauguucaaaucuucuucccagucgcugagaucaaauccuccaauaaaagcagccuaggggagaaggggcuuauguuagcuccacuccauugcagaggggucagguuaaggguggaccuuccaaccucaguuucuuccaccucaauuaacuuaaagacaauaccacacaggcauguccccagaccaaccuaagcuagaccucacucugcacucuuuccuggugauucuggacguuaucacauccacagaaaagcuaacccucccaccugccuagggacauuaacauuuacucuguaugauagagccguguggguuacugcaggaagcgaauaaauuauguugauuuuaucaauggcuuacagagaguccagcuccuccagugcugaguagaaguggcuccuguguagaggucccagggcugcuuagcugcaacgccaggcaucugcuggacaacagcacaaggcacacuggaucugcucaucuaauggaaggaaaggaagugugcauucauagauauuauucacuauuuuauauuccuuauugucacuuucaauaauaaaaauauguuccuguguuuggggagggaaauuuauacuaaaggaagcuacuuuaaaucaauuuuuggaaacuaucuuugggggaaagcuggaaaugagagaagagauguacaacucgugcucuacagauugaugcuggguuauuugugaaguuaagggagccaggguagcagaagcacgggucuucauggggugcgggaccuggggaaagcauugaaacagauuuuccgugaguacagggcuagugcuuguagagaguggaugugggguugcaaggccucccgcaggagauggagcaaugaggguggcuuccucagugagaggacauggagguucauggguccagcuuauuucaucaacauuuuaauguuucaugcagcacagaaugaccaacuagucugucgcauaggcguugagucacacggagcucaguaugguuuuaaacauaaaagucuuucuuuuucagggauauuaugauaacacacuuugagccuuccaucuccuuugagggacuuugcagugagguucgagauauguguucuuuugacaaugagcagccguucaccaugaaauggauagaugaggaaggugaguaacggggcgggcgggcgggcggggugggagcgggcgggugcucugugagcuugugcuuuaagauaaaacugggcuuccaggaaauucaggaaacucaagcaggaaggguaaaucagaaacuuaaugccaugcacauagauuaagauagaagauuuaaaucaaagcauacaaucuuuguuuuuugccucuucaaaaugaagcaaaaguaguccuccccgccccuggcaguuaagguggguguuucaucagugugaugucuuaacuuuuauuuauuuauuuaucagaucucauuacagaugguugugagccaccaugugguugcugggaauugaacucaguaccucuggaagagcagucagugcucuuaacuacugagccgucucuccagcccuuaacuuacauuuuaauauaagaguuuuccuguucuugacugaaauguagagcaguccuagcaauuguguucauuuagggugaugucagagccuuaaucaccuagugacauguacucacaagcauuuaugaccugucugaggauaguggggccuuguuacccauaacugggaguauggaacaucucagagauacucaguuuccacuggucaacucagucuguuaacaacagcccuacuaaguuauggggguauuagaaauugauaaccauaggagaagauccuaaaagacauaaacuccauuaguuagcacuuuuauaaaucucuucaaaugccagcacucacaugguagaucaccaccaucuguaaccaguucugucagggggacuaaacccgugcaagagccacagugaguacuuucaacugcugagucaucaucaucucaccagccccuaagugggccuguuuguuuguuuguuugcuaaaagcaggucuuguuaugugguccuggcagaccuggaacuuggagugacagguccccaccccucacccccaccuccaccccacccugcuucuuuggucuccuaaugugagugaacuaguaggccacaguagcaaaccauuuuaggugaacaguaaacuaucacuaaguauguucuugcacaggacagggaaugauggauguaaguuauuucucugauaguuuuaaagguuaguucuaacugaaagugauuauaagguacaguaugaugcuuugucuuugguguguguguguuuaauguauauggguguuugcuuacauguaucucuaugcaccauaugcauacagugucugagcuggcuagaagaggguuuuggaucccauggaacugcaguuacauuuuuagccacuaugugguuacuggaaauagaacccagguucuccaggauggggcuguuucugugacaaacugaccuuuuuuuuuuuuuaaagaauuguagaagacuuugggauuuugaaaaguuacauuugaaugcuguaagcaggguuaaguaguccauccuagaagagcuuggaagacagcagugcugagagcagugugggcuguguaggcccugcucaaaaugguucagagaagcacuauuagcaauggcgccagcgaaacuauuccuguggcuggcugcuuuggcaaagaauguggcuucuuucuucuguaguuccaagaauuugccugaggcucacgugaaaagaaaacuuguuggaggaugagguuucaugacgaccugcucuugugcaggucucuagugaaaagagcaagugggacaagcaagagaaauacauaacuacaguugaagagaaaaacgggaggcaauguaauguuguggccaaggcuugugcugaaagaggagagaggauuaagacugcucuuccagagguccugaguucaguucccagcaaccacaucauggcucacagccaucugugauggguucugacgcccucuucuggugugucugaggacagcaacaguguacucacauaaaauaaauaauaaauaaaucuuuuuuuuuuuuuuuuaagagaggcccaggacccaggcggucacccgaccuuccagcuuuagaguaaugaaaaaaccugaggaaggguuauggaaacuucuccacaguuaaggagaaccacugagggcacuggggcaagagaguuaguuccggcauggaagucacaagaugccauugugugaaguugugaaagcgacuggauuguuagagaccccuagauguuagaagugccagagucgugggagaucugccaagggaugugcacacauggaguggagccagccugggaguaucuugcaggcaacaaagcuaaaagggcggacccauucaagacuugcaguuugcccugcuguaauuuagucuagugguuccucucuaugcccucauaacuaccuuuuugaaugacaauauauauucugugccauuguauguuagaaauaugcaaauuuguuuuauuuucuagaggguuacaguuaaaaguuugacuugagucucagaagagacuuuugacuuuuaagcaguguugaacaugaacaauuuuggggaccuuugaaguuggacuaaaugcauuuugccuuaugauauggccaugagcccaaggggggcagggaguggaaaguggauuuaaauacagugaacuguuucugcaucuugucagguuauuuuacacaguuggaucuuucauauuaacauuuuguuugaagccugcugcuuauuugcuucuuuuuauagcuaaaaacaaacaaacaaaagggcuguguggaaaauaagaauaagccuacuggucaauauccagauuuuauuaauucuuuaauuaccucaaaauuaacuacaaugagcaaauacucagaauguacuuguauuuuauuuuagacauuuagaauuugguaauaguguuagcuuugaaaaauaccuuuccuggucauuuuuguuuuguaaugacuuacauagagugcuuuaugcaucaaacauauggucgaaaaaggucacauguaucacgcaggcccucaauccaagaaaaacagaacagguucaauguguguggugucugugcagggguaaguuaauguaugguuaacuaacagguugaauguguguggugucugugcaggaguaaguuaauguaugauuaacucaccgucuucucacaaacccccucagagccuagcucaucaugacauuagguccacaguccaaagauggucaucuaauccugugucuugcccaucuaugguuuggguuccuugacugccucucugcuaguucuaaagauccaugaaauggugacaggauaguaaacuagagacaggaguaguauaguagcuaccccuagucaccaagaggggaagguucugguucugaacuauaauagaauguauugucauucccucaggaaagcucacugcuacucucugggauuggaucccaugacucuuaacauugaugcucugauucauccuucucucuuccuaggcucuguuuuguaguucacuaauuugccuagauucucucccacaguugaaagacauagcucuucauuuugaacauuguagaccaccuguguauggaguuguaacuguucauuggacaaaagccauacucacaucagacucuucuagacaaggacuacaugugucugagguuuggggacuagagaaauggcucaucaguugagggcacuggcuaccuuacagaggacccagguuuaauucccagcaccuucaugacaucucacaacuaucuguaacuacaguuccaggggaucugacacuuugacauaugcacauucaagaagacaccacaccaaugcauauaaaaauaaaaauaaauuauuuuacaaaaagaaaagccauuugcuacuuuggcccuucugcccagucuucugaucuuuguauuugcagccacugauucuguagaugcguuuucuguuugcuguauugccuucagugagugucaccacacucgcucauucauuuugucuauuguccgaaccguuuucucugucuucuggccuucacaagcaguccguggcugccaucuucugccuuucaugaaauagaaaaggccacguaagucuucuuuuugugccaguucugguuagguuuucuauuucugugcaacuuaccuuauaacuuagugauucgaaaacugacuuucacaguucugugacuuaucagagcuaauguuauaaauguccacagaacauaaaagggagugaggacuuggcagcugaguuggagaaaagaacagacacuguuuucuuugagaccauguagauaggaaaugguuucucucaaguaguaagcuggguucugugcacuguguaauugaagauuagucagagccaguggcauguagcaugcaggaaugugucauaaaaccacaggaaugagcaccagaguagcagaggggaggauccaguucaagcccagcuuugcucuaagugacuuguucauugaggaaugcaccucggauuuccagggaucacucugcacuucgccugcuuaguugagagagguguguccuccuccccuucuguguguguaacuaaaauucaccacuuacauuuaagaguagcuggagcugguguccagcccuagguaggacauccuucccaccaaaggcucggaacacgucagaggaggggcaucucagaggagggcuucaaagaaugugagagaugcaggaaggcgaggaaugcaacgcugccuuugggcugugcuguggccucugcagccgaggacucacugcagcugugaccagugcagggaggucagucaucaucccagcagagagggcucagugggcagcugugaacaaagaaagaggcagaaggggagaaaggcucguggggugcuucagaggagugggagggaaaguggagcugggguauacaucaucaggacgcauuguuucuaucuaugcaguugucaaagaguaaaagaugcuuuguuuaaagagagaagagaaacaaaaagaaggugauggagaggugggugagcagugaagaacacuugcuguucuuuuugcaaaggacccagguucaaaucccagcacccacaagguaccuuacaacugucuggaacucuaguuccaggggaucugaugccuucugaccugccauagacacacacacacagugcacagacauaucugcuagcaaauauuugucaaauaaaucuaaaaaaaauuuuuaguagcucaagcuagacuauucuuaguccagaguacuuuagugguuucuuucuugugacuuaauugaccaagguuguaauaugauacaauauccauuacagucacugccuguguuaggguccaagaaucaccaaggaaugauaacccagacucaaauaguaugcaaaagcaaagagcauuuuuuuuccagcggaauuuccugcaugcaggggucuuuucauucaggaauagagacaccgagugggcucgcaggcccagcuuuuauugucaagggaauuccagugugugugugugugugugugugugugugugugugugugugugugguaugugccccuuuaccgugauugguuagcucuacucuagggauccuucaggccaaaggacaagguguccucagauuggcugcccauggcugcgguuggcugaccacagguuccuggaucccaguucuguuugugggaaacacaaacuuaggccuagucucccaaacuguuugcagccugucauggagucagccuggcucuggcucaguccucucaccuggaagcccuacccauccauaguguggcaguggaacugcuuuagcuccuuuuuaaaagaaacuagcagccaggucugguggcauuagcuuauaauaccaguacuugguagacugaggcaggaggauugucuguuuaaagccagcccaggcuauagaauaaguuccagagcagccugaguaaauuacugagauccuauccccaaacagaacaaaacagggguggggcuggcucuaugcucuccguguuagaaugcaugccaggccugguccugggcuccauccacaacacugaagacaaggaaaagagcugaaaacuuguucuuaaccauacccaugugagugagccaugccugucugaaagugguuagaguacauuugcuucucucccuccccuucucucacccucucccucucccucacccucucccucgcccuggcccucaccuucucucgcccucaccuucuccucacccucucucccuccccuucucucgcccucucccgugugugugugugugugugugugugugcgugugcgugugcguguguguguguguauuaggaguagagugguuuuauauguagaagauggugcaucugcgucccauguguccuuuugugcaacuagaaauggaugugagaacaucugcagagguaaaguugccuaggguagugucuaagcaucuguccagguacaugcucccucagucacagccuagcgaauuugcuuacuguuaucgugcucagagguuuggggacugagcuuuccguuuuguuuuuaggagacccauguacagugucuucucaguuggaguuagaagaggcuuucaggcuguacgagcugaacaaggauucugaacucuugauucauggugagagagccaucacuugacucccaaagcucuaauuaagacauaacucuuuuauuaugugugcccuccucccuauguaauuggccuucagauucuuuuuccuggaguagagcaaguaagacgauuaugcgcucuauagucuaggagaacuguauaucuuucuauagucuuuuaggauacuaaagugccgucucccauugcuucacaacuuagacauuccugcacagcuuuagaagucuauuuggggugggggcaguggccacccuuuucuaguguaaaguuuuaaaauguugagagaaaugaucaguuacgcaggcaggcagcaccugccuaucguccuacagcuugggaggcagaggcaggaggagccaagauaggccacagcagccugagcuacauagugagaccaugucugaaacaaacgggagcugagaugaaacucaguuguggagugcuugccuggcacggugcuaggacuggaauccugcucuguucuguguacucuuccucaguguggcccuugcuucaccacagagcacauuaguuaacaagauagucuucguuaugaaaugcuuuguuugguguguugauaaauuuccagccuagaauauauucuuauauuggagguugguacuacuccugguauuaauucacucucuaauugaaugcauaucuuuuaaaaacugauuuuugccauuuaauucuuuguuguacaaaaguucucugcaaugaggauuuuaaaaguaguagugaguuucuuugaggaccaguguuuaaaaagugauuauuuacaggggacuagaauuaguaauuuaagcuucuaauguauuaccuauagacacauuuauuuucacagaaacuuacuuuauauagacuugguaaaagcaagagccuuuaguagacuaauauuagccauauguuggaauucugccucuaguaucucagggcacuuuaaauuuguguuaauuuuaauuuuguauaguuuguauuauguaaauauucugcugauuaauuuuaguuuauuuucuuucaguauuuccauguguaccagagcguccuggaaugccuugcccaggggaagacagugaguguucuagugcucugcacacuuauuacucacaguggaaaacuaagaacuuuuuguuuuguuuuauuuuuugagacaagguuucuggcugucuuggaacucucuuucuaagaccaggcuggccuccaccucucagaucugccugccucugccuccuacgugccaggauuaaacaugugugcuuccacaccuagcuuaagaaacagaacuuuugguuugugugacuuauucuguuuuucacucuaauuuagaauauauuacaacugccuaagcugugcuuuugacagaugggacucaccuaacugucuauaucuuacaugauggucuguugugcauaugaaaaggcauguggcuucauguuuuucaauguugaauguuuucaaaucugugggaaauuugaaaccucugagaaaaaaggauaccuccauaucaccagauuggacaguacuuccucagcguuuuccgugugccuguuuguuuaccugugcauguuuucuaacucuccugacucacucagcauauucucagucacuguuuucuuaugcuugcuauagcaugugagaauaauugacuagacacuccacuucuaggcaccuuuguagaucgcacauuguuaggaauuguuauggaaucucauuuucauuauaguuucacuacauauccuucagaaggaaaaguaguaaaugcuuugcuuugaauuacaugaaauuuccaagugucaaauuuuuuaaaaaauuuauuuauuuauuuuauguauaugaguauaguuucgcugcccucagacacaccagaagagggcaucagaucccauuacaggugguugugagccaccauaugguuacugggaauuaacucaggaccucuggaagcacucagugcucuuaacugcugagccgucucuccagccccccaccccccaguauaaguuuuuaauugugcugauucuaguggaaggagaguaaaagccaugcuggcuggcuguacagagcugcugcagacaguggcugucuucugugccuagagccagaauuuugaaagauaccuuguagcauauccugucuaagaguuccauguccaccccagcccauuuuagguuuaugguguccuucccagguaaaauacaguuccaagucuuuccacuauacugcacacucuuuuccccuuuuaaaauuuagugguggagggccagcaucaccuucuccccagcaaaauaaauauuaaacuagaguauagaggaaaauugauaaccaugacuguggccucuuagucauuuaaauccuugacagcaguaaacuauuuaaauuugggagauauauacauauauacauauacauauauauacacacauauauauacuaguuuauauauauauacuaguuuauaagagugugugguaagccaaaaugugcuggcccucgaagcauugguuuuugcaaaagaaugucuaguguuagcaguuuugcacaaggcuucuaguguucaaggcuucguuccccagcuccgcaacgagcaaaaagauugcuaagagcacuguagcugggacuuuguacuuuaacuugaaauagugaacucagugcuacgucugcuugaacauaguuuagaaauguucccuacuauaguuaccacugagggaagucaccaguacacaguacagugucugcagugucuaggggacagugcguguaagagugcuggguagccacauuacgaaggauuagauuugauuauuuggaaccucugccuaugcguuuaggaaugagacauggcucagaaguuaagagccuuuguugcucuuccagaagucccaugugguggcucacaguaacucuaguuccagggauccaacuuccccuccucaccuccacaguccuaggcaugcacaugcuauacuuacauauagacaagcacuaaugcacaucaaaaguaagcaggaauaauaacauucauacacagcuuaggagcgggcuaggcucuggcuaagaguagaaugcuuauguaacuaacaugucugaggucuuggguucaacaccuaguauuguaccagaaacaagccaaaaaggauaaacguuuguuguagaugaagugauguaaaauucacuuauaaauaacucgcaugaaguaaaauuaaaauguaccucacuacuuguaaagguaauuaucuguagugggugcucacauucugacauuuguaugccucuuugauguaauaccauaagagaaauauaacuaucuuaucuguauuuuuaagaucuauuuuauuuauuuauuuauuuugugggugggugggagggugcaugcacacacgcgcacauacacagaugagugccuaaaaguuugagagcaucaggaccccgaccuccgucgucugugugccugccguaacuggaguuagagacgcuugugaacugcuuuugauuaggugcuagaacugaacccaggcccucugcagagauaguucucuagucccuccucccucuaaagauaucucuacuauuuuugccaaaaguauuuagcacugacucugaucacccagagacagaaaaccuggauguggagcacagacacacugccuaaggugugaggaagacacggcggagcgagggcuuugauaaugcgaagaucagccgagccuggacugcagcuugcuccucuuuagaaaaggacagcuuugaaaggcacuuuugggacagcucaaucuugaacaugaacuuuccccugagggaugcuaaaguucauucucuaaggcacagcaguuacguuguuauuguagauggcuagagcggaugcccgagaucuuacugucaaaucauucugaggggagagggacuuuuguuggucuuuguucguauuuguuuguugggaaguuggcuagacagaagaguaguggcuguaaacucaggugaaggaugcaggcaggcauucccuuccucagcuuguccgugaguuuccguuuuucucaaacauuaaaggugagucccuuuaaagaaaagcgguacuacucacugacugcagugugggcacccuggugcuugcucucauccggcccuuuagcgaauccauuuuucaguuucuaguuuguguuucuguauuuuuuuuccagcaguaaguaugggaaacucagauuuaauuaaguggcuuuauucaaacuugcucuuuuuaaacuuucaaucucucuucagaguccauuuaccggagaggggcacgccgguggagaaagcuguauugugcaaauggccacacuuuucaagccaaacguuucaauaggguaaaccuauuuuauugaauucuaguauuuugagacgucuauuuuuuuucuuuucuaugagagaaagauaaguuuguuauuaagguugauaguccuuuuaacagagguaagcagcaaggccuugcaccccggugcuacggccccuugcguccugcugcgucagcgccuccaguuuucacagcccuucuucucagugcccugcacucugcuucacucugcugcacucauagccuucucucuaaaaauaccucagguuuuuuaaaaaggucaggcccuuuuuaaauucgaugaaugacugucauuagucuuagguuaaacuccuaaugucugcuccuuauugucaaaugagucugaaaaaauauauguuuuuagaauuacaaaaaaaaauuauguuuaaaugcauucaaauuggcagaaauuaucagaguuuauuguguaagcccuuuaaucucacuguuuggaaaacagugauaguagcaaacacuuggccagcucuaacucuguaucaguuuccugaggccuuuaccuguguugguucacuaaauccucacaacagcucugugacauagguacuauauauucccauuuuauagaugagaaaaauggagucuugccuuagaaguuucagccaguaagugcaaagccgggguuugagagcaugcagugugcuggcauagccacccccaccccagcccuuuucugacacaaugcuuccuuccuauguugcugcaguugcccugaugcuuaguauaccgcuggaguuagccuagcacucauggcagucgcuccugagugccucagugcugggagcgccugcuccuaaacaucggugucagcacgagugcaugccgggggcccuggcaucacugagauuugggcaccaggcucuaggagagcagggcuuuggcuugcccucuccucagccugcaaggcugcaugcuuuaucagccacucuguucuguguucauuacuaggacauuuuuauaagaugaggcuuucuugagugugacauuggaaagcggcauggcuguacauucacugacucuuugaaacccagucuuguucauuucucauugguccgcaacaaccuuugaagacaaauuaugagggaggagauuuuauuuuguuugaguuuugccauaggcugacaacugaugucaugaugagaggauuuaauuagagaagaagaaaagccacuuauuuuuaaauaucuuagguuuauuuguuuggcuuuuuugagacagucucacucuauagcuuugacuggccuggcaaucacuauguagaccagguuggccuugaacucugugugugugugccucugcaucaugaaugcugggauuaaaggcauagugaguaaacuguugggaaauaacugggagacagguaaugaaacccuggcgggccuggaacucccagugauccaccugccucugucuccugagugcugggauugaaggugagggccagcacgccuggcugugauaaaguggucuugaauuuacucugcagcgcgcccacugugccaucugcacagacagaaucuggggccucggacgacaaggauacaagugcaucaacugcaaacugcugguucauaagaagugccacaagcuggucacaauugagugugggcggcacucuuugccaccgguaaggcaugggguucuguuaguuauauacacgugugggugcuucaguuaacaaggcugaaacaggaaggcauuguagaacuacaucucaggaagucuugaaacugucuauagccucauuauuuuagcauaauaaauaguauaugucuugaccauacauuguuuauucuguuguugaacauuuagaucauuuucuagguuuuccuauaaagaaaaucauagugaacuucuggcaaauaaaucuuaacuccuuaaagguccaguaguagaguuacuugguuaaaggauacacauuuuuagaaaaaucaggauguauuuuauauuguccaguagaaugaucaccccauguuuauuccuagaaccuuguucuaggaaccuuucugucguguugugccaugacuaaaggcugcuuggggaaggagaggacuuaguuggcuugugcccacaggugacaauccgucagggagggaagucaggcaggagcuccugggagaacucagaggcuguggagcggugcgguuuacuaccucucacgcgcaugcucagcugccuuucuuaugcagccaggcccauuuaaccaggguagcaccguucauaguggaucagucagcagucaggaggaaccccucggugauguccacucuggcggagacaguucuucaucacaaguuccaucucaccaggugucgaguuggcagccagccuguuugggaaauaggucauuauuuuguggguagcucauuucugugaggauaauuuggcugauuuguucaaguuuuaagugaauuuauaguuuggggguugggggguggguuccagguuuuagggaagaaaagaaauacuaaaaauuguaagcauaauuuacccaacuuccuguuuguucugguuauuaacugucaaucaacacaaaguagaauuaccugggaagucuucaugaggaauuacgucaaguggauuuuggguggugagauugcuuugcuccguaauugagguagcaugacccucucugagagaggcaguacccacgcaggagcgggccugggugcaugacuagagaaggcugcaggccugccuguguccauuccucuuaugcuuucacugugacugacugucauggcacuagcugcuucgugucuuccuugacauguguccuccauggugaacggacacagccuggaauucauuguuacccuucucagcugaggugcucguuugucaguauauuuuaccacaggaaugaaaaugaguuuccuugaguagucuuaguugguaugcacauguaugggagggaggagguggccagggugagcgaguguaugagaugucgggguggguacugagcgcaugcuuaguuagcgugaaggcauccuagaguuagaacugcauaccuaacccucaucguaugaguuagggacaguuggccuggggaagccuugucccuagggugcuggcagggccuugcuugaguccaugucccagagguguuuguuccuguuuucuggcccauugauauuuuugagaauauauagaaaaauaggaaaccuacaaaauauuguguauagauuuaagagguuuauagacucuuacagccaaccucuggaucauagcaagaacuccuguucuaaaccuuucugccagagauuuaaaaugcagcucagagaaaaaaagguaauuuagaaggaggagucacaguagauaguucaguuuuauuuucaauugaccugaagucacuguguuuuucuuuuuuucugaaaaaagugcaaaaucacaucauucauaggaguauuguauggcuuuauagagcuaaguauuauaaugauaaugucauuuagaguuuuucacaguuaagucuugguaggauacaagucauugaaauacuguauuucuggauuuauagagguuuggggaacuuaaagaaaaucuucuaagucacugucuuuggcaauguuuguaggaacccaugaugccaauggaccagaccaugcauccagaccacacacagacaggugagugggagcagccgccccaggugcugugggugcuugcuuaaaguguccuuucucauaguagggcagcuggcuuccuuccuuccucccuuccucccuuccucuuguuuuuugagacaggguuucucuguguagcuguggcuguccuagaacucacucuguagaccagagauccaccuaccucugccucccaagugcugggauuaauggugugugccccgccaccuggcucauucuuucuuuuuugaauuagcauacagaguauaagauuucauuauagcguuuucagauaaaacugguugcuucuccucuccuguuuucuccuacauguccccuauccuaagcccuucugcccccaggagccuccucuccacuguuuugcgguaacuuuuuuuaagucuaaguuuaaaagcauauuguaccuaaggauauuuuguggugcuaaaacuggucacaauauuuuaguauacauauuugaaaaaccaacuguguaaacuaacaguuggcuuucucaggucaaaaaaauuauuuugagaauccuuuaaauucagcaaaccuaguuccuuuuucacagugagaaaguacagagguguuuggagccaugugacuguucuggaaaugugggguacagcauagcagacugacugugagauggguguaguguuaagcaggaauaaaccuuaaacacgugcuugggaaacucugaagcuauaagaagcuuucuggaagggcagacggguccauuggucauagaagaagcuugaagagucugagccaagggccugucacucccggcaucagcagccuugaggaguagagccccgccuugucagcccuucaucucugauggucaggggcucuuaaaguggagacaggagcugaagaccaugggcucaccguugucuuggggugugagagcauuaaguaggacguguagucacaugcacagaccagguuauucauaaggaggaggagcagaguugacugcugagugggcacccuucucugcccucggggcccgggaggguguuucccuggcuguccuggaacucagaucugucugccucugccucuccaaguacugggacuaaaggugugacccaccacugccugggccacaacucuuaauauauaauuuaggacaaauauuaaacuuuaauuaaacuuacucacauguaaaaacuaaagaaaagccaggaaaagaaaaauuuuaaauaaaauucauuauuaauuauuuuucuuuuuuaauauuuggguuugaauuuucaguaauuccauauaauccuucaagucaugagaguuuggaccaaguuggugaagaaaaggagguaagauaauuugucuaacuguguacagugucuuuagcucuuuagaaagacauaauucuuuaagaauauaacacuuuggggcuggcgagauggcucagugguuaagagcgccaacugcucuuccgaaggucccgaguucaaaucccagcaaccacaugguggcucacaaccauccguaacgaaaucuaaugcccucuuggaguaucugaggacaaacacaguguacuuacauauaauaaauaaauaaaucuuuaaaaaaaaaaaaaaagaauauaacacuuugaccugcuuagauaauagaucauaauaguaaaauaugaggauuguauuuaaugauuuuagaguuuuauuuugauuuaacuuuuuaauuaaauaauuuuaauuaugaaauaauuugaaaauuuaucacuuuaagauaguauaaacaaaaauuacaaaauauaugagacuagcauuuaguaauugauauuauuugaaacauauuguucauucuuccauuuuguggacugauagcuuauuuuaaguauaaaugauugaaugucuucauuaguaucugaagcaucgucuguguaugauauucagggguggggugggccugcugcucugugcuuguggaggucaaaggucagcuuuguggaguagcuacucuguccaaccggcuccugggauccaaaucaaguugcgaggccugugugccagacacuuuuuauucugccugcucuaaggccacuugccuuuuuuuuccuuuccuauuaggcaaauuguuggguuuuaauauguauuuuuauguguaucuauguaagagaaugccauauaugugcaggcaguuauggauggcagaaggaagggcaugucagaccaauuugagcagucgcuaugcugcugggaguugccuguguggcugccgagcucugauccuguguaagaacaccguggucuuaacugcugcgcugcuucugcagcccaggccuauuuauuucuaagacagaaauuaauuaaaacagugaccaguuuagaaagacuuuugguaaagaagucaugucuuaccuauuggcauggaggcagccuuuucagccauuuuuaguugugcauauagugcuuauagcucugcuuuucagauguauguguuuuuggccauggaaaaugacuccuuacccuucuccuuucucucucuaguguuugauggguauguuauuuuggguuucucuuguuuaacuuucaacuguuacuaugaaaauuauggacagaauauuguaguaaaguauuauuaacuucuuuaugaacacauagugguuaaucuuguccacgcacuugcuuuacuccaucauaauuuugaaguaaaucuguugacccaauuuuuuuuuuuaagauuuauuuauuauuuuauguaaguacacugugguugucuucagacacaccagaagaaggcaccagguaucauuacggaugauugugagccaccauguggcugcuuggauuugaacucaggaccuuuagaagaacagucaguguucuuaaccacugagccaucucuccaguccccccaauuuuuaauaugacaucuuagacucucuuucuaauuuagucaauuacuuuuuguuucuuuucuucuucuuuuuuuuugggggggggcgggggagugucaaguucuuauguagcccaggcuggccuggagcucccugcauagcugaggauggcucagucucuugauccuccucacucugccucccagaugugggauuacagauaugcagcacccugcccagccagcugcacacauaugaccgcccugcuuauuucucccucccccuuuccuccucccuccccccuuccucucucucucuccucucucucucucucucucucucucucucucucucucucucucucucucucuuucuuucuuucuuuuuugguuuuuucaagacaggguuucucuguguagcccuggcuguccuggaacucacucuguagaccagauuggccucgaacucagaaauccgccugccucugccucccgagugcugggauuaaaggcgugcaccaccacgcccggcuucucucuuucuuuucuuucuuagaccacauguuuacuuuuacauugccaggguuguuagcacuauaggccaucccaccacuguagcaaaaccuuucuuguuuuguuccuagugagucagacaaagggagaaaacccuacuaauaaggccugagaccucuguucugagcccaugugcugcacaugcuucucugaccagcuccucgggguccuuuaguuccuuucugcuccuuuuaaaacugauggcauuuuuaucaucaucaucaucaucgcuauccauacugcgugguugcucacuauugagauuuguaagaccuuuuaaaugauaggcgcauauauagcaaacacccaaacgauggcauacagcuagaugaauuuccaagcagugagcacuauguaauggccuggcuuguagcuucugguccccggcagucccuucuccccugcccuaaaacuaagcauggucuguaccccuuggaucaccuuugccuuccuuugcucuccucccagcuauagaaacagacucuugggacaugcaagucucugccguccugcauggcacguagaugcauaaacagaacagucucccuucguuuuaccauuuccauugucuguccacugcucagucuccccuuccgguggcguuauuaccaugcguuaugaggagacaacuggcccugcugcugaaaggcugucaucccacccccucaggaggcugaggcacaaggauaacuuaaagggccuucuggcuacugagccagcuggcucagagccugccuggcaaccuagugaagaccuguuucagauugaaaauugaaaauuuguuuggagaaguguuuagugguaaaacacuaacuuagcauacaugagauccuggguucagucuuucauaucacauaaaauacauaaaaaucaguucccagcauugcaugaaaaugugacaauguaaguaaauaaacaaguuaagugcaugaccagucgccaugcggagucacauguaacuuucacuggaagagacagugccaguuuuuaaucgugacuuuacacugccaucaacaguaaaguucaucaugucucuuaaagaucgaauguuuuggaauauauaugcgagaaaagaguuaagaacugaaaauaucuuuauguuaagaaaauaccuuaaaaucauccucauuagaacaguuuguuagaaguaaaaguuuuuaaaagguuguugcuguaaaugcucuccacaggcaaugaacaccagggagagugguaaagcgucguccagucuaggucugcaggauuucgauuugcuucgaguuauagggaggggaaguuacgccaaaguacuguugguucgguuaaagaaaacagaucgcauuuaugcaaugaaaguugugaagaaagagcucgucaaugacgaugagguaaguguggggcuggggguggggggggauggugucacuguuucuagacagaccucacgugcgcgagacucuuggugcaauccagaguaccacacauccauguacacaugcacacgcacacacacacauacuauuucaguguuuguggguuacuuucuaggcacaugcuuuagguaaaaguaaagucagagcauauuaucaucaagggaaguaucauuugagcuuuccuugcuuucuagacuauuucauaauacuggauauuugucaaugguauucucucuuuguauaagguuuguuucaugacagugugugguuuugauauuuagucuguuugguuaacacuugugaucauugacuugcuaggaacaaauuuauuauuaguuugggucaucucauuugacacagauuucucugauauuguaaauaggauaucgauugggugcagacagagaagcauguguuugagcaggcguccaaucacccuuuucuugucgggcugcauucuugcuuccagacagaaagcagguaaggcuaaaggauaacaagugucauuaggugucauacuuuuuggcauguuauauaagaagacucuguuucccauaauucuugaaguaggaggacuacuuauaauuuccugcuacaaucagugauaccaauuuaacaccagucacucauagacauauaaggaagaaaaagggagcggggaggggcucuucagaagcagcaguagcuagccaacccuuuacguauccuccggauucucgccuuaugacauaaugucucauuaccugaagugacauuuaaacaugacucaccuaguuccuaagauugcagugaaacuccuaagagugggaucgauugguguagaaguagaaguugggucacaccgggucacauguguccacuaagggcaaagggugagucaucucaagagccuucaugcugcucugugggagaugccaggagccguacgacuaacugacgugugcuucuugccucuucucagguuguuuuuugucauagaauauguaaauggaggggaccucauguuucauaugcagcgacagagaaaacuuccugaagagcaugccagguaaguguuuuguuugaguuggauuuuuuugcucagggcugccugaccuuuuaugucugcuaguugaaaacaguacauaaacaaguuaucuuguuacaguuuauucuuuguaagucaugagguaguuaaguuacauaauauauuauaucuaccacauauuauuauaaucuguuguuuguguuuauuauguguuuaggguuuuacagaugguuauuauucauagcaaggccauauuuuuuuuuucaauuuaagguuuuacucugcagaaaucagucuagcacugaauuaucuucaugagcgagggauaauuuauagagauuugaaguuggacaauguacugcuagacucugaaggacacauuaaacucacugacuacggcauguguaaggugagagacccccuggauggcuuguaaccugucagcuaaguaacuucacacuuagaugggaagagaucacugccuuguugaggaugucugagaguucuggucugaagacagguguacucucuggccauuuggccacguggagaacuccaugucuucugugauguguguuauaaaugggccacuuuuuaaaaauugguuguagcuuuuuuguuauacuuuugaagaaaauuuggaaauaacauuaccuacaguccuguuacguuaacacaguauuugcaugccaccuuccaagcuuuuaccauuuaucagaccugaaccuacuuucacauuuuuccuaggcaucuuuuauauuuaacuuuuaaaucucugacauacaaugugacauucaaucaaguaagcauuuuacuuugucucagaauaugucuacuaaucucgcuauuuuacuccuuuggcaacaguguuuuacuuagagguuugaucuuuucccacaaaaugucuagagaacuauucuacuuauuaacccuguccuaacaaaacaugugcgagugugugagugugcgcacugcauccccauccaucaggaggagguaccguaaacacacacaugguaaugaggauuuaaugucacccugcacaccuuauaucagguaguaaagucaugcaguguauacaacucaagaccguuuuccugucaugcaccuuaagucauucucuuuguaacuagggaagaggguuaagucacuggacccccugcaugccucauuuguauucacgaugccuuuuugcucugucaugguuuuccauaguguucuucucucugguuuuaaaacucaucacaauaauaauggauucuuacaaguuccaagggcaaaugaaaagcaugcagaguauuaaucugcaaguuagaacaguguuuuggauuuuuuuagucacaaucugaauguuaguuaaaauuacagguagcuugaggaggcagaggcauggugacacaccucuauagggugaagcagggugaucaugagcucaaggccagcguggacuggacagcaagaguuugcccaccgagccaucuucccagccugggaggaaccuuucuuucaugacuucuguccuucccuugucccccaaacauguauguccauauuuauacugugaugugaguauaugggacacauuuggugguuggcuugguuuuauuuugucuuuguuuugguagguguuucuguuuggcuugguuuuauuccuuagaaacaaaauauugguguguagcugagauugacccugaauuaacaauccuccuguuucagccuuccaagugcugggauuacacguggaccaccauacuuuuuuaagucgucuaaaaaucacuguuuauuaguuauugguguauaggguauguuuucugaauguugaaaccucauaaucaaagaccaugaaauuuuccuacuguguucauuuuuauucuuuuuuagaaaauguuaguagguauacagaaacuuauauuuguuacagcucuugauggguguuccauuuauuguuggguuuucucuacuuaguuuauuugugcauuguucaccuuccuacagcuauuaaaauaucaaagcagaagacacagucgguaggaaagaaaacaucacaaugucaacagucaugaaguagucacuguagucacaugaucucuguuuucauaguaaauuuuaauaaauguuauuuuaaaagcaguuuuauguuaacugaauugacuuuagcaacgucuaaagugaauacguuuucuuuuacucuguuuaguagugaucacuguuccuagugacgcuguucagguuuaacauauugcauauacaugcugaguuuagacacaugaaauggaagaggugaauguaaaaugguguugucucuuaucuuuuccccgucuucuccuuuccuuuuuccccaugaaaggaaggauugcggccuggagacacaaccagcacuuucugcggcacucccaauuacauugcuccagagaucuuaagaggagaagauuaugguaauaaauuaauaggugguauuuuagguguuacuauaauugguaccaacuacaacauaaauaguauagcauuuuaauauucacuaauauauaagccuuccuuaguucaguuaaccuacguggagacccucagauucugaaacuggacccauccauaaaagguuugacauuugggagaauuacauuuaaauaguauuuuacuagugacaagaacuaaacaguggcaagaacuugguaagcaguucacucuaaauucccucacaagccuucugagguacauguugacuuauuugacaaagaagggaagcaauguacagaaaagcuuaaauuauaugccugggucacaaaagccaaggcagugcccagguaugcagguacguauuaacucaucggcuaugugaauccagggucacgaacuucagaagauuguucagauucaggggauauuucccuuaguguucuaaaaguuccuaaaggcugggggccugauagguaccaggaaauaccuaccuuccuuccuuccuuccuuccuuccuucucuuuacagaguuagggugucucuacauaacccugucugcccuggaacuugcucuguaaacaagguuggccucuaacucaguuccuccugccucugccuccuuagugcugggauuuaaaguauggaucuuuggcggccauuacuuuucuucacauuuauuuuuauuaguucuuuugagacuuuccuacaauauauuuugaucacaucuacccuuuccuguuccuccuguaugcccccacugccaacuucccuaauccagcuuugucuccuccuccuuuuuacccagcuaguccaugcugcccuuguguucuuggaucuguggacuuccacgggagcauggucaacuugcagggaacaacucuuuuagauaaaaguuccucuccuguagcuaucacuugccauagccccgccuguccaccucgcuuaccaugcugggauuuggucugacuugaauuuacacagggcuugugcaugcuaucccaguuuuugugagcuuguguguacagcugcccuacuaugucuggagacauguuuucuuauguucacccuccaccucugguuguuacagucuucccccuuucuacaaugucuccguaugcuugggagaaggaacauauauguugggagaaauauuaaaaaaugaaccggcauguucccauucuugugccucugccucagcggccugaccagcaaaaauaucucguggagacucucugaccuggaguucccaaaacaucuucacccagcucgcuaaguucccacuggcggauaucuaccaugacagcccuaagcuucaauccuccaaggccuguguaguacaccucaggcaaaccugugcuuugccaccagaagagccgaugcuugaaggaaaacgcaacacaaacuuaguucagaaacaauugcuggcacaacaacaaaaauccuaacuuguaagccuuauuaaaucuaaauccuccaguggcaaaauccugacagaucugccauugaaucugggagacacuuguaauuacaucuuguccucaugguaucccuguccaaaaagaccuaacucuuuccugcuuccucuucuuccuccauccaacucggaagucccuccuacucgcccagugauuggcuccuuuaaucauuaggggguugguucacaagaagucaccugaguaugacucacuccucccaggagaguggaauuagcaucaacauacaaacagcaccaggcucauccacacacauacagauagucauuuuaggguugcuuggaccaaguaucucuguaguuuuuagugccuaccauauuauuuauacucuaauuagacuuugcuuuuccauuauguuuacauuuccaucucaugauaaaauaaaauuucugggaggcuggagagauggcucagugguuaagagcacugacugcucuuccagagguccugaguucaguucccagcaaccacucacaaccaucucuaaugggaucugaugcucucuucuggugugucugaagacagcuacaauauacucaaacacauaaaauaaauaaauaaaaucuuuaaaaaaauaaaaaauaaauuucugacugcuggauguucacacaugcagagaagguuuauuacuuuaaacuucucucuaaaggcuucagcguugacuggugggcucuuggagugcuuauguuugagaugauggcgggaaggucuccguuugauaucguugggagcucugacaauccugaccaaaacacagaggauuaucuauuccaagguaauuugcaauacuucggggaaauucugugaauaaccuagagcaaaguaagggcucucaaauuaguauucucaguuaaaaacaaggagaguaauuuggacacacaccugacuucaugauaguuuggagaauuuuuagauagucccuucccacuucucuagccuguagcuucgucuguaauuuccuucccacacucaauucauaacaaagcauuuaaaugugucgucauacaugcuagaacagggaacuccuggggagauggaggcaucuguuagagacuaaucucugcacaugagccccagacuuagugcccggguucaagaaaaguggagugugauugugauccaagagaucacagagcuuugcuaaggccuccucagggagggagugucauggugaggagugcugacagucaacagagcagagggaggaggccaagcacaggaccucuaccagaaagugugcagcagccacagaauucugcaccuaauaguuaagacccucacaggacaugaggaaguguuccauagaauaaggaaccagagugccugccauuaagacuauagaaagagaaugcaaagugcuaaugagcuacuguuuccugccugugccccugacagagauuugagauugagaguaacugccugguacugaugaagguucggagcagugggaggucuucgggacugcucguggggguugaaguugacaggagcuuugcagaauaauuucacauuucccaguacaguucuguguuacauauauaugcaaacacuuuacaguacuaacuuuuguaccucagaagagccccgugaagcagggauuguuuuuauugaggcacacuaaguugguaaaaauaaaccaggcuuguaaauaauaaaugcaguacuaaggcaaggggccagcucugagaaggagagccaaaggcaaugcaugaaguguugcacuuaugcagaugauguauauucugcuaggaugccuuaaauagcuugggauuuaaagaaaaaacuuagauucaagccacauaaacacuaaaaaugauacugugauucuuaucuuuuuaagucauuuuggaaaagcagauccgcaucccgcguucucugucuguaaaagcagcaaguguacugaagaguuuucucaacaagguagggaugauguggacacucuucugugcuuucuucccugaggaagcagagcgccuugucggcggaggcucaggcgcugggauguuucagagcagggauauguaacuuuccaguuagaacuggaauuuuguuucauaaccagacacagggucaaauccugaccugauuauccuugucauguggccaauaucauugauuuaccuccagcuugaccuuuaaauauaaaugauacacacauaugcucuccucagugaaggaaaauggagucuguaauuuguuauaacugcauuuuuagcuguguuucuguaucuuuagccauaaaaccgauuucucaccaaguggccaagaauguucucuauccauuucauaauaacucuguauuuagauaaaauucagaagaaauggaaugagauccuaaaauguaagcaucauucaguugcuuguggaaauugguaagccagaagcauuuagguucuaagauugugaauuugggauucauaaaauuuauuccaaauaaaugaagguauaaaauggguuaccucugugggcacauaaggaugaaauuaauaaaauuggaaaauugcaccuagugaagauggcuauguuuuuaucauguguauguguguguggguguugugccgguguguaaucuguagcacaugcgucacuggugcccaggaaggguagaagagggcacuggaucucccgcaccuggagguagacaugguuguaagcagcuguggguguuaggaauccaaccugaauccucaggaaggagccaucucucuggccccugcuacaaugucuuaaauaucuuggaauuuaaagaaaaaacugaaagcuuuaagccacauaaaagcuaaaaaugauacugauucuuaucguuuucaucguuuuggaaaagcagauuugcagauauuuacacgagggaggguuuaaacugggacgcuucugcacuaugaaaagugaaguugagagaugcuaauguauaaaauaaaacgccuuucacccagaagaaaacauuguaauccauagagcaaaagcuaaguuccagccucugccucgguccagugaucagauaauucugugucauugucuuagacaaauuaggauuuguugcugcagaggcuuuaacgaugagcuaaacauaagugugcuguaacguccagagguugcuguaauuauuaaauuauuaugcugcccuuguuuuuccacauucuuuagcaaagagugaugaaguacucuaccauuuuaaaacagggucuuauguagccuaggcuugcauucuaagauucuaagauucuaagauucuggguaugccccaccagggcuggugacguggugaguugauaagagccaggaggaaaccuuaccugcugugaccucugaauuacucacuuggcucuggaccaugcuuucuagaaauagcuagacauuucaacuucacaaaugaagccaucauaaaauaggaauuauacuugucuaauuccugaacacuacucuugcuauaggacccaaaggaacgauuggguugucacccucaaacuggauuugcugacauucaaggacauccauucuucagaaauguggacugggacaugguauguaaauuuuauuuuccuagcuuggguuuuaguguaaucaaaguccaauuuuuaucauguuuaucauaaguuauugaaaaacuaagauauuauagcuuaaguaacuuaaaacuacucuauagcacuuauauaaaacuuaagaaacaaacagaauaguuaauguacuggaggaggucauacuggggccaauagcaauguuccucuuacuaagauuuggcuguggcugcugaucuuguguagcagcauacauggugagacaucagagagcacaucaaagugugaggggcagugucccaagugcacaccucggcugucgugaggggcaaugucccgagugcacaccucggcugucgugaggggcagugucccaagugcauaccucaacugucaucugcaugucuuuuagauggagcaaaagcaggugguuccacccuuuaaaccaaacauuucuggagaauuugguuuggauaauuucgauucucaguuuacuaaugaaccaguccagcucacuccagaugaugaguaaguaauuauacacacuaaaaguguucucaaguuucuuuugaaaucucugaaaccuuaaagcuauuuaauuguuuaugaaauuauucuaugguuuauacguaaccauuacauugcuggguauuugaaucauuagcuguuaaaaucucucuagcaacgauuguaucuacuaacuuguaugguuguuccaguucucucagcagccucguaagguggguauugucaucuucacuuuacagaugaggaacuaaggcucagagagagagcaagagcaggugucagggcucacaccugggcugacugaccacggccugugggcugcauggcuccauucuaaauaugccaucuccucuaguuucugggugucccuuguaagagugacagcaaguuucucagucuagccagcaggggucagaauggugucucugucgcauccuuuaaaaauguaauuuaaagugauuugagaucauuuugauucauucucuuucucccucacucucuucccccaagauauauucucuuauccuaaggggccucugcuccuuggcauucacuuucuuuacuuacaucuuaguccuagcguccuucaaagcuguuccuuauuaucucagguucugaagccuucucucaguggaguguauguaaucauuccuugacuuuaacuguaagaaucgagacuucucugauguggcuugcucccuucucagaugaacucgggcaacucugugucucaggacugucccuacuaucuauucugggccuuauuucgccuccugcuggggaagagcacucuucuggaagcacugcugucccaccaccaucagccaccacaccauuugcgucugccuucuccuuugccagcugucucauugcuuuaccucugaacacuuucuuccuaccuaaaagcacgcuuaguuuugcuuuuccacagaaucuuauccccuuuuuguuauuuaauucuuuucauuuucagacauguaaagaaguaguuagugauguucuuacuaaagagggguaagcggugucuaccagacucucucucaucaggccagugagcauuggcugccucauauguucuuaccacagacgcuugccucuuaagcuuugccagaucaggcuggcuucuuacuuuccaaguuucaaagcacuguuuggcuaauccucuucuccccuggcaucuguagaagguuugacauccugagcagugccaguuucaucucuauaacaauugccuguuaucuuuuuccccuuuguaugucaccaggaugcucugggcucaguaccugccaacccucuuugcaauauucaguuuguaccuuagaggcugcagcaggcccuguaugguagauacuagcuguuuagugacuacugaguaggcaaaugaagcaaaaggcauugcgcuaagugcuagauguucacgggugaucaaaauagugugguuucacacaaagcuuucugucuaguaggagagcuguagcagucauuccccacagagcugugugcuagaaagaacagggaguucauaagagaugcucaguccauguccuucuugccagcugugcacccugcuguagaauuguauaacuucucugagccuguuccuucucauugucucuaccucacaagguaccuaugaagaaguaagugcaagauggcuucugaagccuccuacugccccuccgcagcucuccugagcacuuccaucuguuuagcaucuccccucagauagcuugagucuaagaaccuuugucuacuagccuuugucucucucuguucuuugccacuccucauguccgcccauugccccgccgccgucugcuccuguaguuguugacaucuuucacuccucagauucuacagugcccacugcugaugggcuugcgugguuucccuuuaacacuugaucugagcuuccuuuucuuaucauguugccuuaacccuagauccagacucuugcaaaucaaacuaaaaauguagugccuacuagcugauugcuucaugccuuuaccauguuauuagggcuuccguucuucagcccuucaucagaaaccuuccagguaacagcuguccucuugccuggcauuuuaaccuacucaugccaacagugccccggcacugguccugccugacuuuuaggcauaucaccaagagacaaaagauguuuggagcaguccaccauuuaccauucccuuacagcaggugucacucucucugucuugugucuauuuuccucuaucguuuuaucaguugaaaugaucucauuuauuucagacaaaccugaaauacagcuaggucuuugauugguggaggugaaauaccuuauauaagcaucauuagcgguuuuuaaucuagccauggcguucugccugguaucaccuaccacuuagcacccuucuguuccuaaacucuuugauuuucuugcauuucuaacagucuuucaaauuccacuucuauaaugaaugcugauuuccuugauuucugcagcuaaaugucacccucccgguauaggugugguuagcucacacuguaugagauuuagcagacagugggguuugggagaugggcagaugcuugccauguaagcaugaggaccugagcucagaucuccagcagcuguguaaagccacgugugauggugcaugccuguaaugccaguacucgggaugcgauggaguucgguacccucgagugagguggagagugaucaaggaagacucuacaaguguguguacacagauguacuugcauauauaugugcgugugcacacguguacacacacacaauuuaucagauaacugcuuucucuuaagacuuuccugcaugaggggccaugcugucuguagcucugugcuuugcauuucugccuuuuaaaaacccucagucugauucuggacccucucgguuauaagguugguugcuuguagggcucuuagucuucuugugaggcuauuguuuuuccugauucuucuagaacccacuuugugauuaagaacucauuuuuccacaguaaugucauuuagccuuauguuuucaguuguauuucaguuugaaagaugaagauaucuugauuaugauaaauauuuguguuuuucuuucaacagugacauugugaggaagauugaucagucugaauuugaagguuuugaguauaucaacccccucuugaugucugcagaagagugugucugauucugcuugccgccauucagugcauggauauccacccgucagccugcucacaguuagcauuuuauguugccccugcagaagucgcucucgguauccuguuggagacuaggaaucauacagauaaauagaacuaagaaacagaagcuagcuuccugacaaucaugucgacccugcuuaugcuugcucuccagacacuccuaaugaggaaggacggucuuuguguaaaggaaacaacacagcuugucaaagaaagccucugcugcguugugacacucgacgggaugacaucaucagucucccacaguuguugucacuuuguguuaagucauugaaggcuuaauugcgcaguggagggccaugcagaguagugcaucugcuaguguuacugguugccgaggucccucaguuuaagauuuccuccuauaaauaaaucuucucauuacuuuggguaauuaauaauuaugaauuggguucuaaauuauuagcuguguuucaaaaacuggcacagugauuuauuuauuuguuuuuaauuuuuuaaaauuauuuuuacacuaagggguuagcuucugagcuugccuuuucagugaaaacuagcaugcugauguguguucagaggcaggauucgagaguggcagcugcucacauacaggaaaaaguagacgucuaaaguagcuacagaaagaacgauuguagcauuuucuuucuuacuguagaguaaauccuacaguugguguuuaagauuugauguaaauaaugaggaggcucucacuucuuagccagcuuagaaaagcauuccguuuauucaggggaagcggagugaauauauuuuuauuauuauuuaguauaugggaaaauaaauuaucuucugaguagaaugucuuaacuacuuuugguuccuucuccagaguacauuaucuguacuuugaccuuucguggagucugcggugaaauucaagaccaaugaugaugaccacggauaacuauguaacacacacacacacacacaguuccagcucuuccugagcuccuaugucauagcuaacaugugauacagagugaaauccauuucagggcaggguuccucaguucucuacacuauuuuuauuaacaguaaguaguauuuagcaaucucuuauuuaaagaaguaccguuuuaagcaccauucugcuguuuauuuuaaauauuuuuauauaaaggacuuuaaaaugaucgucuaaauaagcuacaguugucaaaucaguaaauuuaacuuuaggaacgccgcgcagugcugagcuugugaugauuuaaaaccuguaggcauuugaaaaucacuuggagaaugcuacguuucauuagaagugugaguugugucaaguuugugucaugcauuuucaaguaauguaagacagagagcagugagaacccccauugauaaagccaacaaggggccaucgaggccacuugccaaaaccugaagaccugaugaugccugcagcccacgggcugguggccauggcgcgcgcagcccuccccugcaggacauaaaugcgagggagcagaccaauaagugcagugcgugcgcugacacauuucauguugaaguguguguuuccccuaagaccuggaacagcugucuuaaucuaaaggcagcauucacgcccuaagcugcuaggagcucggggguguguaugcugugaccuaaguggugcucucccuuggggcauuuuagacugagagcuguugaagugcacaguguccagccugccugggacucuuuggggcuuuguauuccauuuugagaaacuuuuucuucagguuauucuuuuucuuguggccauauuucuuauuggagugugagucuguguuuuuuugugaaaaacauuuuaagaaaggauaaccagugaauuaucaugcauuugucaacaaacuuagaugaguaaauucaaguuguaugucuucccuacccucacccacaacaaaaccuguacauuuucugccaauaacauuuaaaugaugaacaguuuucugugauaagguuuuaaccauaauuaaugguggucuuuguuuuuaaaucuuuuuuuuuucuuauuguuguuaacuaauaagacuuacuauguguguuuuauacagaauuauuacagaugauuuuaauucaguucuaguuuucaguccuuaagugccaugcaaacucucuguaugugguggaagccuccuucucucagagucuccggggagacaggcagagggaugggcgcuuggugucuuagacaccacuuauguugcauaagcuugugaucagaucgguuuaucacaugcagcuggaugggugucuaguuaucugugucccuguugccaguacuuauuuagaaaauuguuuuaauuuuuaucauguagaacacugccuuguucacuauaauguaaucuguauuuguauaauuuuuuuuacauuaaaaucuuuaaauaaaauguuuaauaccuaug

SEQ ID NO: 12077 - RNA, 27518 nt, Mus musculus
uucauuggcauuaaaaguuuuuauugggaauaucauccaaucuauacaaguuauguacaaggcaugaaaauggcaaacaucucaaaauacaauugagguauaagccaagagcacaguaugucauguuucaauaaauauaauccaaaauuuguaaacuaaguaaccagauagaugagucuuuuuuuuuuaguaaaaccauauaaaauauuuauuucacgugagguagaggacaguuuugugugucauguaaugcaaccaaccacagcaauuuuaaucauaaaacuauaugcauuggcaaaauuaucaauuaugcucaauguagcuaauuuguuucaguaguugcagaagggaccauucacuuacugccuucacagguuagaaacugaggaauaauugaacuauuacacugccuuaaaauuaccaagguaaguccuuccagcagagaaacuaauggugacuacauuuaucccaaacucuaacaacucaaaagauguccuagguuuagcaauuauuuuaaugggguuuucaugagaauuacuuuaaaugugcugugcuuucuuuauucucaagugagguaucuuauauugaagaaaaaaaucuuauaaauuucuuuuauacuaaacuaacuuuaaacacuauuuuguuuucugggcuuaauuuuaaaauguuuuauaguugaucacuuucuaauuccaaaacuguagcacuauauaagacauuuaauccuauuucuaaacaagcuucaaauuguauuauauauuuuaaaagccauuuaagugggaagauuaaaaaagacuguccuuuuaaacaagauacaauacaaaauguccauauauguuuuuucuuccaauaguggaaaugcuuaaguauuuuacacuagaaaaaaaaaaaaaaaaaaaaaagguaagcucuguuuacauaucucaguuccacaaguaaauacauaaugcagcaguucaugucacacacugcugauugcuuccauggaaccauuaacaaguagauccaaguucaggagcacauguacauagcaugaacacaauuuaccaucaguuuguaacguccugcccuaaagaguaaaugcauaacaaacaaaaacacacauccuucccuccucacucagagcacggcauguggggcaggccuuccagaggggaugcagacccccaggaccagcuuugcagcuccugcuagggaaauaccucgggcacaguuccuauuacuugugcuuccuuuucauuuugcuuuucugcagacaggaaccagagacacacagacugggcgcuucacggacucugaaggauguggagagccugcaaacaccucaguuacugguucacugacuucggucugcacauaaacuucacuauguacaaaucagguuuuucauuacuccuucccaccccuguacaaaagauuuuacauauaaacagguuauauauuaaauauguuauaaaauuagcucaagaagcauaaaacauccuuaucuucaaaaaacacaagagauucaagcuaaagacuauacuucaaaacuguuaaagcccgagccaaaccuaaguugguagaaucuuucggugcucagucucagcugugauuggcaggugguuuguuuaaacuccuccuugauggcacaggagcuuccacacuuaaguacuuggugcaaagcccucagucuggaccacagagagagaccacccauagcaacgucagucuuugcucaguaugaaagcuaacgcuguguuucuuccacuccuaaacauaguuucucagaauaaauggucucauuccucccuaaacagaguauggacucugaaggaaaaucugcuugccuagugaacuuggcauagcacacgagaccucacaccaaagccaaccuuacgagagcaaccagcacacagaaugagcaugcacgaaguaagcuucaucuggauauuuuagcagaggucacuugugggguauuacagaaugucaaaggugguuuucaagcuauaugaugcaauguaaauuaaaguuacuuucaacagcaguagauaugcuauuuacaguugauuaaaaauuguaaggaaguuuagacagaaaacgauggcacaucauuucaucuucuggaaagugaagacuaccgcucaacaaugucacgaggcaaguuucaagacuagaagaaucacacuuauaagcagcacccaagcagaacacuucugagucugucagaaaaauaaauggugcgaguccuugagugugccucccacgcagccaagcugggguacaauggacugacuacuaagcuaaggcggcuuuacaggugcccguggcuuccucccuccagaucuaaauacaaugacauacauggucccugugccaccuaucgugcuucucccaagguuacagaagucaccacacuaaauuauagagcagaguagaauaaauccacaguaaggucacaauauauuuagaaaacaaacucccguuuggaaaguagaaaaguaucuuuuaaacaaguauuaugaaacaaaguaugaccauaagcagguaugauaacccagggcuccgaugucuuaccgcauggaggacagugacagccaaacuccaaguuguuccuaagcacagaucucaagugcauguagcgcuaugagacagcccggggcacacgcaacagaagauaaugccagggcugcuuucagaaacaucccuaaaaccugcacagggccggugguggcagagcucaggccugucgacccaguacugugggcagaggcaagaggaucccugcaaagugguggccaaacagaacaaaaccaaaaaauuacaaaguuccccgaaaauuuucccuagcaaauuucaagccaagcaucugcuaaugugaaauucggugauaaaaacaucagacuuuaugugcaaaaaacaaaaacaaagaaaagugcaaaggcugcccuuccccaaaucacggaauucauuugucaucuaaaauuccugcuaguagcagauacuucaauuguggacuguuaaccuaccacauauucuuagcugacuguaaauuccugauuuuaagauuaaagagucauaaugguccauucgugcaaguuuuaagauaacauuuaaacauacaaaaguccaaaauaaucuucaagauauuuaguauuuuauaauuuaaaagaaaaaaauccauuauauaaauuucauaagaccuuuguaagacuacauauaaaacuguacaagaagauuaugaguuacauaggaaccaacguacaucaguggaauccauuuuccucgugagcaugaaugaguacuuccacaccacuguuaacaggaaaaguucagaaaucauuuuaauuuucugaagucucacacacacaaucuagagauagucacucuuaaacagaaagacaaauuacaacugcuucuugugugcagcaucagggcacagcaaaggcugccccuccccuccacacacacacacuguuuguuagggaggugguacuaucauuccaucaaucaaauuccucuaggaggaaacagaagaaacccacucuacaaccugaacaaauuaacaaccggcuucccaagagucuguaaugagaaggauacaaaauagcuuuguaucauaaacauuaccucuguaucuaagcugagccugaaauauugcauaccauggacacagguacucuccaccacagacugcagcuuuggaaaguaugcaacuguuagaaauacagguagacugaccacaggcucaaauuacacagguuauuauuaccaagcccacuggaaaaguacaaagaagcauacauuuucauucauuuggaaauggaaaauuuuguauuaauauauaaucuucacuuuugcugccauacaaaugaacagaaugccuagcuaccuucaugcaaauaagauguuagaauucaauuuucaaagcaagcgacaaacacaaagcccugucaaccacacacaggugugucuucuucagcucuuaguccuuggagggcuuggacgacuugccaaucugcagcuucagcuccuuuaucaucaucuccagcuucugucucgccucccgcuccugucugaguucaucuuggaguuccugccugucggccucagcauggucuagucuuugccucaguucugccagcugugugauuuagaagacuauguuagcuuuccaucacugaguuuuucccauuuaaucauccuaccaugguuaggaaacaaacugccauuugcuuuuuacaaaacaaaccauuuuccugcauaucuuggaauaccuaguacuugugacaacugacaggacaguggacuggaggacugggagcaucaagaggaaggagcaauguagcucacgcucacaaaggcuccuggcgucacucugacucuccacagccgccauguccacaagcucaccuucccggacuuguaacgacaguaacacagccuuacuuucuaugcuuggcuccacuuccaaacacaguaggcaauaguuuaugguugcuaauucgaaacaaaagcucaucuuacucuaucaaaagaaugaaaaacuagauucuaguuacuuguuuauccauuuauaugguaccagagauggagugcagggcccuugcguguuaagcauaagcuuuaccaaucagcuucauucccuagcccaaaacaaaauacaaaaucuuaugcagacgacuagacauuaguaaucuagauaacuaaauuacagaauaucaauuacauaauaaaaguuauuuauucacaucuaaucccagcacacaggaggcagucagaucucugauuuugacucuacagagauacccucuccacacccccccccccacaaugaaaacagaauaaaggggcaagagggagggaaagagaaaaagaacacauuaccuuaaugaauaaaagcugugccugcaacaaucucccauccugaaaccuagccugacuugacaaaagcaagcccuugacaguaaggcccagcccgcgcuacgggcugccacucaccugagccgcauacucggccucccuguccuucuccaagguugagucacaggugcauuucugcugcaucaccugcuccagcuuuuucucuaagucucucuguucaauauagaauuccuccauccucugagcaugcucacucuguaacgacucaagcucuuucuguagauucugcugcucuucagugagcuccuucaucgccuuugaacugcucagcaucuccaccuccuguaacauaaaggaauaguccuuuaggaaaaacuaagucacaaggcagcugaacuucagcugugcuaucaugucuauagagaagcgacugucaugaagaacugcuccucagcacgaaacagagcagcucugaguccaucugcagugucuagucuggcucucucuuaaccaugacuacuucuagccgggcagugguggugcacaccuguacucccaguacucagcaggcaaaggcagguggaccugagucccaggacagccagagccacacagagaaacccugucucauggaaaccacagagagaacuauggcuacugcuuaggacagcuuaccaucugcagcugcugcuuccucugcagaauggaguucagcuucuccugcugucuuacauagguucucaucacgucuuccaugaucuuccccuugucgucuucaccaucucugaccagaaguggagaggaaucuucugaaucacgcuugcuugugccucucacuaagcugcacacagcagacucagauuucuuucuacuuguagaauuauuugagauugaugaaucuuuagaaaaaaauaggggggaaaguauuaauaccacugguaaaaaggucacuggaacaauccauaaguauaauuuuuaaaaaauucuauguauaacucaaucaaaagcaaucaaauacuuagggaagaaaauuaacaaauaaauguagugccaggugacaacuacaaaagaaacuaacauaugaagacaggaaaugauacuccaugcucauggacaaaggacuuaaucuacucaaugucuccacaucaaauccccagcucuuauuucugcagaaaguaacuagcucauucuaagaaucacauugaaauuugagaaauucuaaauaccuaaaacaaacuagaaaaagaguaauaaaguuggaaagacucacaaagccccaacuucaaaucuuccuacaagcuacagaaaccgcaauguggggcuggcugaucguguuugccaugucaguguggagaccugaguuugaaucccagaacacuuguaaaacuaugugcaguagcacacauuguaauuccagccuuccuaaggcaaaaauaacuguagauauaguugaaucccugaagcucaaaagacaaaugaccaaaagacugugucucaaggcaggaggcgaagagcagcacucaaaguuguccucugaucuacacaugcaccccacacaaauguaugcaucuauauguacacaaacacacaucgcacauacaggcaaaacuguggucccgacauaagacuaggcauuuaaauaagcaaaagagagcccagagcccaaaucccacuuccacagacauaugcuaaaaguagaacgauucacaauucuacauggccugaccaaggauaacaugcaaacuuauaaagccuuaccuauuuuuagagcaaaguauauggauauguauguaugaaaacauaauuacgaagccuauugcuguguaugcuaacguaaaaaguugacaaaaaaauucggaauccaagcuaggagugguaggucacauacaccugugaccuuaacacacaggggccgaucuaggucaaacucaagaccagccugggcuaccaacaaggaucuggucucaaaaaccuucaaugcucuuuuuauggcgccaagacaauucaaucaggaacaaucuuuucaaaaauaaacagcaacacuaacacacaaagaaaaaaagcaaaacuccuauuaauauaaauguuaauucaaaaugaccuaaauauaagaucaaagaauuaacuguaaaagcuaaaaccauuaaguauaaaucucucuggccuuggacuagacaaugcauuaguagguaacacacugagguaagaaagcaaauuaaacagacaaacugaacugcauacaaacugcgaccucacuaacaggaggagaaagggaacugagccuggcaaguccuaugucuaaugaggaucaaucauaaagagagcucuggaacucacccaaccuaaaaacaagcacggguugugaguuaggcuuuuucuucaaauaaaauauccaaugcccagaaaaucauguaugauuuuuauaaacguucaucagucauaaguccaaauuacucgagacacuguaucauaaccacugcaaugacuguacucagaauagacagguccaaguguugacagaugugcagacauggaaaccucuguggacugcugagaaauucacaaccguguaccuacuauggaacagccuaacagucucucgaaagauuagcaguuauacagcccaacacauucuaacacuaaauauagacuaacaagaacuggaaauguauguccacucuaaaacuugcauacaagcuggcaguauucuucauaauaacugcacagggaauacaaugcaaaacaucuacugccugaagaggggcuacacaaaacacacauagccacagaaaacuuuaaguucuuuucuuaaaagaaauuguuccugccagaaacacaguagagaaaaccauccuaguaaaagaagucagcccucaaagccacacauuguccuucuuguuaucuacacuguccagaauaggcauauccauaaagaccacauacagucacagagcuaaaggggaagaagggcugacugcuggaggguggcaggaaucaguacaggagccaggacaaugcucugggacuaaagagcugugacgcuguucacgacauggcgguuacacuaaagacaaucacauuguacacaaauguaccucagucaaguuuuuuugguuuuguuucuguuaguuguguuuugccugugugguguauauugcauaucacguguacacacaugugguaccagcaguggucagaagaaauugggucccuugaaacuagaguuucagguaaguugugagccaccgugugggugcuaggaaccaaacccagguccucaccaagugcccuuaaccacugagccaucaagccaaucccuuacauuucuuuuuuaucauuaaaaaaauuaauuagaagucaaacagaaugcaaauguuauaauaauauaugaaucauuacuaucauaguucaauucagaggaaacugagucacagcaauaacaacucaaauacaggaagcugucacacuguaugaagacaggagacagcaggacuacaggauggagacccguggggaugcuaaauuacuuccacugcacugcacugagcaaggccaauggcccagggucuaucuucaugcacaccucuccuauggucuacaguauuugagaaagcauaggaaacaugcaaguuuucuccgagguaccagccagcaccagcaccaaugucaucugcccgucccaaccuugcuuuacugucuugaaccacgaguccaauguuaaauacaauuaacaucagguaaguggcaugcaucuccguucacaggaaaaaaaaacaaaacaagaaggaaaacgagaaacagcaaagcuaugggauucuaccaaggaggcagugagacaucacugcacugaagcuguuccccgcccucucauggcccuccauaggcugacagcauucuagaaagcucaaccgaggugcagagaaaccacccagaguuuucaaaguuagaaccguuuuaaaguaaaagcugugguucuauaggggaaauugccuuaaauauaaaaugcuuuaaaaauacugaauaaauggguuucuuaacuagcugauuuuaaaaauauaacuucugaauacuuaccuaaacaacuguauaauucucuacugguuuuuaaauccauuuucuccugcuccucaagugagacgucuggguaagacacuguuuuuugaugcugacuacucucaugaggcuuuucugacuguuuggagguggacuuacuugucucugccuugguggccucuuuagacugggacgcagcagaugugagcgacacauucggugcaaccacuuugucacacauguacagguaguagcuggggcagaaaggaaaaacaaacacacauuacgucauacugaaauuugaauugagacuugacgucguucugaccucaguucucagcuacuagaauaaccaauguaaacauacaaagaauacaggccacggaaaagauuucuuagaaaacaaaguucauacuuaaggacaguaaaacugagggauuuuugauaguuugagaguaauuucaaacacuaaaaaaaaaaaaauuagaaagcaaaagugagucucuuccccuuucccacaaaccaccugacaauucaaagcaugaaacacccagguaugauaccucacauuuauaagccaagacuuaggacugccacgaauucaaaguuagccugggcaacagaggaagcuccaggccugcuucccugggcuauauauaguaagacccuuucucaaagcucaacuaacuacaggcaugaagcucuggagucucugcagcucggcuggugaggucucagggaccauaucuaccucagagagagaacagguucugggaauagugcccuugcaucaaaacucauagaaugaucuccuaaaaguauuaauaaaguagcaauaguauuaaagcuaaaaaggacaacuacugauuuuucucaaaguucguguaacuuugagcuuauuggguuaucuguaagucucacauaacaaacuugaacuauugaacacaguuugaucuauaaaucuagguaaccuuccaagaaaggaggcagccccuuaucuagcacugccaccccuuuuacagcucauucucuuuuucuuuuucuaauucguccccacucccccucuauuuuccuuuaaaggggguggggggcgcagaccucccaggguauccacugaacgugguauaacaagcuacaauaagaccagccucacauccaggcuggacaagacgacccagcagaaggaaaagggucccaagugcaggcagaagaggccgaugucccacguucucuuuguaggauaccuauguuacuacucuuuauuucugggucugaacacuugguauucuaauuaaaaauuaaacaaucuuucauggacuuaauagugcccaaaaggcuuauuaagaaacuguaugauggugauugugugcugugugaauuuuacgguucagacugacaacuaggauuuuuauugaaauauacgcucuugauugugaaggauguaauuacuauaaaaucuccaaguuucacaaccgauuguuuuuaaaauuacuaugcagggguaaacaucuuuaaucucagcacucagaagggagagacugguagaacucugaguuugagaccaaccugagcuacauaaggaggccagucaggguuaacaaacaaacaaacaaacaaacaaacaaaaagcaaaguaacacuuucaacucuugaagagucaauuuaccucuuaaagguaaauaaaauaaacuauucaauuucuacuucaagauagaaguuuuauauacacacacaaaaggugcauucaaucccaauguucuugccuaaaacaauucugaaucaucaaagguaauuaguuaacaaggaaaaccuaaagggaggugacuuaagucuuaauucccagaauugcauccguuaauaaacagauaaacaagccaacugagaaacaaagaagcaaaccaccacuggacaagcaaacaaaugaagaaggcucacucaccugggguguaaaaaugaaugugucuggggaacauggucaccuuccuguuuuauaacaggauaccaugauggcaauuccauucccgaugguguaucugucuguaggaguacauagaaagguacauuauugagaggaaaagaugguuucucuuuguugaauaugguucaagggacagaacccagggaguaaauccagggccuuguccguguuaggcaaacacucuaaccacugggcuucacagccagcucuccuuuggcuaaucuucugucuacuugauagggcugcagaacaagcagucacauuucuaaggcucagcuucuacuaagagcgcucccacagugcuaugucucacucugaaacuuaaagacugcuacuucuggucacaacucacaauacgcacauucaaauggcauggcuuaccagaaaccauuucauacuuaggaaaccaauuucaaauaagguaacacaacccugaaaauacacagcauggaggaccucuuucucuuggugccccaaucaaccucccucuaccccacagccacagcacuuacuaaacuuuugacuagauaccauucuauagcaguaaguacucuggccaauuaagugggaaacuacugggcuugcuaguaagaauuagcaaaccauauuccucauagauauuaaaagcugguuuuuaaguaccuauaaauaaaggaacaggggaauaauaacuggugauuucguaaguauuacuggcuaagaauuuuacacucugauuaacucuaauaaugcccuuccacuaagcaggggucacucucugcucacaucuuagaacaacacugaaagaaugaauugccaugguuccagcagcuuccuuguccuggccugguuuauaacuuguccuccucacauacuuccacggucacuccacuuacgugagggagcgagguucccugacagaaaaguggaggagcugaagguaccagaugaaggcagacagcagagacgcgcuauccauaggucccaguggguuaaaggacaaucaccuaacgagacaccuggccaccuagcuaggcuccgagcucucggcucugagaggcuccaaucucaccggcagucaggaggugggcggaggccagcaagcucaaugaaacccacaacuguggguacagcccagugcaaagacuugccuggcauaacccaggcccugaauucagucuccagcacaagucccucauauagggaugggcaccaaacacuaacaauuagggaagcuggcuuacaugucccaguauuuuaggucaagaaagaacacaaagggaaggaugacacgcaguucuuauuaaaaguaagauccacuccgaauggcccaggggaggagacaugcugcuagugagagaacccagugugagugaagaaaccuuggagaagcagcccagugccugcaaccaaccaaccaacaagcagacaaaaagacaaggaacaacuccuagagucagcuuuauacaacuucacaaucuaaaugugacuuuauugccaggaaaagguuuuaaaaaagacaacugaaaagcaauguugggugagguggcucauccguuagacacguaagacacuugccagugagccggacacccagaguucaaucucuggaacccauacaguggaaggagaacugacuccuguaaguuauccucugaccucaacauauauguuguggcacauauauguucccccccccauaaauaaauguaauuuuuaauauuuagaaaaguagaaaaaauaaaauaugguaauuuguauugcuguguguaugucuguguuugugugugugagagagagagagagagagagagagagagagaaagagagagaaagagagagaaagagagagaaagagagagagaaagaauaugcaagugagaccgcaccagcaguaacagugcauagugcaugcauuugauccuagcucacaggaggcaaaaguagggggaucucucugaacucaaggccagccugaucuacagagugaguuccaggaaagccagggcuacacagagaaacugucacaaaacaaaauaaaacaaaacagaauggguuauucauggaagacuucuacaggaguaggucauuuuucuggaaaaaaaaauuccacaaacugauaaaauacucguuaagauucaagugaauaccacaacucugauguauuauucagaaucuggccaaacucaaccacuuacaaaguaaagcaaucagcuguucacagguucucagccuaaaaagaacugacuucuagcaauacauacuaaauggcaaguguucauagaccacuaauaacuugggagaaagaggaaucacagaguagaaccauauaaacugcuauagcaauagacaaucugagggugucagcauagaccggagcaagucauucacuacauuucaauuguguaugacuaacccagaacuuugaguuacuaugguaacuggugcuuaagucuugagucuagaugacaucaucaagcuauauucugaauacuaucuagauauaaacguauuugaaacauuuaaacucgcuuuaaauauuuacaauuucaggaaucugaaggguggcucuuguggaggaugcagggucaguccccagcacccacauggaggcucauaaccaucugcaacuccaggucuaggggaucaaacaucuuuugaucuccaaggguaccaaccacauaaguaguauguagacauacauacaagcaagcaaaacacagaaaaauauaaaaauuuuaaagacacacauggcguauuuuuuuuucaaaaaccugacuucuuuaaaauugugaugaugcucaaggguagcuuaaccccauuugauaagaggacauguugagaaaaauaauccagggaaaucuaagauuaucuugaacuaagugaaacauuuugguuaaacucacuuaaaaaacaaaacucuuuaauuggucuuauaucuuaaacaagucuagauauagugcccaauaaaucauuucaaacuuuaaaguuaauaaucacuacacugaaccacgcauuaaaaaggcuuuccuaguauucccacuagaaucugaaaucuucagaaucgcuugcaagaauuuuucaaaacuuugacuuggaauaugacuuuaaucauuaauuucauuucaaaagucuacuuugacuuuuguggucauuguauucauaauacaagcacaauguguccuuuuuuaaaaaacuugaggcagugucuuguuguauaaagcaggcugaccuugaacucagaaaucuaccugccuuugccucccaagugcuaagacuaaaggcuugagccaccaugcuuaguuaugcguuuauuucagcaauuucucuacauuugaaacaccaucuaaaguagcugcauuuauuuauuuuuaagcauucaucuuccucaguuucuauucuuuguuucuuauucuuacaucugucaacuaaaagagucacagagcacagguucuaguuugcugucuguuguugcaauaaauaccaugaccaaagcgacggacguggggaaaagggcucuguggcccacagguccagcuaacagcccaucagcacggggagucagggcaggaacuugaggcaaacugaagcagacacccauggaguaagguugcucagguagcuuucuuauauauagcccaagauaccuauggcugauaaugccuacacuggggucagcccuucuacaucaauaagccaccaaauaaugccaaucugaucaacccaacugagguuuccucaggcaacuguggacugugccaagcagacaacugaagcuagcuggaacacucccuguaacaaugaccuaauacugucccuagccaauguccguauucccuagucaacaccaguaaguggcuaucccgccucucaacaguaacuugaggucaagagcauguuuauuuuguauucucaguagcuagcacugugccuaccaugcaguacuugcugggugauuuugaaugcccaggaguggcaaugguuccacggcagagccuuucuuugcccagcauaugugaagcugcgggcucagucaucagcuccagcgaagagaacaggaaaggacaaaagaggcaggggaggcugguacacgguuacuggcuaccaagaaacucaagacacucucauauuuggaucuuucuccuccaugaagcacaagggaagcugaaccuguuuggcugcacuauugaugcaaauccugcagaaugcacagugccaaccgugaaagagaacugcaagcucauuuugccuaaaaugcugugguaaacuauaaaacacacuccuaacaaauuauccuaagugcauguuaaaaacaauuaagcacauauuacaaaaugaaacauuaacagucaugccagauuuucucuucuaagccugcauuugugucaacauacaaauuggguuuuuagaaaaagaauauaauuaaaugguacagcaguaauggcccugaucaaaaauacaaaugagauaccagaaaccggagcaucuccugccuuugucuuacacucagugugggacaaucuaugccuuugugaacucaaacauuaaaacaugccuuuucucacuuggcaaguggagaagaacaucacucaauaauuaaaggcagaggcucacuacuuaagugcucuaacugcugggcugccccgccgucaucuacgucagaauuaacagacggcgcccuuucacaccugugagcaaauuucaaauacauuauuucaauccaaagguuccuuuucuacuaaacaucaaauuaacauccauggaaacaaaauuuaaagguucccaaaauguacaguaaauuuauuuuuaauaaauaacccuuaggaaacaauguucaaguuuucguucauguccacaucuuaacucgggcaccucgagcacacagcccuuacauaaccagauggccuaggaagcaucuauugguuugggugacacauccuauucaguuucacaaugacagaguuuagggaacuugacuucauuuuuuaaaaagaaguuuugguaacacuuuaaaaacaaaagcacguccacccgcuccaagcuauuuguacucaaauacuccaaacugcauggacguucuguguguguguauguuugugugugugucugugugugugugugugucugugugucugugugugucugugugugugucugugugugugucuguguuucgagacaggguuucuuuuuuuuuuuuuugguuuuucaagacaggguuucucuguauagcccuggcuguccuggaacucacuuuguagaccaggcuggccucgaacucagaaauccgccuggcucugccucccaagugcuggaauuaaaagugugcaccaccacgcccagcuuuugcauugauguucuuaugagugccaaaauuacacucaagaauaaacuugguuuuuaagugguauacuuauuuuuaauuauaauaauauuaugcucuuuaauuuguagugacaaaugcuuauuauauaaaaaaaaaacugauacgucuuaacaugcuggugaaucuuccaaauucccauuaaaauuaaaauuaagacauuuuaaguuuuuaaaauguuuuuacauuuagagugaguauauguguucauaugaguugaauguacguguguggcugaaagaacgugugcacgccuuuaaucccagcacucgggaggccuggccagcacucgggaggcagaggcaggcggauuucugaguucaaggccagccuggucuacaaagugaguuccaggacagccagggcuauaaagagaaacccugucucggaaaaaacaaaacaaacaaaacaaaaaaaacaaaacaaaaaccaaacaaacaaacaaaaaacauguguaugugcgugaaacaguucucuucuuccgccagaccccugaggacugaucucaggucaucagaauugaugggaacgcccuuacccacugucuucuaccucacugaccccuccagaaaaccuuguaaaagcagaauuuuuaaaaaugcuaaaaauaggggguagaaagggcucuguagauaagagacugucaucucuugcagaggaaccagguuugauucccaaacccacaugguaaccuggaaauaucgaaaacuccacuuuuaguagcuaugacagccucugcuaugauuucuuugcaggcaccaggaauacaagugaugcagacauaauucagacaaacagccacacacaucaaacaacaguaaaagugcuacaaauaauagucauuuuuaaauuguguucaaaggcagcugaaugccaguugguaagucuaacagucuuaauggaaugcuuauaugagaacuaaaauauaauguacauuauuauguaauaggcucaacauaaaucaaaaaccuuaccaaggacacuauuagauaacauagacaguauugcuuaagaaauacccccuuuaguaugaaaugaugccccuggcucugagucucuuuagcauauguaacacuaagacagucaaguggucaauaaaugacugcagaaauacacaaagcaccuccuacccaauagcugccaacaacuuucacgaaaagaaacccaaccccucagaugguaucugguuuccucagcguggccagcauauugugaaugaguaugucaacaacugaagugaaauaguguuaugagggagcaaacagcuacuuaagagcuuuucagauuuagguuuaggccgcacuuacugagaacuaacuaaccuaaugcaagacugaggcacaaugaccuaagcugcucccagggaucacggcgugaccuccgugccggcugcucacacugaaagacauaccacagaggguccagguggaaagcaaaggcuacacuucuuauaauaaauaucuaucuuaaacuucaugugaagaacugauaaaagucuuguugaggaauuaaagaaaugaggaagaaaaaaaaaauuuuuuuuuuguuuuuucgagacaggguuucucuguguagcccuggcuguccugaaacucacuuuguagaccaggcuggccucgaacucagaaauccgccugccucugccucugccucccaagugcugggauuaaaggcgugugccaccacugcccggcuagaaaauaaaauguuauacuaugaacuuuacguaagaaacugcaaccaucagugugcugcuuuucccuccaagugcuuaggaucaaagcccagagccuuggacacaacagucaagcauccagucauggggccacauccucagacaauuaagcagagcucuaguuugcuuucagucacagugacaaaacacugaccaaaaaacaacuuggggaggaaagaaagaguuuauauuuacaugacuuuuacuuccuagucacuguccaucauggaagcgaaaucaggacagcaacucaggcaggagcugaagcagaaaccacggaagaaagcuguggugugcuuagcuugguugcuucuacaaaccaggaacauuugcccaggggguggcccucccacaucaauuggcaauaaagaaaaugccccaagacuugccacaggccaaugugacuucgguaauccccccaauucagacuccuuuagauaacccugcuagcugaagucaaguagaaaaaguagcuaucuuaaugccauaaacauauuuucccugaaauaccugucaacuauuuaacauguuacguaacauguauaaaucuaaggcuuucuguauguacagauguguaccagaagggcaaagagguaauggguaauggguccuauggaacuggcuguaaaucacaucugcaaguaaccaagccuggguccuuugaaagagcaguaaauguucuuaaccauggaggcagcucuccagaucucgugcgugcgugcgugcgugcgugcguguguguguguguguguguguguguguguguguacaugcaaugcauugagaugcauaugcauauauauguauguacacauauaucacguauauacauguauguacacauguauauacauacacacuuuuuguuucuucagauuucagagguggcgccuuuuuccaagcuucaacuuuuaacuuugcuaacucuauaugugggacaguuuucuuuugagcagcauggaacugcuauuuuuagccaaucugguaaaucuggccauuaacugggggguguucagaccauuugcacuugcuguuguuauuaauaccacugcaugccaucuacccuauuauuauuaggacuccaugugucuccuguucuuuugaaauuaaaaaauuaaauauaaggcuuuauuuuucuaccuuauuuggaaacacaugcaucuuaaaaauauggugugaucugagcuuucaaaaaauguucacuaucaauacaaaaagaaaaucagcuuucuguauuaauacucucaauuuucuauuuuauucuauuuuuguguuggcuuuauuuaaaugcuagcgaccuacgaaaaugauuucaugcuccuucugacccuucucagcgugguaaugaagagaguuaaagaugccaagccgcugacugcgugugauggcuggacugguacuguccguggaaaguggcaaagggcuuacuucucucaugaagccccacaggagacaaaaaggacagaugaaaaguaacucaagauaaaaaggaucaauaucuaacuuuuuacugugucuucuuaaaaaacaacaacaacaaaaaaaaccacuagcaauuccauuuuagauuaagaaaauuaauguccuauauuaauuaagacauacuauuccaaaagcauucuaaaacuuuacaauaaaaccaggcaacuucuacuacuaaaaaacccucuaaagacucaaguaccauaacucccuauuaagacccacugugaaagaaaacgguauagcaaaagaacucuggcccaauccaaacaagccugcacuaggcuccaucaucugaaaccucacgguggugucaccaccucaccucaaggaaaccagucagccuaccuguuuggguuguugcagucuaauaauuuuaaaaugguucuuauuacaaaccucucuccuacauaagugguggaggaauucccauguacacauuaauauuucaguaaccauucaauaccaucugucaucucuacauaaaagacuuccaauuuccaaacgcuuucacaucuauccucucauuugacgaauuauacuaagcuguauauauaaacuauauacauaaaagguuaagccacuauuuaagaucagaaaacaaaaaaccugcugggcuguguggcacaccuuuaauucuagcacuugggagacagaggcagguggaucucugaggccagccuggucuacagaaugaguuccggaacacccaguaauacacagaauccuugaaugcguugugccuaacaaggggaaggccuuggauuugaccucagaacuuaaaaaaaaaaauuaauaaauaccauauauuaaaagguauuugcuuacagcauuaggauuauaacaagaagccuguguccuacaaauauagcacccugccagagaagauaaauaugugucccauuguuccagugaucacugcagaaacaaaacugcaaaacuaaagggagugaaaugguuaacuucuuugagggaggagaagcaugaacugaaucucaacagagggauaacacuagcuaagcuaaguucuccaccaacuuagagaaagcaucuccaagguguuuaucguagggacgucugcaucacagaucacuaaaaaacaaugcagccccuuaaacguauaaaguaaaccuacuguacuaagaguagagaaaucuaaguguuagaaaucuuaauucuaauaaguuuuaagagcauacaccacccuucuuuaaggaucuucauaugaaugaguguuuauuuggauauauuuacgugccucuugccuucagaggccagaggaggacuuuagaucccccuagaacuagaguuacagaugggugugagcugccaugugggugcugagaaccaaagcugaguccuuggcaggaucaaccagugcugagccaucucucccucccagcauacaccauucucaccucagugaauuagaaauugucaggccuguguuaacaaugaagaaccgccgacaauucuguuaucagcuaaguauaaaugaccuucucuacuaugcuugaaaauaaucuuaagcaucaaccuugaggcuugucugccaauaauguacuugcuuagccuuguucuagaagcagaauuucaguugcuccgauucuuaucuggcugaauaucuacugauaaggugaaaaucugcauauugagcauccuaaaacacaacagccauuuucuaaauaaaauucacacuaauuuuuuuuuuaaaucuaucauuaaagggucuggaaauacccauuguauugugcaacccaagaauaucuaaaauuaugucuuuuuucuucuugagauaagaucccauguggcccucaaucucucuaugaagccaaggaugacccuucuacuuccauuucucaaauacaggacuccagguacacaccaacacccauggucuacacagugcggagaugaaacccagggcucugugaaggcuaggcaggcucucuaccaacugagucccguagagacccauuaggaauuuuuugaugaccuaagaaaggcuccaaaacauugugguuucuaccaagaaagagcugagcucuucacuaagaacacuuagcauuaccucacguauucccagaaucuaaacauagcuaacuaugcaaauuaaauauguuagcuacccaaagaaacagcuuguuggucauuacugauacaauuucuguucuuuaaaauaaguugccacagugacuuggugagauggcucagcugguaagagcuggcugcccuucaagaggaccugaguucaauucccaacacccacacucacaacugucuguaagucuaguuccaaaggaucaaguacccucauagacccacaugcagggaaaacaccaaugcguauaaaauauggauauguuauuuuuaaauacaguaaguaaaaaguugcuacauuuacaauaaaugccuacauuuucagauuucuuuuuauuugaauccaaaaugaguauuuuaacuacauaacccauaucaaauuacacuggucacucuuaaguauaaucuccuucauuuagaagguuaaaguaaucagcacagccuuugggguaaacaaaaguuugauuugauucuuuuacaaugaguuuccucaucaauuugguuugccuggcaaccaacaaguaaaauucugacucucugaaugcccuaaaaaauaucuucuccaacccaagacugcuuucccuuguaaguacuucaguuucgugcaaucaauaaagaauuuaagagccauuauguuaaacuaaucacuaauacuauuccgcuguuucagggaagauuucuacccuuaaagucagaagacuaccuucaacucacucuaccagcugccaguuagacagcagacacgccuaacaggaggaaaucgucuacgucacuucccucacagauccuugaaaacuaccuauguuuagaggaaauuuaaaaauguacaguaacuucacuuuuaaagcugcuugcauauguguuaaauacccaguuuucuucugaagguuugacuggaaaguuuccugaacuccccugacuuccuucaacuuacauaaaguuggaaacaacacagcacaagaccuccagcaaacucugaggaaaacaaaagaaagaaggggucucgcauaccuuccccaaaucaaauaaaaaguguuaucuguauuacaucccaagagacggagaguuucaauucccucucuauaaauuuuucguuucaaaccaaacugggccauauuucucagauggguuuccacccaagcacagaacaggugauucuaagaaugcugucaagaguaaugaagaccagagcaagaagccccagcaaauaacauagccacugucaaacacguauggagagugacucuaauaagcugaagcagacagagguauacacaucucugaauaagacuccagcacugcacaaacagagcuaaaggcaaguuuuccacuuugaaauaauggcaucaagucaauccugcuuuaaaaccaguucacauugcaccugaagaacuuaguagccaccgucgaggaaugucagugauaacuuuuaggaaagcagcaagcagcaagcuauccuaaggaaaagucuaguucucuccauguugcgcuucaaccgaaaacuacuggcucagaagacacuagaguucccucaaaagcuuaagugcagaacacccaauauuaaauuauaauuuaaaccuaccuaaaacuucuauaaacaacccugaguuacuuaauaaaguuucucccauuaaacggaaagugguaguucaaaggcaagaaaaacuaauaauggaaaacuuuaaguucuuaaaauguagcccagcuucuguucuaaaaauuaauuacacaaaauuuacaugaaaaacagcucuagaguaacgaucaauacauuuuaagcagugcuagguauauuacauauuaauuucaaaucaaguagaaaaguauauaagauaaccauauuaagguuuaauacuucaaaccuuugucuuucaucagacauucaaacucuucauuagaaucaagacauuaucuuagccuaccagacaguacuguggaagggguaauacuuuuaagauuucuuugcagauagcuuuucauagcaguauuucacuaaauugaaauaaccuuuauucuaccucuacaucacaaauguucaaaagcauuccuuucuuuuauauuauaaacaagaucuugguuacuaauaccaaauuacucagacaaaugucuuaauuggauaugaacacugauuaauccucaauccaagcacaaaaacaucaaaaaccagugguauuucuucaaaaagcaauuuugagccugucaccagacagguuugcaaauggagauugcaaauggagauaacgccacaccaaagugugaaccaucuugagucccaggcaacagacugagucaagaagcaggaugugugaaagagauuggccaaaagaauucccaaugccugcaguuuuagaaguaucauuuuugacuggaggcucauucucuuaucuguaaaaugggaauaauccuacuuuucucucagaugaaaaacuacaggaaacauggcuaaacacaaacauggcacugaugggucuuuguuguuacaugaacaagccgaagcacuagcuucacaauacaaagcuauagacacacagaauuagaauaccauuaguauucaaaaucaacacuuaaaaaaaaaaggaacuugccuuugauuggauucucuuuccauuucucaugcuaaacuucuccuucauuucuucuaaaauuaucuucaguuucuuuucuucgggugucccuagguauuuuugguucacaugaagguaacagugccacuuggcugacucaaagccccaauggcaaguucucuugucaggggaucugugcgaaugcaugacgaacgucuggggagcaaacauuccacagcacuccaggcacuggauacagggagcgucgggcugaacauaaaacugaggcgcaaagagacccugacauuugcccaagcauucauguuccacuucaaaggcacugccaguuuccuucaacugggccagagagcuuuuagcaggaaguaugcuaccauuuugaggaaaaguucguggccgcaguaaagcauuacagagucuuugugcaucggucaacgugaucagcccacaggauggagcauuaaaugggaguaucccuaagaccuuuaagauaugaagcuggucugaaguacaccuugaacaauagauguacagcucaucacauacuguguuuaucugcuggagugaaaauucucggaggacagaguuuaagacuuggggcaaacagagucucuuuucuccuccaacuugaaaacaagaaauagacuccccuuccaaaagagucugagugagcucuguggagcuaucagaaggaaugagaagagggccgggaagaaccugaggagagggaagaggcaggaauacagucggugacaugcucuccugggaauaucgagcagaaaaugcugcugguccacccaaagagcucugacugcuuaaguggaauugugccagcguguguuucagacugggguuuaaauuuaaaguuucagguagagaaacacgguuucgcuuggcgugcucgccauccggcuccacggaugcaucuccauagucaucuaagugcuccuucuucaccuuggucaggguuuucccauuggcaugaaugucggucaucauuuuuuucacaggaggacugccaucauccuccaugccguucagcuuuuuauuugaacccugaacuaaggagaacuuagacuggagguuuuccauggccacacuggugcuuuaaacgauuaagucugcaacuggcauguuguucucaguuccuaaucugaagagaaaaggggaauguauacaaauacuuaugacucacuuagaaauguuuacuuuccaaagaugaauuuucuuacucaauagauuguacaacucuguuuugguuuagcuguacuuuaagauauaauugaaaaugcuacaaaacuucucaguuuuguuugcuucuaauaacaaauaagaauauaaucguaagcacacuucugagaaaaucacuucagguauuuauauuaaaauaaagcucaauucaagaaguccaaaguucgguguaaugguugaguuugguugguuuuguuuuuuaagcaaagcaugugggaaguuuauaccaugacuguauccugaaacuacacccaaacaugaguuacaaugacgcaauggguuuaauuuuugccaagaacaccaaaaaagaagaggcagguaucgucccugaaaauggugaucugcugcucaguacugauaaacugaagacuccaccugaacuuuuauaauuaaaaauauacauauacuaaaugaaaaagcuguccaguuuuaucuucagggauuacagcucauucuucuuuuaauugaucuggaagagaaagggguggggaguuacauuugaauuagcuccagaggccaaagggucuguuuaaaaccaguuucuuaaucuucaacucaguucauuuuaccaaagguaacacuugggugguuucuuccaaccuaacaccaguuaucuaaaagaaacuucaucuaaauaggaagcaguccagacgguggguaacagaagcauuaaauaaugccucuccaaacaaggacgaguacacaaauuuagaauacgaauaaccaaaccucaguaccagaggcuuucucaacuaugcaugccauuuaaauuuuaaaaaacaauccuuucucguuagaaaaaaaaaaaaaaaaaaccuguaguuucuggucuccccaccccccaagauacauguuaauauaccuaccauaugcaacuaaacuucaaguacauucauacauacuaucuuuuuggaaugaagaagaaaaaaaaacuuucccuuuaaaagguuagcgaauuugccuaauggaagccaaaagcuguaagacuccacgccuggaaaucuccauccaugagcaagacuaauccgggacaaaaagcacaaggcagacagaccucacaaagaaugcaaauggaggcagaguggcgaaaaagaguauucauccacuucccucccuggagaaaacccaguaaaagccgacaaauaaaaagcuuugcuucuaaacucccagcaauuuauguuaacacaaacccagagaauuauggacgaaagccaccuagccaccguacugugacuuucgccacuacagggacaccucagccaaggcgagccaaggaaaagggcagaaggcaugaccuagaccaggggcgcccccacagcccugcgcacacgcagagacacccacucaucaucaacccaaaggacagggaagcaggggacucccggcgucuggugaggugagagggggcagaggaaguaggaguccucccaacccccaccucugugacugggaucacccuaagugcccuccccacaucgccccacugcgggggccgccgguggaaauaccccacgcccccggcccgcgggaaguucucuaggguuaccuaggcgccccagggcugcgccuccccccacuugacccacccugagccguggcacccacaggggcgcgggcagguuaggcgccaagcccggaagcccgcgucgccggacgcuuagagcuggggccagcccggggcauccccgccgagcgcagacggccgggggauggcggcgaugaccaggguccaggucuccugggucccggcggcucgggucaagugcaccgccauccccucccagcugacccgucccagaauccgcgaggccuguacacccgugggacccccgccgcgcgcccugugcccgcgaccccgcccgggacccccacgcaucccggacgccccacucaggcccuccgcgcccgggcagacccccgggcucugugcccuccccaucacccccgccgccgccgccucagcgcccccagaggccgcacgccccucgcguccccucgcgaccugcggccgcaccugugcccgccgucgccgucgccgucgcucgccagccgccuucgcugugccggcgccgcuccgaaccccacacacaucgcuacacacagccucugacg

SEQ ID NO: 12078 - RNA, 2821 nt, Mus musculus
guuaagauuauaaaaaacuuccuuuaaucaaggcuuguaacauggaagagaucugucagauaaaaugcaaaauuuccaauacauugaaacauaaauccauaagucaucauaaauacaauacccaauaguaaaaaacacgucagcaaauucacaccauccuuguaacagccaugaucuagauuucacaugcuucugccaaaugacuaauauggccugcugggucccgcgcacacgagggcuuugaggucacacucaucugacagggcuguggcacugguggcucaacuccagaagcaaagcagguaccagcacauucaaacaguguauccuuuacauaucaaagugagaaauaagaaagcaacauggucacgcgaucagaaagauggcagggagugaggacagcuguggaccgcucgaggccggaaggcgguucgccggcuucauuucuuuggcuucuugggcaguggccgucggaacaguaagaugugagguucuggaagaaacagugaaaucuaagaaagaaacucccagcauucugagcagucgacagugcaugcuacugcgcagugcagugcuacggacucuucacagcaugcaggugcacacagcccgagagccugcccuuucugccacgcacagaaguguuacaauagaauuaacugucuuugcuuaucuggaacagauccagugauuugcaggggccaucaccaggauauauguggcuuuaaaaagaguccccuccaaugacugacgcccuccucccucuacugcucugcucuguaaucucccuacauuucacugaccugguucauggaucauauaguggacccaucccugacucugcugaacgccgagguuccuccauucagauucagacaucagauggguuuucgggaccagcuuggcuauguccuugggcaacaugacaugccuguaacagaaacauggggaugugagugaggacugugucagagcugucagucugccagacacugaccuacauacugagagcggaguguggcacacgugccaugauucuggcacucggggauauggcagcaugaccgggaguuucaggcuauccugcgcuacagagaaucugugaaaauaaguaacuagcccagugugggcacuccuuuaauccccgcacucaggaggcagaggcaggugggucucaguugaggccagccuggucuacagggcaaguuccaggacaaccacagcagcagaugaacccugucucaaaaacacaaaaccaaacaaccacaaccacaacgaaacaacaacaaacaaaaacaagaaagaaagcaaaaccaaaauaaaaacaccauggguuuucaccacuuucauaagaguuauuaaaaccacaaaugagcaauuugaugugugacuccuggguaugagauacugacgauauuuguuucuccuuugaucacaggccucacaggccucuagcugguuaccuacucuaggacuguguggaaaggccuuuuacggaacagguaugaagacaaacaugcaaauguucauacuucuaagggaugugcuaugauacuuggaaaaucccaagcuuucccaaacauaaguuuauggcaaaaaauuaccugacuugacucaggcuaccccaaguagauuuacuuuaucaugcucagugaagauguacuaaaugcuucuuccuuugugauaauaacaagagccccaccccauuguuguccaaaugucagaaaagagcuuccauucuaacugugacuucgauacacagaaccaaaaaaaaaaaaaaaaaaagaaaaaaaagaaaaaaaagaaaaaaaaaaaagaaacccaaacaaaccccuccuuuaaacaaaaaugccaaggcuaagcuggaguuacagcuucccagagaugaagccacucauuucuccagccaugcaaaugcuguaaguguaacauuguuacagacguggaaaacagcugaguacuuuacacuugagacaagguuccaucuguagugugaucugggcuggacccuaugacaauccugcagccucagcuuccagaaugcugagauuaaagaugugagcuaccguaccagcuuaucuugcaccuuaacagaaaacacuugaaaccucuaugcgcgccaugaaugaucaaguauuugaaagguaucuacccacggccacagucuucaugccacuccaaguccuguaaaagccuaucuaaaacaaggcugacaacuacucaucuuuuuuauaaacuaaaaaccaccaacacugaggcucucuuagaaccguccuuucaucaagagcaugaaacuuucaguucugcacgggcuaccuucuuucucccagcagacuuugagauuucaguaacgcgagcaguuccuauuagggaaaucgccacaacaaaguugcuuuagugaugugaauucccagagguaaaacugaucagagcuacaagacgcuucaauuuaacagccggccaacucuaaguucccuuucauuguuuuacauccuccguccaccuuuugcgcaugugcuuugcugcuguacccaaucccacccccaccccacuccccgguaauuccuugcgcacgcgcccguucuacacugucccccgcccccaucccccgccucccacuccggccuagguaacuaacuccucgcgugcucucuuuugucuguaguccccgcgccggcacuaaccgguauucgaacuccucgucgucguauuuguccgaauaguagauuuguuugugggacaugauugcucuguccgagggcgcucagccccgcgccgcaggccuccagacaacucccagcagcacgcgcucccacccucu

SEQ ID NO: 12079 - RNA, 5422 nt, Mus musculus
gggagggggugggaauucccgacgcgaggccggaaccgagcgacagcaauggagugagacccucgggaggugagugaggccucgcuggucgcagggucaaaggcagcuucugaggccucccaggcuaggagcuggggucuccguguuaacauuuccucugcuuccugcgacgcuggcggccuccgaccuggucuccgagacuuccagacgccgcccagugcgggcaaagcucgucccaagccccucuuuggcuauaugccgagacuaccuguuauuuccgggaaauggcccuggggaguggguaguuaagagagucagccagccccgaaguuccccuguuucaaaucaucggugaagccauccgggacuucucuucagcuccaaccucccuuugcuacaugcacuuagcagacugagagaguggucugccuuccuuagggaaccccagcuccaggugcagguccuaccuggagucugcaccucauuuucugcgugcuccaggugaaagaguaaugugagaucuauauuggccuucgcgugccucaguuuccuccuugaugguucgcugaacuuggggagagaaauucgaaggaggaaaugcaauccugauguuggcguggaugagucacuucagcugggaaaggccagaaaguggcugggcugaggggaagugcauuccgcugaccagccuucccuuuuccgugaccccuucuuuccugugaccauucccacccaugcuaguuuucucuguauagguccaagagucaccgaguuaucacagccaccauggggcccuggggggagccagagcuccugguguggcgcccagaagcagucgcaucggagcccucggugccaguagggcuggaagugaagcugggggcccuggugcugcugcugcugcugacacucaucugcagccugguaccugucugugugcuucgaaggucaggugcuaaccaugaagcuucaggugagucuuuucugcuucggagguugggcgaggugacuggggugggggggggggcggcggggggggggagcaggaguggucauggcuucuguugggguagaaggacuuugaagagauucauuugguuauauauaaccccuuuuguacuucacucuuguuuagccucgggccagaaagcccugagccucgucagcugcuucgcaggaggagucuuuuuggcuacaugucuucuggaccugcugccugacuaccuggcugccauagaugaggccuuggaggcccugcaugugacgguaagcauugacuucaacaugugaccaagaguauauuauagaacagcuaauagaaaacagagcuauaaccugggcggugguggcacaccaccugugaguuggaagccagcaaguuccaggacaaccagggcuacacagagaaacccugacuggaaaaaccaaaaaagaaaaagacaaacaugguuauauagaucucuucaggggucaccucagggcugcggaaggccuugguaugugagucugugaauuauggauuucagcaacaggauauucuuacugugcauucuuucccugauacuaaacucugugugaccucucuauauuccuugauauaaugugagcagccucaucaggugugugaacuacucuggguugcaauucccaggaaguuaacaauguuccaagaaucacauuucauacacuuauuugcuugucccuccuucauucucugucuccuucccuccucuuuuucuuuuuuuuugguuuuucgagacaggguuucucuguguagcccuggcuguccuggaacucacuuuguagaccaggcuggccucgaacucagaaauccgccugccucugccucccgagugcugggauuaaaggcgugagccaccacgcccggcuucuccuuuucuuuuuugagacagguucucacuguguaggccuggcacuuguuuuguagaccugccucaacuuugcagugaucuucuugccucugccucccagaugcugaauuacaggguugugcuaccucaccccacauucucuuucuuauuuuucuuucuaaauuuuauuuauuuauuuauuuuugguuuuuugagacaggguuucucuguguagcccuggcuguccuggaacucacucuguagacaaggcuggccucaaacucagaaaucugccugccucugccucucaagugcugggauuaaaggcgugagccaccacugcccagcccuccuuguuuuucuuauuugcacauauuauacauaguaaugggcuuuauuauuacauuuucauacacacauaaaguauucuaacuauauucacuccuauuagauuucuuguuucccucccacugaucauccucuucugaucucucuuuugagugugaguggggugugugugugugugugugugugugugugugugugugugugugagacgagugcuugacuccaugaguuuaauuagggucacuuacaugaacacgagcgagggcgccuuuuuuccaguagggucuaucuacguaauguagacugcgcuaagcucuugguucucccucuucaauuuccuggguuacagguauucaccagcgagcuggagacagaucacugcagaucuggcagcauaggaagcaauuccccggggccagauguucucaagaaagugggaugugggguucaaggcaaggaagucugauacagaguuggaagcagugcagucccagcacuugcaaggcuggggcagaaugaucacaaggaguuggaggccagcuugaacuaugaaguguuuuucuuggcuagucugggcuucacagcgagacugucucaaccccugccugccucccaaacagcaacauuccaaagaacucagcuuaggaaaaccugagacgguuguucagcgaagucaucuuuuuucccuugugacugaggaaguaguaaugggucgugaccccuguauaccugugacugagcgaccuuugucuucauaugacugugaaugucccugugacauguagcuuuguaugugaacauuuguggcaggcccagaugugccccuuuguaugcuuacauguaacaacacugugugcauauacauccaugauucagcuucgggaagucuugacccuuaggaaggacugacuggguaauguguggagacauucuugguggucacagcuuaguguuggugauacuguguuugugacucacaucugauggguagaagccagagaugcugcuuacuuacaguaugcaugacagugauggcagagauauuuaccccaaaauauuauuagugccaaaguuggucugcauguaauacuuuggauaccauuagcuguuccauuaaguguuguucugugguugugccgccaacggacuucaucauggugugaccacagggggcuugucugugugggacgucagauguguauaacagagccucuaccaggcuuugcaucugauuucuucugauuuccugaacucuuguugccaccucuguucacagcuucaguuccccuugcaagaguucaucuuggccauggguuucuuccugguccuggugauggagcagaucacgcuggcuuacaaggaacagaccaguccaccccacccggaagagacaagggcucuacugggcacagugaauggugggccucagcacuggcacgauggaccagggaucccccaggccggcggaacuccagcagcucccucagcccugcgugcuuguguccuggucuucuccuuagccuugcacucaguauuugagggccuggcuguaggguugcagcgagacagggcucgggcaauggagcugugccuagcucugcugcuucacaaaggcauucuggcagucagccugucccugcggcugcuacagagccaccuacgugugcaggugguggcuggcugcgggauccucuucucauguaugacaccucugggcaucggguugggugcagcucuggcagagucagcugggccucugcaccagcuggcccaaucuguucuagagggcauggcagcuggcaccuuccucuauaucaccuuccuggaaauucuaccccaggaacuggccacuucugagcagaggauccucaaggucauucugcuccuagcaggcuuugcccugcucacuggccuucucuuuguccaaaucuaaggugcuucaagagaaagggcaggggagguuggcuaucaggugccccuguccucccucccuacccuucucaauuggugggaaauagaaagaaguggagaagggaaguagugaggaccaaagaguucucuuagauauagggaugggacauuuggacuaugaauaaugagauggaagugggcagagaagaggcuagccccagacccaaagaauaagagauagcgaaguuacuacagacguggucagggacauuagaaggaggcagacugcuacagucagaggccaggcaguacaucucagagacaagcugacagaagaacugagaguuaggcauccagccucuuugcgauaaagauacagaggcuguaagucaaagccaguauccuguugguucuagcccaucucaccacucugauggcugaaaugguuccuccuccuuucuucccuccuacucuuauauuucucucuugucuuccacuaagggacuagugccaaauggucucucugccaguuuucguaauuuaucuggccucuccuguccucaccuuuuuggguugcucuguguagccuuggcuguccuggaacucacucuuguaaaccaggcugggcuugaguuuacagagcuccaccugucucugccucugccuccuuaaugcugggacuaaaggggugccaugccaccacugccuagcucacuagucuguuguuaaagugccaaauacccacccacccacccuuuagguuuguuugcuuuuuuuuuuuuuuuuuuuuuuuuuuuuuuuugacaggguuucucuguauaacccugguuguccuggccucaaacucagagcucagucugccucugccuccugagcacugggauuaaagguguguagcacauguauugcucaccugcccccuuuuugaaagcacagugcugaggugcuggggccugccuagcaccucaguggagaccuauuugcucuuuuauuuaggccccauaguuugggguggggaagaaauauuugcugaacuggucuggagugagagaaaaguagguacugacaccagacacuacagaaaguggacauggugguccauaccuagaaaaaaaccaauaaccugccaaaacuuuauaucugaggaguccgggguggagggagacagacucccucccccaggauuauuuuuggggagggagggcugugcauaggucuguacucuguagaaucuauuuuacuaacugaccuguuuugggauauguuacccaaauaaaagauguuucuauaca

SEQ ID NO: 12080 - RNA, 5422 nt, Mus musculus
uguauagaaacaucuuuuauuuggguaacauaucccaaaacaggucaguuaguaaaauagauucuacagaguacagaccuaugcacagcccucccuccccaaaaauaauccugggggagggagucugucucccuccaccccggacuccucagauauaaaguuuuggcagguuauugguuuuuuucuagguauggaccaccauguccacuuucuguagugucuggugucaguaccuacuuuucucucacuccagaccaguucagcaaauauuucuuccccaccccaaacuauggggccuaaauaaaagagcaaauaggucuccacugaggugcuaggcaggccccagcaccucagcacugugcuuucaaaaagggggcaggugagcaauacaugugcuacacaccuuuaaucccagugcucaggaggcagaggcagacugagcucugaguuugaggccaggacaaccaggguuauacagagaaacccugucaaaaaaaaaaaaaaaaaaaaaaaaaaaaaaaagcaaacaaaccuaaaggguggguggguggguauuuggcacuuuaacaacagacuagugagcuaggcagugguggcauggcaccccuuuagucccagcauuaaggaggcagaggcagagacagguggagcucuguaaacucaagcccagccugguuuacaagagugaguuccaggacagccaaggcuacacagagcaacccaaaaaggugaggacaggagaggccagauaaauuacgaaaacuggcagagagaccauuuggcacuagucccuuaguggaagacaagagagaaauauaagaguaggagggaagaaaggaggaggaaccauuucagccaucagaguggugagaugggcuagaaccaacaggauacuggcuuugacuuacagccucuguaucuuuaucgcaaagaggcuggaugccuaacucucaguucuucugucagcuugucucugagauguacugccuggccucugacuguagcagucugccuccuucuaaugucccugaccacgucuguaguaacuucgcuaucucuuauucuuugggucuggggcuagccucuucucugcccacuuccaucucauuauucauaguccaaaugucccaucccuauaucuaagagaacucuuugguccucacuacuucccuucuccacuucuuucuauuucccaccaauugagaaggguagggagggaggacaggggcaccugauagccaaccuccccugcccuuucucuugaagcaccuuagauuuggacaaagagaaggccagugagcagggcaaagccugcuaggagcagaaugaccuugaggauccucugcucagaaguggccaguuccugggguagaauuuccaggaaggugauauagaggaaggugccagcugccaugcccucuagaacagauugggccagcuggugcagaggcccagcugacucugccagagcugcacccaacccgaugcccagaggugucauacaugagaagaggaucccgcagccagccaccaccugcacacguagguggcucuguagcagccgcagggacaggcugacugccagaaugccuuugugaagcagcagagcuaggcacagcuccauugcccgagcccugucucgcugcaacccuacagccaggcccucaaauacugagugcaaggcuaaggagaagaccaggacacaagcacgcagggcugagggagcugcuggaguuccgccggccugggggaucccugguccaucgugccagugcugaggcccaccauucacugugcccaguagagcccuugucucuuccgggugggguggacuggucuguuccuuguaagccagcgugaucugcuccaucaccaggaccaggaagaaacccauggccaagaugaacucuugcaaggggaacugaagcugugaacagagguggcaacaagaguucaggaaaucagaagaaaucagaugcaaagccugguagaggcucuguuauacacaucugacgucccacacagacaagcccccuguggucacaccaugaugaaguccguuggcggcacaaccacagaacaacacuuaauggaacagcuaaugguauccaaaguauuacaugcagaccaacuuuggcacuaauaauauuuugggguaaauaucucugccaucacugucaugcauacuguaaguaagcagcaucucuggcuucuacccaucagaugugagucacaaacacaguaucaccaacacuaagcugugaccaccaagaaugucuccacacauuacccagucaguccuuccuaagggucaagacuucccgaagcugaaucauggauguauaugcacacaguguuguuacauguaagcauacaaaggggcacaucugggccugccacaaauguucacauacaaagcuacaugucacagggacauucacagucauaugaagacaaaggucgcucagucacagguauacaggggucacgacccauuacuacuuccucagucacaagggaaaaaagaugacuucgcugaacaaccgucucagguuuuccuaagcugaguucuuuggaauguugcuguuugggaggcaggcagggguugagacagucucgcugugaagcccagacuagccaagaaaaacacuucauaguucaagcuggccuccaacuccuugugaucauucugccccagccuugcaagugcugggacugcacugcuuccaacucuguaucagacuuccuugccuugaaccccacaucccacuuucuugagaacaucuggccccggggaauugcuuccuaugcugccagaucugcagugaucugucuccagcucgcuggugaauaccuguaacccaggaaauugaagagggagaaccaagagcuuagcgcagucuacauuacguagauagacccuacuggaaaaaaggcgcccucgcucguguucauguaagugacccuaauuaaacucauggagucaagcacucgucucacacacacacacacacacacacacacacacacacacacacaccccacucacacucaaaagagagaucagaagaggaugaucagugggagggaaacaagaaaucuaauaggagugaauauaguuagaauacuuuauguguguaugaaaauguaauaauaaagcccauuacuauguauaauaugugcaaauaagaaaaacaaggagggcugggcagugguggcucacgccuuuaaucccagcacuugagaggcagaggcaggcagauuucugaguuugaggccagccuugucuacagagugaguuccaggacagccagggcuacacagagaaacccugucucaaaaaaccaaaaauaaauaaauaaauaaaauuuagaaagaaaaauaagaaagagaauguggggugagguagcacaacccuguaauucagcaucugggaggcagaggcaagaagaucacugcaaaguugaggcaggucuacaaaacaagugccaggccuacacagugagaaccugucucaaaaaagaaaaggagaagccgggcgugguggcucacgccuuuaaucccagcacucgggaggcagaggcaggcggauuucugaguucgaggccagccuggucuacaaagugaguuccaggacagccagggcuacacagagaaacccugucucgaaaaaccaaaaaaaaagaaaaagaggagggaaggagacagagaaugaaggagggacaagcaaauaaguguaugaaaugugauucuuggaacauuguuaacuuccugggaauugcaacccagaguaguucacacaccugaugaggcugcucacauuauaucaaggaauauagagaggucacacagaguuuaguaucagggaaagaaugcacaguaagaauauccuguugcugaaauccauaauucacagacucacauaccaaggccuuccgcagcccugaggugaccccugaagagaucuauauaaccauguuugucuuuuucuuuuuugguuuuuccagucaggguuucucuguguagcccugguuguccuggaacuugcuggcuuccaacucacagguggugugccaccaccgcccagguuauagcucuguuuucuauuagcuguucuauaauauacucuuggucacauguugaagucaaugcuuaccgucacaugcagggccuccaaggccucaucuauggcagccagguagucaggcagcagguccagaagacauguagccaaaaagacuccuccugcgaagcagcugacgaggcucagggcuuucuggcccgaggcuaaacaagagugaaguacaaaagggguuauauauaaccaaaugaaucucuucaaaguccuucuaccccaacagaagccaugaccacuccugcuccccccccccgccgcccccccccccaccccagucaccucgcccaaccuccgaagcagaaaagacucaccugaagcuucaugguuagcaccugaccuucgaagcacacagacagguaccaggcugcagaugagugucagcagcagcagcagcaccagggcccccagcuucacuuccagcccuacuggcaccgagggcuccgaugcgacugcuucugggcgccacaccaggagcucuggcuccccccagggccccaugguggcugugauaacucggugacucuuggaccuauacagagaaaacuagcaugggugggaauggucacaggaaagaaggggucacggaaaagggaaggcuggucagcggaaugcacuuccccucagcccagccacuuucuggccuuucccagcugaagugacucauccacgccaacaucaggauugcauuuccuccuucgaauuucucuccccaaguucagcgaaccaucaaggaggaaacugaggcacgcgaaggccaauauagaucucacauuacucuuucaccuggagcacgcagaaaaugaggugcagacuccagguaggaccugcaccuggagcugggguucccuaaggaaggcagaccacucucucagucugcuaagugcauguagcaaagggagguuggagcugaagagaagucccggauggcuucaccgaugauuugaaacaggggaacuucggggcuggcugacucucuuaacuacccacuccccagggccauuucccggaaauaacagguagucucggcauauagccaaagaggggcuugggacgagcuuugcccgcacugggcggcgucuggaagucucggagaccaggucggaggccgccagcgucgcaggaagcagaggaaauguuaacacggagaccccagcuccuagccugggaggccucagaagcugccuuugacccugcgaccagcgaggccucacucaccucccgagggucucacuccauugcugucgcucgguuccggccucgcgucgggaauucccacccccuccc

SEQ ID NO: 12081 - RNA, 9631 nt, Mus musculus
ggggacuggggcgccuugggcgccuagugauuacguagcggguggggccggaagugccgcucccuggcgggggcuguucauggcgguuucggggucuccaacagcuucucagguugaaguccaaaagccucccgaggcggggucugcggaguuugagguaaagcuccggccugccuggcgucggacuucucagcgugugaacgccuggcggggcggggagacgcggagacuuggcgagcugaaacaaaggcuugggugggggacucuggcuggcucuggggugauuuucggagccggaaaggggaguuucgggaagugguugugccaggcggaccccagagcuuggguuugcaggaauuggaagagggggguucuuuucccguaaacugagggcggggccgaguagauugaaaaaauagucgcuggucuuuaauccaauaaucuggcccgcacucaucugcaaggaaugcuauguuucugaaucacuuugagaacuuaguggaaggccacguguaucgaaugggugccuuagaaacagaagaguuugguaaacucauagaagcccuugaaguauuguagguuugguuugccaguuuaaucguaauugcugcuuuucuacagguuuuugcuggugugaaaugacugaguacaaacugguggugguuggagcaggugguguugggaaaagcgccuugacgauccagcuaauccagaaccacuuuguggaugaauaugaucccaccauagaggugaggcccagccccugccuggcccuuauccucacuuugggcuuucucuugcccauaacggcucuuugaaaguaaagagaagagaaagcaaggagguauuccaaaaaagcaguaaacaaguucgugcuuacugaggauuuccuuuuaaaagaacacaguuuucauuguuucuuuaugucacagcucuuuaauagaaacguaggucacaaggaaaaagauuguaggcgaucauacagugaggauagagaacucagagcucuggauagucugaaguugucauuuuugaucuaguccagauugaguugggguagaaacaaguugagauuuugagucauuguaucuaggaauuucuucacaauuuaguuacggauauugaggaaaaucaccuaaauccuuacaagucucauauuucuauaugacguuaaauuucuaucacuucccugggauuaauggugcagguauguauaaguccaauuuguaagcauucaagaggcugagggaggagguuucaauuucuaggcuugccugaacuacuuacugaggcccuguuuacaaaaaccaaauauuuuuuucauguguaaaccuguucuaacacacaggaauguuaguuaaauucagaugucuacacagguuacauuuuaauauauucaugaaacaaaauauaagcacauuuccaaaaccacagauaaggucuucuaaguuuggacuauuauauaauaaaaauaagaauuuggccauaaauccauacuagauguuucugguuuuguuauuuuuuauuagugguuuuguuuucuuugguuuuuuguuuuuguuguuguuguuguuauuguuuguuuguuuuuuguuuuugucuuaaccucauaacucaggcugguuuuguuuuuguuuuguuuuuuuuugaaacagggucucacugcacuacccuggcuggccugagacuugaacucacagauauaaauucaccugcccuuaugucaugugugcaugcaugcgugugauuauguauguguauguuuguuugcuauucaugcuacuguuagcggguugaggguaaaucacauagguaggcguauucauccugguuaauuacauuucucugguuuuaaauaaagauugagccuguccuugucccccccaccaccaccuccucacucuuucauauucccaggauucuuaccgaaagcaaguggugauugauggugagaccugccugcuggacauacuggacacagcuggacaagaggaguacagugccaugagagaccaguacaugaggacaggcgaaggguuccucuguguauuugccaucaauaauagcaaaucauuugcagauauuaaccucuacagguacuggggauauuuucugaaacaaaaaauuuguaugugcucugaaacuauacuaaaguauauggacuuaggaaacauacaacuuuuuaacauuuuggugauauuguuuuguuuuguuuuguuuuguggaggccagaacaagugcaacagcagauaugugccaugggaggcagaagacagcuaauaaaagcucccuccuuagggccugggcaucuuggcuuaguuagcaggcgccuuugcccauggaccaucuuuaaaccccaaauauuaaaaagaaucugcuaggcagugauggugcacaccuuuaaucccagcacucaggaggcaaaggcaggcggauuucuaaguucgaggccagccugguuuacagagugaguuccaggacagacagggcuacacagagaaacccugucucaaaaaacaaaagaaagaaaaagagaagaaucugauuuucacugagugugugguguacugucacgguacuacucgggaaauggggucugcuacagaguaacaguaagacuucucagagaacuggugaguuucagagcuauuugggcccuaaggauuuuaguacaacauucuuacucauuuuacauuuuugagacaggauguugcuauguaucccagacuuaccuugaauuuagcacuuggccucagccuuccaagugcuaacuuuauagguauaugccaacacucccagccaauauucugaguucagagguguuagauuuucagaguuguugugauuuuucuguuuguuuguuuaaguuuggucugguuuuaaagacaggguuucuuuguguggccuggaacucuuugaucaggcuagccuugaacucacagagcuccaccugccucugccucugccuccccaguucugggauuaaaggcaugcaccaccacugcccauccauauagcagagguagacccccaaaacacugggucucucucucuuacagcagcauucuaucuuuagucacugucaaaguuaaaacauggcucuguuauuaauuagcuaaguaacuuuaggacaaaauacuaaaucugugugucucuguguuucugaauuuauuauaagaauaccuccaucagccgggcguaguggcgcacgagguguuggcagacuuacaaaguauacacaaugggucagacacuguucugaauauguaugaauuuguuuacucuuggcaacuuuaugggggagguauucuuuuuuaagaagauuuaguuuuauuucuggguacgcguuguuuugcuaugucuaugcacacaugggccuggugcucaaggaggccagaggaggguuccagaugccuuagaacuggaguuauagaugucuggggcccuguguggguacuagcaauugaaccugggucaccugaaagaguagacaguguucuuaaucccugagccaucucuccagccuugagggagguuuuuuuuuuugguuuuuuuguuuuuuuaauuuuuugagacagguuuucucuguaaagcccuggcuguccuggaacucacucuguaggccaggcuagccucaaacucagaaaucugccugcuucugccuccugagugcugggauuaaaggcaugcaccaccacacccggcuagaauuuucuuaguguuacguaucuuaaguuauuuagaauccauaagcucuacuuucuguacuuuuaagcuuaaucuaaagaaccuuuuguaguuuccaauuaaacccagagccaagcuccuuggaaaauauaggagccuaacaaggacaugcaucaguauauuggagcuggaagugaacugguauucacagccucauacagcuucuacaccaagucuaaauugacauucuugacuuagcaggucuagaguuguaugaguguguaagcugaguaauaguagcuggaaggauuuuguaaauuuaccacuuccuuuugugugccagcguacuccuccagaaagcuugcuuugcuuauuaugaucagcugccugcucuuuguucuagggagcaaauuaagcgugugaaagauucugaugauguccccauggugcugguaggcaacaagugugacuugccaacaaggacaguugacacaaagcaagcccacgaacuggccaagaguuacggaauuccauucauugagaccucagccaagacccgacagguaugcuagagauucaagcaagugugaguaaguguuuaaagcagagauguuugauugaucaagugugguagagauguaaucuauguuauguauaauggguuuuggauagugguuucuguauaguuagucuuuguuucuuguuaaacuuuuccccucuuccccuaucaccccccccccaaaaaaaagaacacuacuguacugugggauuucguuguuguuguuguuguuguuguuguuguuguuguuguuguuguuguuguucgagacaggauuucucguguagcccuggcuguccuggaacucacuuuguagaccaggcugggcuccaucgaauuuagaaauccuccugccucugccucccaagugcugggauuaaaggcaugcgccaccacucccuggcagggaauucuauuucugcuuuaacaggcucaacucuuccaagauuaaacauucucuaagcaugaauccuuuuuucugucagcacuugccacuauugaggacuuaacuuuccuggagggauccucacagucaguaguucuguacuguacacccaccuugcccuucuuccuuggcuggacuaucuuuguguuguuuguuuuguaaauaaaacaugccaguuaccagugugauccccuaggaaugcugaauuuggugucuucuuccuaagucaccccaauuuaucagcuauugauuagaaucaaauccacacagagagguggaaaugagagguuacaacuugaacugugccuguuguucguuaguuuuuuuguauguguuuuuuuuuuucuuuuacuaggguguggaggaugccuuuuacacacugguaagggagauacgccaguaccgaaugaaaaagcucaacagcagugacgauggcacucaagguuguauggggcugcccugugugcugauguaguaaggugagugugugcucuuacauuggaaccauagcuucuacuuagcauuaggcaguucagaauagugccagcacuacugacuuuugcaacuuaaaugagaguuuucauauauuugcaacuagaaaaugcaaauauauauuugauucauaugccagcauccauguuggguaucucguagccaacugugacuccagcuccaagggauccacuguuuaugaccuccacaggccacuacaugucacacacacaaacaaauauuaaaaguaaaauaauuuggggcuggagagaugcucagcgguuaagagcacugacugcucuuccauacguccugaguucaauucccagcaaccacuugguggcuuacaaccaucugugaugggaucugaugcccucuucuggugugucugaagagagugacagugcacucacauauauaaaauaaauaaaucuuuaaaaaaaauaaaauaauuucccucauagcaccuuuucagggagugcuaagaucuaauuaauucuuucagcauuuauucuacagacagcuuccuauuuuuaguauaggaauuugagaccuauaugugccaugauuguggaguggacacauugaagaugccauacuaaggauugacaauauagacacuaaaugacacuguguucuuuuguuguagacacuuugaaaguucugucaucagaaaagagccacuuugaagguaggacaaguuugaaaugucuugauugacacugaguuuccuauccugguuucucuuaccuccgucucuguuucagcugcacugaugcccugguucugacaucccuggaggagaccuguuccugcugcucucugcaucucagagaagcuccugcuuccugcuuccccgacucaguuacugagcacagccaucuaaccugagaccucuucagaauaacuaccuccucacucggcugucugaccagagaaauagaccugucucucccggucguucucugcccuggguuccccuagaaacagacacagccuccagcuggcuuuguccucugaaaagcaguuuacauugaugcagagaaccaaacuagacaugccauucuguugacaacaguuucuuauacucuaagguaacaacugcuggugauuuuccccugcccccaacuguugaacuuggccuuguugguuuggggggaaaaugucauaaauuacuuucuucccaaaauauaauuaguguugcugauugauuuguaaugugaucagcuauauuccauaaacuggcaucugcucuguauucauaaaugcaaacacgaauacucucaacugcaugcaauuaaauccaacauucacaacaaagugccuuuuuccuaaaagugcucuguaggcuccauuacaguuuguaauuggaauagaugugucaagaaccauuguauaggaaagugacucugagccaucuaccuuugagggaaagguguauguaccugauggcagaugcuuuguguaugcacaugaagauaguuucccugucugggauucucccaggagaaagauggaacugaaacaauuacaaguaauuucauuuaauucuagcuaaucuuuuuuuuuuuuuuuuuuuuuuuugguagacuaucaccuauaaauauuuggaauaucuucuagcuuacugauaaucuaauaauuaaugagcuuccauuauaaugaauugguucauaccaggaagcccuccauuuauaguauagauacuguaaaaauuggcauguuguuacuuuauagcugugauuaaugauuccucagaccuugcugagauauaguuauuagcagacagguuauaucuuugcugcauaguuucuucauggaauauauaucuaucuguauguggagagaacguggcccucaguucccuucucagcaucccucaucucucagccuagagaaguucgagcauccuagaggggcuugaacaguuaucucgguuaaaccauggugcuaauggaccgggucaugguuucaaaacuugaacaagccaguuagcaucacagagaaacaguccauccauauuugcucccugccuauuauuccugcuuacagacuuuugccugaugccugcuguuagugcuacaaggauaaagcuugugugguucucaccaggacuggaaguaccuggugagcucugggguaagccuagauaucuuuacauuuucagacccuuauucuuagccacguggaaacugaagccagaguccauaccuccaucuccuuccccccccaaaaaaauuagauuaauguucuuuauauagcuuuuuuaaaguauuuaaaacaugucuauaaguuaggcugccaacuaacaaaagcugauguguuuguucaaauaaagagguauccuucgcuacucgagagaagaauguaaaaugccauugauuguugucacuuggaggcuugauguuugcccugauaauucauuaguggguuuuguuugucacaugauaccuaagauguaacucagcucaguaauucuaaugaaaacauaaauuggauaccuuaauugaaaaaagcaaaccuaauuccaaaauggccauuuucucuucugaucuuguaauaccuaaaauucugagguccuugggauucuuuuguuuauaacaggaucuugcuguguaguccuagcuggccucaaacucacaauacucuuccuggaucaaucucccaagugcugggauuacaggcacauuccaccacacacaccugacugagcucguuccuaaugaguuuucauuaagcaaauuccccaucaccuugaaacuaaucagaagggggaagaaacauuugcuaugcuccugagugcuaacacugggaucauucacaugggguuugcauuccuaggcaaacuaaacugcugccuuuuacaacaaggcucagucaucuuccugaagcugcugagaccagcacuuggucuuguuuuguuuuaauaugucuauaugacuggugguggaucccuaaauaguuuauuaauuaaacuccaguuaaggagaaaguuacucaccuugacccguuugaccauaucccgugugugugugugugugugugugugugugugugugugugugugugugcacgcguauguacguacguauguauguagguauguaggugguuuccaguauaaacacagaaacaaauggagccaauucagguuucagaugcccuuacuaacauauauucccacgggguguggguuuuggcacaacagugacaaacuuaaaagccaaguaagagccgggcgugguggcgcacgccuuuaaucccagcacuugggaggcagaggcaggcggauuucugaguucuaggccauccuggucuacagugaguuccaggacagccagugcuacacagagaaacccugucucgaaaagccaaaaaaaaaaaaaaaaaaaaaaaaaaaaagccaaguagguccaguugguauaguaucaaaguguuuuuagaguaauuagugaaggucugcuuuaccucaaaguugcagagccucucuuccugaguuuaagugccuggccggcagucacaaauuaacauguugcuguaaggcaguuaguugaagcuuuguucacacauuggagaguaugaaaauaaaguguucuaagagcgcugauacuggaucuguguaaaccugguaaaugccguuuguccaggacuuagcgugugugaguugguagcucaguacgaguuuacuaguuccgcaguguguacaauggaggcggguuuguuuuagcuggccaccuguagaaucagccuuuaaacugcugugaacuuugucaugacuugaauaugaagauagacaaaaacucuguaaagacaaauguuuguuuucccccuuacagaacgugugagcuugguuuuaucuuccuuuguauuuagucauaaccucucaagcuggcagcuccgaccaaggaucagaagcugugugcguuccaccugguggaauuagcucagcucuauaugagaaguggaguuaauggaaaacguguugacugggugguuucuauuuaaaagagugaugauaauucuugaacaguaguuuuuauuuugcuauuucuuuaagcugacugaugugccacaaaauuauuuuaagguauuuguguuuuaagaguguucucaugagauuaguuguagauauuuuuuaaaauacaacugguuuuuaaaaucugaguauugcucuaagcaaguguuuagacucuuacgggaagguggguggaaguuguuuggcuuccguauuuccaugcgugccgucagacauaggucagaacgccaacugugcauccugcuguuuaaagaccucuuggccucugugacccucaugaaggggcugauauuuuaaguugacuguuugauuguaaauuaauccuuucuaauuuuuaaagacuugcuugacuguuuuccuuguuaaauaauuuuaaaaaaauaaaaaacuggaaguucuuugcuuaacugua

SEQ ID NO: 12082 - RNA, 5427 nt, Mus musculus
cagucucagccuccggcacuggccgcgcagcuggaggcgguggagcccaagguaccggggccccagcugguggguggcgaggcgucgugggaacugaccucggaggagagcacuuucccgauucccggaucgcuccgggagcggcuuggggggcgggggguguuccgggccaggcaagagagagcgccccaagcugugggccaggcgcucuagccuuccaagcucucgaaccagagcccagaguccuucccuuucugagucuuuccuuucuggaccucccuagcugggccagggacacacuuagaucuccgugagcgacucaacccagacgcuccaguuccgggcagggaguaagaaacagggccucaggcuggcuaggggugggaguucuggccugggauggggaauggcgggaauagggaugggaugugaccacuggaggcugcuacugcuuggcgggucuggacgccgcccuagacggguuuuggagcugaucugagcugagagguugagaagacuaggaaagaucccgcuccuguguuguguauaugugucugagagugaagggggguggggaagaacaaaacaccccaauccccaacucuuccucguacccucuugggaaguuagggaguguuagggaauugggcugaaagcuggaguccagcucuuccuugacuucuggcuuuaaaguuaaggaaaagguguugcccgaagagugauuccucgccuagaucucggggggagcagaguacaaaggccuguuggaucaccugggaaaucaagagaauaaggaaggcuaguggcuuguccuagggaaggucccagaaguuccagaccccucucccggcccugggugaaguuuucguugucucucuuaggguuaguggggcaguuccgcuggagccgccuuucacagggaguguuagccaggccauccaugccauguuggccuucggccuaaugucccggcuuggccugaguccccaauuauucuggccuaagcagagccuagaugcaaagucuucggagcuggaggcucuaacacagccacgaaguuccggccucugccucccaccaucagaugcucagccgccuugcugcugugggacagccggggcucacgcauggggaugugacuaguguuuaaguguccuagggaucacgcuccauccacacugcccacccuggcuuggggcuguccccgccagccuguguacagcuagacugguugaauuaaugggaguagguggggaaguuggaggaaauccuguggguuaccuggauauaccucucagaccucauuuuugaaggagauaugcagcauagcgaaugccuucuucccagucuuucggggguaccagggaaagccccuugagauggggggugguaaguguggcugugcauacgcaacuccuauaaauucucugugacucauguccucuuuccucacaucccaguuuuguguguguguguguguguguguguguguguagguguaggggagggaggaaccacccaggcgccugaugcugaaaagaaucagccuggggcuggaguacucugcuuccuaaaaggcaggcacaggccaggguuugaggugguuuguagggagcuaagaguugagcagagccagacaggaugugggacugaaaggcaaagccaaguuuggggcugagcucagguuacugugcccuucuuaacugcucccugccuggucaaaagcuuagacugauccucacuaguccuuucuuuggaggcuccucccagcccaggcucugguucccucccccacagccuucgcuucaucucuacucugucuggcaugauccuugccaggcuguguaggucuggagaccucacugacccggucagcucccuguggucugaacugcucguucacgugugcugggguguaggacacauauaaacucugagaagcugacuccuuccuuaucuugagucacagggaggugucugcugggccuaagggucagcuggucacaaggaggaaggggcuguuccagagaguggguggaggugauucccgaguggguuuagcuccgucacagcaaugcugugauagauguguggcuccccacaguguggucauuguccccugucaggggcugagugacccaguguugcugccaggcccagaaaaggggauggguggugguggugguggggaggcagcggaacaggcugccugaccgugagcugccaggacugagccuucuuugugugacuugagacuuuggggaagggaagggggugggucagggaagccagccugcuuccacuggccucuggcuuagcuucucccacuucugcucucaccugugaagugccauguaggcaagacagacugcaucacaaaguccuguuuugagagcugucccuguacuuuugucuaaaccacacugagccucaguuuccugcuuaugucaggaaggcccggagucagcgagagggacccgggagaugcucagugggcguggugcuugcaaagcaagcauagucaccugaguuugauuccaggaccccaugcaaagguagacugacuugucuuuuaccaccacauguguaugugccucggccaauaaagaguuuuuuguuuuguuuucaaaugggaaggccaccauccaccuaacaggcagcuggagagaugaaguuguaaggucuucugccugcaggauugguucuuggcaagaacaggccuuggcgaacccucuucucuuccuuugcuggaugcugugguuucuaggcaggcuugaggggguggguggcuagauaaguguuauugaauuuacuggcuuuccccuccucaaauccccacugccaccugccugccaguuucagccauggcugcgauccgaaagaagcuggugauugugggugacggugccugugggaagaccugccuccucauugucuucagcaaagaucaguuuccagaggucuacgugccuaccgucuuugagaacuauauagccgacaucgaaguggauggcaagcaggugaaagccauguauuucuuguuuuccuggcugggaagccuguucccccagucacacggggcccauggauguccuuccuuaccacccaccuccuucuuuauuucccugcuggaaccagcagaaguuaggaagugaaacuggaacuguagaaaaccuggaugcacuaucugguuggaccacauacuggcucuggaaucugagccaagucccuuuugccugugggcuuaacuucucccuacugcaaaaugugaaugagagugagacuucucccaaaggguuguccuaagaacuaaaugcugcugacaguggcagcucauacuacaccaagaucaaacccaucuuagaucuuaagagaaguggaucauugguuuugugacugaucaauacaacccagcacauagcgagcaguuaagauguuguucagcuagcuuauaggaugagugauuucagagggccucagggugguaggguuggggcccucaggccaacugcucaauagccuugugugucagguggagcuggcucugugggacacagcugggcaagaagacuacgaucgccugcggccucucuccuacccggacacugacgucauccucauguguuucuccauugacagcccugacaguuuggguaaggcuuuggaagaaucuugggagcauguagguccugcaagucuccuuugcuauagagacaguagcccuuggggugaggaguguucacugcaaagggcuuugagcugugcaagguacugccuguucaguagacuccagggcugcuauagaagaccuggcuucuguugcuaaguagaaguggguacauccacguuuuggugauaucucugcagaaaacauuccugagaaguggaccccagaggugaagcacuuuugucccaacgugcccaucauccuaguggggaauaaaaaggaccugaggcaagaugagcauaccaggagagagcuggccaagaugaaacagguggguggggcugcgcugcugguggugaggcaaguuucccagccgagaugcaaacagcugauagccagugguagcgggacugugacguucaucugcuguccuguccgaaugcugggaagaacuagaagggcccccaaguaacugaaguaucagagaagcgacuugcccgagggugugggggcuguguguuaagaguucccuggggagggagggcauuauacacugcugggagaaggcucagaggggugaguacucgaggacuugcuaaauaacucuagccaguggacuguuuuacuuaggggaagguaggcuaucuugggaggcuaauuaaggcuuuagguggggguucagucucuguuaguaaaaguacucugguagcuauguaguauagacgagaacagucucagccugugggucaugaccccuuuggggcugcauguuagauauccugcauauuagguauuuacaucacgauucauaacaguagcaaaacuacaguuaugagguagcaacaaaaauaauuuuauaguggggggguguccccacaacaugaggaacuguauuagaggguugcagcacuagaaggcugagcgccaccagacuagagaagacggaguaugaagucaguugggcaguagguacuuguucagggggggaaugggugccguaggggugaggcugggcgggggagggaucagacagaauucugcaauggcaaccugggucuuauguccccagccuggaaacuggccgugguagcuggaccuaggaauucugcagggccagucuggaggaugcucaguuaccccuucuuuugacccuguaucuugucuuaucaggagccgguucgaucugaggaaggccgggacauggcaaacaggaucagugccuuuggcuaccucgagugcucggccaagacuaaggaaggggugcgggagguauuugagauggccacucgggcgggccuacagguccggaagaauaagcgccggaggggcugucccauucucugacuuccccaaagcuuccucaacccucccacccuucccuucccagggguacaguuacccucccccacgccauccuuguaggacuccaugcugccaguuucuuuuuugguuccuuucugcccaggacugcaugaguuucccagccccaagugggggcugcuaggcccuuccucccugccucugggaaccgggcuggugcccugccuuuccugagcagggcuccuccuccagaagcggugguccaggggguggggcucuuagucccucuggccuuccccauauuacacaccagcacuuuauauauuuuuggcucacaggaggagucuaggguagggacugggguuucugcuuuggguaguagccuuguuauuugacuuaacuugguggggacaugaauaaaggucaaagguugcaccgug

SEQ ID NO: 12083 - RNA, 80715 nt, Mus musculus
cuugagugcauuaaauaaauauaaauuuuauuaaaaacacucacauggcguuaucaggaaugauauaauaaacagcuuuaaaauaaacugcauucauaacauuacaauacuuacaguauuuauaaccacccucagauuguauaaacaaagccaaaaucucaggaaguaagcuacauuaaaaaauaaagcauagaaaaaugcacacagaaguucauuaucuuagugucaaacugcaaaaaaacaaaaaacaaaaccaaaaaaaaaaaaaaaacccuaacaaguuaaccaaacuaccuuguaaagugaacuauacaucacugugcgucaaucaagaugaaaaauucauucaaguaauguugacaccaagcagaagcacuuguaucgaguauggcuauguagucaagcuguuccuauagaagcaaaucacagaucugccucccacuugaucuaauggacagaggugggaugucacugccuuccucccuacaccacccauccucucaaaccacacuuacuacuccuguuggccagcaguuugacaaaugacagugggugacauguaaagcaaauauuccuuagggauggcuggcucaaaaaaaaaaaaaaaaaauugccaagcacaccuugcaggaaccugauguggacucaacaucaugguuuggaaaccuugugguuuuuguuuuugugugugugugugugugugugugugugugcaaggcagacauucugaaaguuuuuagugacaaaugugacugaugguaaauuacaaaggucuccacugacgcaaagcuauuugcaaagcuaguaagcaacacuguauuuaggccacaauguaacaacaguccuauugcacagcacaccaccagcuucuaggacuguccagcugcaguccaaagcuguccucgucacuagaucagaagccauuaccggcgaugucuuguaccccccaucucccucugccagcucagggcuuccuauuuuacacuuuuuacucugcugaaugccaacucuccaaaauuuacaauugaaaggugacaaaauuuauaaaauuaguuuucaguuaucaguacauauacaagcaaacuacgagggauugcaauccucugaaagcgaauauauuaaccgacaacuuugcauaaacagaugacauguuagcauaaggagaaugagcugaaauaucccugaauuuuuagaacaaaaaguuugagauucaaguuauacuugcuaagaaaucaaguauuuaaaaaugguaugucuuaauacaaagauuuaaaaaaaaaaaaaaaaagaaaaaugguggucuacaaugcucuaagccuccacuguuagcucaguaucccauugccuagcuaguguugagguaugacgacaaguaggaacaccacuccaacuuugaauggauucuuagcucacauuaagaucuauguggagcaaucuggguagcaccaucgugaugugaauuuuucuucaaucucauauauuauauauauauauauaauauauauauacacauauguauauauuuaauuuuuuacaguacuaaaauacuaaagcauugcauuaaaaaagguuguuuuacaauuuaauuuacuauacaacucuuuuuuaccuuuuaauacaaauuaauguuuaaaaucaccauaaaccagcugccuauucucuuucgguuuuuguugguugcucuguaaccaguagaguccuauggacuuaaccaugucuucucaacuucugcggguuucaguccacucaaccuuccugguauauauaacacuuagcuaagaaaagacaccacaaagcauguaaugaacacaaaggcagccugcuguucugaagaacauacaggucugugugugggacaacauggacuuaagugggcaagcuuugcucugucugcagcaccaaggcuaauuaucaccugcaauuaacagacguucuuaagcuguauacgcaggagggaugagcuugcccuaccaccguuuuacaggauagcaaguaaggugagcaccaaaaacuguuauuuguuuucuguggacuagcauauccauucagcuucgguuuggauuguaacaggccugauacugcucaucagccgauaguggcuaagagcaaagcaaauguuuccuuaaaaggaaacaaaacaaaaccacuuuuaauccuaaaugaaaguaaacuuuuuuuuguuuuguuuuuauguuuuaguaccuuagcauugcccaaguugccaaagcuuagguaggcaaagugcuuuucuaagacacaacuuaaaauauuucaguacacauguguaagugugcauaucuauacauuauaguccuacaaggacaucgguggauaacuacaauccagaggccuuugaaauguccacauuuuaaaaacuaagcugaauaauuaagauagaaauguaaaaucagagguaccccagugccuccagggcccucgaccacacuggcuagaugauagaaggcauugauuuuucagcuauuaaaaacaccauuuguagcaccauuuaauguuaacacccaaacagauucaguguuuugccauuauucacuuaagcuuucuguagcuacuuugauaaauaaguuauuaagauuacaguaaaaaaccugcauguuaaaaagucuuaguuccaguauuucuucaguacaucauacgucagcaccagaugauccugcaacugcucuacuacagcgcugugucccacgguuacacacgcugaguacuagaagcaguuacguguagagugcugaggggcauggcacacgcaugaccucagccaauaagagaaccagugguuuucaagacaaauguccagcgcuuccuucccacugugcccuugcauaggaugcucuuccugaaugccaccauggaccacgggagagauuaaauauaaugauaaaauaaacuauuuugcuggugagcugacagcccccccccaauaaacauacacacaaacacacacugcauuugucacagaugcugugaccugucccuacggcccaugccaugaaagacauacugcucacaggucguccuugguggucuggccuaauggccagcgucauacaaauguguuguaaggcccugugaccugagugaaagcauauggugauguagucacgguagaauccguagucacagacccuguguucucagcaagagacuggaugaaacgcagguaacuggguuccuguggcccugugggcucacgcuuuuccuguuugccaugauuuuucugagacacguggucugauccauucuuuccgcacucuuccucuuuccgggccuuuucagccauuuuggcuucccagagagccaaacaauguuuugguagaaacaaauucuuaugccuauacaguacaagugagauccugguggggugauuccggucgggaucguuuacuuugguuguggcaugaaccucacacuuugcacacucaauaagaauugacccaugaguuggagcuauagccaccccuccaaugcaaggauccugaaaguugugcucacuaucugaccaauacucaauuuccugcacagcagcugcauccuggccugacaccucaggcugcuucuccugacugcugccagucagacuguauaauaguucuugggcagaagcaguucuaucaugauuaaacccuggaagcacucuugagagcccauuggcuauguugucauucuccuuguuguggaaggcguggcuggaacugcuccccgaagcugcugccguguagcuguagaucgugugagaggguagaugaugcucacugguuuuguagucaguguguggguggcuguauggugaucuggaggcagcucccaugaaaugacuauccaucuugggggugggguaaggagaaaacguugcuaggugguguacauuugguuuuaggguggaguuaguagugaaggcaucucucugcauauuuugguuuccauaacuuaaguacuuagagggacuguccccaaacgucuguuggugaaggguguggaugggugguaaguucugauuggugagaugguccugguuuggauaucuauguagaucccuggacugagccuggggggaauaagaaccuaagaaaggggaaccauuguccacuggcacacucccauuguauggaaaaggugcauauugguuauucugauucaaaagcccaagguagggguucauguaauuagaaggauucaaauaugaacccgaggcaugagaugaagugggguaaaaguucacaugguugguaucuccauaaauaucugaggugugugcugagcugggauaaggacugugaggaguaggcugucucguguagacacugguggauccagaacaaugagaaccaacagacugagaguuaccgggcaugauaugcuguggcuguggcuguggcugaggugucgucugcggcugcggcugagguggcugcggcugcuguggccucugcccuugcugaaggugccucuggaguguugguggcugccggaugaccgggcccgaaagcugcgguugugcuauggagaggguaggagagagcagguacaaacacaucuaagaauggagauacuuaauauaugcaagagcauagacaagcccugcaagcaaggacaaaggaaagcgagggcuuugagcauugucacccauaauuuugugucugaagccauagaagaaacacgccaaacuuuuaauggugcauguugguaaugugcguuaccccacccucacuccagagucauucaacaugccucugcccacucuaccuaucuaccucugcuuaguucaaugccaaccuagcuugauaacaaagacucuacuauaauggugcccccucaaacccuacuauuccugaaggaagggaacaguuuauuuuacuuuacuucuuaaugaccuggcacauggcaggacuugucaaaaauggaauggcauuuaucuauaccuaaagagaacauuucccggcaaggacauuuacauggcugcauguagagagcaccuugugggaauguuccccuugagaaccaugcacugggaaaauggaccugcaguggcacuuuugggaaaugaacaguguuaucauggaaaccagcaaggaggggacuuuuaccucucagagcaaagaggacugcuuaaggaaacacuggauuucuuuuuaguagcucuaauuauagacauacagcaaggguuauuauuuauggugcccagugcuccuccguugggacuaaggcagaguuugaugaguguggaacauuaccuaagcgagaaccaaccugucuaugaaagaauacucaguucacccuuuaucccgcaaacgaguuuggacuuaguucaguauagcacuguuuuaauuucuauucaguccuguucuuugcauucugagaggguucacuuucauaguugcucgcaaucccccuacuggucuacugcaucuguguccagugcuccccuccuuaagcuuggugagauauuacgccaugauucacauuaauuuuggcuuguuauuuguacccugaacauuugagggagcauuaugauagacuagucagaccgugauugcuaacacuucccagcaagcucacacagccuuaagugucacacagcuuaccugucauuuguuucauauggcuugcauuuuccaucagcuuuguaugugaggaagacuuucccuucucaguccuacuggagcaguucuccagagaggaacgcuuucgagcugcuuucuuggucuuggcuuucuugggcuccgcuuucuucuugcaacucuugggcagcucuccuauccuuaugacccuucuccuccgaaaugacugcagaaccucaauggaccccauccguaucuucuucuccuggccuuccguacucccaaacucauccucaggggcgaugauguacauaggcagcacguggaacugcucauccucaggcuuagcuccgacuucucgauugucuucucuauugagggugaccaccugaagcggaugugagauguuccaagcucaguuguagguccagaaagaaagugugugcaugggccucccuagcaguauccacaugcguguuggaugagggacaugcauauuauuaaaaccagaucugccuguuuuaacggaagacaauguacaaauggaggaaauagguagagaaaaagaccaucucccuuuuuauacuuuucaagaauagaauuggcuauuuucauggacuucuagagccaugcuucuuccaaaugaaaugaagcacuggccugcuuucuguaacacauggcagaugcaugucuuucaaaagaagcuacagcccucuucuuccagcacaugcaaugggauggggaaggaugacaacaggacacacagcucuaugucccccagaccugacuccuaacucuccauguguaaaaaacuugcuauacucaagaaaaagaaaaaaaaaaaaaaaaccaagaugccaguugaauguaugucaugcauaucuucaugcauccucuuuugcuugcucugaucuuaacuauaaucauauuaauugauaauugguaaguggagaaaauaaaacuuaaaggacauacauaacaaggagugggagauaucccugaagggaaagagugguuucuaaaugacuaaugugaagaacugguucccaaacucaugucucugaauguuucuuuuacaaauacaccagcauucaauucccacccaagugccuuuccauccugccuuguagccccugggaucauccaaaggcaggcucauugcucauugccauuucuuuauagaacgaagagcagucuacauggcugcacuauugugauuauacuacagccucagacagggcugacuagggucaugaguagcuuauuuuccuggaucuaacuucaaacuauggcagguagcuaauauaccucagagucuguguuuagaauggaggcuguauuaauccauugugcuaccgugcuauguaggcaugagcucuuguggucugauuguacauaagucacaagugaaugacaggaagugacaauuacuuucuaccuuccuuuuggggacaggguaucucagggagccugaaggacaccgaucuugcugguuggcuggauagcaagccucagagauuccuguguccacuuucccaauguugagugauuaacagcacuggguauagguauaggggauucaguucuucagcuugaagguaagugucuuccuggcugagccacuuucccagcugaauuucgauuuuucuuuuuaaagauuuuuaaauuaaguguauggauguuuauuguacgggaacuagcaugacugcagaaaucaggaaugucccuagagcuggaguuacaggugguggugagcucuggguacuagggauggaacucagaucuucuccagacccacauuauuuucuugacaagcacuuugaaauaacaauguauagacacaauuuagauuaguacuaagaccacccaaauucuugugugguugucagcauuucugcuaaugugccacuuaguugugagagggcuaguaaggucaccugucaccuaggaaggccacgggaacauaaucuauccaugaaaacacauggccuggugaccccugcugaaagcacagugcucugugccaagcacuguacagcuugugcuugucaguggcagacgcugcuaggaucguggggugccacuuaccacuguacugccauuuggcauguucugcuggucucugugggaaugagcagagaaguccaaacaugcagugacuccugagaauggccggccuuccuucagacccaaacagcagucuggggcuugguguucaaauucaaccugacagacagaugugugucaaugggaaaguucuuuagacuuuugcacuuuauaucuagagcauaauggaaugaccaaaaauagagcacacuauuacugaggaaaaggcuucucgguguaguaagguaagcaaucuagcacugccaggucccacauuuccccauccguuuccucccuccaaacccucacuuauaacccucccugcucucuuucaaauuuaugcccaaacuacucauuagugaaauaugugagugugugugugugcacaugcacaauuguuaugguagcacauacuccuaaauaugacuugcccaugaacacauguuaaguagcauugauggaaggcagccuuacuuugaucuaugugaacacccacguaaccacugcuauaaacaaaucaggucuauauacccauuccuccccuaaaguuucugccagucucugguguuuucccuccugcuuuggucagaccuaccacacagacaaaugaggauuacaacacauuuaaagucuucuacaugcuccaggaaauaacccaaguaaaaugaaaauacaugggauggaagaaaaucugcguagaugguuuuucugauuaguuauuauccagaaucuacuuuuuaaauaaaaauucaaucacuucaucccuccucgccuuucacguacccuuuucucugugugccccauccuagcuguuauuaugugacaguugcuuguuuuuuaacacuuucuuuuguuuuuaaacacauagaagacauauugaucucuugauaccuguaguuauaacaggcuuuugcucaagcacaaagggugauuguuguggggguggggguaggguguuaaucuuugagacugaucucauauagcuaacuagugagccuucaccuugcaaaaucagcaaauacggguuuuguuuuucuuuuuguuuacuuuuuuucuuucuucauggacaaagucuaacaauaacuugacaccuggacccauguguaauaaaacaacuguauagauaguccuguaaaaaucaggguaacaugauuuaaacauauugaauaaaaucuucacauggauauaaauuagauaaaccaucauggagauuuaauuuuuuuaaggcugaaaaccaaacgugugcacuuuuagcagugaaauucauacaauagaaacaauucaaguaguucuaaggauuaagaaaacaauaagagugcggcuggagagacaccuaaguaaagagcauuugaaucuugcagagacaguaacccaaauauugguuuacagcugucuauaauuccagguccaggggacucaaggcccuuaccgugcagugcauucauacaaaugcagggaggcugccccauacaugaaaaggagaaguggcuuuauaaaggcuaaaaaagaagucacucuuggagcugagaugaaaggauggaccaucuagagacugccauauccggggauccaucccauaaucagcuuccaaacgcugacaccauugcauacacuagcaagauuuugcugaaaggacccugauauagcugucucuugugagacuaugucagggccuagcaaacacagaaguggaugcucacagucagcuauuggauggaucacagggcccccaauggaggagcuagagaaaguaaccaaggagcuaaagguaucugcaacccuauagguggaacaacaauaugaacuacccaguaccccccagagcucaugucuuuagcugcauauguagcagaagauggccuagucggccaucaauggaaagagaggcccauuggucaugcaaacuuuaucugccucaguacaggggaaugccagggccaagaagugggagugggugggugggggacuuuugggauagcauuggaaauguaaaugaaauaaauaccuaauaaaauaaauaaauaaauaaauaaauaaagucacuccuucaaaaaauaguuuuggggcuggagcuggcagugcacaccuuugaccccagaauuuaggaguggaggccagcccauccaggacagucaaggcuaauacuacucagagaaacccuuucuugaaaaaacaaaagaaaguuuuggacuggccaggucaccaguaauggcauuugacaauaaaaaacucacuuaccugauuauuguaugcaucgggugcaagcuucuuguauauuggagcaaugacaguagccagguuuugcaaaugagaaccuagucucucuuccuguacaaaaaugauucaacaaauuaaauucuaaauuaaacaugguuauauaaauguguacaugcauuuagacaugacacagucuaaauuauucccaaguauaauguguuucuuauuguaggaaauaucuaaaucuuuguuuaaaaaaaaaaagaacaguucuaauaugaauuuguaugugcuaucuaccaugugcuaucuauuuggauuuggguaugauggucucuacuuugcaugcagacaacugacaauuuguaaacacaagccuccacuggggguggagugcugaacaagccagcuggcucauggaaacaaacacuuuucccucucacuauucaaauguucguuaaggaagaugaacuacuacaucugacuacuucuaagcacuuccuaaguuuaaaugaagucucuauagaacuuacuggacauuuuaaguguggauaaaauucucuggacuaacuacauucaaugcugagcaguuuguuuaaaaaauggaaauacuguuacauccccacuaucccaugcucacaaagaaauguuuccaauaggcuucuaaaguggcaugaccuaaauucccucugacaccaucuaauuucaaauugcuacuguugaacaaucuugggaggcugggagauaaagcucaguuagcaauugcugcucuucuaguggaccaagacuuguuucuucucauuuaugcugaguggcucgccagcacaguaacucaguuccaggugacuucugggcuccagagccccugcaugugcaagcacagggagcuaagguggaaccugaguacucacguaaaagauggggacccauaacagugcugggguggucagagcaaaaggaaagcuggggcuucuuucucugauacccauucuagucaaaacagccuugaguucaaugagaggcuucuucucaaaaagggauaaaggaagaugcgcauacgcaugugugaaugcacacagaaaugcaugacacacgaauccagagaugcaaacuuuaguagguagguagaguuggcugugcagcaggccugcuuaagaaaaaucuugcagggaagugguggcaaacgccuuuaaucccagcacuugggaggcagaagcaggaggauuuccaaguuugaggccagccugguccagggcuacacagagaaacccugucucagaaaaaaaaaaaaaaaagaaaaaaaaagaaagaaagaaagaaagaaagaaagaaagaaagaaagaaagaaagagaaaagaaaaggaaaaaucuugcuuacuugcauaauuuauauuuaauauuauaacuuuaauauuaaagauaacauuucccuuuaagaugaauauaucaaaguuaauaacaauguguggauuuuagcacuuuagauucaauuuaauuuuuggucauugguuuuuggucauucagcucuuaauuaaauccuacaaucuuaaaaguauugucugccagagaaucuuuauuuuaaaagauaaaaaguuugaugguuuuaagugagaaaucaguguucguuuauuugaacugaauauguauacuaaaauaucaaccuguuuuaguugcuugaauucauauauacugcaguaacuuaaauugagauauuagaaauaguuuaagcaugaguuccauaauuuaaacuugaaagugaauaucacaaauccuaauuuuaguuuucugaugucccuuucugauaccuggggcaaugaauuaugccacuuugagcagaagccaugucuccaauaaaguauuccuuccuuuaaaaaaaaaacccaauauuuauugauauguauugguaguuuacuugcaugugucugagugucagauccccuggaacugaaguuacaggacaguugugagcugccauaugggugcugggaauugaucucagguccucuggaagagcaaucacagagcucuuaaccacugagccaucucugcaggcccuaaauccacacugucuuugcccuuguuugcaacaugauucacugccauaguaauucccaguaguaucauagaucuuucaagcaggauaaguuuuaauaugcaaauauuucuuauuugguacuggcaaauuuuuguccaaauacucuaugaaauagaauguuaaagggagccucaauguuauacaucagugugaaauuacauugagaaaucagaaugacauaaacauggucuauugcccauauuacagacuuuucuuuacacagagccucacucuuuaguccaggcuagccuaaucaacuuaauuuacucuuggcauggguacucuauaaaggccuaugugcuggcuaguuguggcaacuugauacagccaaccauuucaaaaugccaccauguagggaagccuguggcucauauuccugauuguugauugauauaggagggcccagcucacuguggacagugccaccccugggcugguaauccaggguacuauaaauggcucuaucaagcaacagggaacaaaccaagacaguacacagccccucugaaauaguucugugccuacacugaccucccuguaugaacuacaagcuuuaaggcaaaauaagcccuuuucuucccaaguugauuuuggucaugguguauagaaaccuuagcuuacugcucacaggucagaauaauuugugcugcuauauauauauauauucaugauaaauuuauaaaauauuuuauguuuaggggguuagccagaauauguagguucaucugagaugaaauuccuucuugaguaugacaggucauuaggcucauugauucuguaugaaaaacagguuauagauuaggaaacaaaccaaccucuuuuggcucagcuccauguagccuaaauuuccuugguuucuugcuucuggcaaacuuacauccauuauaguacaugcuccaagaacaaccaaaagaaaaggaggcaccacaggucucuggauucucacccugacaacaacaguuucuacugagagaacacaggcauuagaaauagucucugacaauagccauugugugcuacugagccauuugcaugucuuacagagguaagacuaauuucuaccuuucaaauguugacugaguguaccuagaguucaugucauuguguaaugugugucaaagaaaacuucaugcauuguuuggccagcccaauuuucucauucaucuucauuguguucuaaacugucuuauuauuuuugugaugaucaguuaauauauacuuggugaauuauuuauaaguguaauauuauauacacauucugauaaggggaagaaaaacuaccaaauguucuacaaauuacccugacaccuagccaauaaagauaacuaaacuauugaucuaguucccuugaugaacacagaugaacaaaaucuugcaaaucauauuuaagaacacauuaagaucauacauucuguuagaguugguuuccaacuuggcucaacacacaaaugaaauaauucucaaacagacaugaacauuccuccacaagaagugcuaaagaaacuaggaauggaaagaaccuguugacauaaggguccgugaugaagccaguaaacauauacuaaauggugaccaauuccuugcacaucaaaaguggggcaagauuauuuuuuaccacugcccuucaaugcucagucuuuucagcaaacuccagaauacaaaaucaacaugcaaaagaagauuuugcagauagcauguucaaguuuacucccuagcacccacaucaguuagcucauaauugccuauagguccaguuccaggggaguccugugggcacuagcaugaacccacucagauauucacaaaaaaauaaaaauuucaugacaaugaaauuuccuaaacuuaacaagaacauucccacacuauuaccaaauagaaaugcauaaaacuaaccgaagagguaaacgaccuccacaaugagaaguauuugggcauugacuuaggcaguauuauauaauggcugcauugauaaaaugaaucuauagauucaaagcaaucaaauuucuaguuacauucuuuacaccccuagaaaaaucccaaauagcuaauaauccuaaauagaagagagcacagcuguaucauaacuaauuucaaauuauacuacagagccauaguaacaaaccaucaugguacuuuagaauaagaggaucuaggaauaaaccagaguuacagccagcugacuuuugauaaagauaucaaguuacaaauuugagacauaaugccugaauaauccacaugcaguagaaguagaucccuaucaccgcacacuauggacacaaguggagagacaagggacaagucccccugcagcucucaucuccagaggugcuacccacauuacagucggucaacccaccucaacuaacccuagcuauagaaaucuccucagaggcaugcccaggaauguguccaaccugagucuagaucuugucaaguugacagucaugagguaguaauaacggagauuucauggccccagaaaucuuaugugggggaaagucuuuagcaaauacacuuauaaggaccaaauguaagauauuuaaagaacuacagaaacucaauacggaaaaaaaaaaaagcucaaauuauccagucaauaaauaggcuagugaacugaagggacaggaaauaaaugaccaacaauuauuugaauguguuaagcaccagggaaauagacauuaguacugcuuuaagauuacauaucacuggagucaaaaugacuuaagggaaacaaaugaaagcaaugcuguugaugaugugggcaaagaggagcauauauguauauauacauuacaggccagaaugugaacuuaugccacugcuggagaagucaguguggaugcuccucaaauagaaucuaaaaagaacugucacucuauagcuaucccacacuuaguaucauuuagauuguggcuuacuuuaaacgcggucaucuuuaguuccauucauuuuccugaaaauaauuucacuuuacucagguucaaaauguggaugcauccuguuuuucuuuaucuaucuaucuguuaguaguggacaucuguuucauuuucuagcuuauaggcauaagcauguuugugcuucccuaaguuauuuuucuagcucacuagcacuuuagagccugaagccugcccugagacucuacgguaagaagagugaguucuucagcaaagugugccaaugugccuucacuuuuaaauguacauacacacaccuuuagcagaaugaacaagauaaacggauaaucugaagagucuuuacaguuaaaaccggucaucagaaguguacaagucauaggugaggaagugaaugagccauuugaauuaaucaguaagugaacugaagagcagaucgugaguuuuuguuuuuggaguuuuuuuuuuuuuuuugaucaaacuugucaaaagcaaaucaguuucaaauaggaguuauggauaccuguauaauacaaccaagacugaggaacuaaggaacagauaugauuagcagugagauuggugaauguggccaggauucuuugugaccccaggaaaugaaucugugugguuagugguuagguagauuuuaaaaguacaaacuguaaauuauuuuuagaccaacugugagaaaaugugucaggagaaccuucgugugcuaacaucaugcaugaauucacaguagaggaauaaaacgaaccuggguggugauugcuuuuucuuccugcaaaggggagaaaguuaacccaacaaacaguaaacgauauguacuaacuacccagcaauaacguacggagcagcagugaaaagggaagaaagugugaccuacaggaauaaugaauuagaauaaauggaacaauaauuucaauuucuacagaacuuuuaugaaucucgaaauuacagauuaaaaguuaaugaucagggcuggugagauggcucacugcuuaagagcacugacugcucuuccaaaggaccugaguucaaaucccagcaaccacgugguggcuuacaaccauccauaaugagaucucuucugaugugucugaagacagcaacaguguacuuagauauaauaauaaaucuuugggccgagcaagcagggccagagugagcugaaguccugaauucaauucccagcaaccacaugauggcucacaaccauuuguacagcuacaguguacucauauacauaagauaaaugaauaaaucuuaaaaaaagucaaugacucgaaucccaaaaugguaucuuacuaaaaugguagccacauuaguauggaguuuccaaguuggcauaagaacuagaauagaaaugguaaaaccaaauccaccuagaucuuaccagaaauggcuccggaacaugacucccuaugguugaaguggaccuuaauaagcauucacaguccugacuaugaaauaaacacgugaccccugcuuuaucaauauacaaauucaagccccucuggagaacgggaaaggucuaaacccacuuacguuucauucugagaacagcgacgguuggugcauaugccacacuugcccaagauaucuguaaguucugaguagaguucugaugcgaguagcuuugggauuccgucccacaacaugauggcaauuaccaucaccgccgucucacaugugugauuaggucgcacucguaccaaacacaguaguuucuccuccucacucgaucuccgauauaccuguguggaucaacaauccacccaaacagccccacccacccaaacagaacaagggucaaucggagccaauacgggcauaugcauagcuuucauaucuggaucaaaauuaccaacugcaauuccucuuuuauugcccagcuauagagugggaaccuaaccaacugugaaaaaaagaagaaagaaagaagaaaaaagaaaaagagagagagaaauaaagaaagaaagaaagaaagaaagaaagaaagaaaggaagaaaggaaggaaagaaggaaggaaggaaggaaggaaggaaaagaaagaaaggaaaaagaagaaagaagagagagagagagagagagagagagagagagagagagagagagagagaggaaggaaggaaagaaggaaggguacaaaauuacucaucaaugguuuagcagaccauaccugguacaguggacaguuaaauguaaccuccuauaguaagaacuacaggaaagacaugcaaggucuuagcugaaggcuuucuuuaagcggcuuaaguggcacuacaaauacuaaccuguuguuuaagauuaaaaacuguuucuucgcagucuaaggacuauucuuuagacagugguuugaccuuccucuagcugugccucuuuaauacaguucauugcuccuucauagcuguaauccugcuacuguuaugaauaauaaugcaaauauccaugucuuucaaucaucucgggugaccccugcgaaaaagucauuacuuuuacacaaggggucacaacccacaguugagaaccacugcuuuugaccucaaaauuauuucaguuuaaugguuucuucaugauuucagaacccuucugccuuuagaacacaaggguacacauaguauauauaugcuucuucaaacugucaaugcucuuuggcaagaauugggcaaaccaguuacuaagguuagagaaaugaggagaaaugauugagcccgaagaccaagaucacacacaaggcaaacuuacccauuuagcaauaggacaucccugagagcucuugccuucuuuaccaguauauaugacuuuuucaauccuaauagcuuuacccuucucuccauaccuuaaagaaacacauacuauuauuagaugacuucaagaagcaaucaagccauuuggacauuuaagugguuuuuuuuuccccuucaaccacauauaaauaaaggguuuaauuuacuuaaaaaaaaauuguugggagcuggagagauggcucagugguuaagagcacugacugcucuuccugagguccugaguucaauucccagcaaccacaugguggcucacaaccaucuguaaugggaucugaugcccucuucuagugugucugaagacagcuacaguguagucauauacauuaaaaaaauaaaaucuuaaaaaaaaaaauauuguuuuucccugggcauguccagacccugacggaagcagcuacauucccauuccggacagggcugucuuugugucacugagccauacuagcuagcuacagccuguggagaauugucaccaacagcuccccagcugccucauguuaauucaaucagcaagaagccuguacaccugacgacaguucagacucugaggcgaacgauuaaaguuuaaaaggucgcaugccauuguaauaccgaaaagaaaccucaugauucaucauuccugaugccaucucaucuguuuaauaaagcuguauuucacucacagcucauauuuaaugggccaauuuaaaaaaaaaaauggucuaagccaagaguaauacacaauagucuuaagucuuuucuucagcauccaaguacaucagaaaugaccauggauuuuucuguaauuauaugguggaugaaaaguauugggaaagauauuuccauauacaaaguauaaaaugaguuugcuaaauucaauucuugaaacaauuugauuuucauccuuuacuaaauuuaucuuacagccuggauaauuguaaguuuuuagaaagcuugugugugggaauuuguuuuuuguuuguuguuguuguuuuugcuuucucuguguagcucuggcuguccugcaacucacucuguagaccaggcuggccuccaucucagaaauccgccugccucugccucgcaaaagcuuguguuucuaaagacaucuggccaaaagcuaguauccagcuaucuuggaaaaguuagaacugcagaaacagauuguauucuuggugugccaaagugcuguauaguguucacaaaagaaaacuggguagcucuggcaggguaccauggcugggggugagcuauguggugaauuucuacauaauaacuuuguaaagcacaugauuugaaaauaaagccaagaauauuguauacugccccuacaaugcaaauauauuuuaaaagcaacucugcuaauggcccagaucccuucguucagaccucaguccauaagaaaagcugauucaacauacagaaaugaaacauaaauaccccggacugacaguuuucaaggcuuucagaagaaagugaagucucucagucaguaagagaaacaacucauucgcaaagcuaacucagugguguuccagucauuucuucuuggacacaccaucaaguaaguaggagagagccaagugaggucacacuuuguaaccugugccagcacucucaugcagguugauuuguuugugccuggguuuucuagcauccaugugccagcggagugacuauuuguccugucaaauauugugacuguagugaauacugcaguguauuggguuggcaacccuggaauagcuaauccuacugauaauuacuugauuuacacuuguuuacugugcugugugggagacuggaaaaacugcuguauacagaggguaaacauuaagcugcccugugccuuugaguuaauuaccuuucuuccaugaguguucuaauagcugccacaucaggaccagcuccuagauggguauaauaaggagcuucaucuuugucuguugagauaauagaagauuauuuuagacuucaauuauaccaaauauuaaggcuacauccacacagauuauucuccagcuguauauuaauggcccuaaguaacuuuaauuuuuucuuuaaauuaaaguacauugaugguuuguucuauuagaaaaugugcaaagccaaguaauacauacuauuggaaauacauacuauauuucaagauauaggaccaaacaauaaagaaauuaaaauauauuauauguaagcaggaaaaaaaagcuuuuuuugguuggguuuuuaaugaguucuguuuccuuaggggauauggggcuguauagauauuuugccagaucuugauuuaacuuuguggaaucugucuagaauaucauccauuucaucuauaucuuccaguuuuguugcauagacagguuguucaauagaauagaauugaagauccagaaauaaaacuacacacuuauggacacuugaucuuggacaaagaagccaaaaccauccaguggaaaaaagacaacauuuucaauugaugguggucaauauguaaaaaaugaaaagauucauauuugucaccuuguaaaaagcucaaguccaaguggaucaaggucuucaacauaaaaccagauacacuguaucuaauagaagagaaaaugggaaagaaccuugaacucgugggcaugggguugggggugggggugauuuccuauacagaacuccaauggcucaggcucuaagaucaaaaauugauaaaugggaacucaucaaacugaaaaucuucuguaagacaaaggacauaaucagucaauaggacaaaucagcaaccuauagauggggaaaaauuuuucacuaaccccacaucuguuagagggcuaauauccuaaauauauaaaagaagcuaaccuucaaaaaaaaacaaaacccaaacaaccuaauaaaaaauaugggguauagaacuaaacugagaauuuacgacagagaaacacuuaaagaaguggucaaaguccuuggucaucaggaacucuaaaucaaaaugauccauuccaccgaacaccaaucaccuuaggugacugcauaugguggugaggauguggagaaagaggaacaucccuccauugccagugggauugugaacugguacaaccacgcuggaaaucaaucuggcaguuccucagaaaaacuggaaguagaucuaccugaacacccagcuauaccacuccuaggcauauacccaaaagaugccccaccuugccacaagaccacauacucaacuauacucauagcugccuuauuugugauagccagaagcuggaaacaacugagaugccccacaauagaagaauggauacagaaaaugugauuaauuuuacacaauagaaugcuauauucagcuaucaaugaggacaucaugaguuuugcaggcaaacagauggaacaagaaaauaucauucuugagguaucucagacccaaaagguucacaaaccaaagggaccaagugaggcugccucaaucaaucucacuugggagauagaagaaaaguagagagcuguggggagggaacuggguaagaggauagggggaggggcagaguaaaggggaagaugaucagguauuagagggagggggcauaagugaagcuccaaguuccagcagaugugggagguaggggaaucucaagacucaaagaccuuagaugaaaugcccaacagugggagaggaaacuugaagaaucuaccuucaguagaaagucagagcagcaaguggagggaugggguugccaucccugucaaaaaacucugacacagaauuguuccugucucaaaggacugcagagacaggaauggagaagaaccugagguaaaggagauccaaugacaggcccaaauugugauccauaucaaugggaggcuccaagaccucccugaugcuauggagugcuuacagacaggaaccuugccuggcugccuucugaggccuugaaugacuugauuccucagggggguggggaggccuggugguguguggaguuagaugggaguguacuuuuguagggugaugacuggacuguaaaaagauuaaaagauuaaaaaaaaaaaaagaaaaauggaucccagacuccagcuuaagaaagaagcaacacacaugaagaugacuagcuaacucuggcaaacaccauguauguuacuggcauguaccuggauugcauccuucacauuugccauucugacuuuguucaccaggaguaucugauucugaaacaucgucgagaacagaacaaucugugcuuuugguugcuugaggcucugcagcucgggcgugguucuccgauucugcagccuggauaucuguuggcacuuucacguguuucugugacuugagagucagagccuuauagucacagagugacuugagcugaaacugcuucaggugcuguuccauggucucaaugaugcucuuuggcugcccauugucacggcuuggagaggagaucucuugcuuuauccugcuggacauauuuucuuguggcggugacaagggguaucuauaggaagaagguuuggauacaggcucagucuugauuggccuaagcaucugguuaugaccaggcugggauugcuguguuugcugcuguucuugcuucuguaagagaagccaccuuaaggcagcgugcuucugaguguccuucugaggaggggucugugucugacuuccuccuugcucaggcacagggagugccuuugcuucauuaugcaccaaauaccucuguugagcugccucagcugguggggcuggagacucacccuggcuucuguccuuaagccccuguagagacgaagcuugcugaggcuucugcgcuuguuccugaaagcaccggugaacguccugauuuggggucacauuauucgggaaauacugcauguucugcagguuugaggucuuacuuccuacgggauguagagcuuguucccgcucacaagccgggugugugucauuugaagggagaaucuguaaguugcucgaauuugguguuaagaucuucgaauaaggaaaauuuuuauuuauauuuuguacuugcuccaaccccccuuggguauuauugugaguuuggaaauuacuugauuuggaguacugauuuccgacacaaaagcuuucuuccacuuuaaucuggccaaagcacgagccuucucuuugcuuaucauugcuaccuuggagaugagagaaagucugaggcauuugcucuuuauucuuccucuguaacugcugcugcugcugcugcuggcagauuugagggaaauuugaguucugggaugcugguguuugugaugccugcgucugaggaguauguuguaaaaagccugauaaccguugagucucuguggccuguugacucaaaugcuuaucacuggagggauuuacucuuugcuggaaaugauacugaggaacgcucggugcuugcgggugagccucagaugacggaucuguccuggggaugcacuccugguauaaagcuuucuggaacugaagauguuggucccccauaccuggagacgguccuugguucacuugcacuugguacauuugugccuucugcucuggcugggcuguuuucuggagguaagguagccuuuggaauccuccuggcauguugacauugccaguggacuguuuggagcucaucugauugacagggccggucugagaguggaggacugagugcaaggauauauccuugcguuuugucugauggagugcuucaugcaaauucggggcuuucaguucuauccagccaggugcugccuguacagagccuugcguuuguuucccguuugcauccuucggaaucucuugcucccugugccccaucagguauuggcuauguucuuguaaaccuccacuguggccaugauuuggcagguaauacaugagauauucugacauuuuucuugacuuuucagggcucggugagccacaaucauucugaugcuguucuggaagcaucaaggggggguuggguguauguacagauggauucagacucuggcuagaugaugucuuggguugauggucuauuuucccuucccuuaaaagaguucgguugcuucgguugggguagucaugguguucuuccaaagcuacaucauuuagagcgccuuuuccuucuaaaggaggcugaagaacaagacggggagcaagaagugauugugacgguggggucacaguagugggagagauggaaucuuuagggaacuucgagcuuugccugaaguaagcaccauugguuuccuuuugcuuugaauacuguucagagcugccaugcgaagcuugcaaauuccggucggaacuaggauaguauucuucagcaaauagcuccaugcuuccuuggaugguuuuguuuucugcacgagaugggccuauguccaaagcugacuuuuguugguguucugcuuucugaaaaggacagguaccugguacuauagcugguuuacuggcauuaucagcaucacaggccuuagucaccauugcagcuggcucuggaggcagcugcaagcuugaggucugggagaaauugaucugcgcugagguaagcgaugguugagggaucucgugggacaacucgauagcagccugacugcuagggguguuuacaugagaugcgguacucugcacggcaauggagacacaaucuggauaacacuguguuuuuuccaggaguucaccacguguguucuccucagaaugggcagaaacuguagcaccauuaggcauuagcacaaucuuguuuuuaaguaauguaacgcuccugccuuuuuccccuuccugcucguugagaaccugaauuucaacuccauuguaguuccguguugggaaagcaucugcaccugaacuuuccuggguggucgaggucacgggcucuccauuaucacuuaguccggagacauuuggcugacggcugcuuuuaccgugguuucuuucuuggcuuuccucgaagauauugcuuucucccuuagcuuuuuggucuaguuucaauaucuuguuuggauggagcccagagagagaugguucacugacugugcguuuuaucccuccauucuguaagcaccuggaauacccucugucuucauguggacucucaugacugcucuggcugccuuucaugugggauauuccauaacagcuuugggaagauugccacuuggugucuccauuuacuucuggaugaggucucucugcuaacgggcuuccauucuggaguuugacagccagagguucuguauggcugaugggagaagguggugcuaucaggaauggacucagucuggugcccucagcaugggugguucuguccuguuccaucaggcuugcuucggggccauccacaaggcugcccuuugaaugaauccuaaagacacagaaaaaaguaaagacacagcauuacaguuacaccaauaccuagaucuagcaagcagaugcugauuuucaucuuuagcuacucuugucuucccugcauggagcaaaggaacaaugggaugaaucccagauguuuauaccuccccaguaacucauaucagagaaaaauccuuuucuuuagcccuugcugagcuaucaugcugcuuccugugugauccuggaaucaucuccauuauugcuggaucggcucucuuaucucauaauccccagaacagcuucugaaacuggacccucaaguucuucaaggcuaccuccaauuuguuaucuaucagaagaucagaaacaauguucuagagucuaauucugguaucuuuuccucuuuaccauacuugauuggcucuggcaggccuguagcaauucuuuaacaaauucuuuaacagggacucucgguucaugucagugcugccaguggauacuguguggugauggggugaaagguacggcuuaagaaaacccagaaaccccugaacuagggaugugacagugugaggugaauccugcagcgugcaggaaacucuccucagguucagcauucaguuugaaacaaauacacacaccuccgaccaucuucaagggugccacuucuaggugauuucuccacagaugcaggugaaaugauucaacacguaaggacacgugucacaaaugcugaugaguugaguuugauuccccccaguauccacaugagaagggugaacuccuacaaauuguccccugagcccuacaugccugucauggcacccauguauguauguauguauguauguauguauguauguauguauauauguauguauacacacacacacacagaggacaaguaaauguaauuuuaaaccaugcaaaaccuaucaauuggucucagaugcaaauaugcaucuacccuauuuuucaguuuauagucuagcaaugacauccauguugaggggcuaauccaguucacuugcccaaauguacacucucucacacacacacacacacacacacacacacacacacacacauacacacacacacacgcacguacacaccuacagaauaaaaacaaauguuuagaucguaauacuucucuacucaucuaguuauguuuuugucccaccauuucuuuaaagguauucacaguagggaagggcacuauuggucuggacuaaaaugguguuauguuagauuaauauuuaccuacuuuagaccagacaaaugaagcagaggaguaauagagaaaugcugaauagcaacacugagguuauuacauuuaccaggacauggauuuuuacacuuugaauuccaacauaggcaggaggaucugaguucuaugacagcuuggucuauacugaguuccaggccaucuagagcuuuacagugagacccugccucaauaguaagacuguguacaugugucaaugaagagaaccaagugaaaugcugucaugguuuaaagauugaguaaaguauaaaaaaaaaaacccacaaaaguaaguauagcuucaaaaucuaaaaucagucagacguuuugacaauuauauugcaguuauaacaggauaaacuccaaaguugacaauuauauugcaguuauaacaggauaaacuccaaaguucuaugugcaguaaaaugcuguaggcaagagggguggagggcuuaggugauauucugagaaggagagcaguggccugugggguccccaggugucccucuagugcucaccuggauccugucugcuaacauucaggauggcuaaauggagcucuauggcuaucgcaacaauuuacaugucuuauuuauugaugaacuuacaugguuccuaaacugcugaaaggaauccaguugaaauaucagacacaggcuucauuuacuaucuacuuagaagugaauugaugagauuagacacuuugguaccaucauuuauuuauuauaccuauguuuguuuacuacaugaagaaaguugucaugauuacuaaggauuguuaucauuagaaucacuacuauuuugagguagggucucucuggaacccaugauggcagucacaccuaacuuggaaagcauuguuuauaagagggguuagccaaugucacuuaugaggauauuggccaaugaaaauuaggauaccacuuuucaaaauugguuacacacacacacacacacacacacacacacacacacacagagggaaguauaagccaaaggucccuugagaaaccuggaaaguaugacuaguuaagcuucccauggaugcuucagaucucacauaguaacagcuacacuuaaaacaacucauuuuaaacauauuucacuuaagacucauggcuaacuguaagcugcugaaguucaucaugaauuuuuguuaggaauuaauaccuaggguuacuuaaaucaagcccaaacucccugagccccacauauauuugaugguagccauucuggcugucagaauugugcugaaaaagagcucagaaucacagaaugacauuuuaccuuuuaaagacugcaaaggcuuuaaaauggcauucaaaugagaugguaugugaucauaacuguccuaaagauguauggaacauuucagagaagcaggaaggaccacauuguucucccacuguacauacgugaauacugagaaacuggauccuacuggggacaaugcagcucucugaagcccuuccccucacagaauacaaaggaaaucacaguuuagggagauuuuuacuuuaagugcauauuuuguucuuauuugagucuaucugcagucuuaucaaugcucugaaaggcaguuugcuacauaucuaugaaccuuaguuauuaacaggauuaagaacauuugcuuaucuuuaaacagggccuaacuuccucauguggccugaaauaaaugaaauauacagcacuuagaauaugaaaugugaaguuccugugaccauuuauugaacugaagaucccuauggccacauugugauugcuagcaucacaggugugacccacuguagcggcugcugcucacuccccuaaaauauaaacaaauacaggguuggguucaaaaguuugaauaaauuauuauucacgggcuggagagguggcuuagcaguuaagagcacuggcuguucuuccaggacugggguuuaauuccuagcaaccaaaagggaggucagaacuguuagguauuuaacucauuuacauuuccaaugcuaucccaaaagucccccauacucucgccccaacuccccuacccacccacucccacuuuuuggcccuggcguuccccuguacugggguauauaaaguuugcaaguccaaugggccucucuuuccagucauggccgacuaggccaucuuuugauacauaugcagcuagagucaagagcuccgggguacugguuaguuuauaauguuguuccaccuauaggguugcagaucccuuuaguuccuuggguaauuucucuagcuccuccauuggggguccugugauccauccaauagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuuggcucuguaacuccuuccauggguguuuuguucccaaaucuaaggaggggcauaguguccacacuucagucuucauucuucuugaguuucauguguuuaacaaauuauaucuuauaucuuggguauccuagguuuggggcuaauauccacuuaucagugaauacauauugugugaguuucuuugugaauguguuaccucacucaggaugaugcccuccagguccauccauuuggcuaggaacuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuugcagaacuguuucuaagucaaguuccagacagauguguaggucaaacaccaaugcacauuuaaaaaaauauauacauucacucucacagacauaauuuagaacccacuguccauauuuuaauauuuaccuguuuauucaaguagccuaauauuccucacaaugacuggcugucuggugguuccucagaaaauugggcauaguacuaccggaggaucccgcaauaccucuccugggcauauaucccagaagaugucccaacugguaagaaggacacaugcuccacuauguucauagcagccuuauuuauaauagccagaagcuggaaagaacccagaugccccucaacagaggaauggauacagaaaaugugguacauuuacacaauggaguacuacucagcuauuaaaaaaaugaauuuaugaaauuccuaggcaaauggacggaccuagagggcaucauccugagugagguaacccaaucacaaaggaacucacacaauauguacucacugauaaguggauauuagcccagaaacuuaggauacacaagauauaagauacaauuugcuaaacgcaugaaacugaagaagaaagaccaaaguguggacacuuugccccuuccuagaaaugggaacaaaacacccauggaaggaguuacagagacaaaauuuggagcugugacaaaaggauggaacaucuagugauugccauauccagggauccaucccauaaucagcuuccaaacgcugacaccauugcauacacuagcaagauuuugcuguaaggacccagauauagcugucucuugugagacuaugccggggccuagcaaacacagaaguggaugcucacagucagcuaauggauggaucacacagcccccaauggaggagcuagagaaauuacccaaggagcuaaagggaacuacaacccuauauguggaacaacaauaugaacuaaccaguaccccggagcucuugucucuagcuacauauguaucaaaagauggccuagucagccaucacuggaaagagaggcccuuuggacuugcaaacuuuauaugccccaguacaggggaacgccagggccaaaaagggggaguggguggguaagggauuggggguggguggguaugggggacuuuugggauagcuuuggaaauguaaaugaggaaaauaccuaauuaaaaaauuaauuaauuaauuaauuaauuuuuaaaaaaaaagaauuuauuuguaaugucauucaggcuucaucggaauuucaacggccuguaaucaccucuucuuuuuucuaauuaguguagauggguagauuuggaaggagaauguugauucauuucuuucagaaacaugggucuaccccagcagcauuuuaagaaguugucuguuucuggaguagaaaguagaagcaucacucauauuguguacuucuugucuucaaucagagauuaaaaaugaggcauuaaaaaaaacaaaaaccuaaggauaauagguauagaaaagaucaaagauucccacuuuaaagggccaguaaaugcauucauuauagaagaagaagaaaacuucccuaaagaaagagaugcccagccgggcagugguggugcacgccuuuaaucccagcacucgggaggcagaggcaggcggauuucugaguucgaggccagccuggucuacagaguaaguuacaggacagccagggcuacacagagaaaucuuaucuugaaaaccaaauaccaaaaaagaaaaaauaaaaaaggaaaaaaaaaaagaaagaaagaaagagaugcccaucaacauacaagaagccuacagaauuccaaauagacuggaccaaaaagaaauuccuccugacacauaacaacaaauucacuaaacaaagaauauuaaaagcaauaagggaaaaaggucaaguaauauaaaggcagacccaccagaauuacacaccagagacuaagaaagcuagaagauccugggcagaugucauacagacccccuaagagaacacaaaugccagcccaggcuacucucaauuaccauagauggagaaaacaagauauuccaugucaaaaccaaauguagacaauauuuuuccacaacggauaauagauggaaaacaacaacacaaggagggaaacuacacccuagaaaaagaaaguaauuuuucaaaaaacccaaaagauagccacacaaacauaauuccaccucuaagaaaaauaacaggaaguaacaaucacuuuuccuuacuaucucuuaauaucaauggacaaucacuuuuccuuaauaucucuuaacaucaauggacuuaacuccccaauaaaaagacguagacuaaaagacuggauauguaaucaggacccagcauauugcugcauacaagaaauacaccucaguggcaaagacagacacuuccucaguaaaagguuggaaaacaauuuuccaagcaaaucgucccaagaaacaagcuggaguagccauucuaauauggaacaaagucgacucaauagaaacagauguauaaaagaguuggggucauagacagaugcacuuggcacuuaaaaugagcagaaugcauagaaacaaacacuuaucuaggacuaauuggcuacucugggucuuuuguuguuucauaucuaauugaggauuuucuuucuauuuacgugaagaaugagaugaggaugcugauugugauuuuauugaaucaguaaauuguuuugguaggaaggucuuuuuucacaauguuaauucuaccaagguauacacuugggaggucuucaaauucuuguauguuucuuaaucccuuucuucacacauuuaaaguuuucauuguagaaguuuaccucuuuuguuauguauauucuaaauauuuuauuuuauuugagaaaauaaaauauuuagaauauuuuagguccaugaucucuuucucagcaugcuucuuacucauguauuaagacugguaaauuuuguaagccaauuauguaucauaacacuuugcugaaauuauugauaauuucuaauuuuucuagucaaauuagaaauaaaagaacauaagaauauaaucuucaauugaaaauaauuugaggggcuggugagauggcucaguggguaagagcaccagacugcucuuccgaaggucaggaguucaaaucccagcaaccacaugguggcucgcaaccauccguaacgagaucugacucccucuucuggagugucugaagacagcuacaguguacuuacauauaauaaauaaauaaaucuuuaaaaaaaaaaaagauaaaucuuaaaaaaaaaaaaaaaaagaaaauaauuugacuuaauauuuucccauuuguaucccuucucuugccuuauugcuccaacuaauguuucaaucacauuaugaugggaguauggagagugggcaguccucucccacugcugauuuuaauggggcuuauuaaugguuuuauucauuuaggaugauauuggcuauggguuugucauaauaaccuuuauuauauuggaauauguuuucuacagaccuacuugguucuacggcuuuuauuaagaaggcauguugaaucuuagcaaagguuuuuacuuuucuuuucuuuuuugcuuacauugagaugaucauaugauucuuguauuuuuuugucaauguauuugguucauuaauuuauuucuuauauguuaaaaaauaaaaucaaagaaaaaaaaguaucuucguugaaaauacaucucuugauugauagugggcauuuaacaaggaaggguuucugcagucacaguucuccuaugaguuuaauuuuguacuuucucuugccugugacaauaauuaugaauucaagucacaucaacagcaucugugaaacaauuacugcacggagggcugagucugcagucuaauccaucauaauuaugacaguccucuuucaagacgcuaugaugcaugacuuaaaaauagcgcguuagcgugcaaauggaucagcaucucauuucaccaaugugcguuuagugcuguaaugcagcccagcaccguuugacuuucucugaaucacucagaugauacccauaucagucaccauagaaaacugcagauggugcucaaaauuuggagggcuuuuuguuuuuguuuuuuggauuacuggucuuguacaaugguauguauuuuccagcucuaaauguaaaaauacacuuacacaagaaguacaauaaggcaguaauuuuuacuauaaauacuuucucuauauacuaauaauacacacacacacacacacacacacacacacacacacacacacacacagagagagagagagagagagucagugaaucauguuugugugugaauuuauccagaauaauggaggcaaauaauuauaguuacuuaugggcaggaaauguaucuacuuuaaaguccaugucccagaaucaaauuuuuuugggggggucauuguuugucacccuguuauuuccagugacaagcuuuauucuuuuugguaaacucauuuauuuuugauuuugagacagacuuucucuguguaguccuggcugccuuggaacuuacuuugcagaccaggcuggccuugaacucagaaauccauccuugccagugcugggauuaaaaccaugcaggaccacugccuggcuggcuaggaaugaucucuuggcauggagaaaagcuuagaaaccauacauagcaaucaauaaucuccagaacaauguuuuauucuuauuaccaaacuggaacauuauuuauaucuaccauacauuuauuucaagauuaugugcagugacccauuguaaugguaaauuuccauuaccucagauccaaagcucaaggacacacuguauuacccaguaaguccccaucucaaaguguacaggacaguggacaugauuaugcacuggagugcccuugaaaacaagcuucuugugaccaaaaugccacuuuuguguucuuauguucuaaaucuaccaaaucccuccauuuaguuuucuugcucucuuuuuagaagauacguauuuauuuguccaucauccaucccuccaucccucuauccauucauccauccauccaucuaggaugucagggcuccuauuugacuacuuccuaccuccuucccuugaagcagggucucacuuauauuguauuugaguuaguggccagcaagcuccaggaaucuuccugucuccacucccucagcacugggauaauaggcaucuauguaaacauaggugcccagaggcuagcagaggguaucaguguuguaagcuauuggauaugaugaauguugggaaccaaauucuguugagcaugucuagccugagccaucucaccagcccuaguucaguuucuuaguugauuugucuguaugguccuacuuuuuuaguaagaaaaauauaugggaaucaacagcuaccuauauucccagacuggucuuaaacucuguucagcagaggaugaccuccggccuugaccuccaagauuacaggaagcugacuuuacuaucuccuuccuuguaagaacuuucuauaguggagcauugggaauguacuuucaucucuugaaaaaggaccugugggaauagagaaauggcuuaauaguuaagagcaauuguugcucuuccaaguucacuucccagcacccacauggcucacaaucuucucuaacucuagucccaggggaucagaugcccucuucugucuacuacaggcaccaggcaugcaagugguaaggacauauauacauauaaaggcagacagacaaccacaaaauaaaaaaaaauuuaaauuaaaaaaagaagacagaugguaggggcauauauucaaucuuagcacuggggaaaaaacagaaguaggcagaucugugaguuugaggccagcacuucugucuaaaguucuagaacugccagggcuacacagaaaaccacugucucaaacaaacacccaccccccaacccaaaacaaaacaaaaagaaaaaaggggaaaagaccuguauaucaacauccuuagaagucccuagccuuuccauagaaauacugauaagauaguacucauacacacacaaacacacacacacacacacacacacacacacacacacacacacacacacaucuauccuuucuaggguagccuucccuccaugcuuggagggaaggcucugucugucaggcuuuuuagaaauccucauuaggaccauuuaauuacugucuuugaaaauuaaaaauuuuaucuuaagaguugggauuaucuuaaagaggcaaauagagauggggguggggguugggggaugggaaccucuaauuccuaaguaagacugccacugacaguuaaguaaauguguuugcaguuuguaacuaacucagucucccaaguaggagcaugccuugugucaauccucacuuacccaugcaccaguuaauucuaggacuguuucuuacaauggguuuguuugacuuucugcuagcuggaauuugucacaaguacauugguaaaccauaaacuuaaagcuaaaccuguuuauuuuucacuccacuccucuagaaucuaccaccacuugguugucuuugguaucuucaagcauugcccaaaauuuucaauucaauucaauucaauucaauucaauuuaauuaaaaaaaaaaaagauaaaucuuuccagugugagccagugccuugagcagaccuugggugcuggcagucccacaacaccagaggaagcaugacucccagaugcucuauuaugcccaggaucccaggugagguggccacaacaucugcuggggauguaacuggccccccaggauccaggaaagcaggaacucccucccacagccagaggcauagguuccuucuggucugaaucugcaccuggagcagaccuggggugcuggcucugcacucacucuuaaaaccccccaugcucauggauuggcaggauuaacauaggaaaaauggccauccuccugaaagcaauuuacagauucaauggacuccccaucaaaauuccaacucaauucuucacagaguuagaaaguacaauucucaaauucauuuggaauaacaaaaauccaggauagcaaaacuauucucaacaauaaaagaauuucuggggaaaucaccaucuaggggccucaagcuguacuacagagcaauuaugauuaaaaauaaauaaauaaauaaccuguaugguacugguacagacacagucaagauuaauggaauagaauugaagacccccacaccuauggucaugaucuuugacagaggagcuaaaauccaguggaaaaaagacaacauuuucaacaaauggugcuggcucaacuggcauguagaagaauguaaaucaauccauuccuaucucuuuauauaaagcugaaguccaaguaaaucaaggaccuccacauaaaaccagauacccugaaacuaauagaaaagaaaggaaggaagagccucaaacacaugugcacaggagaaacuuuccugaacagaaagaacaccaauggcuuauuuaugcucuaagaucaagaauugaaaaugcggccugauugcaaaagcuucuguaaggcacaggacacuguaguaagaaaaccgcaaccaggauacugggaaagaucuuuaccaacccuacaucugauagagggcucauacccaauauauacaaagaaguuagacuccaaagaaccaaauaacccuauuaaaaauugguuacagagcuaaacaaaauucucaacugaggaauauugaauggcugagaaacaccuaaagaaauguucagcauccuuauucaucagggaaacacaaaucaaaacaaccccgagauuccaccucacacuagucagaauggcuaagaucaaaaacucaugugacagcagauacugucgaggauguggagaaagaggaacacuccuccaaugcuggugagauugcaagcugguacaacucuggaaaucagacuggcgguuccucagaaaauuggacauaguacuaccugaggacccagcuaaacuacuccugggcauauacccagaagaugcuccaacacauaacaaggacacaugcuucacuauguucauagcagccuuauuuauaauagccagaagcuagaaagaacccagauguccuucaacagaggaauggauacacacuggauacagaaaaugugguacauuggaguacauaauggagcacuacucagcuauuaaaaacaaugacuucaugaaagucuuaggcaaauugauggaagaucaguaagagaugucaauaaauucauugccuaucaugggcuaucuguuuaagacaguuuacuaugugccaguccuaaggcagccaggaaaacauuccacagaggcacagggagaagaaugaggucuucaaggucagacuagacaaagugagacuguuaaucuauucagagaaccgaguaaaagaaacccucuaagaagcauaggaaaaaacaauacuaagacauguuuuaaagguaccauggauaaucacauaaccaguaacaaguucccuuuacacuuuaagacaacucuuuaacuugaaaacucuaacauuuuaguauuacuaugugguaccuuuagauaguaucaaaauacagacagaaagacuaauacuuuguuauuaauaaaacuuuggucuagaagcaggagauggcucagugguuagcacuugcugcucuuccaggacccagguuagguuccuagcucucauaccagauugcuuacaaccauguauaauuccagcuccagagaaccuaaucucuuuuccuuccaaguucuccuucaugcuaauguauauauacauauacucaggcacacacacacauaaaacuuucuaucuguggagucucgagauauaaagaucucagccggguggugguggcacaacgcauuuaaucccagcacuugggagguagaggcaggcagaucucugaguucgaggccagccuggacuacagagugaauuccaggacagccagggcuacacagagaaauucugucucaaaaagaaaaaaaaaaaaaagaaaaaaaagaauuuuuaguuauagggauacauaagacaugcacaaguaugacuacucaagaguaaaaaaaacaccacuccaucuugauauuuuuaaauuagcaauuuggggccuggagcaaugguucagugguuaagaacaccgguuguucuucccaaggacccagauuugauucccagaacccacaugguagcucacaacugucuaauuucugucccuacuucuagguucuaagagcaccacacacauuuggugcagagauauacauucaggaaaaacauucauacacauaauaaaauagauauacgggcaauauuuuggauuuuaaaugcaauaguuaauuggugguguaauuauuuucuggggauucacuaaaauacagauaaguggauauuagccccaaagcuuggaauacccaagauacaauucgcagaccacaugaaacucaagaaggaagaucaaaguguggaugcuuuaguccuucuuaaaaggggaaacaaaauacucaugggaauaaauagggagacaaaguguggagcagagacugaaggaaugaucagccagagacugccccaccuggggaucugaaaggagaaccccaccuuguuuuuaaugggugagcauuggaauagcuacgaaaaagggauauaugaagugaguacaugcagaugaaauggaucaugggucagucuauggaugaguacauagcuguacucuccaggaaaaagugggauuggccagugagugcaaucccugggcaaacagacaugaaugaaacaaagaugugucagcaaacaguaccacugacagucagacaaugaauuguucacuaagacugucuggcagcagauucccuuaagaacaauucauuucccucaauccaggccagaagagggcacuugagccucuggaucaggacuuacagagggccauagccaucacgcauacuaggaaguagacagugaaugcucugauguaccucacagguacagguggagcaucaucuauagaacaugcaacaaaucuaacauuccacagaauagcauauaucaaaacccaaacuuagaugaaugcguuauguaguuuuaauuaagcagggggugggagguggggagggguauuaaaacaguuucacuauguagcuaugcuugcccuggaauuuacuaucuagacuagauacugucuauacuaguuugccuugggccugcugggauuaaaaguugacuucacuguagcuuaggauggucuggaauucacuauagccuugaacugguaagaauucuggcuuagcuucuccaguaccgugaauauacggaggccaccacgcauguuuuaaauacauuauuccugaggugcugagaagcuauggaugaggggaaugaauauaaauuaucacauuaaacuuagcuggggauguaccuauguaaauuaucacauuaaacuuagcuggggauguaccuauguaagcaaccucaaacaaacaaacaaacaaaaauuuuuuuacccauaaguaacuuuugaaauaguaauuguguugagauuauguacaaagagcaggcuuagggaagucugccacacuggaaauuaacuuuuaacauaauuuuggcuuuuguuguuucuguugagacuguuucuuuguguagcccuugcuguccuagaugaugcuuuguagacuaggcuguccuagaacucagguccuccugccuuuucaugugccaccauacucagcuucaguuuguuuuguuuugguuuuuguuguuguuguuguuuuguuuugacauuagcauagcagguauuuuguuaaaugccuguguuuuaacuuuaaagauaaaugagaauuuaucacuaacuuuguauagcucggguccaccugccuaggaaugguacugcccagagugggcuaguccuucauaucaauuaacaagucagaaaaaaugucccaaacaugccuacaggccaaucuuugaguucucucucccuggauaaaucuaccuuguuucuaucagagugauaaaaaacaaaacaaaacaaaacaugguuuucuaacuuaagguaacugccacacaacaacugcuugucuuauaaauauuuaaaaguaccaccuagauaauuaauuuugaaguaguaaaaaaaauaaaaucacaaggcacugaauuuagaacuugggcugaauuucaguaauaaacaugggucaagcaucauuguuuuaaaaguucuuucauuauuuuucauaugaguauuuauuuuaugggcugcaaguagucagaagucuguagaaauacacugaaauugcauuucuaguucagugauacccauuugaagaaaauuagagaccauaaggccucaugacauacuuuauggacagcauccuuccaauccagcacuauccaaagcaugcuuaugauauacuugacacauagccucacugguucaacugacuuuuauugaguuguauguaaguacuguaaaacaguguagccuggacagcacacauaucagagcuuucuccuaaguacagcugucaaucauggucaauaaguaaugcaggacccaaacaaaaaugaagccaugaacauuuacaguaauugucaaguuuauuggcaagugcuauuauuaaagaauucaaauuggcaaguuacagauagggggaaaaaaaucuucacuaaccccacaaccuauagaaggguaauauccaaaauauauaaagaucucaagaagcuaaccuccaaaauaccaaacaacccaauccaaaaaaaaaaaaaaauggguauagaacuaaacaaaauuucacaacccaggaaucuuggauguuugagaaacaccuaaagaaauguucaaaguccuuagugaucagagaaacucagaugaaaaugacccugagaauccaccuuacaccaaucagaauggcuaagaucaaaaccucaggugacaacacauguugggagaggauguggagaaaaaggaacauuccuccauugcuggugggauugcaaacuggcucaaccacucuggaaauccaucuggaguuuccucaaaaaaauuggaaauagaucuaccugaagacccagcaauaccacucuugggaguauacccaaaagaugucccaccaugcuacaggggcacaugcuccacuauguucauaguggccuuguuugugauagccagaagcuugaaacaacccagaugucccacaauggaagaauggguacagaaaaugcaguucauuuacacaauggaauacuacucagcuauuaagaaugaggacauccugaggcaaauggauggaacuagaaaacaucauccugagugagguaacucagacccaaaaggacaugcaugguauguacucgcuaauaaguagauauuagccaaaaccaaaaaguacagaauacccaagauacaguccacagaacucaaaaaggucaacaagcugaaaugcccaagugaggacaccucaguccaccugggagggagaagaaagaaaucacaaugggggaggaaaggaaggagagagagagugacuugggagggaaaguagacaggaaacgggagugggggguaugauuugguauugggaggggggaaaggaccaaagaccugagggccagcagaaagaauggaaacaggcaacagagguuggggggggauagaccuuccagaauauaccagagaccugggaagugagagacucucaggacucaaagggaaggaccuuagaucaaauguccaacaguagggagagggaacuuauggagcccaccuccagcagaaagacaggucauugagugagggaugggguugccaucccagucaaaacucugacccauaauuguuccugucugaaagaacugcagggauggaaauggagaggagccagaggaaaagaagguccagcgacaggcccaaaguaggguccaacucaagggguggucccaaggccugacuguuacugaggcuauggagcacucacaaaaagggaccuagcaugacugcaacuaggaugcagacuggcagcagugguauagagagcaguguagaccugacuggccuagaacuucuauggucaaaacuaaccugcuuuagucuuccaagugccuugauuacaggaaaacaccacaccauuuaauucccauagcuucuauacccggguagaacaucuggugccaggggaagagcccaggccuaagacaguccccuauuagaugccaguugaaagccuuacuaugcuucugaccaauaggccacaauuuccuuggguuugacucauuucucagagagcucacaaaacucaagagcacuguauaaaccacaaggcauucuauaaaccaauuuuccauuaagaaacuguaagaaggaaagagagguauggaagaaaagagguguagaaagaagagagagagagagagagcuugaagcucccuuaccugcuuugggagaucacacacacuucagugucuuccacacacacuccgcuggggcaugcuggaggacacuguccuuuacgggcuccuauaaaacuugcaaguguaaucaaugcuaaugagcuggguggagaucagggaggugccuuaacauucugggccucucccaccucccucgggcuggguggccgucgucgucacacucaagaaaguccaguuucuccgaccuacccuagggacaauaaacucagccugcuauggggaguuacaagcuagacgcaaauuuaaaaacugacauaucucauaaugucacugaauguaagggaaaaggaaauuucaaccaaaacgagaacacaaauauauuacucaacaguagaacagcauguuuggaaauaauuugcuuggcauuauauaaaugaauuauauacuugcgugucacccugccaaaggaauuagcaugcagcauggcuguagguagaaaauaugcccucaagugcaagcacaugcaugcaaagauacgaagagacauccacccacgacacacauagacacacagauucagacacagugacacagagagacagacauauagacacaccugcauaggaaggcacacaagaaaaaaauuuuuauauauauacuuugaaagaagugaaugucaaaaagaaaaaucacagggaugggguugccaucccacagucaaaaacucugacgcagaauuguuccugucuaaaagaacugcaggaacaaaaauggagaagagacugagggagaggauguccagugacaggcccaaauugggacccaucucaaggggagacuccaaggccugacacuauugcugaugcuauggugugcuuacaaacaggauccuagcauggcugcccucugagaagcccaagaaggagcugaaugagucagauacagauauuuacacucaaccaauggucugaaguuggggaccccugugguugaguuagggaaaagcuggaagaagcuaaggaggagggcaaccccauaagaagaccagcaguuucaacuaacuugaaccccugagaucucucacucagccaccaaccaagcagcuggucugagguucccaacacaugcacagcagaggacuuccuggucugaccucagugagagaagaggcacauaacccucacuugguggggugggacuuggugugaggacauccucuuggagauggggcggguaggggaugaggaauagucagaggguggacugggagggggauaaagucuggacuguaaaaaaaaaaaagauaaaagaauuuuaaaaaaaugaagaaggaggauuuugaauuugagccuugggcucaaaagcagggaaggauggggaugaugacugacagacaacagacagacagaugggaauauuaaugaauaaaugacucauuugccccugugcugggauuacagguaugugccaccacacagcuagcuacccaguucccuuuuugucguugucauuguuguuguuguuguuguuuuccagacaggguuucucuguguagcccuggcuguccuggaacucacucuguagaccaugcuggccucaaacucagaaaucagccugccucugccucccaagugcugggauuaaaggcgugugccaccacugccugguuuacccaguucccuuuuaaaagaacauuauaguguccagugggcauggggggggggugcaugaauuuacucugggaggcagagguaggcaacucuguuaguucauaguaaguuccaggccagccaggguuucauaguaagacccuguguauauguguauguggggagggggaacauuuaggaagggcaaaaugaguaggcuagcucauuuuguaugucagcacuaaccaaauugguguaaguacacuccuguccccacuugagguucagagcuacaaacauggcugcauuuggacacaauuuagaaggccuggaucugcuuucccugguuguaauccuguuuugucucaaucaacuuuaauuuuuguuuuagacuaaauuggccuuauucuagguuaacaaagauauagagauuucuguuuccuuuucuaagaaacuuuauuuuaaaaaaaaaaaagccuuugaaauaaguaccugaaaauagugaugagcacggcacaucuuaaagugcauggaauauucuacuuaguuuuauucucagagaaaggagaaccaaaauaaaauuuaggcauuccaagucacaaaagcacaaaagagagcuaagggcacuguacucacccugauguuaucacuagacaguuaagggccagaagaucagcaauugaaaugcaucuucagauacgcagccccagccuagaucaaaagagauacuaccucaaaagaccacaacaaaagcaaacagccccauaaaaacccuaaaucugcaauggguagagcuggagaaggucaaguugauugagauaaccagagagacaacugucauguguucucucugccuaggccccaucuccaaaccugcagaugugaguacagaucauggagcaaguacagaaaccagggaaguaagaagggaccguugcugguauggaggggagugggggauaacaggguccauguggucuaaccagagaaaugagaaagaggcgcuuuaauuagggaggagaaagagagggacagggaagcugggacuaaagaaaugacucaaugguuaggagugcuuguugcucuugcagaggaucugugacucccagcaccuacaauauggcucacagcagccugcagcucaaguuauagagaaccuaacacccucucugcccucuguggacacugggcaugcuccagguacacauauguacaugcagaucaaacgcuuauacauaaaaaacugccaugaacauauuucugcagguuuuuauguagauaaaaaaaucuucaguucgcuuggguaaauauucaaaauaaauaucaaguugcuguguuuaaaucuaaacccucacuaagauuuaaggagaguauauucauuggucaaaaauuacaaaagccuuaaauacaaauaggacauucacacgggaucagaaauucuacaagaaaacuaugauuggccugaucucaacauuaaaaucuaagaugauacacaacaucuuccuauugauaaaaacaaucugguaggcuaauaucugaaacgacgagcaaacacuucuacagccugccuuggcacucuggcuuuauuuuagaauacaaaguguuuucaccaagacucucaucucugcuuaaaauaucccaugagaucaauagaggcaaaugauacucugcugggagaggaagcugaaauccaaggacagugaaaaugacuuucucagugggacucuauuucagucugcuccacuuguucuaaauguucuuguugcauguggaucuguaguaacgcaagacuccugcccagcugcuggugaauucugagauugccaaauuucucagcugaauucuaugacagugcucauauucucuaaccccugagaaacgcaggcuacacaugcuagucuauaucucacagggcucuaacacaguucucccacagcucaaaccaggcugugccaggguggagagaggaaagaaaugaauacggacaaucaaaaccuuucaaauacacuucugcaguucauuugcuaaauuguuauaucuuauuuuuaaaauuuaacuaaaaacagggccagcaagacaauccaacagguaaagaaaggcuauugaguccagugagcuccacccccacagacggaaaggaccaacucccaagaccgcaugugugcauguguccauacacuacaauacacuuaacaacacuuuuaaaaaguaaaagcaguaacaaauggcaagaggugaaaagucauuuggagacugaagaacucggcaugagauaaucugcuguaucuguguugguuuuaaaauuuugugucagacucccucccccuuccccccacauccugugucagucaggcaauagggcgaccuagagucaagcuaccugggaacuugaggcaggaggauaacuuuaguuagacagcaauagaguuggaccucaagucaguaacaaacaaacaacaaacuaucccaagauucaaagggcaaguuaggcaaaugacuacagacuucaguucaccugaaugguuuguaaggaagaaacacugagaucuugcucauuugaaacccaggugacuuaaaccugaggagcaacaggcaccuuggcaagaacagagaguugucucuuuccagagggucaaggguacagacagacaugcaaacacucacacacauaaaggacuaacuaaagaaauaccagaaugaaacaaaauaaaaacugaagaaaucauuaagauuagugauaaauaaugacaguaauggugauaacaaaauauauucuaguagaaaaccgggaagucacauuguacuugacucgauagauagauaaauagauagauagauagauagauagauagauagauagaauccauaaaagaaugcuauuacuguugucuauuucuugauugccaaguaaaacaaaacuuaaagaaggccuuagucauaccugcagcgauguacucaaguauguccuacacuuauuuacuacagaaaacuaagucugacgcugagcugucccaucuguaaaaguuaagugugaacuaagauuaaggagggguuaaaggaaagaacuccucagcaagccaagucaccaacagcgaaaaauuuaacuucuaugccuuuuuaguuauuucucuuacaugcuuccauaaacuuguacacucccuuccucacccacccuccagcuccaagaagagaaccucugagucaugcuauaaucucacuaaagagaugaaaacuccaucuuagcauacauguucugggaccucaaguagagaacaggagugauggaguggucacaguuggcgcccacagggggaggugagcagcgauugggugagcaggagaggaaguaacgccugcuagguuuauaauuacccaagauucccaacaugaacagggaaagaaaucuaagaauaucaacaauugggggacaaucuuuauucugaggguucccuuacgaugacaucaaagccccaugguaaaaagguaaucuaggcagccucagaagccuggggcaggguggcaguggggggguauccaaggccagugcaaagacgguaccaagucagugacucagaagugucaaggggcagaguguucacuuacauccucaagcuccaagaaugagggcagagguucuagcuagcagcauaaagauacacugcagcugaacuaccugcucagaguuauagauggaauacugucaaaaaucuuccuuugcucucucugaccaccagcgcucucccacaugacccaccccugccacuucaccuggcuucuagcacaggaaaggguagauauagaaugcauuucauuuuccaaugagggggggcauccguuuguucuuuacuuuuuuaugcauauaaauacaugaaaaugguuuuauaaggaguccuuacuuuguggcucaguagguaaagguuucuccugacaaccugcguuugauccccaugaccuacgugguagaaggagagaacagacucccgaggguugucacuuuaccuucacaaaguacaaguacacauauaggcacacaugugcaugugcacauacaaagacauggcaggggagagugagagcgagaggaagagggagaaacccuaaacuucgucuacagaugacaagaugggcaagggugcuugcugccaagggugaaaaccuaaguucuaucuacagaacucacaugguaaaaggacagaaccauuucuacaaguuguucugugaccuacaaguacacucucacacacacauaauacacacacagaccacacacacacacacacacaucacacacaucauacauacugucuuaguuaggguuuuacugcugugaacagacaccuugaccaaggcaagucuuauaaaaaacaacauuuaauuggggcuggcuuacagguucagagguuuaguucauuaucaucaaggugaaagcauggcagcauccaggcuaucauggcgcaggcagagcugagaguucuaagucuucauccaaaggcugcuaguggaagacugacuuccaggcaacuagggugaggaucuuauacccauacccacagugacacaccuauuccaaccaggccacaccuccagauggugccccucccugaucugagaauauacaaaccaucacacauacauacaaacacacacacacaaacacacacauacaccacacacauacaccacacacauacacaucacacauacaauacauaccacacaccaccacacaccauacacacaaacucacacacaaacacacacauacaccacacacacacacacacauacaccacacacacaaacucgcacacaaacucacacacaucacacacauacaccacacacacauauacaacacaucacagacaucauacacacacacaaagacacacauacaccacuacacauacaccacauacauacacaucacacacaauacacaccacaaucacacacacaaacucacaaacacacacauacaccacacacacaucacacacaaacucacacacacaucagacacaucauacacacaaacacacacauauacacaucacacacacacacacacacacacacacauacacacacgcaagugauguagaaugucgaaugucuucuccccccucccgcaaguaaauaaauaaauguaauauauuuuuuuuuaauuuuaagaacccugcuuuaggaaacuuacuaguaguucagagcuuugaaagcaaacaggucuuuauuaagaucaacuuuaaaggcacaagggguucuucggauuuucuugcacccacugccuguguuguccucucaggagcugguaugaaugccugucaccucuacagcacacgucacaccuuaguucucugcuaguacccugcugccuacuaccacagcagcuuccacuccgaguacucagugcagaccuagcaacaaaugcaaaugcucgcucaggaaguggcuguccuugagucagaaagggagggagagacgcgguggcaauaacauuccucuucuccaugcuggcuaguacgccaagaagacuuuuacuucuuuuccagaaagauucagacauugagaaucugauaagaacccucuauaaaaauaacaauccagaaaaauagagauauguauaaaaucaugcaaauuagagauuuaucuuaaaaaucuaacccuuguuacuguuguaauucccagugugaccuguaauugaagacagagacgauaguauguauguaacugcagacaacuuugaacaugcaagccaagcacccaucaugagcccugccucacuuaccagcagcaccgucccucacugcuccuccuggaucauguccuguugaccgugagggagcccaucuccugcuuccaagcaccguagcggaacaggaacaaggaacaugaagagucuugggagggcaagcugcugaauguauaccagccuagagaagacagaguuugcaaauaagaucagggcaucuauacuuauuccuaaagguacacucugcuguucuaauuacauggcugaguguuuaaaaaaaaauuaagguuaaaacauuuuugucaaagcaguaacaccuucaaaugucccaauaaaaaucccgucuguguggagcacuuugcgacacgcaagaaccaacaagucaauccuggcgauggucaaguagguuccauacaguuccacuggcguccuuauuuuaucuguugggcucagugcccgaagacugggcugucagagcagcaucucggugcuaggaugagcccuucacccggacucugaucugaagucucugguaggacuuuguccccaaugauucuauggaaggcagaguugaagaccagucauuuaagccuuaguaauuacugaauggagcgcgagguuaacucuguauacaccaugagacggcagugugcggcugcuaaggaaagaaggccugguggucccucugcucugaagcguucauuuucucuaauacucauuuucaaauaaagauuuggauuuauuuaucuuauguauauaaguacacugcagcuguacagaugguucugagccaccaugugauugcugggaauugaacucgggaccucugcuugcuccggcccugugauuuauugauuauuauauaucuaaguacacuguagcugucuucugacacaccagaagagggcgucagaccucauuauggaugguugugagccaccaugugguugcugggauuugaacucaggaccuucggaagagcagucagugcucuuaacugcugagccaucucuccagcccaucuaauaugcauucuuaaaagauuaccugaaaagaaaaauacacugaaaacaacagaaccuacuccaccaaagacacagugaaagucuugaguguuagaaaauuuagaguucuacgguaggguggaguuacuugagagagaaauggggcucccagucuucuacaaccuuuccaacacguguugugguacauucuuuuaauuauauucacccucaugaguggugaauggugaaaagugcucugaauaaugaaggguaagacauucaguacuauauagcuaugcauggggugauugagugugaaaacaaguagucugaaauugagucugaaucgaaaggaaaugacuagcuggggaacuucuaauaauacauaaacaccaaguucagugacauccuagguguguagagaaaaaagaaugacucagugacaguaacaaagcuuuggguuugagugacaggaucgguggugacaucaccaaauaaaugcaucaugguuccggaaaggagagcugagagaagacacagacuucaucuuaacacacuuggggauaucuaggaauuuccaauaaauaaagauggaauuuaggaucuuucucucuucucuuucccucgcuaccuuaaccccauucuccaccccccacccccuauuuucaaagaaauuuggguaggaucaugugaugguuuguauaugcucagcacagggaguggcacuauuagaagguaaggcccuauuggaguaggugcggccuuguuagaauaggcgugucgcugugggugaggacuuuaagacccgaauccuaguuuccuggaagugauuauucugcuagcagccuucagauaaaaauguagaacucucagcucuuccugcaccaugcuugccuggauccugccaugcucccaccuuggugauaauggguugaacccugaaccuguaagcagucccaauuaaauguuguccuuauaagaguugccauggucauggugucuguucacagcaguaaaacccuaacuaagacagauuaaaagagggucauugucauuuccugacacacuuacuugagaucucuccagcugaguucagccacuuacagacagaacacgaaagaaggcaagggggauucugccuucuuguuuuuuuguuuaaaauuuaaaauaguaaaacuauacuaaauauuaccaggccuccaauuguaaacuucuugagguggaauacuucuuuguacaccauggggcucuggugcccucuacucucagauggacggaagagcguguucaaagagucuucccucuaaggccuggcacagguucaggaguccuagagggccgaguguugcuacagcuuguuaucugguuggcugggauuccagcuggcaaacugucaaagagagcuaugagguuccaguuuuccaugccccaaacaaugucucagcacacaacuuacacggcuaacaacggaacuacuagcaacuguauucuauaacgugcaauuguucugaaacuaauguaguuccuagacagauuuuucuccuugaauugaaaucuacucuaauuuuauucuuauuaguuauucgcuguuuuaaaaacagauuuucuaggagauaaaauuuuaaauaaguuaaaaagcuaugaucaaaccagcguuuuaaaacagauuuucugcuauauuuucuaaaagguaaaauuaaaauaguaaauuaaaaagcuaugaucuacugaaggccuuuggacucauuuagguucaacacagugucuccuguagguagguggcagagucccagagccucuacuaggaucaaccauguuauugugucagagccuauuucaaaccuuacaagugcauuuucuuuccuuucuuccuuuuucuuauguaugggaggugugugugcacgugcguguguguguguguguguguguguguguguguauguguguguguguguauauacacaucaaccuucauugcucuccaugcagugaagcaggaucucccacugaaccagcagcucugcaaaucuagcuagccagcuugcccugaggaucccugcgucuccggugcuggaauuccaggaagcuucuagcuuuuauauggauuuggggaguccucccacuugugcaguaagcauuucauccaccaagccaugucuccagccaaagcaggccuuuaacaaagaaaaagaaaucucuaaaagccagucacucaaacuauacauacauacaaguaauguacacugugaauaacaucuuucuauugaaauucuuuauuauuuuauuuuaaggcacugccucauucuauaucccaggcuggccuggaacuuacuaugcgggucaggcuugccuugaucgcccuucuucagccuccugaguacugggauucccaacauaagccaccauguccagggacaaagucauccuuggccaguacuuggauccauggcuagccaaagucaugaaggcuccacauuccgcccguugggucuggcccuucugagcggcccagcauggccuguuuccuuccucugcagaugcugucucugccugcugggauccuccaggucuaaauagggucagaguagaguacacugcccagcagguuacugaccucagcaggguguguccacaaaauggcucuccccuuccacacacacccagagcuagcaaaugaccucagcugcccaguucucagaagaaaacgcuauuucagaaucgcagcaacuuggcagcaauggcucuuuccuuauuaaugcuuugaaaaugauuacaccgagaacaacugcuuuaaagcaaagccaugagaagaaaacugaggaagaucucguauuauuucugcucucauuccuccuaacuuauacaaagugugccucugaaggaagaauucagcaggaauuugcauaacaaauuucagcaaaauaaaaacaagugugccccaccuacauccuuucuugucaagucuuugaagaccugaaaucccaaacaaaucugaaauauuagccagcauugaagauagugugaccaucacugcacugcacugagagauaaacaggagccaggcagaaugucagaaagaccuauagcaucuucucuaugaaaagaggagacauaagucaauuuacauacuugccagaaacaaacaaaaacagguugugaagaaaaaguuauaguggguauguuuaaaaauaaagauagcauacccgaaucccaugcacccaccggaagaagaugaagaaaaaugcagccgaaggccaggugcaguuccucgagcuucuguuaucucagcaggcaggaagcugaagcaggaaggucgccugcccaguuccaaaacucaucaaccauacaaaaggaaagcaugcggaaguuucugagucugaccuaaaagcauuugacacucugacacuggccagcaacugaccuccuuggucaaaaucugggccaauggcaggugugucuaaacauugaaagccagcaaaagauaugguguacuuuacauccacaaaauaaaaaagaaaacuuuguacaauggaggugccauugugauauccagacaucuugaggauucucucugacaaucccauauaaagacaaagggaagaagcuaggaaugaaggacaccuuuaacccagcacuaaggagaaaauggcaggcggaucucuaugaauucaaggccagccuggucuacagaacaaguuccagaacagccagggcuacacagagaaacccugucuugaaaaacagaagggggcuguggagguaccggaaagggcagagaggagaaagaagaggauagagcuuugcacugguuuuaaagguucaucugacauuuccuuuuucuucagacaaagaacucuaggcauggugauugugguuguuuaaaugaaaaucccccuuuaggcuuacgcuuugaaucuucagauuguggcacuauuugggggaacauuuagaagguguggccuugcuagaggaaguguggcccugugggugggcuuugagaacugaaagccaacugccagaucacucugcacuuucuucugcaguuaaggaugugagcuaucaguuuucuguuccugccccuaggccugcugcaugcagccuucccucccagcacgaaggucucuuagccuaaguugcuuuuggucacugcaucuuaccauggcaacagaaaccaacuaaugcagaggauuuaucgauauaguuacauacaggacaauaauucuccuggagggcuggagagauggcucagcaguuaagagcacugacugcucuucugaagguccugcuuucaaaucccagcaaccauauggugacucacaaccaucucuaaugagaucugaugcccucuucuggagugucugaagacagcuacaguguacuuacauauaauaaauaauaaauaaaucuuaaaaaaaaaaguuucaagccacccugugccuuggcacacaguccccagucccucagagagacugccaucuucacuguuaaaaaugaugaugaugauggccgggcagugguggcgcacgccuguaaucccagcacuugggagguagaggcaggcggauuucugaguucgaggccagucuggucuacagagugaguuccaggacagccagggcuauacagagaaacccugucuugaaaaaccaaaaaaaaaaaaaaaaaaaaaaagaugaugaugaugauaauucuacuggaaagcaauuguguagcccuggcuagucuuuaacucacacuguagaccaggcuggccuugaaccuugccgcagcagcucugagguucucaacccuuuaauacuacacuucagguguggcaacccccaacauucuuugcuacuucauaacuaauuuugcuacuguuaugaagcauaauguaaaugucuguauuuucugauggucuuagguaacaccugugaaagagcccuuuggcacccaaagggccugugacccucagugcuugcaacccacuggcuuagacgcuggcuuugauucuggugggacaaaugcaugucauauaaauagccagguguggcgauauacaccugaaaccccagcacucuaagagagagaggcaggaggauaaccacaaguucaaaucuaggcugaguuacuuggcaaguuacaggcuauaggcaguguuacauauaaugaugaaaaugaaguugaagcaggagcagacaauauguagaaauacaagguacuucauauagauagaacuaucucaccuuauucccaguuacaugauucuaaagguaacugguuuuuuaaaaacagaaucucauguauccuaagcuggccuugaacuugcuacauggccaaggcugaucuuaaauucccaguccucuguccccacuucuugagugcugggacugcagguacuucccacccugucuaguuuaugcagcacagaagagugaaacccaggacuuuuguguguguguguguguguguguguguguguguguguguuaagcaagcuuccucuacuagcugagccacaccuccagccccuaauaacaccguuuuuacaaagaauauucccuaagcagaaauguguaaccacaguucagucacaguguguaucaguggguucaaagacauuuuauaacauaagcucuauuccuuuaaacuugugaauuucaugucauaaaaugucaugguggacuccuggagaaaagcauguaugaccaaguuucaaccagacugaauuauugacugcaccauucauaauggacacacauuaaggaucagaaauacaagcuuuagagagcugcuucaaaucgguaacaugacccuagauauuaaaaauaguuuagcuuccaauauucugaggaaaguaugaggcuuguauuaacccuaccuuccaaugucuucaaaacauuaaacaagaaugaauguugaccauuaauugggucauaaauaacucauagcccugccuucaagugaaggcuuguucacaugagggacgauuuaagaccauugagggaguggcaucggucccaacaucaagccucaauuagcuggacucuacagacuggugcuaugcagaacuacauguaaugugaaacuucccucuccaacaccacauuauaaggcugguaaucuuuggucuauuauuauuuucuuugaaacagcauuacuuggcuggagagaugacuugacuuggccacuaagaccacauacuguuccuugcagagaauugcaaguuccuggcacauagguugggcagcuccagcucuugggaaccuguacucccaugucacacagccuugugcuauacauaauuaaaaacaaacaaaaaaaugaucuuaaaaaauguuauaaauaguaucacuuuagaaacacuaguguugaauuuuaagcaagcagguuuuaucaauuccuuuuuguuuguucugggacagggucuggcucucagguuguccucagagauuucagucucuugauucucccuucuucggcuucucuagcacucagaugagaggcaugcaacaccaccuccggguggauuuuuaucaaaccucacuucuaauaaaaaaguagcugggcagugguggcgcacaccuguaaucccagcacuugggaggcagaggcaggcggauuucugaguucaaggccagccuggucuacagagugaguuccaggacagccagggcuacacagagaaacccugucuugaacccccccaaaagacauaaaacaaagcucuacagcuauauuuaucuguguuguuaaaacaaauugugcauuuugcaaacuagaaauuuuauuuaagaugaaauaaaaauaauucaaucacaaucaugccaugguggcucacauuugucaucccacaacuuaggaggucaagguaggaggcgcaguaaguagaaauucaagauguaccccacgugugcaugccugugugugcaccaaaggauacuacaguucccaaacagaaagcaaagauaaaaguuugaucagaauuauuacuauuguuauaucaucauuauuauuauuucaucagagucucgguauguagcucuggcuggccugaaacuuauauacacaccaggcuggcuuccaacucacagaaauauaccugcuucuauauccaagugcugggauuacagguguaugguaucacacccaacacagauuguauaaaaaaaagcacugaauugucagggucucaggccagcauaguugggcuacauggcaaaauuuuaucucaaagggguaaaaagaagcggaggggaaaagcguucaucaacuuaaaacaaacaaguaaaugaggucucucuugccaugaccaauaguaaauggaauauuuagcaucuaaugugcaaagccugaggcacaggacagagcagggucccaguagucaucuagagcccacccauaagucguauguuauuuugguugcagggcaguggagagguccagaaguggcagggagggagguccagggacugaggcagcagaacugcccucucucucccuuggaagcacucgagugagcagcggcucagccacccucucgcaccugcugcacacggcggacacugcuucuucccacagauccuaagggauaaaaaaagcccggcuguugucaagucucuuugaaucuaacauuugcuggggagaaaugucacuuaucacccuagugacagcaagagaccaagaugagagggagaaaaaaauauuuuuugugggggagaccccaaacauuuaaauauaacaaacuuguaaaauacuuucaaaauuauacaaaaaaguauguucucaggccucaaugaaaauggaagcaggaggccaacuuuucaaauucuggccaaguuaacugaauuuaaaacuauuuuccccuaaguaacgaugcuagcuagcauaaggugguauaaacccagccaggcauaauagugcgaccuguacuuggaaagguaagacagugagacucugaaaaaacaggcaaaauaaaacaaacaaacaaacaaacaaaaaugccaaaaauacaagcacaugucauacuuaauguuugauaaucacauaaauggauaagaaauucaaauguuuauauaacaagcguauggcuauuuugaucaaaguaauuauuauuguguuauacaaaggaaguauaacuauuacuacuuagaaacuguuuuguuguaaacauuuuaaaaauagcacaaauugaaaaaaaccaaacuuuggauccugaugcagaucauaaauaggacauggccacacagaggugcauugugaagcuacacguaguucugagcuguuauaugggugcugggcaucaaaugaggucaacucuucagcauguaaaaaauucuccuuaaauguucaaaaucagacaggaagaugaaggcucaggagauaacgugcuuacuguacaaacugauaaucugaguuccaucccuggaacccguguaaagaggaaggagagaagagauuacacaaguuguccucuagccucuauacacaugccacuguauauguauacuccccuaauaauaacuuuuauuuuuuuacagucuagucauuauucucccgcuggucugcccucggacaguuccucaucucauucccccucacccuugucuccgagaggauguccccaccuccaccugcccccaauaauaacuuuuugaauguucaaaaucuacuuuuauuugauaaaucuuccaagauaccugaaaaaagacccugugccucauugauuguccuuuggugaaggaguucuagccaccuguagcuucuguguugcugaaaccaauauaagaguugucuauagggggcuggagagauggcucagagguuaagagcacugacugcucuuucagagguccagaguucaaaucccagcaaccacaugguggcucacaaccaucuguaaugagaucugaugcccucuucuggugugccugaagacagcuacaguguacuuauauauaauaaauaaauacaucuuaaaaaaaaagaaagaguugucuauaacuaugcuacagugaagaguggggcgggacagagaagcagaaaggacauucacuaccuccaaccaucaugggucaagguggaaaccaucaaaaguccucucaaagaauaugaacuaugaccaaauggagcacuuaugagccauauaaagacugauaggcauacacauaccuuccccuuaaugcaaauaauaaagauacaggcaccggcuaaagauuccgguggcuucugaccuuuggcuaaggucaaguauugagaccacuuuagaaaguaaugcugagaagcuguuugugagauggucucucauaccaacacucaagaaguugagguaggaggauuuuuauaagcucaaggccagccaaagaaacaaaucuaaacaauaaaauaaauaagcaaauaggaaaaaaaaaaaacacucccacuacucauagaugagaacccauaggcaagccucauugcagacggccuuccagagggaagucagucucacagcagcaagcauggaugaaguaagucccuuaaguaaagcacuaggugugugccaggucaggguguacaagucaccuccuuucacugccauggaugaagucauguuacacagaaugcaggucagagguagcauaaaucacguaggagucacagcugucaacaaauaacuuucuauuacaggaacucacuuucaaaugaugccgugaggcuaggagggaauuaaacacaaagcaggguguuuucaucuugaauacuaacugcaagcaguagagaugcuaauuugcuuuguagccuuuguaccaagagcaugguuaagaagguaacugaagaaaguccaaugucuccuguagacccuccuuuguagauccugcucuuaauaaaagaucagggcuaacuguuugucaugaauaaugcuaugggcaguuaagaaggacaguaggcuacuuaagccacuaaggguggggugcuccaagugaaguagaugagcauccuggauuuauaaccauguauuuggcaucaauuugagaccacucagguucuucugcauuuuucuuucucguucaaaguuacacuaugagcuuuggguguguccugcagcucuccagugggaugcucuacuugccuggagccuuuuuccuuuugcauuugcuuuaguguuugaaucgucuauggccacauccuugagcacagauucuuucuuuggucgcaugcagcguauuagcgaagccaucgaaggcguucuugacacuccugcuacagcaugcuugugacccaacaggucuuuaguucuuucugaaaacgucuaccucagucaacauuacccaccuguucuugcaucuguccaccuuuuauucauuagcaucuuaaucauuaaaaccacuucugggugcaacgagauggaccuugcuaaagcugacaucugggguuuaccacugagagucacaucuugaaaggagaacugucucauagaagucaucugaccuccacuggaggggugugugugugugugugugugugugugugugugugugugugacaugcucacacaauacaaaagucaggcagugguagcccaugccuguaauucuagcacucagaaggcagaagcaagcaaaucucugaguuuaaagccagccaggucuacagaguuccaggacagccagagccacacagagaaaccaaaaaaaaaaaaaaaaaaaaaaaacaaacuaagcaaauaaccuaaacacuauaauccccauauuggugcuaauuugcuucuauuuugaguacuucuccauuuuuuuuuuuuugguaugucuugcaauuguuuguucaauggcacacacgauauccuugguaacugcccucaagaagacuuugauaaugcaguggaggaacauccugcccugcugugacuagucugucuuuuguggggcugggucuugcauuaugaacugcaccacugugguucaaaguuacuucagccaguuggguaaaacuggauuucuugaguggucugcagcuggguaguucucuuccuucagguuaggguuagacuagaaucugcuacaauuccagaaauugcuaaaaucccagcagugggcaggacagggcgugggagcucagugaguuugaguauagccagauccacguagggaagccugguauaagaaagggaaaaagccagaauguagguuuuauuccacaguuccuuaaagccaggccuuaaauuccuaauggaauucucuggcauauuucaaaagcauuucuuuuccugccuugccaggaaguguguggugaugggcuacacuaccaacuuugaggaacugggagagcugguggcagaggaggcaccaagugggugcuacacugacugugugauccuggagucugcacuccucagccacaccaaggccccagcgagucacuaacugcccagguuuucccacccugacaauagguccugauaguucuuccuguggacugcugacaagcuauggcuuucacuaucagccuacaucuucucagcaucgggagaugaugguuuccucugaucuucucuugaaagaacugagcccuguugguuuccaucucacucauuuacgugucacuuggauggaguggugccuucucuguucccuacacgacagacugcaaacaggaaguuugccauuuuuaaaaacuauaaaacaaaaccaccaacucccacuccaacucuauaacuuuauacaaaguccagcuuuuaguuuauucuucucuuuuuccuuauuuuucucuuuuccuccugccccaagacuaggugucucacuguacagccccgaaugaguagaauucucuuauauagacuagucuugccuggaacucacauagaucugcccagcucugcccuuggaguacugguauuaaaggcauacccuaccacaccuggcaaaaauuguauuuugaaagcuguugaaaacuguacaugacaaaucacgcaccugugacugaauuaaaaaaaaaaaaaaacucuuuugggccacuuaagaggcagaaggagguauaucuuugugaguucaacgccaaccuagucuacaucgugaguuccgagugagugagccaggguuauguagagaaacccugucucaagaaaauaaacaaaaaauauuuuguggggguucaagagcuggcucagcaguuaagaccaccggcugcuguuccagaggaccuggguuuaauucccagcacuuauauggcugcuuacaauugucuguaauuccauuuccaggagauccaaaccuucuucuagccucuuauagcaccagauaccauguggugcaaagauauacauguagggaaacacucauacacaugggauaaaauauuaauaauaaauaagaaauguguaaaacacugggaagugguggcacacaccuuuaaucccagcacuugggaggcagaggcaggcagauuucggaguuugaggccagccuggucuacagagugaguuccaggacagccaggacuauacagagaaacccugucucaaaaagaaaaaagaaagaaaaaagaacagaaaagaaaagaaaaaaagaaagaaaacagaaauguauaaaacaaaauucaaaguuucgggguuuggguuuauuuauuuuauuuaauguacaugaguauuuuaucugcaucuaugccuaugagucaugugucugaucccuuagaacuguaauuauagauaguugugagccaccaucugguaugugaauucugggaaccaaacccagguccuauggaaaagcaacaaguguucaaagcuuuaagccccuaugacugcuuuuuguucuuucuuuucuuuuucuuugcuuuggaaacaaggccucacucuguagcucugacuguccugaacucacuauggcuggccuaaaacuuagagauccaccuccucugcuuucucacaaguacuggaauuaaaagugugcaccaccaaaucaagguagucugcuugccaguaccaaagacaucugaagucuaaagaaguuagcagagagauuuguaucucuuuaugagaguagaugccgagauaccagaaaccacaaucucaccuagccccaagguuaucaggcacaccuuggaaggcaggaaucaagggagcuccccucugcuuguaauuggguuguuuaaaacuucaaaguauugacagugucuuuugccuugcagcuuugcaguuucaugaggucccauuugucaauucucgaucuuacagcacaagccauugcuguucuauucaggaauuuuuucccccugugcccauaucuucgaggcuuuuccccacuuucuccucuauaaguuucagugucucugguuuuauguggagcuccuuaggccaccaacagauugggaaaggaucuuuaccuauccuaaaucagauagaggacuaauauccaauauauauaaagaacucaagaagguggacuccagaaaaucaaauaaccccauuaaaaaauggggcucaagcuaaacaaagaauucucaccugaggaauaccgaauggcugagaagcaccugaaaaaguguucagcauccuuaaucaucagaaaaaugcaaaucaaaacaacccugagauuccaucucacaccagucagaauggcuaagauaaaaaauucaggugacagcagaugcuggcgaggauguggagaaagaggaacacuccuucauuguuggugggauugcaggcuuguacaaccacucuggaaaucagucuggcgguuccucagaaaacuggacauaguacuaccggaggauccagcaauaccucuccugggcauauauccagaagauguuccaacuaguaagaaagaaacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaaaaaugaagacugaaguguggacacuaugccccuccuuagaauugggaacaaaacacccuuggaaggaguuacagagacaaaguuuggagcugagauaaaaggauggaccauguagagacugccauauccagggauccaccccauaaucagcauccaaacgcugacaccauugcauacacuagcaagauuuuaucgaaaggacccagauguagcugucucuugugagacuaugccagggccuagcaaacacagaaguggaugcucacagucagcuaauggauggaucacagggcucccaauggaggagcuagagaaaguacccaaggagcuaaagggaucugcaacccuauagguggaacaacaauaugaacuaaccaguacccuggagcucuugacucuagcugcauauguaucaaaagauggccuagucggccaucacuggaaagagaggcccauuggacaugcaaacuuuauacgccccaguacaggggaacgccugggccaaaaagggggaguggguggguaggggaguggggguggguggcuaugggggacuuuugguauagcauuggaaauguaaaagagcuaaauaccuaauaaaaauggaaaaaaaaacuccaaaguagugcugaaaaucauguuuuuaagcucucaagguacuuggaauaccauaacauucuaagaccaugggaaaaaaagauacaguugccauugugaagagcucuuuagguacaauguuuccuuugcuccagaagcuccugggaaauuucguugagaggcauccauccgcaaagccagccucaccugcaugcacuggcugguuacuauuuggauacuauugaaaucaagugugaaaugagaggacuuuaacaaaccaaaagauucagcuggggguggggguggggugggguagggaguggguuaaggcacaauuagaaauucuacaaagauaagaaaccagauuuaaaaaaaaaaagaagaagaagaagccagguggugcacgccuuuaaucccagcacuugggaggcagaggcuggugaauuucuaaauucgagaccagccuggucuacaaagugaguuccaggacagccagggcuauacagagaaacccugucucaaaaaacacaaaacaaaacaaacaaacaaaaaaagaaugacauuuuaaauuauacccuaaagacuuuguaccgagauuuuggaguuaagagucaacugcuuucauaagaagcaguuggauguuuaacauguugacaugggauauuacacaagcaauccgagauagcuaguaaucuacuaauaucuccuaaacucuuaguuaaaugauuccaaauuaccagguaugguggugcauacuguaaucucuacuugguagucugaggcaggaggaucuagaauuugagaauagccuguauuacauaguaauacuugguggcuagaaaauaaauguuaauuacuccaaaugauuuuaaacacaaguguguuucuauuaaccaugcagaaaagcauuuuggacagguuaagagugcuauuaucuccuggacccccagagugcuucgagguauagacuggugugaaagaaaggagaagagauagauaggagagagugaaccacgauuaagcccacuuaaaguuuaaaaagaugacagaaacucuguguuuuguagcacaaaaugagaccuaaagaaaaauacacuuccuauuuaaaccugugaccuccccagcacucaguggcauagacccacacacagaugcacacuccugauuagaagcaaucauuuaaagaggaagacaaaguucacuuaaguugaugcuuaaaauaugaacaucugaagcaagccacauuccgugucaggauuacuccucuuguuugacauauucaccacaccuccagcugaguucuagacaucauaaucacgacuguaagcaaugugccuguuucaguuagcaguaaggaacagaacacacaugcccaaaacacuaguuauaaaugaguacuaggauauauauuuguguguguguguguguguguguguguguguguguguugcuaggaccaacacaauccacggaugaaaugauuccccaucucuucagagauuacaccacuacccugugcauucuuucucaggcccaauacugggaaaguuuugccaaguucaguccaaggaucauccaggcaauagagaaaucaguccuucaaguaaugauuggaaacuaucccaggaaaguccucagauacauagauagucuauaaauagcuauguagcuuaugcugaccucaaacuuauggcaguucuccugccucagcuuccacgaugcuguuauaacagacaaggggaucaaaacucugauucuuguccauuccauagaagcaaaggugauggucauuuuccuccugaucuagacaaaugcucagcacugaagagcaaaugcugcccacucaaucacuggaacuugaccucucacgggcuccucuuagcaacauuaucaacauuuuuagcuguucuuugcaggcggucaagcagguauagagagggcaagacaacaugauaaagacacacauaccuaaugaaaaaaauagagccacaguuugagaaguuuccuguggcaggaucuagcuuacauaugggaucugaggaaacagaagucggaagagagguuaauauugccucuaucagaaucaaauaccgccucuuaagcaacagcagcaaacuggcguucccuuacagucuucucuuggcucaccucaauccuuagucuauauccggucacacuacacaaugcuguguaugaacuaucgguuuuuuucccaaaucuaauaaauaauuuaaaaguggacugaagaugguuaaugucaaaggguaaucacaugaguguuugaaaagggauuuaaugugcacaugugcacauaaaauaugaaacagaggauauggcuuggagguaaaguggcccaaagcccauaaaacaaucauaacaaaaaccaaauucaaacgaacacacagaacuaaaccuauaguuuuauaagaauuauuaaaagugcaaagaacgagaaaaaaaucaaauauuugacaauuugucauaagcaggaaucaguugacagucaaucuugaguuuucauaacuagugacaguguuuauuauucacugggaacuauuaguguugccaugucugcacguuuuccucuuacguggcuagcacguguuuguguucaacacucgaugacucucaguugaauacucguacaagcacuucauuguuaaacugauuauaaaauucucucucacuuuacuuucccccaucaugauuguagcaaaugauuuagcuagguaauggauucuagcauuauagaagccaaggcagagcuaccacaaguuagagggcagccuaagcuaugcagcucaaggacaaucuaggcugcucaaggagacucagucuuaaacuacaacuaaacaaauaagcaaauguaucagauuaaaaaaaaaaaaacaaccaaacaaguuuuucucauuguauucaacccauugcuaagcaauguuucucgguacaaauacauucaguaguaugcagaaauaaaaauacugcauuuuaaaaugggaaaaggcagcuuccagucacuauaacuauuaguuaacuaaguuaauuuguaacagagugaguuugcaucggccuaacaauuaaagaguuaacuggcuuagaggcuacuuccccucagugguuugcauacaaaaguacuggucagagucaaaagcuacuacuacuacuacuuuucacucaaaauguaauucaggugcuaauagauucuaaaauagggcgaggcugcuuugggcaucuccaucucucuuucagacaaguuuacuauaccuucaggguuuucuuauucuguaccaauauuccaagagcuagcuagcuaaauuguuugugagauucaaccccacugccauuguuaaccgcuagucuucagaauucuggaagggucuauaaacauuaaacccgaguuguguuucagcaugugggaugcaaugagauuaaccaggagcugcucuagagccaggcacuaaucucaaaucacaggccuuugcuagugugagugcccaugugucuagcccacauaggguguuccuggacagccugaggugcacaaugacacccuaugucuuaggaaacaguuaccugccgcaucucagcuguguguguguguauguguguguauguguuuguuguuguuuuuuuuuuuuccuugguuuuucgagacaggguuucucuguguagcccuggcuguccuggaacucacucuguagaccaggcuggccucaaacucagaaauuugccugccucugccuuccaaaggcugggauuaaaggcgugggccaccacgcccggcuugcaacucagcuguuaacacaccuuccauuugcagaugauguaauguccgggaagccuggauauacaacacaaacccaacucuaaaccugcacauaccuuacauaucagaaccugccugcuuacagcuacagcagaccaagcauacaaaagauaaagucaggaugcuuuaaaaacaaaaccaaaaaaccaucaagacccuuuauggauaaauacaaaugaaaauccccagaaaucaacuccggaaagcaggaagucccaagugaaagcuuucuauuguguuaacccccaagggugaggagggucccggguagggcgggccagacauccaacaggaggauuucagaugccaguguggagguggggagagcggcuugguaagcaacaacuuuccuguggccauaguuccugcuuugggaaguaggaucaccgagaccccaaaaugaaaaaggauuuccuucuccuucuucuuuuaaguugaaauggauuuuuuucauacacuauguucugauuaugauucccccucccucagcuccuccaagaucccccuuugucacugcugauuguuauuugaaaagcauuugugagaagggaucauacuuaaugcacuggacacuguaauuaagagaaacaagacaucaccuacaaaaacaaacaaaaaggccagcaagaccggcuccgcaagccucgggagacacaaaagauuaaccuaagccaaggcaggcucagcaggccaggcuuccgcaaauaaacuuugaauugggcaggucucaccuaaacaccuugaucuuggggucaugacccggucagagccaggacaggagauuuuugacuauuaauuaaggggguggagaucuggccccagacacaaaagccaucucucuuggagguuggcaaaguguaaauagcucugcugagagcccagguccacgugucuaacuguguaauagucuccucugcuucuuuugcacacagaaaccuauuuccuuggccauaaaaauguacaugugcaugacaaaauugcucuaagaaggauuuaauuuauucuuucuuguuuauuuaaaucacuuuaaaauuaaauauacuggugcugaagggcucagugcuuaaaagcacuggcaggucuuaccagagguuugggguucaaucuaccacauguaauaucacaauaauccauaacuuacauucugagagauaugacauccucuuuugguugcuucaagcaccgggcaugcacauggugcacauacauacaugcaggcaaaacccuuuuugaaaaagauuuauuuauuuuauuuuauguauaugaguauacaguagcuguacugaugguugagccaucaugugguugcugggaauugaauucaggaccucugcucgcucuggucgaccccauucuggggcggccuugcuuagucuggucagucggccuaaagauuuauuauuauauauuuauuguauauuaaauuauaucauuauacuauauuguuauaaaauauguuaaauuauauauugaauauuaaauuauauauuacauuauauuuguuuauuauuauaucuaaguacauuguagcugucuucuaacauaccagaagagggugucagaucucauuauggaugacugugagccacuaugugguugcugggauuugaacucaggaccuuuggaaaagcaaucggugcucuuaaccccugagucaucucuccagcccaacaggcaaaacucuuaauaaauaaaauuaaaagaggucuuaagggcuggagagaugguuucaugguuaagauaaguaguugcucuuccagaagaccuggguucaacucccagcaccauuguggcagcucauagcuguaacuccaauguuaggacuuuggauccucucacacagacauacaugcugacaaaacaccaguggacauaguauaaaaacaaguuauuuauuaaaaaauaacaaauuuuaaauuuuuuaaaugacauguucuauaccucuuaacacuugaaauaugcacuuuguagaaaugauuucgaaucuauuugaaagaaaucuauaaaauuuuccacuugaaaaaaguaauguuuuaaaaagaaagagaucagccagaagugguagcgcacuccuuuaaugccagcacuugggagacagaggcauucuaaucauagacuggugaaaugaaaagugugccuuuuaaugcaaaagcuaugcgaucauucuacagccaacagccaauaugaagauucugaaacuucagaugacgaaugauuugcaaaguggcaacgugcagaaaggacagacagacaagaagcaaaugggcaggagugagccgaagugcugaggaugggaugcagcuguggcuggaaugggcaggagcaggccagugugaggacagacccagcuguggcuggaaugggaaggagaaggccagugugcggacagacccagcuguggcugggcaccgcugucuaccuuagaggauuaaggucuuguucuaaugggugaccuucuaauugcagacagggaagaaaaagagaagaguaacacagauaccauuucacaucacuuggcuuccauuauccucacauaggccaccgguguuuuguuuuguuuuguuuuguuuuguuuuuuucuaagacaaaauacaaaaauaaaaucaaacggagaguucuguggauagcucccauuaaaguguaauacucugugaagaaagucaguacuuugauaaggugcauucuagcaacguccacgaagccauggaaaugaccauuacuauggcugcaauacccacagaacaaucuuugguaacucagagcagucacugcagcaaaauccugugugcagcacagcacagcuuaaugaaagacagccuccaccugugccuggccagaggcaggguucuuugaagagaauaguccaucagcaaaaacaacccaucacuucuucugaauauguuuuauuuuuaacagaaauuauuuguaaaaguaaaguuuaaaauaucaacaacaaaccaggcaugguaaggcacgccuuuagucccaccacucagaaggcagaggcaggaggaucucuugaguuuaaggccagccuggucuauagagugaguuccaggacaaccaagacuaaguacauagagaaacucugucuugaaaaacaaaaauaaaaucaagggcuagagagauagcucaguggagaagagcacugacugaucuuccaaagguccugaguucaauucccagcaaccacauggugacucacaaccaucuguaguggaaucuggugcccucuucuggugugucugaagacagcaacaaugcacucacauacauaaaauaaauaaaaauuaagaaagaaagaaagaaagaaagaaagaaagaaagaaagacagacacugucucaaagagaaggaggaaagagagugggagagagaggggggucauguuuuaggucagucugggauacauaguaaggcaaaaccaacaaaucacaauguuccaauuuuacauuuuggggaggugucaaauuuuggaaguucagaaaaguaaaacuggaggacuaaaaaguagugacuaaaauuuacugucaguaaagugauucucaaguacuaagagaaacugcggagcuggacucagcagcaaaugccugcuaaccuggcaccugagaucucuaugagacugaggccagccuggucuacaugaguacauggugagauccuaucuugcaaagaaaacaguucaaacuuuaggaacugacgaggcccucuacugccuuucuguuuccagcuggauaagacccagaaauugucuagucauuuguugcuaaaauauucaaucuacagaugucauuucgagaccuuacuauucacuaagcaucauuaaagcgaugacagcucuuuacucuuucuuagguuccgccuccugaaugaacugcaaaaaggcuacauaacuggauauauuuugcuaaaauauaaugguacaaucacaugcaugauggagaauugugcucaacuucuuugugcucaagaucaugagguaaaaggguacagaacuagguauacacaggaauggaugaguggagaaagucaagacagacaggcagagagacagacaugaagacaagcauugcagcacacauccaugaccaaggcacaggagagguuaagguaguaggaagcuucauggacuacauagcgagaugcugucucaaaaaagacagcauuggaugugacaguuugugccuguagucacagcacuacagaagcuaggacagggugggcgugaguuugcuacccgcuugggcuacagagcauggcucuaccauacaaacaacaauaaaacacaaacaaaucacuacuucucaauggaaaaaaugauugcuuagcaugucugagacccugaguuacacacacacacacacacacacacacacacacacacaaguguaguuggaucaguugaaucaaugccagcuuccuggguaugacacuaaaguugugcaaaaugucaccacuagaggagaacaggucauauacauaggaccuguguauauugcuucacauaacuguacagauucuacaacuauggcaauaaaagcuucaaauaaaaauauguaauuccgggcuggagagauggcucagcaguuaagaguauauugacuguucuuccagagguccugaguucaauucucagcaucugcaugguagaucacagccauccauaauaugaucugaugcccucuccugguguguaugaagauagcuacaguguacuuauauaaaauaaguaaauaaauguauuaaaagccacuaaauccuacguugaagaugggagacuuuaaugggagccauucaucagcuuuuccuguagagcuuacauuaaggaaaaucagcaucacugcccaccgcccugaccgugccuaucaccaaggucgcucacauuauuuuccuauugugcuuucaguacagaugacacaugcuccaguaagaaaaaacaaguuucgcaccgggcgugguggcgcacgccuuuaaucccagcacucgggaggcagaggcaggcagauuucugaguucgaggccagccuggucuacaaagugaguuccaggacagccagagcuauacagagaaacccugccucggaaaaccaaaaaaaaaaaaaaaaaaaaaaaaaaaaaaaaaaaaaacaaacaaaaaaaaaacaaaacaaaaagaaaaaacaaguuucuacuagaucuugcuagugaauaaaaagauauagaaaucaguaacuacuuaacagacagaaagaaaucuaauuuaaaagaaaugcuugcaguuuauuuagaacaacaacaaauuuauuuuaugcucuaaaugauccuucaaaaauacuucagcccaguuuagucaccuuugguuuuaauucucagacuauuuagaauacgguuucacaucaguucuuuagaugggcaugguaagugcucagaagauggagucuggaggacugccgcaggucugaggccagucuggguuguagagaaagcaccagggcauccacagccagaccuuuucucaaaccauagcugaagagauggucggucaggcagugaagacacugacuguucuucccgaaccagcccuggguucgguucccagcacccacauggcagucaguguccaggaaucugaugauaccauuuucuggccucugcuggcacuguaggaaaauagugcaauauaaacagacaaauacacauaaaaauaaaauaaacacacaaaacauaucuuuaaaacuacaggcuaagauuauugaaugcauuuuucaaaaauauuuaaaaccucccauucugcuugcuaaaacauagaacguuuaaauacuuuuuugccuauaaauuucuuuuuuuaagauuuguuuauuuauuuuaugucuaugaguacaguguagcuauacagaugguugugagccaccaugugguugcugggauuugaacucagguuaagagcagucagugcucuuaaccacugagccaucucuucagccccuugccuauaaauuucuaaucugagauuuuccauuuuuaaauauuuauuuauuuauuuauuuauuuauuuauuuugagacaggguuucucuacauaacccuggauauccuggaauucacuauguacaucuaacuggucucaaacuugcaaagaucugccagccucugccuucugaaugcugggaucaaagccauacacucccaacauccagccuaugauucagcugucugcagagguugaaguaggguguuggaauccuuggacuuguaguuaauaaguguuuguaagccacucgguauagguaguaggauucaaacucccauccuuaugauugagcaaaguauucuuaacugcugagccuucuuuccaaccccuuaaauacucuuuauaacaaguggagaaagucaaaacugagaauuugcuacaucggaaauggcaacucaagaugaauucuguugagaaggaugauacaucuaucuuaagcccggaauuuucugcaaugucccuauuauagucagaauacacuuggaaacaagcaagaaccaagugcacacaagucuuccugcugauggucacagugauacacgugcucugcugauggucacagugauacacgugcucuggcugcgccuccuccccugccagacccuacacacaccaacagaugcacuguacaaccucauucaauaaugucacaguagucacuuaguuuuggcaguaaacuguaauaaaaaccagagcacuagacccaaguaaauacugcguguuuggcaaaaaucacuguggcuguguucuccagcacaguuuccaagauaaccaccagcucugcuuggcaacuggacucucccacaguuaaggcuccaacuguaaagcuggcuuacaagacauuuuccugcugcuggcuuuggucuguugcugcuccuaggaauugcuauucaauggcagcgucuucuuugagaaagcauaauuuuaaugaaucaauaguaucccauucaagaaacaauuauauuaagucuucaaguacuaagccauguaagauuaugaaguuugaggauggagagauggcucagcaguuaggcacucucacugcucuuggcagaggaucugggcuucaagcaguacccaugugccacuaacaacuaccugaccccagauccaggggaaucaacauccucuucuggauuccagagguaccaggugugugugcaguacacauacguaugcaagcaaacacucauacgcagaaaacaaaucuuuuuuaaaauaauugaaaaauuaggagugauggcagcauaaaaucagaucuaguauaaaauaccagguagccuaaaauacuggcauuucacaucaucuccuuguuuguuuguuuguuuguuuguuuguuugaggugucucauugcccaaguuagcucuaauuuuuuuaaagcaaucuuccugucucagcuugccaaguucuaagaugacagacuugagcucagacauuucuagaacauuuuaugugaugacaauuuuauuucuaaauugacuaauuugcuuggguaaugauggaaaauagaguuucuuucagauauaucagugauucuuaagaaagguuuccaaaugaggccagcaaacaaggaaauauuggcacuugguuugcaacagggucuggguggagcuagagaaauugauauggaauuucuagcuucaacaaaugaaaccaaaaagaaacacaaacccagcagccaaugaggacuguggaagucacccuaaagaguccaaagcaggugugcacauugcaggagaaguguuggugaugccaguaugcagggcauaugucaccacaugaaaacuacaccaucacccugguucccagaacagacuuaaacaguaaaucuagugaaagccuuaaagaauacuugacaaguaagagaguguaaauaaaucaaagccuggguccaacuuauuucugcauuuguucaagaugugaugagaugaaacaauguaucuuuuuuuuuuuuuuuuuuuuugguuuuucgagacaggguuucucuguauagcccuggcuguccuggaacucacuuuuuaaaccaggcuggccugggacucagaaauucgccugacucuguuuccccaagugcugaggaaacaauguaucuuuuaaagguaccaaucuuguuacuguuuuaauaguuuuuuucugaaguaaaaucaacuaaaacaacucuuaagaacuuuuggaauacuuagguggaacuuuaacacacauaguaaaugaaaggcuacuguagacuccccaucccauguuuguuuaaauaauuucucuaagaaaugagaaaguguuucuuuuuauucagaguguucaaugauguacaaaauuucccugagacccuuaaaguaauauuacagcuguuuucagcacaaaacuaaaaugcaccaagcaauaagaaucaaacuucacugcaagaaagaguaggccucuaugauaacauaaaaaauaagccaacuuaagcauucuuauugauuggaauggaaaacacuuuuguguaguuugagggcauaucaugaaucugaaaaguuccccacaaagaagucaugacacacuggucuacuagugaaacaaauuacuuauuuuuaauucuagauugcuggaauaguugaccacaguuuucucaaccaacaauagacauuuaugggaggggggaaaaaaagcucuguuuccucuaccacuucagggcaagucagagccaaugaacugcucuguucagggaugaguaauguuuuacccucuggucaugugaaugagucccuaguacccagccuuaagcaaacuuagccacaguucucauuucugagaaccaaaucagaaagacuuguaaagugaacuccuaaggguuuggaaacuugauuuaugcagugacaugccuuucccucuacccuguaaucagaucaacccauacugaucuuaaguuuaagccccaaucuuucacaaacacuguucugcuuaauaaaauuuuuaaaaauaauauuuauuauguuguaauuuauauuguacucaaaacacauuauaaaacacacauacagacauggagaagaaugcaacuccucuucaguauuucaacuuuccauuaaaaugcaaauguaaugauuucauuagcuaggcuacaauacccacagucuuaaaccaaaccaauauauuuucucugugaaucccaacuucccguacauguaaucuuauccuuaugaugguucuuugcugaugaauucugaguaugaauuuuagcauuauaauccuaauuagagcaaaguacaguaugugacuugugauuuuuaaaucuacagauuuauucugcuccccagauagacaaacaccacaacauuuugcuaaauuuuaagcaaacaacuugggaaaaacaacaaaacaaacaaacaaacaaaccuaauucuauuccaaaaauugcucaaagcaaacaaaaucuaucaauuaagccauuaacaagcaaguaucaugucuuuuaacaggaccuucucaagagucuggccaggccucacuugguuucgccaaacguagaaaacucuccauagaagaaacccuauaagcuuucuaacaguuagcaagcaggucuagggaagagagucaagcucugagugaagagugaggagggguguuugugaacgaccaaauaaaagagugagugccagagugaaggaaauuugggaugggacuuguuagagaucuucucugggauuggguuucauuucuucgggcgccccugaccuugccuucuccaacuccaaacgcuucgcccgcccccucccccggccugcgccugccuuugugugugccugucacuuaaggggaacagaacgagcugauucgggggcagcacaaagccaacacacagauuugcacagauucucuuacacacauuucccaaacuggaaggcacagcccacucugagcuugugaaccuugagaaaaguggguucuggucuuguuucagggagcagagaaacuauucuuuccccucucacuuagcgccaauaacaaaacgcgaggacucaagagaaaaaaagaaagaauggaaaaaaaaaaaaaagcccuccacguaguggauccugaaucuacacacugugacaucugucuaguguaguccacgaggggacaaacguguuggaagccagagacacaaacccagaacaggacccaaacaagcacuacuggagauaaaagagucaaacacaccgggucaguguucuuuccggggugucugaggaugaacuaggggcucccuggacuuauacuaagaacaggggagaggaggaucaaaagagaaaguggugguccccaaagaugaacucuuucaggaaggcagccccaagaaaacacucacuuuccugagacuaaaaggccagaagagcggcuggugggagguacaaagguaaguuuucuggguacagaggggagacacgcauuagcaggaagaagggaccacagaagugcaggucgcaggagaagggggugcugaauuaaaacuauauuugucagccauguugaagaagcuccuguaauuugugaggcuucccucuucccucuuaguauuugugggugacaugacaguccccgcaaggccgagagaaagagagggagauuggaaagggaccauuccgcagccgucaagagcgaggaaagaaagagagagagagagagacaggcgcggaccucagcgcucugaccugguucuggucccucagccucgcaguccaccgccgucgcagccgggucuccuuucuaacaaauccuacagggcagccaucuugcuuccuucugcuccucuacgaaagcagccucgccuccgcaucaauauucauaaggcaguuugacgucuguucucuaggcucggcggggccggcucucaggcggccgc

SEQ ID NO: 12084 - RNA, 106894 nt, Mus musculus
guccgucugucugcucucucucgacgucagugggaauuuccagccaggaagugagagagugagcgagagaggacgagagagaaguaccgaggcgagccgggcaggaagaggagguuucgccacccgagcagcccggcugcgcgcugacggcuucccgugcccugcgcgcccccggccugccgccgccgccgccgccgccgccgcccucggccugcucgcgggccggcucuagcagcgcaggccggagcucagggccccgccgcgcccggcccgccccgcgcuucuccgcccgcgccgcagccauggcgcgccgcugagccgcccgcccgcccgcccgcgccccgacccggcucgggcucccgccgguccgcgccgcuccgcagcgggagcccgcaggcgaggagaggccgcgccgcaucuccaggguaagccccggggcagguagaggaacggagccgccagcucuccgcaccacggugcagcgggucccacuggcucgaagcucccgggguucggggggggacuaggggagagccccaagcaggagucgcggaucgagcggccccggcugcggggaaagggcacauccgcacugggcggccccgaggccuugcgggccggcuggcggggcccucggcgucuccgcgggcgggaacgggaagcggagaggaacucuugcaaaguuuuagaaagauguacccaagccccugcggcgggguugggguggggugguggcggccaggcugagguccgccaccggccuaggacagauagaaaggugcuuggugcagugcacagccagauuucaccaaagggcggucagugaaaugaaagcagaagugccugucaguccuccuggcuggcaaagcccuucccagcuccuaagaaucagucccucgggagaaccuggggcccacuuaccaaucugagauagacaccccccccuccccauacacacacauaucaugcauucagcugccaaaucucaacuuugauuuucaaaauaauaaggagggccucacaccgauucuccagggcuggcauuugagagagaaauuaccuacuaauagcaccuuucagacuuuugauuacggggaaacucuaggauaauggcaccauguuuugugccugaccuccaaaacagaaaacgauacaaacaugacgccucugcuacauguaggcuuccuucggucuucugagacagacaccaaucuuggcucuguuuaugggucgagucuaaaacuuaagugggacaaaugauaaaaagauuucaucaucuagauuuaaucuguuuuguuuuuuuaaugaacuuuuaaaaguaaaggccaacacugcagcuuucuaaguaagcauauuuaacuaaaauuuuuguuguuuuagggcugagaacaacuugugguguuuauuaacauuugauggcuauggcaucaaauacuggggcucagacuggugguuaguacuaaagauggagauggugauagaguuggguggcuuucuagaggacucuucagcugauuguucuuggguggcaaaaaaaaaaugcauuaauguucgucagaccuuaaaaagagaaacuugauuaaaguaagguccuugcugaaguggguuuuuuucccccugauuuuaauauugcgcuuucuagagauggaaccucuugcuguuugaugcacgaaaaaaauauguaaauuauuuacaucgaaguccuuugcuuugcauaugaacuugagaggccuggaauuuaaaaagcugugcuuccuguugcauuuaacauuucucaccccacuggaugacuacaagaacacacauauugaugggaaugugaacucggcaacucuggucccuguugauacuucugggagucucuugcuagcuuagagaaaaugucuucuuggcuuaagacacugaguaaacuugaacacaaaagaaggcuucucuguacacuuaaugcuggcacuaaaauacuacacuugcugggaaacgcuaaccacuucaaaaccaaaagacuuuuaaagaaaguuguuuaauccuguuaaagguugguggcacccugauuaucucuguuaucucuuaucucuguucagaaauucaguugccucuugcuugccacagauggcaauuaccugagcugaggagguuguaaaugucccuggguuugaaagccaguuaguaaauacuagaguauacauacagaaaacaguccuucccuuuuguaagcacugcuuugaucuuucugcuuccauuuugacuucugccccuuaaaaguagcucagccaggcugacugagcugcagugaguuggaagggagccgcaucagauucacuggugcuguuccuuuucaugguccuuccggugaaucgaggcugaguggagaagcuaguauuucugugggcugucuucacgacucgcagacuuccagauaacugaugaaguaagccucuucguugacguucagggauugcucauugcgguagagaggucuagagaaagacuuggcaaccacauggacuguggauuaucauucauucaaucagcaagccaugguuucgccuaauuuauuuaugagguauuccccugcucugaagagggggagaguucuggcuucuacggagaagugaccauuuauaaccuuuaauuaauuugagcuugggcgaagaaaauaaagucgcuggcguuuuaaaauaauaagcuaaaauaauuauucccgaguugcuauguggauucauugcuuagccacacugaggaucaaacccggggccucgugacuguuccauuauacuucgauauaccuguagccuugcugucaggauuuuuagagaauguauucaaaaugccuuuucucccccuucaucuagcagaguguacugcuggaugccgcguucuagguccagagcuacuguguuagaaaguguccguggaacgcacuaguugaaucaaauagaguaugcccuguguccuguguguucuucuugcguggcagacugaggaggagcccuguccaggacauugaauguaugugaauggguaucugugggaaaguucucauggaccuguccucuggaaggaaguuguuuuguuuggauggcaugccaacuuucugcuuacaacaagaauuauauaagguaguguggcuguguuagaagaaaaggcccaggagaaggucaaauaggauuuuagugcuagaagacucuaccguacuuugugccugccuuucugucugacuagagcugauggacuaccugggcgcuuucgucugccucuggugauugugacuugcgcuuguguaccucucgucaguacugaaacugauugucguguuagaggugagcagguccaagaguaagaacagauguauccuagcagaugccuucuguuagagcacagagauuugaggcuguuagccaaaugcaggcacucagccucagggggaaugcuuggaagaagggcagucuuggaaggucuggggagaggcuugaaaaccacauaguuugguagaguuaauagcucuuaucaucguugugcuguugcuuuaaugaguauacauugucucucguugggaagaaagcggagagggggagagauggagagauaaagaagacaggagggaaggagggcgggagggaaggagggaggggaggaaaggcauucuuuucugccagauggaauugccuuccccuccuagcugcugcauugucugagaggauguaccugcaaacuaguuaauccuuucagaugagauuaggagaucaacaaauaguuuagagaagaagauaagccuacuucaaagccugauauaagaaaggacuugguaaagauugcgaaaucaagaggagagaauauagagaagacuuuuguuggaauauuaauauaucaaaaauacuuaaaucuaauauugugacgccauuacacuuuacauagucacuaacacagauguaauuaucaguaacgcacguuugagaggcuuuaauuugcuguuuguuuuaaaaacuggaauaaugauauauaaguuuuaauuaucuaguacaaauuaccuucugaugguuuccaaaguaaacuccuaggccccaaacuuccuaagcagcuuuuagucagaucccuauuucucacagauuuaaaguaucuacaguccuuauugaacuguacagacgggccugaacauucaaggaagauauaaguauuguacaaggcaccgucuuuagaagaaccuaaaauuguuuuuaaaagaauaaaaggcuguuugaaagaguaaguucucuaguucuagcuaaaagcagguaacagcucauccgugcugugagaccccuccaacccuugcauggacuuuguugguacugagaugacaccugauaaacagcuaagucacauucaauuguuucgcuagcuuguuuugacaggcaaccuuauccaacaggcaaugaaaagcccacuguucuucugguaagagagaagccccccaaacaguguuugcuccccgaguacaguauuuuauguggugcauucaugguuuauuagaauguauaaauaauuaacaguuaccuacuguucccucuaaaaaauacaaaaagaggaagucuuccauucaaaaaggggauuuuaugagauggaaaaccaucuuuuuaauuuuauuuuaauuuuaaagcuuuagagacauuggcaagcaaggucauaagguaauggaaaugauuaaacugcacuuacacagguaaaaugcuuuguguguguguguguguguguauuuaauuuuuugcaguuauuacuucucuaaauuccacugaaacuguaauuucagugcuagccucuccaaaaagggaaccaaugcuaacaaaagauugcuaacacauauucaaauccaucaagcaaacaucuaaguaaaguacggccucuaugaguccuccucugugccugcuccugggaaccagagggacaacccuaggaggccuucugugccucacuuucaccuuguggugaccuugccuacccgccucccucaagucagccccacuagucccucaguuguagcacuuucaggaaauugagcgugaaacuaugcaucugaccacguguuuaagugaaauauauaccagccggacuagaaaggagcaagaugcuggucuccauccugaugucauuguauucaggaaggcuuaggacaggcuucuugguugcucucaauucuuauucugguccuugccucgcuucacaauacucaaaagcauauguccacauugagaaaaauuaguguguguguguauaguuaauuaauuaguguauauacuuagugucugucuaaauaaagugauauauauauauauaguaucacuauauguguauaucgccauguauacauuugcauacauauuuaaucuuuuguuguugccaacacacucaagagaauguaaguguuugcaugggaagcugucuuugcugagaggggcuguggaaaugauuggcagcgguugucaguuaaaaguguauacaacccaagcacacugccugugucuucccgcuaaugcugcuaccucaaagcaguauguuuagcugggcuccaccgcaugaucaacccauccugcagcuucugcauauaucuagaauaaacaaagcuguaacuuguucuagacgcugugcucgucagagacauaugcauagccauacauauuagauuuaacacucauugguuuauuuuauuuuuuuccccuucaguguaaaccuguugauaagcaaggcucaguagagucucuguagcgggcuuacuauuuauaagccugaaguaagaaacgcucuguaucggguuaaguguccucuagagaagaaguuagcauuuaagagaauggaguguuugaaugaaucuuauuuauucaaauagcaaaaagcuuccaagucauuacauuuguuauguauccugugguuagaacugaaccugcuaugccguagauccaugugagagcacacccaccggcuaccuaccauauccccuguaguucucaagucucuccgugugcggagaagaauaguaacggucucuacggagcaacuggcucucucugucaagcccacagcucauucuaauagaaaaauaaauggcugaauuguuuuagaaaauauguccucaaagacaggaaauuuaggacugagauagugacucuuccagauauguuaauacaaauuucuaccucguggguuuuuuuucauuuccauuuuuuauuagguauuuucuucauuuacauuucaaaugcuaucccuaugcccucgccccacccugcucccuuccccaccaaaccccacuucuuggcccuggcguuccucuguacugggacauauaaaguuugcaagaccaaggggccucucuucccaaugauggccgacuaggccauguucugcuacauaugcagcuagagacacgagagguacugguuaguucacauuguuguuccaccuauaggguuucagaccccuucagcucuuggguacuuucucuagauccuauauugggggcccuguguuccauccaauagaugacugugagcaucuacuucuguauuugccagguacuggcaaagccucacaggagacagcuauaucagggucccuucagcaaaaucuugcugguguaugcaauagugucugcguuugguggcugauuaugggauggaucccuggguggggcagucucagcuccaaacuuugucucuguaacuccuuccauggguauuuuguucccaauucuaagaaggggagaaguauccacacuuuggucuuccuucuucuugaguuucauguguuuugcaaauuguaacuuggguauucuaaguuucugggcuaauaucuacuuaucagugagugcauaucaugugaguucuuuugugauuggguuaccucacucaggaugauauccuccagauccauccauuugccuaagaauuucauaaauucauuguuuuuaauagcugaguacuaccucauguuuuaaugacucuucaagaugcuccccuagcugucaguucuuauacauggauuucuuuguaggcauagccuuuuauugguguuugccuauuaaggcuggcuuaaaggcuuucauaucauuuuuguuaaggcgugggcaugguauagaagacaguagcaucuaguacaaagcucuaccuauggugaacguuuuaaauaauuacauuuauuaauguaguuuggggaaugaggagacaacucacaggaguuaguucucugcuuucaccauguggaucuuggggcucgaagucaagguuguauggcuuggcggcaagugccuuuaccuggugagccaccuuaccagccuuaugauguacuccuauggcuuagaaauguaaagaaagacaguguggagggccagaugaaauguggauggccacucauaggggugggggugggguauuugcagcagaaagaaagacccacauagaugagguugagaauaaacaucaagucaaaccuguuugcccuuuggccauuuauaaagguacuuucgagaauauauaauaccagugguuuuauaaaacuaaaacugaaaauaaauauaaaauauaggaaguggaauuuaaaaaaaaaauguauucagacuacuucuuccagaccagguaggaaaccucugaaggauuuucuagaggcgauggauuaaagugaaccuaaaauccagccaguugaauauuuauuuaaauaacucauuucuaaugcuuuuagcauuguaacuaagucugugcaggugucauuaaaccucagggccuugaaagauuuggccaaaacagugacaauggaaaaauaaacauuagggagcguccucuguaagguuagaucucgaauguggaaaucaaauaaucuagaaggcgagucaggauuccugagaaauggauaaguuaugaacaucacaguugaaaaggucgugaaggaagagucguugccugugacucaguguuuguaggcauuuugucucggccauccuguuuaggaacugcgaacaguggagcuggagauacagcuuacccacggccuacuugccugcucugcccaagaccauggcuuuuuaugcacagggcuauucuacauacuacacuuaaaaaaaaaagucacuuccccuauucuaagaaacauccuaagaaaacauugcugcacuuggggaauuaaaaucaaaagcaugguaccuggcaauaacuaaauaucucccauuguucuagugcuaauuauaguacucauuuggugcaauauaguuucucuccguguauuuacccaauuccccacugaagacauuuaauucaauuucaacaaguacacagaaccauuaaaauauuuccugauuauuuaagagagcuaugugcuuggucauuuacccugcaauuaugguucuuuucuuuucuuucucucuuucuuguuccugaugggugggggaaacacccuccuucucuuagaaagucugcugugauagccaaauaggaguuaguccuaguugcuguugagguaguuuaaucccuuguugcaauagacagaugaugguuuagacagugucucugcacuuacuacacaucugcuaaacagaaguggggcggccauugggacaaaucacagaaaacaggguucuguugcucagcugccucagcaucuccacagagaugcacugcacuaguaugccaguuuuaaauuucucacacuccuccccuuucacgccuguuacuucuacagaugaggggacaccauugcugucccuuugcaccauucuacaggcuucucccucucagagccuaacagcccuuccuuccuaaaccccaccuucuccuucaguugcuccuagagucucuugaucugcagccucagaccaagaggcccacgccuucugauggauuucuggcuuuugcuucucccugucucccaagccaguguucugcuucuggagccuuggccuuggcuucauagcuacuuucuuuccuucucugagguaaaucacucuugucuuuacagcucucccgcuaggccucagcucccuaauuccucacucaucuccuaauccucaagucaucccuaccggcuuccagugccccacccccacccccugaaacuccuuaauacauuugcaagagaggauuuucuuuugugcucacccuacugguugcucaaccuuaggcugggcucagcaccuucaguucucuguuaggcuggccucccuguaagagacuucacuggccuuucugcguucucuugacuucuuauguauuuuuaaacaaaacaugcugaguauaauaggcagggguuauuuuauuuaguuuuuauuugccuagcacucuuucuguuugcugaaggaacaaguaacuaagcaaaaugauuaagaaguugcguuccccacuaagcugugugacucccgguccacaaauuaacuuccuuggauccuggguccuguuuuguuuccaggagagagagagacagagacagagacaaacagagagagagggagagagagagagacaagcagagagagagagagagagagaaacagagagagagauugcauagauuagaagacuucagauuuucuugccaucuugaugggcuaguaaacagaaagggcaugaauguucuugauguucaaugacuauaugaagaacuguugauuguguggauaguggguuacuuuuuggucccgacaguagacguuuuggggacuuuaucaugcaguuauuaacuagucucuuacauuuaacuuaugcaaggaaaacuaugacaaauuugagaaagacauugaauauaaacuucagaaauugagucuaagucaacuccaguuuggaagaaaaaaaaagagacaguagugauggaguaagcuucaucugucaccggaggaaugcagcucucaacaugacccugacaaaacuguaagcucaucgcugggaauaugaccagaagguagaucacagagacgucagguuuagggcuagaagugggaggagagagggaggcagccuucgcuuauccuagcaaucauucugaaguuucuuuccuuccuccuuccaaccuuuguguaggagaagugacacaugacaccgcauaaacuuacgggguacacagcaauccuguuuacacuucaggaaaugauugagugcagcugacauguguagaguuuuagccuuacagaaacaauucauuugaggagccuuuaaguccuugucacgggccaggcacuuagaacaacaauacugaccaaaacagaaguacacagccaaauggaguuuagguuaauggaauguuuuuaguuuuacaucucucgaaagccugaagaacugaauaacuaagaacguguccagauaauggaggaauauccuuagugauuucucuuaaggcgagcauacuuagucuugguggaaguuaaaagguaacauauugguggccccucaaaauuccuccugcccucggagguccucugccugaaacccuuaucuaaaggacaccacccacgcucuuggguuuuauaaacauugguccugucacucacauucacucaccugacaguaaaucaaggcauggcaacacaugccagaaaccccagcacucuggaggaggcagaagcagguuugugacauaauaaaauuaugucaaaaacauaauaaaauuaugucaaaaacaacagcaguagcuaccaacccaacccaacccaaaaauccccacagaacagugagcugauaguccuaaguagccaaggacuuuaucaucaacucguuucacaguucccucacuaaacaucauugauaguuaaagaaacauuaugcuuauuugagcaggguaauggagcccgcugagaaggacaacacacaggagagagacaucuucacucugaccucagcugugaugggguaaaggcagccucgucguccuuggccauguacuguacauuggcaucuguguagagucagcaguacacaguacugacagggcucucaauuagacucagcaguacucaguacugacagggcccucaauuagacucagcaguacucaguacugacagggcccucaauuagacucagcaguacucaguacugacagggcucucaauuagacucaagggcuaaaugagcccugugugaaaccugccuuuguugcuggcaagucauuguaccuuugugugcacgccuggaaaaccuucacuuggguuguuccucaaggauaccaugucucaccccagccuggccaugccuguaucugcagggccaaacuugcugauucacacaaucaauccuuucuuucaggacacagggcuuggaaauguaggugauugguagaacacucgccaacucaguucaagguuuggauucaaccuccaacaccauaaaaugagacacccccacccaccccaaaaucaaucagaaaagacgcauuuuugaggauuuauuuuauaaacauccaagguaugucaacucauucagaaccaacacaaguggcuugauuucuugauuucugcuaguaaucuaugaagucauugucucccucagucuggaggugugaucauucuagcugggaacucaacaggagaccaggcaucaaaauuacaucccguucugcauguuuuuaaggaagcacucuguauauccaggcaugggaaguggauuuccagaacacaguccaguagacaaaugagcagaggccuugauuugacauuuaugaggaaaacccaggcagggcuuacuucaguuauaagauaaaacuuuuuaucugauuuauuaugauccuuagagacuuuccauagcucuacaaacuucucccagcaggacugagcccuuucugauacuacuaaaaauaaauuuuacuuagaaugaaaucugccauuugguauaaaugacacuuaauuacacuauggcuaaaacacgucccaaacaucuuuuugaacccauggauguuagucagcuaggauuaaaagauaaccacaggcaaagguuuguuucuuauggaccacgauggcacacacucuaaucacugugcuaagcauuccugucuccuuagugacagugaacaugacacaguaagacaauagauguuucuuucacacaggagaaucuggcuauguauauuuacuuaauuuuauucagaggcuuuccccuuccuaccaccauguuggcuuaacuacauauaucugaguauuuugaugcuaucuuucugucacuaguuuuucuugguuuuugggggggaguuuguguuuuuuuuucuucugaauaucauguuuagauuauguaaguauucaccggcuuucugucacuauaaaccaauaccugaguugauuaaugaauaaagaaaaaaagguuuaguugaugaguuuugaagguuccagucuaccagucuguuacugcagacguccaccgugauaguaugucauggccagagcaccuggcaaagcauaaacuaccugcucgucaaucaggaagcaaauagaaaagagaacugguugcggucccacaacauccuuccaggucaugucuuaguagagcacuucucccaggagaagcacccuguuggccuugccgucaacacaugaacagcuuggggacuccuacugagguaacaguacccauucugcauacauucccugagauuaacugagacuugauucauggcccgcuguuuugucugccuuugugaguguucugcuugcagcccuacuaaacacagauggccaaugugguauucagaguagugggccuuuaagagguuaugaggucauagcacauacccugccccugccaugaauaggauuuuaaagggggcugaugaaggagggucguccccucugacucuuccaccuuuacugugugacaauagagugacuguuuccucugcaggagacauuccucauuugcgugcuuugaccuugcacuucuugccuccagagugauaagaaauaaacuuauguuuuuuauaaacuacccagacucaaguacuguuuaacaguacagacauaugaagauaguuggccauguuuguagucagcaccgaaagaggaaaguugaaaacuuccacucugcuuguggauuucugucucuuccacaaauguuuaggucuaccacuuugugcuucauguauucuggagaccuauuaauaagugcaugcagguggaggucauuaguuuuauaaaggcucaguaaugcauacauauaagguuccaacacucagcaucuagaggcaggaggguugcugggaguuugagcccagccagggcuaucuauagagacccugucauaaaaacaacaaaauuauuacugcccauugaugaccuggccccuuuauucuuauauauauauccuucuuugcccuuaguaauauuccacccccugaucuucucuauuggugguuaugauauaaacuacuuugcuguguuuaguauuuguauuauuagcacaguaucccaggcuucugcuuuuaaacacuuugcgucuuucauguuaaaaauaauucauaggaaaagcauuuucuugcgucuugcuuuuucuguacuguuuaccaugaaugcuuuuuauagcugaguuuauuuuauuugcauuuaauauaccucuucuuuauccacauuuugucuuucauugucaucuuuuaaaugaaauaaacguagcacuugaagaguuccauuuuaucucccgucugguaguucuguaaaacgguggcuuucuguaguaggacuuucugcauccugcgucuauagcgagugaagcgcuauguaccuaauguggaagcuuugauuuguucucaccucucugcuagugcugguagacuuuuuucccuccauggguucagaauacuccauaauauauuguguuguucaauguguuuguuguacaguaaguuugaacauacugcaaagcgaaagccccaugugcccacaccuuuaucaccaguaguguuuuccuuguuucuuaaagguccaauucuaucucauuucccuucaccacaaagaucugcuuuuaggaugucuucugucacuucuacgcguuaugaauucucucagcucugcuuuauuagaaagugucaguuuaccuuuauugucaaaccauucugggacaaagcuaccugcuucuuuguggcuucaauguuuuuguuguucauuauagauaucaugaugugaagaguuugcauguuuuucuuuuauucagaguugaguuuuguccuaguaggccuuacuaagaugcauuuaaagucgcccuuauuuuaugauguguucuugacucuuauaacacgguuuuccccuagacugcuauaagcacacauguucagaacguuuacugaugucucuucagcccacgugauugcacccucagugucucucagcucuguauggcgucuguaaucuuaucagagcauuuauagaacaacaguggcuuucacugagcuuuuugggaucucuguuaggauuucaucagaguaaaggugggcugauuauagauuuuugaggcuuugcacauauaccauuucucugaccaaugagaucacugcucuuuauuugaacucugcuuccuguggccuggauuagaaagugcccucagucagaaggugagcuuggaguucacuuaaacugugcagccuguaucucuuguuuagugucucaggcuauuguguuucauaauuacauaugaauuuggcaagaucaaauagugguugauuuauaaugacugaaauuagauuuguguggauuuuuaaagauuuuuuuuuucaagacaggguuucucuguguagcccuggcuguccuggaacccacucuguagaccaggcugaucuugaacucagaucuaccugccucugccucuggagugcuaggauuaaaggcaugcuccaccacugcccagcuguagcaugcuauuaaugauuuugaaagacauuauuccagggcauuuauauauucaauauguuggcuagcuagcauuucucuacagcuuuguuuugaaacuuucucaucaucccagaagagugccuugaaugugguaaaugauggcucccuucccagucuucacucacuccccuggccucuggcaagcaaugauguguuccucuuccuacgaaugugcuuguucuugguauucaaugugaagggaauugaguauaggugagcgacccuuucugucugguuucaguauaaaucauuuagucuacugguuuugaaauacaaaaucaaaacucccauugcuggcuguaaggcacaccauuuaaggagacuguaaauauauaauguaugauuaaguugcauagaaacagugaaccauagugcaaaaccaccaggaaauguuauagaccuuauggacugaggcgauaacaguggaagagaaaauacagguuuuauggaagaaguugauuuugaaguaccauguuguggaauacauaauaucuaaacaggauagaaucucgagugugaagagauguacacacuggaaagaaaugacauagagcuguuacauguguguguguacacaugcgugugugcguguaugcagugagcauucacauguguagaggucaaaggacaauuuuggaagcugguucuuuccuucgagcauguaaguuccaaguaaggacuuagguccuugggcuuagcagcaaguguuuuuaccugcagagcccucuuguuggccaagcaaugcaucuuuaaaugauugauuucccuauaguaaagugcuuguguuggaucauggugauaguuguggugcuuauauaauauauaauauaauauaaucauaugcugaguaguugcucuuuggacuucacuauguaaagcaccuggcugugaucugaaagauauuuaaucaggaagauacccugccaugggggugagcgguagaaaagcuguuucugucagagugagguaauaaggucugcccuaggguguggcuauggacauagaaaggaagugcacacacaagaaacagugugaggaaagaagugagcgacaacaagacuguucacugcauugguuggagaaggcuacauuugcaagaaugagacagucaggagucgggcuuguugucgaguaguaaacuguagacauuaggguugauggguuuaauguaucauuaacuuguuuucuaauggcaucguuaccuaaagcuaacaggggcucauuaccaaauacaccuucagagccuuaacaguucuaaucauguacugaugucacggggguugggcucguaucuuggauagcuuggguuuuuuguuuuguuuuguuucuuuuugcucuuuccuuuuuuuaaaaaaaauuauuuauuuuuuguucaauugagaacucaguagccgauggagaaaagccagugcaaaguccagaccgugacuaagaguguaauuaaagcugugauacugaauugccaggguaauuaacccaugcuccacacgcccucuguucccaugacacugaccaagcuguaucguguaggcugcugucuuuccauuuacuaaccguucugauuggcuagccuuugcugcggcgagauaaaucaugaagaagcacauagaaacacagauaugccucauuucuugcgaccugugacuguguguggugauuugucuggcugcucuguggagguccucagcugcucugccaccgagggcucagccugggaagucuuggcugagcucugcugcguuuccacuccacacguggguucucauccuccacugggcuggccaggccuuucccuuccaggaaagaaaauccagucauugaacggcuucuugaaagccauguucaugacucaugucugcauccuccuguuggucagggccugccaagggccugacaacauucaaggggcagagaugucaauuuuauugucccuguguugugagggauagaaaagggcaguggccauuguuuugagccuacuacagcuauaagcccugaguucagacuaugccacucuuguguaguuuuguuucuuuggaaacugacaggguaggcaaaccucuuucugauggguugaugaagggccaaaaacauccagguaacauuucaaacaugguuucccugugauacagaccauggcauacacaaguaucacaaaucuguuccuacagcacuguggaugacacacacacacacucucucucucuuucucucucucucucucucucucucucucucucacacacacacacacacauguuuuaauuuuuaguuuagcuaacuguggcuuuugugagauauucucucucucuuucucucucucucucucucucucucucucucucucucucucucucucucucuuucucucucucucuuucucucucucccuucacguuuggauugccuuguaaguagcucaucugaaauucaugcacuguaagguccuauucuguucucuggguuacacuguagaagaguucuaugggcucaccagguacuagauguaggaacagaaagcacacucgggagaaggcauguugcagaaacgagagaaacaugcugagacuccuaaugugcaucuccccaguggagacaacacaauuugacuggacagugugugcaugaaggcuaaagagcgcucagggaauauagagggagccucuucccgcuccagucaccgugacagcaugcuacuucguguguuggcaugcacaaaauuggcagaacgccucaaguguggagaauucaccauuauaacaagauuauaguaagcaaaaaaucacuccacaucacguagaagagggaguuggcaaaggcggcugguuuaaagcagcucuuugcaaucuucucuagagggucuuaucugaaagcaaacaaaaaacaacaggaacagcuugaauguuagcaguuauccuggcaggcagcacuccaacccagcccagcccacccagcccccagcacagguguguaacccuuuaguagccuacuuaauauggcugaagagauagauggcuuaacuaguaagagugcuuacugcucuugcagaggacucaggcugguuccuaacucccacaugaugacugacaaccuccugucacgcugguuccaggggaucuggcacuccccuccuugccucugccaguacccuuacauuuguggugcacagucaugcuugcaggcaaaacacucaagccacauaaaauaaaaauuaauaaaaccuugaaaaaaagauccuagcuagcaguuaauaucaugaguagacuagcuccagccagaacuuuugagaggcuugaagcaaagauguuuuuaaaugaauaauacuucugucaagaggaaaaucacaucacccauuacgcuaguacaagggccauaagcugugcaguuagagaggccagcucuagucugucagccugagcaaaugacucauucucucugaagcuuggcucuucagguggacucuacuuucugggcucagcauagcaagagggcagcauacguaagcauuaccuccgguuccuuaguuauguggaagcagucugucaagcuuagcuuuccccauacaaaggagagcacuuguccugaggccagagcacucacuggcuucuccuccucagcguaacuggcaccagggauuagguaaauugucccuggguuaauccugagccuuccaggaucuuuggaucacuucuagaagaugguaggaccagccauccaguccugugagcccagaauacuucagagaauaacuucuaaacucccccucagggaaaaauacaaguuauaggguaauggcaugcaaccacuucagacucaaauauguuagacugucaguagcuauuggcagaaaauuuaucugucuuugcuacaguucuauugcugugaagagacaucaugaccaaggcaacucuucuaaaagaaagccuuuaaaugggccuggcguacaauuguagacguuuaguccauuaucaugauggcagagagcagaggacacaggcaggcacagaaucaggagcugagaguucugcaucauggucuguaggcagagaaagacagacucuggacuugggaugggcuuuugaaaccucagugcuccuccucagugacagacuuccucuaacaaggccacacuucguaauccuuuuaauccuuucaaauagugucacucccuggugacuaagcacacaaauauaugagccugugucuuucucaggacaacgaaaaguuuaucuugcaucuuucuuccuauaauuuaucaugagugagcuauuagacugucuggugaguuaacauauguucuguaucucccacucacuaauaagcuucgcauggauuagcuagcugaguguuucccaugggucugccagcccauuaggcugacacuccaucaugaauggguuucuucgucagcucucagauuugcauuugcagugcgugcauguauuguucuaggucauugucacgaugcuccuggugaaauaauauugaaaauaaaagaagugggaaaccagguucuguaaaucucagugugguagcaugcacagaaacauugauuuauuuuuaaaagaaagcuuuuagaaaucagcauuacugaaaaaaaaaaaguccauugccagccuuuaucauuagugugacauacugucagacaggaggacacacagaaagggggacgcuucugaagagcagucaggaauaauuaggaguguugacgaauucauacuucauauuuuauuuaacacugucagggcauuuuagguucaaugauuuaaauuuagauucagcccccuuuuuauucuaauacaugucuaauguguauuagauaaauuuccaugucacuguacaaaucuccccauuguuauagcaauuccauaauauuuaacuuacaguuguagaacaagaaugcaaacaguuagaucagagcacaucacaaacuccugaaaaucgacuugcagaauuuacgcccucugaauauuuuacaugguauacacuuuauguggccauagcccuuacauuauguuuucuucaaaaaauucucuauggaaaagaaacuuuaacauuuuauaauuuaaucuuuagcaauuuauugugcgugcaagauacaaaacaaaaaauguugugaaaagucucuuuucccaguaucuuugccccauugcuaaacaaaacaguacauuaaaugacaccuaagugacaccuguuaugguuacuagaauuuuaaaccacccugccaccccacccccucccugauuuccaagugcaccuucuagcuggugucugaccgccuacuuuucauagugcgcauugugguucucuuuggauuaugguauuuuaauggguuuggaaauuuagagagccuuuucccccaaagaaaucgaacagaacagaaagaguuguugguguuggugguguuguuguugguggugcuuacagugagucaggccucggcugccuauaucucugaaccuagaugcuauauaguuacugacaggaauucuccugacuuuguccuugauggcauacagccaugccuuuagaauuucuccacucaguccagcugcuucaccaagaugccccugugucagauugaguuacuaggaagauugccacaggaaugcaggaaacaguucguucagcauucauagaauaugucacauacucaggacuuggcugguuuuguuacauugugcuuuguaugaaaaccacaacuccccggauauuugcugagaccuagcuacauuuucugcgucuccuuauguggugagaagauuccuaaagauuccugguugggguagacaaaugcauaaaugagacccaggcuugugucucccuuugugucucaagguccuuccucaaaagcacaaaaggaaagugggggcaaggcugagaaagcagggguacauaagggacuuucccacugcuuucucauccccagcuccaaagcuuagucgauauuucaacauuuuagguauaaacuugcuuuugcaaucaaugcaaauauuacucagugauucauccuuuccaagugacucucgguuucuuucuuuugacauuuaauuuaaaauuagaaauuagcauuuauaucaugcuagagcugcacuuaccuuucaacgccucaguaauggccaaggcuuuaugcgucaagauucuaaggcacccgaguguuccuugagcuucuguaguaccugacggaguuaaguuuuuagccacauauaaucuagaaaccguaggagagggugccaugaugacaaggugcccaguauggucguuugucagacauuuaaaguggagccgucuucauuagggccucauguagggaauggaccaggaggauacccuuacgucugugaagugcgguuggaguugaaucuuccaaguuggagugagacuucuuuauguuaaauucccccacucaaacuucuacaaaucauccaauuuuaaagaaugauuuuuaagaugauaauauauuauaucauuuccccuuccccugccuccaaguucuuucauguaccucucucucaaaacuucaugaccucuuuuucuuuaauugauguaucuuuuucuaaguacaaaaaaaaaaaaaaucaaucugcuccauccaucuaauguuacuuguaugaauguuuccauuggcauugaguaaccaaucaguguacauuuuugggaaacacaauuucucaugcucucagcuuucccuaugugccuguaguucuuagucuaggguugagaccuccugagcaaucucccuuucacauugccugucuguuggugccauccuuguucagguacacacagaaucaaugacauaaagguacuaaguggguuuggacaguuuaauaaggcaauaaugucaccuccaccuuagaagauugucuuuggauuguuaggaaagaauaucaucacccagguuaauggaaaaccuagagucauaaggauaguguaaaacauuguuuguggaaauuaauuaguauccaaagucacauaccagacaguggcagaacccugguauuuucaaugaugucauaccccuuuacugcaucaagucaaaauuccccuguuuuaacuuuuuugucugaauaaauauguuuaguugcagcugcuuagagaguuuuguuuuguuuguuucauuuuguuuuaagacaagaaucuuacuguguagcccuggaacucaccauguagaccaggcuaaccucuaccacaaagacaucuacuugccucugccucccaaaugcugagauuaaaggcgugugccacuacacccagcucguguuuucuuuuuaaguauguauguaaauuguguguuugugugugccugcauaaguuuauguauacuuuaugugugcagguacccucagaggccagaagagggugucagagcccuuguaacuggaguuugacggucgugagcugcgcauguaaguacugggaacugaaucagggccuucugcacgcuuaacuguugagccagcucuccagcuuguguuuaaacauuuucaaguguuucuuguuuuaaacaaccccacuuccuugcacacaccuuugugaaguugugccaaaggacuuagagcuccuacuuuuccuuuaguuggugcuggcccugcuccauguggcccugggaguucuccagagccucccgugcaucccauuagucacgugguguuauagcacagagccuuucacuggaaaugaagccucaaguuaugggaaugucccgagauguuuuuauuaguguaagauaggcuuuugauggaggcuagacaguacauuggauugaaaacuaacuagccuccauucuuccaucagccuauguucaagcuccaaggugggcacaacagccccauccuuugauacagagucuguucccucaugugcuagaagccagggcuuuucuacauuuggguuuuauucagcauggaacgcaguuuuuuaaaaaaagauuuauuuauuuauuuaauguaugugaguacacuguagcuguacagaugguugugagccuucauguaguuguugggaauugaauuuuuaggaccucugcucacucuggucggcccugcucacuccagcccaaagauuuacuauuauacauaaguacacuguagcugacuucagacgcaucagaagagggcaucagaucucauuacaggugggugugagccaccaugugguugcugggauuugaacucagggccuucagaagagcagucagugcucuuacgcgaugagccaucucaccagcccagaaugugauuuugaggugcagauagaugguucuauguguuuaucagggucucugggugccugaaggccgcugaggcugcuuauauuaauagcuugcuaaguucaguaaguuugagacuuucagguuugauguuuucacugguuauuuuuuuagugcacucuuuagaguuacagaauuuucauugcacuuugacaaaggcagaaugacucucaccaguccucacaagagggcagggggugucguucuaugcccacucaaguguuauguaaaaugguaucaggacuuccucagccucucaaccgagucuagacaguccuaggaccaucucagaguucaugagaaaaaaaaugcacaaaguagaaguggccacaggguuccaucuggaccugauuuuuacccagagguaggaccagcuguaucaaaccgaggacccugagcuuagccaaaggguuuagaucccguggucucccuacaaugagagguagaugccaaggagguacagcacgcaugaugcccuccuacagaggucuuuuuugcagacauuuguggucccuguagaaauacagccuagcccugcauaugugccagaguuguaggaucuuuaagauucacuccagugcuacagcuuucauuucuuguucuguuuuguacagcuucaccauggcagacgaugaucccuacggaacugggcaaguaaguccucagcucacuagcaacuuuguuucaacgcguucuuaucccaaacacacagaggcaacgcuaguaacucaguaucaagcaaacccuaaauuaguaaacacuacucuuaauuuauuuucaguuuuucuguucuuccagaguuggagagggcccuuucuuauguauuuuugcauaaaaccguauauacuacaugccagaaaguagccacugagucaguugugguguugaaggucugaccccaguauuucauauggugacugguauauuaaaaaaauugcuauucagugagauuucuagggcugcuauuaacaucgcuacaaaccuggugacuugacacaauagaaguguauccuuucauaggucuggaggcaagaacucugaauuuggggcuggcagaauaguucccaccuccuaccacugcuggguguguuuagagauccuuggcaucacaccagccacagucuguuguuguguggcuuuccuccacgucuucacacauaccaucuccucugucuuaaaaacacaucacuuuuuggauguaggauccaucucugucuagugugaauucaucuuaacauauauaaaggcaaaggcugccguguccaaauaagucacaugaaggaggagcacuuaugaauucugaauauauuuuuuuucaaagguacuguaguuaagcccacugcagucugugggagugagugugcuuugagagcggagcaguguuuaucaucacgucauugucgcugucaucauaggugugacagcagccaugacacagacugacacgaggauaucuguaucuucacuuuccuucuaguuuuuucucuuaaaaaaucuaaacccauagaaguguuagacagucugaugauacuuccauuucuuucucuucuccccauagagaauauagggagcauagaacugauucuugaaagcaguuucuagcugcuagcaugauuacaguggcaauauuaaaaguggacucuaauggucuauuaaauuauuuaaaauacugguaucucuuugcuccucagcuaucuacugagacuuuauagaagacuuuaugcccagaacauuagcauccuagagacgaagggacaggugauaugcucacugggcucaggacugcaucccggcuggaguaacggaaccacacuuuacacagucuguggauguugccaugguucacugagagacagaagcaguuggagggauugcuguguguuccuuuagggaaagagcagguuaaggaugacuuugcaaaggaggacuaagcugagcuuugaaagcuacaaccagugcaggggcacuauuuaccaagguagcccugccacaacauucauuacuacuucacauuuaaauuuuggugguaaacacccgagacuaccauuucccaaauuuaugcucgcaaagagucagccaaaaauaaaacugaaaaugaaauauuugggggagaccugguguuucuauagucacacagccccagagccgcagucagagcugccauggccugcaccguagugacagcugcaguggccucagagcugcagucagagccgcaguggcccucuucuucucacccagcgggcggagugagcaugcaccauccgcuccugaccauguuauaaagauggugguacuggguaaaccuaaggauguuuucuuuuauggcagcauaaaagacaccuggcaaccauacgcucaaaccccuuguuuaaccuuucacuuuuaaugggccuccucuaacacaggccagcccucaccaccaugagagcugucugcuugguuucaaaccaugcuuuucugucuguacacaggaaaucuuagcaaccagagauggucuuuuaugccacaaaagaguaagaccugccaaggacagucauuuugaaagugucucaugugggcagcaguucugagcucauuagcagggugggcauguucugauaguucaguugugggggaaggggaggcccuuggaggcuuuuaaguuuuugucuuuggguugguuuuuucuuccugucuuaagcuuuaagucuaucucuucuaaaguuugcgauuuuugagggagguguccuccguguuuuagccacacuggaguuuguucuccaccugucaccaagcaaacaccacaugccgccuucaacaggacgucugucuuagugggcuucucccccagccagaucacugcagacagaggcggaaccacagcaaaggacuucuuugugaggucguucucuuugcucagagauggaggccuggagcuuauuauaaaaccuaguuucccauucagugugucuuucaugguuaauagcgaauggcacagaugcgcuuugcuuuuaaggauugaaauauaacacacucuuugcuccucaguugaaaauuugcaucccucaaaaguggauuugaagugacucgcauuuaaacaucacauuuuaggggccaguaagauuuuucagagagcaaagugcuuacuaaguuagcuugacuuugacuuccuccacuacccacacauaagcacacucauguuacacacacacacauauccaucucauguuaaacacacauacuacacauacauaugcacucuuacacuaugcacacauacacaccuuacacaaacauauaugugcauacacucaaacacacacacucacauacucccacuacacauacauacacuuucacacuauacacacauacaugcacacacacucacacuacauauacauacauacuuucauacuacacaugcauacacacauacuacgcauacauauacacucucauaccacacacacauacacucacacuacacacacacauacacauucucacacuacacacacaaauguaauaaacaugcaagcauuacucuucuuauucuugauuuaacuagacauaguaggauuugagguacccaagaauaucuagugauuuacuaauaaggacaaaaaaucccaaaaaccaaaaaccaaaaaaaaaaagaaagaaagaaaaaaaccgucuagcuugcaagcugaccagagaaaguaaaagaaauaauuugguuucuauguuguccauaaacauuucaacaagucacuucuggugagugagacagauaguaagcucacacauacaaaugugauuuucuaaaugagcuaacugggaaaauuccuuuuggaguaauuauuagucauaacuuaccaagguagagcuuaauucuaucaaaacguuauauguucacuuuuucaguuuucuuaguuguguguuguuucuguaacaaguuaccauaguauuugaaacaacacaaauaucuucuaaagauuagaauaaaaaugucagagucgaggcaucaacagggcuacacuccuagcagcguuuauuucuugucuuccaagcucuaggggcugccuguaaguccugcuaucaucccccaguccugccucuguaggccugggugaguccugcuagcaucccugacuccugcuucuguaggcacacugcacuuugauuucucacucuccuaaguagcucacuuggauauuccaggauaauccugucauuuaauuguccuacauugauggcacaugcaauauaucuuuugccacagaaagcauagguucuggggaauagaaagguucuguggaguagcauguagacaucuuuagagccauuguucagugugccuucaucuacuagauucagguauuuauauuguaauagaaaauagagcugggcagugguggcacaugccuuuaaucucagcacuugggagguagaggcagguggauuucugaguucgaggccagccuggucuacaaagugaguuccaggacagccagggcuacacagagagacccugucucgauaaaaaaaaaagaaagaaagaaagaaagaaagaaagaaagaaagaaagaaagaagacgacgacgacgacgacgacgaaaagaaaaagaaaauagaggcgggagaaagugagcccucugcuccaucauguucucaguuguauugccagucauuuuguaaguuguguaacuccugccuguaauucuuucaaggccuugaaguucuguagcucaguaaguaaucuauuuaucaucagaacagaagcauacauaucuaagaucaugugcacguaugugcugucugucuguacguguacauucacaaguguguggaggcugaagguggcuccccaucuuugauuuugagaaacggugucuaaccuaaccuacagcuccuggauucagcuaagaccuccagccagcaaaucuucaugucuccaccuuccuguagcugggacugcagacaacugccgccagcccagcuuuucacugggguacuggggcucuggacucagguucuugugcucuacagcaagcaccuuaucaacugggccaucuccccacccucugggauguaaugaacucaaguuccuaagagggugcgagauucagaucacuuacucuacacauuuuucugaaggguccagcaugccugaagcucucuuggcuccgaagaugcacagcuugcgggauccaccaggcccuugucuuuagggaccccauagccauuauucuccucaaauuucuuuguuacauaaguuacacacacaggggccuaagaaggucccagaaaggcacguuaaaauuuugauuucaggaauccuauuuuugcguuuuuauuucuaguuuucaaucauguaauuaguuuucuggcuuuguguauuagugcaagaagagaaauuaaaauauuuguauuuucuucuuuacagauguuucauuugaacacugcuuugacucacucaauauuuaaugcagaauuauauucaccagaaauaccacugucaacagguaagaaaaacacccccuuuuccuguuguuuugcuuucccuuaaaaauauuuggggucaggagucagggagauguggaucaaccaaacuaaguauauaugaaauuacuauaaggaaaucuguugcuuugugggugcuugggaccuagcccaggcccucuggaagagccacaagcacuuuuaaccacagaaccaucucuuuagccacaacagucucuuuuaaaauucaacaauauucauaggaaggaaguggugauccguguuuuaaaaccacccuuucaguaugcuuucuggaaaugugucucacaaaaaugcuccggcgugcgcgcacacacaucguuuuagcaagugugguuucuggucucuguuagaauacccugaagcccugucuucaccccguguaaggacuuuccucuucuccguaucucauuacccauuagugcuccuuuuugcuuuaccgcagcucacagagagccagucuuagccccucaguucuguaucugagggccagucuugucagccaggacacgaggcucuggggaaacaguaggaaaguaaccuuuauauucugaccagaccaagcguacagaacuaaugcuccugacaugacugcuaauuaacgaacccacaaacuguuuaaggucccuuuaugcuauagcgcacgggcuuccuuuagacucauuauugacuggcauguguguagccuuggccugauggcucuuuugcugcuuugaucaccuguuggagcuaagccgucuucagcagccacuuguuaguugguggagaugcguauggaagugauuguccauuacugagguggacagcaggugcuuugugugcuccggauuucugugucucgugauguaguuuuuaucauucucauuuaaaaugacuaugguuuugccagcgccugccuuacggaaaguuuucuacagacgugggaggaaggagaguuaguaugucacccuccucacuggugcccagaaguuacaucacggaggccugucuguccuuaccccaaauaaccaccacaguuuaucuguaaucuuaagcuguccaacacgcucuagguccccuucuugugaccaaguaaaugcaggggaggcaaccguguuuccugugaacuucuaaacucugagaccccaagagcuuccuuuagcauuucugcuuuauugaaaauguugcagacucgguucugcccucagggaaagcacagguuucuagaaaaugccucuaauuaguuagaauacuaaacagcauccugcaggcagaugauauucuaauguguucuccuuuuccuuugguuuauggacuuagaaauaaaguuauccaaagaaucaucucagaaagucguugguguucauaucauugcgcuucgggaaucuucuuuuccauaguguuagagaauccuucagaauugcauggaagaugcauucuuuuccuguuguaauggcuccuugcuugcacuagcucuccggcucuguuucagugcguuguccuguuuuuauaguccaagauggaugggacauuuuguucagauuuuaaaggacuagaaaggcuaucugugacaguguuugcuuguaauuuucauguggauuuuuuuucaaucuucucaacuucuuaaaaucucaacguauuaguauuucuaacccuguguugggaacucucuaacaagggacagcugauaggucugugucauuuugcugugauuuaauuuucuuuuuacaauggaagaucauuuuuuuucuggcacagaaauguagccaacagaauauuagccuuaaaacaaguaucuguguaucagcuccaguguucuacuucucuuacccuugggugugcucuucuaaggguaaugauugcccccucuccgcauggaacuucacauauguaaggaaaaccuaaaaccaauccugugaguguuucagacgggcuguuaagaaggaagagacuuggagccuaacacgaggaugucuccucugccuccauauuucagcagcaucuuauccaaaugcuaccaccuuccuggccuggcuucucaguaggcucuuuuggaugccuagaggaaauguauauuuuuaauauuguuauacaagcugucugauaugccuagcaugaaaucuuuuucuaaucaguuuuauuuccucauaaaaguuaaauucgagcaauuuucuuuuugaaauuuaaaguuaacaguuaccuuucuaaaaguuuaaagugucaagagaugaaucccaugagacagaagaagguaauuugcuacauuacugaccccaguaaccacccaucugucuuucuuauuuggcuucaaauuagguuuccaauugcuuuccugguacaguguuuaggcuuccguguuaucugaucagucauaauauugagaagguaaaauguauucucuuugaaguuacaguuuauuaaaaauuacaaccugaacuuuuaucucaccucaaauuuacauaugcaaaauaaggcuuaagcuucagccgagaaagugaauuuucaaaugagcacagaaguguucuucuagacugucuucagcuucaagucuuaauuuucacucaaacaacuauaaaaugucgaauauguuuguguauuacacagcuauugguuaucauacugggacauagaagccaucugacgcccuuauggaauuuuuuaucauaacauuuauauuuauuuauuuugaaauuucaagucagauaucauugguauauaaauugagccuuuagguccuuuucauaguaauuaauuggcaugcauuuaucuucaauuacauuauuuuugguauuuuaucauaacucugggcuguuuuagaacagaguucuuaugagcacacacuguuagauacuuuauuauaucugcaucaaaagcugugaguaagaugccaggguagugguccaugcuuuuaaucccagcacuuggcaagaaaaucucugugaguuugaggccaacuuugucuacauagugagcuccaggcgagccaaggauacauggugagucucugucuaacaaaacaaaacaagccauggagaagcaagaaaaguucuucaggucucacagagggcaaggaagaagccaguuaggcaacaguggcugucccuuggcuugaaguaagggaaagacuacauuucaggagcaguguuaggagaggcagguggcccaggaucucccuucuguggguuucuagcuucaguucuucauuuacuccugggcaguucucuuugagggaggaaaguagucugcaggugaaggccaccugacaccacagcacucagaggugcucccugcacucagcuguauugugcccuaaauguuuguugacacaugagucugaggacggcucggaucagaaucucugucagcauucagaccuuuuguucaguccagugguguaccauuaccauucagaaaaagccacuuauuuaccguuagucacuuaaacuauaaaacuacuguuaaaauaagcugaacuuaggagcaggagcaauuggucagcaguuuagaguguccaguucucuuccuggggacccaagcuugguuccuaguaucacauggcagcuaacaaccaccuguaacuccaguuccagggcaucagacacucucaucuggcuuccuugggcacuaagcaaagcacuuaugagcaaaaaauaaaauaaauauuuuuaaaaauauuuauuuaauacuucaaaugagaacacauaucaguagaacacacuucaccuauaaaaauugauuugaaaucucuguuuaaagcauaacuucaguauuuggcuugcuuuguauuucauacaagauuccagaagucucacaguuuucuuuugguuuucuuguguuguacuuguuuuuaacagauggcccauaccuucaaauauuagagcaaccaaaacagguaagcguaaaggggucggguguuugguaaugcuacaucucaugguaaggcucggucucugaguaauaguuaaaucugaugacagagguaaguguuuuaucugaauaaucggcagccugccguguuaugcaauaacuuccugugucuacauuuuucuuacaaauggcuuugaaacaucaguuaauuauaaauccuugguagucuguccuuuuuccagcuuagcucaucagcugcuuccagggaaagcacuaaagagucucauucaugaagaaauacucacacacacacagguucacagccacucugacgcucuauugcucauggccaugcccacaggguaccccuccugccuucauaagcucuggccuuuucugugcauagaauguguagcuuaaggcaguaaacgcacugggagacauuagaguggacugggagaucuccccuccaccccucuggcuuuaaucccagccuuuuugaagcaaggagaggauuuuuuuguuugguuguuguuguuguuuuuguuuguguuuuugucuggcucuuucgcuuucuacuaaauauuguguucaccagcugaagauuaaaauagccucaaaacugcaaauaugcucauuagaaguugcauggcucuaguacuguaagagagaagagaaucuucaauaucugccgacagaacauuucagucauuaugggauggaaguuaugguauagccucccacagagugagaaccaagucacuagaucucuggguggauaugcucaucacagccguggcgcugaaggacuguauaccuggccuaccgaguugugucacccaaugucuuuucuaggcuguuccuucuuguaacucaggagaguggguuaacacauuguguuguaugacacucaaugcuaagaagugaaugcugacagcauucggugcugugcuguagaauucugauguggucagcuguuaaauaggagaaacaucuuagggauguccaugcuacuuuguaaagcugaaaucagauggaaauguuaauuauaaagacaggaaugucacauggaacuuuggggcauuguuugguugcuuauaggcggccucuuaacacacacacacacacacacacacacacacacacacacacacacgcacacacacauacuuauacacauguacacccucccugggcugcagauaacaccugcccuugcuuuaucuccacguccaucuuuguaaagaugauuucucacauaaagucgcuguucucggagcucuucaguagaguuguguucugugaaauucugcccaguaaucuggaauccuggaaaauguccuagccuggaagauuuggugaauucauaaaacugaugaguccaaaauguaccuacacaucaaauagauuuuucagauccuuuagaaaauuuuaaauaauuuauuuaauuuuauuuugugcgcauuggugugauggcgucagagcccuugcaacuggaauuacagacaguugugagcuaugacgugggugcugggaauugagcgcagguuccuugggagagcggacagugcucugcugaaacauuucucuagcuccccuuuuuaacaauauuaaaauugcauugauuuauuuuuuaauguguugcucucuuugcccccaccccguguguguguguguguguguguguguuauuaugaaccccaaagucauagguauuuaugauguguuugaacagcuaguauaguuccagaauuuaaaauuuaauucauuuugugugaauauauaaaaucauauauguauaaaacaucauguuugauugccaguccgauuuuauuuugguaucuggcuuuagugaaaguaagaagguuguauguaagccaggcuuuuugacuggauguauggagucucucugagguuaaugacucauuugaaguaaauggcguuccugagaugaacagcgauagauggugaacguuuaauuucagaauacuagaauuagaaauguguccagagcgugcauuuuaagacuuccuaauuuuagguuguuauuuaauuuaaaacauuaguuuauuucugagucaaaaaaugucuguagucauugcuggcuucaaacuggugccaguuuuccuaccuccccucuccaagugauaagaugacaggugugagccaccaugcccagcucaaaggcaucgaugcuccagccgaacagcgcaauacacauuacaaccuucagaauaaaugcugccuuggauaggacguucaauauucuuauucgaccgagaauaauacacagugucacacgcugugcaauaaaucaugcuggcuacaggguuaaacgucacuccccauaagguaugagagguacagguacagauuuuuccaaugccacaaagaaauuuuguaauuaaagauaaggaaccacuauguuaaguuuuugaguuagaaauguucuuuuucuuggaggccuuuugggcacagaugaugaaaaugaaccaaaccacagacuacaugucuuuagacuguccaguuccguggcauguuucucacuguuaacuguuuauucauguuguguuguguuguguugugcugugugaguuuuguacugcuuuguuuggaggcagggucucagcaguguagccuuggcuggccccaaacucacagagcuccauuuacgugccucugccucacaagcacugggguaagauguguggcaguuauaaucugaagguguguuugaauuuucucaguuaaguggauccccauccuaacggcagcccauuuggggcucuugguguuauacaugcuauuauuguauaguuugggggugauugaguucaagcguuauccagacuggaucccaguaauauuaauuuuuacaaacuuuaugaucuuauuccuugaagugcucagaagacugcuagagucacagugucguagcauacagcaugucuguaacacagaugcacuuaauccuccagagacuugagaaggggcaccaggagaagggggauguggggggggagcacccucucagagucgaggaggaggaggaauggggugaggaacuugggggggugauguaaauaaauaaaauaauucuuaaaaagacaccuuuauggucugugaucagagcagauaaaggaacuccuuuaaguaauuagcauaacuuuuacugauggcagagcggagagcuuggcagcagccauugguaacgagaggcuccaguugaauaaagugcuaacguauauccaaaggcuuaaacucuucaucacuccuguguugaaggugggugccuggcuucuccgccacugcucagugcaucauuuucauaguggcuguuagaaagcauuucuccgucugcagaguugucuuccacaguuuugcauguuuagagacguguguguacaucugucauuguugcguucaguaaauaccgcuguguucaccucugcagaggggauuucgauuccgcuaugugugugaaggcccaucacacggagggcuuccgggagccucuagugagaagaacaagaaauccuacccacaggucaaaguaaguuugaaaccucugcucucacugcccaggagcaaagccaaaacguucaagugaaugugacugggauguuccuuugccccucagcgggaguguuuacaugguucuuagaauuuuuaaauagaaauucaccucaugaaaaugacgaaucgucaaaacaccauuaacaucuccauuuaagugagaugguuccaacaucaacuaagaaaaacuuaacuaccucuccagugaucuuaaagcugucuuuucaucuuaaaguauuuuuaaauauucucugauguuuuaguaaaacuuggagccaggugucauaguccauaccuguagucacuggacuuaagaggcuagcaacaggacuguuagauaucccaagcuagccugagcuacauagcaugcuugagcucagccugggcuaggugagacccuuaucucguaagaaaacgaagaaaauaaaaaaugucuuugaggcaaauuucaaauacuggguuuauagagauuucaugacaagacccuugacagaauauaucggcuauggaguauauuaauuauuuaagaucauaaguucagacccaagugauggaauaaacagguuguaagcaggcuuaucucacugaccaaacauauaaauacacaaauaccacuagcauguacuucacaagguguuuuagaguuucaaugaggaaauaugcuuaaguucucuguagagagccugagagaaaccgugugcagcuaccaugaaugaguucuguagcauggggggcagaggggugggggaagcuucacugucuuuaccuuggggugucggguguagcuucgcugcucuucgcuuuuuacguuguugaucuaguugagacuaccuuccucuaguucagaguuucuacuuuccuaauccaguguuguguuucagagacugacagugauuuuccaaggaaacaguuaaaaacuuucgagugguuuaaaagguuuuauuuauuugguaaucugggcuuagacuaaauguuaccagcaguaaacguuauggcacuccagccucugucuuucugcuggcuugagaucucagacgcucuugcccucagcugagcugacacuggggaaguuaucuucaguuuugccuccuagguugcuugucccccuuuuaauguuguacuuccaggcucaggccuuccagguucuugcccucugucuaagacaaaagagccauaccauccuuuaucuuuccagugaaaaaaaugugaaaaagccauaccauccuuuaucuuuccagugaaacucagcuccuggcuuggguccugagagucacauuuucauuuuaaggcucccagcucuaguuguggaaugagccguuuuuuuuuucucaguaaagguaacugaacguggaagugcaguggcuuuagugcacagaaggccacaguuauauuagacaguguuuuucagagaagucgaaccaggucggugaagacagggagauaguuagaugguugacugagcgauagcggaggagaugagaguaaucggccucagcugugacgauuaugaacgacaccaagacccacucugcagcgucuguaaaaugugcgcagggacacugcuaggauuccagcacagaagccugggcgcccuguaaccgaggggacucuucacuaaaucugggcguggcuaugcuuuuccucuaaaggcaggagagguuggacugcugaugcccuggaggggcaagaaaugaagaguguccucccucccauucagguggggcaguagccggagggagggaaggagaggauucucugguguuuugguccagcaggucuucuagcugaagggaaggucuuccaucaguccagcaaacuuuccaguguccucuggaaacgugcacacagcuaggaagcaaaugcuuuaucagcuuucagcaucugcccaguguagucgacugcacaccggaaacuucccucaggacagucuguggcuuccaguccugcagaggccaggcaaggaaugcagagcagagcaccggcgaagaaaacgguuauuccacaccccuggugguccucgugucucccaucuguucccuccuguagccuuauuaacacugaggagcucaggcugagguuaacuggcccucuucaaaggugcugggcuucuuucuccugcagcucacuggcccucccaugugagcgugugcagcugaggggccaggggccaggggcugaagaacaagucaagaaggacugauaaaucaagucagggaggaugagcauucugaacagcaaagaagaaaugggggcagaagucaucaggggucagaucuagaauuuccuaccuguguguguccuguacaaauauugugugcaauuauguguccuuaucugcaccagggucacugaacaucccuugucagcacugauacugaucauaacuacuuaagaaccgauguuaggagaaaaaaguaggguuuuuuucucuauuggccuucuaccaaaaaaaaaagaaagaaaauguacauuguguucuauuuaugaacucuuuccuucugaggcacuagaauucuguggucugccaugcaugaaagaugggagugucuguagaaagaggcuuccagggguaucauggcuuacugcauacccacccauaauucaucguagagguggguccauguacuuccugagggagcgacucuuccguagccuugcacaugcaaggcugugacuugcaugaaguauaugucuucagacucaccuuuucuucacccccacugacaaucucugucucccuggacucaggcccucuuuccugcccugccucuucaagcaccccucccugcuguccuuagggagcgccccugcaagguuagugguugaugugaugugaagauugcagugaagaucugaaggcucuugaaagcuuugggaacuggucaugacuuaaggcugcagaaaccaagcuuugcuuuauggagcuuguaaacuuacaucuuguuuggucgucuacuuguugacuguuugaagcaucagguugacuugcaagcuaacucuaggaaucucccaaaaccagcacuuccuauuagaaguauuuccacgcugugguagaugcugggaugcaagcucagucgucacccccuccccccacugagguaccaccuuuucuagaacucaggcggcuguaccauguguauguuccucucguguaguugagaagaaagaaccucuuuggcucucuaggaucuuguuguacaagucuucacguucuuauuuccucucucucuuuugauuaauuucucugggauuacugguuccuauguccucacagguaucaugaaugguuucuucagauugaagcauuccuuccacugccuucaggagcucggggugggugaauagucucuuuuaaaccagcuacuucauauuucaaaauauuuuaagcauacaaguuguaaaguucuauauaacaaauaccauguaccaaaauuaauaaauuuaauagaugguaauauuuugccuauuugcuaucugucuaucuguucucucucucucucucucucucucucugauucucucugaaguacaacauaguuacagugggagccccuacucagccacugcucuguccucuuauccucuuucuuugcccaaaggaaaaccacuguucugaacauucuuuaucugagaugcauucauaucauauacuaaaaucacuuucaagaaaguuacuuuuuacuaucuuuaauccaaaguuuuuuauuauauaugguggcucuuuuucaaacuauauccagguuaaaacugggccccugaaggcuuaaacauugauugcuuuaauccagucucuuccucuuuauuguuugacuaaaaaugucuucagucacaguguggaauuuaugcugacccuuaaagcaaaaaaucauauucaugaggaagcuagggaaaauaaauauccagaauuuaagaaaguuuuccacuuuuaaaaaauggaguaauccacugucuagccuguaagcucucccuccaguguuugcuugguucugacuuuaucugcggcuccugggagaacaggagagacagcagagcuccucugggccaagccugucgcuaccuguucuugacucagcaaggagugccagggaaggcucacugcccuccuuuucccgaaaguggugcagaaaaauuuuaaaucaaagugucuuccuugagcaaauggaacagggccaagaggagaagccacacguggcuuuaggaaugcgccugcagcccguccucacuugcuugaguccuucugugcugggcaccuugugaacauugcacuuggacaucagugacuuucauuucuaaaagacaguuuguuuguaaucauccaaugccaggagguuggaacacagugaugcuaauaugacgauucugaucagcuuugcuggcagcugcccugccugccacucuccugggguuugaugguuaaagaacggguuuauuggaauguuucugugaacaacagcuuuggcuccguucucccaccuccuguagugugcacucuuacgugccucucacugaacaguccuuaauguuacguuuccgucaagguuaauaaagcccggcugaucugcuguaggcuugaggauaucacauaucuuugcaaaagcgcccuuucccuugcacaggcuugucugcauccggagacuugccauccuaaagaucuaguuggaauacuaauuuugaauaauuuagccugauccaguuaccuaacaugccaggggggaaagaucaccacaacagauugggcauucagaaccuaccuaguucauagcauuuauuagaauguccuuugacacuuccaaguguuuacugugcucaaauaaaagaaaagagcuauguucccuaccaauacuauagucugugcuuuguaacacacacacacacacacacacacacaaacacagaguuuauuaaaacaagggcuuuguaacccaagguucauggauccuuuugugguuucagaaagguuugcaaccucugacucuacacauagaguuuuaugcauauuuguaugcauuuuuaaagacucgaacauguguaaaaguaaugcugaagggcauuggcuuuuuuaccacagcugauuaaaucgaucucuacaauuuuggagggaugggggcgggggcggggggagggcgacuggcucucacuguguagcuuaggcuggccuugaacucaucuuccuaccucugccuccagaguauugagaaauuucagggaugcaacugucuugaauguuuuucuucuuucuuuuuucauuucaaaaauuuacauuuacacuuuuuaguuuuacccauuuuaggcaaguugaagcgcuuuguguuucucagcauguaauucaagcuaguugcucuuuaguauuccauugacuggaaaagaugugagauuuagcgccuccucacacacacacacaccccacaccccacccccgccuuucuguucucuccuuccuccccucuccucccucucucccacucccaccgagucucuuggcacugacuaaauacgaugguucaaaaccaaaaagaaaagagaaucauuucccugauauucacucagcacgguggcaaguccugcacuacaaggagguaacauccucugcguggccauaauaaucuagacuucugcauaacuuuucuucuacguaucccaggcguuuugcgauugccuccaugaguaaaauacugacuuguuaaaaaacaaacaaacaaacaaaaaaaccagcccuuuauuucacuguuagcauuagaaguuagagaaagcugcuuacugaaggaaacuguugagcagugagaauugauccugagaguuaggagagccaagcuccugaggguugcagguugucugacuuuccaggcuugguaugguggccugccucgccuggcauuuccucuuccccucuccuguuucucugcauacucauugcucuugggaugcuuguuccuaguggcaguguucagucugaaaucaucucugaucaaaguggucucuguuugaagaggaucauuacauucaggccgggaaucccgguuucguaaagccacaugugaagauugguuuugaugaggcagagugaguaaccagagccuaugauccucauguccccagccaccuucuccauagucagggucuagggucuuuggugggucuagggauguucugcuggcucuccuggaguccccaucuucccccucccacucuaaguggauuuuaggucagucuuccaaacaacuuucacuuucuugaggucuaauggaggugagugggaggauaucugggcagacaugugaaacaauccagucugaagaccaggggaaugcagaguaaguccccagcaucuucagauaaccgaguuaucuauccauugcuugauagauaaguacaaaacagguuugcuuguauuagagaagacuuggaauugaaaacaagccagaagaagguaaggccaaacacacauuuuucaaaucacauaucauugaaauggucuagacauuggaaaaacaaugaucaggugggagaguggauaaugagguuucucgggguggaacagagaaccguggaggcugggagaaagggagagcugaaagcagagcagagggugucuagcugaaguccugggagaaacuaacauggcugcauguguguguguguccuucucuacgcacagcucucagauuggcaugcaguacucagcuugugggcaacauauucacgguguuaagcaccagcugugaacugauggccagcguggggugugacauuacuuccuagauucucauuggcuaagcuuugugaacugauggccagcguggggugugacgucacuuccuagauucucauuggcuaagcuuugugaacugauggccaguguggagagucucacuggcuaagcugcagcuucuucaucuguaaagcugacguagagaaccaacucaauggaacaugugcguacauucaguugcucaaugccggcacacagucagccuggaaacacaauuacacccguuuucauauaaaauuucaggaaauuggguacuacuccaaaagcuuguguuuagagguaacacaugaugucauaggaaacucacagaaaacaagaggauagaaacaaguguuagguuuuguuaggucccuucacuguguccugguaggcccuaugugucuaauuugcacaacgcuguauucauuccuagguugccauaacaaauaacugcaaccugggucauauuaaacaacagaguuuauuguuccaaaguucuggaggcccagaguccacagugaaguugccaguguggucuugcuucccacagaggcuucaggaaagagucaauccuggccucuuccaguuucggguacuuguuggcaguccucagcaagcucuagcugcagccacuucucugaucucugcuucugucuucacagggcucuucucccugacuuuguaucugaaucucucccuccuuucccucguaaagacaccagucagcgugguuagggaccaccacgcuguguagcaggaccucuucuugaccaaucgcauguguaggaagccuguguguagaugaaaucauguucuuagcuccugcauaggcccgaguccugggagaugcucuucucacuuacuacaggcacgaugugcagugguuacagaguguucccgagugugugcauuuaaggccaugucguuccgugcugugcucagaaagaagccugugugcaccacgugcuccccuguguaccuuuguuagauucagguaguggaagaaaaucucucaggucugaggaaauugcuguacuaggguuuugaacauuuauucuaguagauggaaggugugcuagaaagugucuggcaucagacucuuggauggcacucugaauuguagcaucugccaguuuccuucccauaguaaauuucaggcugcuaacaugaagucaacuggcuugcaauaaauaaauaaauagauaaauaaauaaauauuuuaaaaaacagugaaaauuuaacuauucugaaauuaacuccaugaacuagucaaccgguuucuaaccuacuagguguuaagccagcaaaguuagagcgagagaaggugauacauuguuuccuguaggagcuacuuucuaugcacauguuacauaauauaaagaugugcaggcuaugagggaacccgauagguguuacagcugggacuucauugugugauaguuaaagagagcugcgguugagugggauuacugcuguuuagaagcaaggcuagaccucggucccauucugccacucgcucgcaggugggguguucuucagaaaguugcuaaagaucuucaaacuugguuuuguuuaugagaugaaaguagaaacaacuccuucacaggaaccaugcgugcuuacguaaaaaacugaccucuuagaaaggcagcugccauaguccuggcacaucugcgucauuaagugcucauucggacacguguguagaaagagccauggagaugacuguuuuuuuccugagagcagaagcuugcagguacuuugucaacagcaccuagaaggaugcccauguauagcagacaggcagcaguuacuuguacagugagcagguggucagugcucagaagcuggaaggaucaucuaaggaggcacuuguccucccaugguggcgcuaagcaagucacuggaguggccaccaggucuccaccugucacugcugcucacuccccaccagccugcuccucuuugcuucuccagccuggcaugacugccagccaggacagccacaucccagaccuggcuguacacuguaguguagcucuuagacauagcaccaaucuauucuggguugaaacuggcuuuucugccuuaguuucuaaaccuauuuuaacuguccaauugcaaaauaacacuuaaagaaacuaaaaagguuuaagcaaaauagacauuuauuuauuuuaaaaacugaaaauucuaagggaagaaguagaaaaaagaaacccaaacaaacaaacaaauuugccaaauccguagaaaaacucccauugggcuuuuuagcaucucgacuucuaccuuagaggccacucagcagcagcaggcucacugugagaagaccugcauucccaaagcugacaucaaagcuuaugagacacccaacuggcaguuccuaggccuuugguacucugaguuguuccacugccugccccugcagcagugagacaggggauaggguugagcccuguguccgucagucgcauacucugccgcugguucuacaagugggauuagucacugacuaggaacauggggaaugaacugagguuaggauucacugagcaaagagcuaugcgcuagugacacgcggaugcuccaagaucacaaggauuagcucauucguccaucccgugaccagccuacaguuucugaacucucauuccuaacaguugguaaacccggguuccucucuugagaaugacuguuccaugcuacuccuaauauaugaaacuuuuguuuuuaaaauaaaccaaaaaguuuuuuguuuauuuacagauaucacuugcauuuaauaaaauuucaagaaacacaaaguuauagguaguaaguccccuucuguccaagauuccuuuguucccuggagaggagagcuguuaggggcuucucaagugcacucccaaccgugccugccguguguuuaccauguguguuuauaccugcuggcacacuuccacucacgcuuccucguguaaguaagcauuaguguagcgcuugugagcacggauguagucuacuaaucuaugaaccaucugcugcuuacuuuuuucacuuacugagucugaaauuugcucagauuaacagcaaacuccagagcuggcaaauccagauucaaguccagcucuguccccugaguaacuguguaaccuugagcuaacugaccaccuucucugugccccuauccaacuagcauaagaacaacuccaugucucauaguguuguugggaguacuaauugaauuaguguugaaagagcaaugucugcuccagggaagaguucugauguugaauuuccuacccaucuacucuguaaaggcugugugcuuuccauggcugcuuggggcaugcugucuucucuaagcuccaucugucuucuaucacaggccaaccuuaguaacccugcaugauaguaacuucucccuuauccuggggucuuugucacuuugggauguuuuguuauugagauagcuuuuuaaaaauacuuauucauuuuuauuuuaugugucugaguguuuuugcauacauguauguaugugcaccauauguaugcagugcccacgggggccagaagagggcguuggaaucccugaaacuggcguugcaguugguuuugagcagccauggggauuugcuagaagagcagaaaguguuuuuaaccacagagccauuucuccagcccagagauaccauuuuaaaauuauaaucugugacuguuuuguuuuguuuuguuuuguugaaacuagguuuuaccaugaagcccccuagcuggccaggaacccacuguauagacaagucuggaaugggacucacagagguuggccugccucugccucccaagugcugagauuaaaugcaugugccacugugucuaacccuuucuuaauguaguguguuuauucuuugaagagucauaaacuagauuuucaccauauucacuucccacuguucuuuuuagcucuucugaggucuaccuccuaccuccucucaguuucuuccuuccuuccucccucccuuccuuccuuccucccuuccuuccuuccuuccuuaauucauucauuccuuucuuucugccuauguacuaauggauaugagacuauccacugaccauggucauuccuauaaacauuuuccuuucauaaauguuacucuaugcauguggaggucagacgcagcuuucuaaggucaguucucacuuucugccugucucucuuguuccccacugugaugcauccuccagacuugauggcccuggagcucccagcugguucuccugucucugccucccaucucucuaugggguguugggauuauagaugugcaucaccuaauagggcuuuuuaccugggucccagggucucaaacucaaguugcugugauaggcauauauaacaaugcuuuuacucaugagccucccuggaugcugaauuuuuuuuuaucauagcuuuauuuugacucuuuauugugccauuugcuucuuauauguuuaaugauguguuuuucaaugugaugacccuuucagagagucugcccugaguuguucccaggccucgcccacuugaguguguucuggggaugccuuccuaaugagccccaugcggacucugauggcugccguacuaugucuuacucagaugugccccuccucauuucuagaccuuauuucaugugcauaagaacugugucuuuuuagauucccuaacacugugcucaguuaaauuccuuuucauucuuggguacuaggugauuaccccaguuagcaauagaaauaugcaauuaguauuagacauaagaggaaacaugucucucccguucaucucuuacugagcucuugcugugucucacagccaaucauauucagcuccaccagggaggcauugguauccuaguuuucaauuggguuugaugaacacuuggccaaaaacagcuugucugucuaccuuucuuauguacaugcacacacacauaucuccuaauuacuuuccccagccuagacuucucagaaaaccaggcuucagaucuggcuacuuggucgacuuuaccauuuggauaccugguaggcuugccgagcucaaaguugaaugcuugauucccuacuugaaguuguccacucuuagaaaaugguaacccaucccccaguuucucagaccaagcggucuugaaguuauucuugacgcuccucuucuugaucaccacuuauaaucuacccuacuggcuauuucuucaaacuaauuagaaucuacuugcuuguugccagcuccaccccaugagcccugguauaaaccauccgccuccuaauggcugccauuugcaugggugaugccugucucaagcagguauugcuaacugauuacaaauuuaggguuugcucuaucauuuuuuuuguuagauagcauuuaucuuuuuguacuuuucaaaguaguuuucucuucuucacacucacuaaaaaauauuucagacuaguuuaaauguuucuaaucuaaaaacacaaagucaaaaaaugcucugaaagaaccaggggaaaaugaaugggggugggggggggguaaaguacuugucauacaagcaugaagagcuugaguccccagaacccacacgacagcucaaugcaguauaguagugcaaggcucuauaaucucauugcuccuguacagaaaugggagguaggcacuggagacucccuggaaauuuaccugugguccugagcgugucagcugagugcaguucuggauccucuucucauccgggagccacgcaucacuccugccaugauuuacugugauauuugaacggugcuugucaccaaccagcagaaguguugcaugccagcucucguguccgcuagaccucgcucccccacugcuaacugacugggcucauccuccaucuccugcucuguccugaaauggcucaucuguccaagggaccugauuccuuagcagagucgcuuuuccuagguuuuccugaggcuccaucauugaucuuuuuuguuguuguuguuuuuaagucuugaguucagagccuauuucacacaucucauuguugccaucaucacagacucuccuucccuccccauccuagguuuguaucuccuuuucccaauaaaaugcaaacccucauugccaauaacacuagaagugccuacucaguugauugguccuacaauacuuccaaacacauggggagauaguaugguuucaggaugacgacgccaguaucagcccuagcaacuuaacaaagaguugcguuuucuuuuuauuucuuuaaccaaaauucagcagggaauaaucaaccagaauagcguuuucauggguuacauucuuuuccuucuaggaaacugcguuaccauugaacuauaggguuagaauacuuuguuuaugaugaaucuuaagaguuuuccuauuccugcugauuuuguuuuauuuuugaaugguggcauguaucggccucaauuaccuuccauuugugugagauaaacuggacgauuugggaacuaucauaaagucgguuugcuuuauuaccuuuuaaucagagagaggaacaaagaguucugggaugguuauucuggaaugugaacccaguaagcucacguugucacaugggguguuccauuucuauauuuggagcccucuuagucuuccucacagucacagaguacacacauauaugguucucgcacauaggcuuggugcuggcucugcggucacagacacgaaugaguuuauuccucugccccgagguuacagagaguagccaagcagcagacacguaugagaugauacugggguguuuccuuggaauuuggggaggaugcucugcaguggggugcauauguguauguguguguauguuccugaaguggguggccuucccugaaugcauuccuacuguguagucauuccaaacuucugaugguggaaugccaggaucacagagcacuuuucauacuggaugucagaggcauggccccuucacaacacacgugcuucacugucagagcggugggccugucacacugcgugugccucagagauaacauaaucuuccaagcuggugaugucauccuggagagacagagccaacgaugagccccagggauuguuccuaaccauuuuaacaagucucagcccuaaagucuuuaugguucuuaucaaguuuuuugacaagaagugguagauaacaaauacuuuaaauucaaauuaaucuugaaaacuggagcgaagugccaaacucuucagccuugauguugaacagagacacacacauccagaaaaaaaacaaugaauccacaaaaguacagagcagaggggugagucagcagcaguacaugcggagagaguagaguugacgugccuagcaagagcuagcaaggccugcagcugccaaagaagucgcuccucacuaggcaacaguaauggaaauaugauguauaagagccaagaggugauagucucauggccacccugcaggaagaucacacuagaugcgugcagccugcugggcagagcacaguagucggcugugggcggggcggggccagaucaggaugguugugugaccacacuggaauggcuuacaggaugguccuggcuguccucgguguuugaauagcuauuauaagaaaauggaaauggaccccaccaucacaagacaggggaaagagggagcggugagcugaagucccagaagacaccagcuucgugggaaucacagccaccacaggacggggugacuuugucgucacugcucugaacuaaccugaaagacgguagaggaagaaagggaggcugcgugggcuucagcuucacagccucggagucucuggcucuccaucccuguuuuauauggcauuagacagaguuuugcuuaguaaaucauaccuuuguaacaagggcugaucaagauuuggguacaaggaaguuauaauuucauaauuucaugauagauaagaaaauauaacaauagaugcuagugacuugcuggccauuuucuccaugggucaaagugcaugacuuauuuuuuuacacuaguaugucaguuuauuaacacaggccgaacaguuuagucacagcuugaaaggguuugguuugguuugguccugaaagaccagguacagagugauaccagauuuuuccaacaacuugcuggcauuauccuagaaaucaguagaaguuuugguguuuaccccuccaugccuuggucuacaucaugcuaugcagauggcacacugcuuugguuaaccucagucugacacgcagaucgugaguucucuucugccaugcuccugucugggggcgugaugugaccgaugaagugucaccaagaaauaagacaaaauuucccaggucuacucacuggcaauucucuuuauuuaguagggguuuuccacaggaaauugcaggagaagaguugaagugcucuuugucuuguguacuuuccucugacuuuucuccuucccagaguggcccacauugccuuguaaaggagcuguguugaccaugauacugaucaaagucagagugcguucugccagucagcuaaagccugauugcuccucugcaguggacuucuguaguuaaacucuguuuuccaaacaugaaaacacauaaacaaggacuggagauauggcucagcagcuaagaucacauacuucuucugcagaagacccagguuccguucuaagcacccacaucgggcaacucacaacugccuauaacuccagcuccaggggacccaacacacuccucuggccucuaugugcaccugcacucaugggcacauauucacacauauauacauaauuuaaaauaaaaaucuuuuaaaaauuaaggaacauauacccagagaguaaguauuugucucuaagaagaaauaaaucggugauauuaaucugaaacaaauuuggacaucacagaaucaaaaauauuucugauuauccuaaauuaagaucaaaaucauuuuaagggaauucuggagagguggcucauuggcuaagcucuucucugcucuugcaaaagacccagguuuagcacccaggacccacauggcagcuuggcaacucacagccaucuguugucccagugccaggagaccugacacccucuucuggccucugcaagcaccugcacacacauggugcacguauuucagggaaaacaauuauagacauaaaauucaaauuaauuuuaaaaugucauuguaagaucaugcuagauaaauuuuguauaaaucaugucuguuuucagacagggauucuguacaaaucuaacaugcauuuuagacgacuuaguuuugaaguuuacacaaacuuuuuuuaaaacuuugcuuaaaauagcuaauuaugacuucauuugccuguuuuggcccugccccccauggccaaagccugcugacauccccaggaccaauagucccuuauucucaguacuauaauaaguacugagcucccagggcagagccugcacugcagucacugaaaagcacuguguugaguacccagacccagccuggaugggaaaaguuaauaucauugccuaacaugaagguuuucuuugucucuaaauuuugauuuuuccaugcuaucagaggcccccuugcaacagguaaucugaguguugucuguuuucuccguccgucaucgugguuaaguguauuuuagaugcucacaauuguaaagcuaaauugacuugacaagguucuuuccgacccaaauucugugauguccgacucuuuuuuucuucuuuuauuuuggauuugugauuguugaccauuguccuguaugucuuacauauauacuuuagggaaccauaagcauuuuagagcuggaagccaugcuagcugugggcuaggacuagacauuuugcaaagaaagcauuaggagaccaaagugguuagugauucaaacaaauucauagcaguagcuaaagacuaaaauucugaccaucuucagaggacuaaaaauaaucaaaguguuaucugaaaauuuguaacuccaagccagguauauauauauauauauauauauauauauauauauauauauauauauauauauauguauguauauauauuuaccccaaacaaauuaaagcuuccuauaauucuguacucauauauguauaugggguguguguguggagagagagagagacagggaaagagaaggggaauuaaauauuuuugauaaacguaagcuuugauaagaucugccugacacaaaauacaaaaugcauuugguauaaacagcaucauucucccuuuauaccaaaaacggaaauuucuucgcauucuauacauuugagaaugacacgucgggcuuguugugaacaccccuguuauuucccucaaaccugaaaucacagcuggaaucguagacauuucuccuugacuuagaaccauaaaggaaugcugcaaagcugggguggcucuuuugugaagcugaggugguuccuagugugaagcggggcgggggggggggggguuuggcaauuccuagugugaagccagggaggaggggagcacaguuccuagugugaagcugggggggggggggggagagaacaguuccucgugugaagcuggggccaguucguagugugaaaccaggggaggcagucccuagugugaagccagggaggagggggguugcaguuccuagugugaagcugggggcaguuccuagugugaagcuggggcaguuccuagugugaagcugggggcaggggacacaguuccuagugugaagcuggggcaguuccuagugugaagcuggggcaguuccuagugugaagcugggggcaggggacacaguuccuagugugaagcugggggcagcuccuauggggaaauggugccuugucucuggaccgugggaagcugucuccugugcugcccccgugggguuggcugguuggcuaguggugacuugugaggagcuugcccuccacccagucucacuucuguuuuaucuagaaccaguucagaccgcgucccacccagccugccaccuuggccaggcccuagcauagucaggaugcuguuuuccagguuuaauuaugaaaguuggauuugggagacuugaagaugcuugagcauuucugcugcuagccucuccauaagcgauaacucauuuauguuuauaaguggaacagccgaagggaauacaaggguuuccaaaaauucucuuagaaauuccagugucuaguuaagugcuucuaauuucaguuuccagccaaggagaugauaguacaguuucaccuuugcucguacuuucugggucccagaaacagauuaaugaaugaggaagagacccucgcagcaguucucagucagaggucccagucugacucccucccucaggcuucugggagcuggcuguuccguccacccccuccugcuucauucaccccucacaucucugaacagcacaaaucagaagguaccgguucuguauccccagaauguaagggagcuucucugagugccguguuugcugcucuguacuggcuauaaccugcacaagaauggccucaauacaacuguuuucuaauaaaagcaugcgugauguuauaccucuaaaguaagauugguuuauguaggucugccauugagagugguuaugggaggauuccuguccagcauugggacuguaucuaaaaacagcagucuagcuagaaaaaaacagcaccuguacaaaaaaacaaaaacaaaaacaaaaaaagcagcagacucaaaauaggaaucucacaggucuaaugggaauccugaguacuucugcugcagaaaaguauccuuaagagagcccaggugaaauaguguucgaaagaaaaacagggacauguugugcaaaaaagauagacuauugcuuuguuuguaaggagaugggucagccguacgcguuuuaauagagugguaaugagcaucacuaaucccugagcuucagagcacagacucggcgucugucugcaaagggggcugaguuggagcacuguugugauugauuccucuucaguuagacuuagaguucaagcuaagauggauaggcaaggcagugagaucagaggaaagggcugagcacggggggaggggcaggggacgaggagggaagugcccuggcucugaaauuuggcaguuaaguggagauaagaggcagcgcacucccacacacuaggacgguuuugguacaguggcucuguucaacaggaggcaacguuagguuuaagaaaaaagguaagcugggcgugguggugcacgccuuuaauccuagcacucgggaagcagaggcaggcggauuucugaguucaagaccagccuggucuucagagugaguuccaggacagccagggcuacacagagaaacccugucucgaaaaaccaaaaaaaaacaaaacaaaaaaaaagaaggaagguaauuaguuaggcuugggcacauggagugauaaacugcugugaacagaagggcuuccugcuaagggcuagaaaugucacacaugcuuaucugagagaugaaaacacuggguuauuggagggggcugugagagcgagcgagcacagcccgggcauguguuugaggacaggagccuaaggagagccagagguaucaggucacaguggugcuggggcugcaggcgguugugagccucuccaaacaacgcggccaugaacaaccaaauucagauccacugcaagagcagcaggcucuuaaccaacaagcaucuguccagccuguagacucuaaguuaguaucauauggaguagaugacacaacuccaucuuguggauggauaucagauaaugugaugacuuccagaaagagacuaagagucguggaccggcgcuugugagcucuuugagaaggggaauguagccaagcagcuggugaugggggagaagggaggucagagggaccacguuucagggauugucauaggucaaaccauaagugacucauggguuuggaaacuuaaggcagucagaaccguuaagcaaccuuuauuugaagacuaguagaaguacuuaacuuucagaagacuucgaugugagaagcuguuucucccuggugacuagaguuguucuugaacgcuuggguguagagaaaggaauucaagcaagaguggguagacucuuuuaagaaccuuucucacagacuuagaagaagaaaaaaaaaaaaaaaacgucaaaugaaacaaacaaccccccaccccaagccagcccuguuuucuuggaguggcaccugccgccauguguuugaauaaaugauagccuuuaccaucaucaagaaagggcugcuauuuuuagaauaagaaagcaaaggaacuauguggauagcuaaggggaagggucauuuagaugcuuuguagggguggagaguaauuaggggaucuagaauaaauauuguggguaaaacaagauggcuuuuccuggaaaagggaagagacacaguucucugaauuagugacaagaacagguccugagcuucaguaacagaaaggagagacauuuguggaggaccauuguggaggcuucucguuagaucucaggaaaucccagcagcagaugucugugagggcaagaagagauaaaggagaauuauuuugcaucaagaacuguucuaagcaauuuaaauuaucucuucuuaauccuugugaaaacucagagacuaugacauugaaaguuaaacaacuuucccagagccugauaucagcuuguuauggagggucuaggauucagagcuauucugucugacuccaacgccuguguucuuauggugagaggacucacuaguuucaggucuuggaaguucagcccuauaucauagcaggaugagaacuuugagggagguccaucuguccaucagagaaggaugcucuaauauauugguucucaaccuaccuaaugcugugacucuuuaauacaguuccucauguuguggugacccccaacuauaaacuuaucuuuguugcuacuucauugcuguaauucugcuacuguuaugaaucauaauguaaauaucugauagcaggaugaucuuggguaaccccuguaaaagggugguucagccccccaaagagucucuaccacggguugaaaacugcugcucucgugagaaauugugaggcugagaaauugggguggaacaaaacuguagacccuguaagucugacagaaguuaagauaaauggacagaagacaaugugaggcagaugcaggagacaagaggccucaggucagcagccaacuggaaacaggagggaaggcaaaggaggguucugacuucauggggacagcuguuggcuugacuugacuuucugguggugaugacugaagagucuauuuccacagcugcugugauuucuuuggagguuucgguaccaauucuggucuagagacaagaccaggguccuagacacacaguuaagcuuagguuguucucugguauuuaauaaacaagcuguaacucaaauagcuuguugagaggcuguguugggauccagguaucuuuaaaggcaaaagaaaaagcauauaucacuuuaauuucuuccuaccuaauauaacuguuuacacuuuaguaguuugccuucgauaaagaacauuuagugcuaucucaauuguuagucacgcccacguuaacaagguaaaguuacaggaaguacugugagcacaaggaauaggaaggacgggugaaaggaacgcuucuguucuuauaguccuuccauucucacauagaagauaggacauuauugauacaggggacauguuacauacuuaacaguuauuaacauacagagaaaagaugaagcagggcagagagcagaagaugggguggucggagcuuagguggaggaagauucgaaaaacacuugucugagaagagagcugugcacagacuggagcuggacagaagacagcagacauccuggaacaaugucccagcuaagcacgcaaguccaaaagcucucuggugggagcccucuuggcaaguucuggaacagcagggucuacuauagaugcauuggaaauacaagaaucaagguugaaucaggaccccacucccccaaaacccccgaggcucccucagccgcugucgaggcuuuuuaagaauagagacauuaaaauguuuuauuuacuucuguucuuuaacaugggaaauuguaaccauguauucccagaucuguguguugaggcccuugugcuaaucacucaauuaacaugggaaauugucauguauucacacaacuguguguugagccccugugcuaaucacccaguuccaaguguuuucauuuuuggaauuuugaacugaggaaugaugacuuagcauguccugacuugaacaaaacucacucagaacagguucugaggaggcaggcagggagccagggaguagccugagaagugguuauuuggggcuucguuugaagaucuggcuugauuuuauuuauuuucuaauuuuuuucaaaagaagaacugaaaaggcaaauagaacagugaaaagagaaagguaauaaagaggacccagcccagggagcaccccuucacacuucaccuucuaccuagacguguaccugccuggcaaagggcuggcagagggaauauuucuaacaccauccuauaaaugacaagccacauuccuaugcucuuauggaaucauggaguauuaagcccccacacaaaggugaggauuugucacaugucaccaaagcauugagacccaauuguaccugagguacugaggggcgcuugaccucuagauauuuaugaugcaugugauaaguuugaaaauuaaaaggaaaccaaaaagaaaacaaggaagcccugcaucaaggcugaugaggugaaacuuucagaacagggguacaugcagguagagguguuucucucuucucuucucuucucuucucuucucuucucuucucuucucuucucuucucuuuucucuucucucuucucuuuguguguguguguguguguguguguguguguguguguguguauagacuagaguuuauucagggccuggggaggggaguuaagaggguaguggagucagagaaaggcagagagagggagagaguagagaaguaguugcuggccaugaccauguggagagagaggagaagggaauggggagagaaggggagcaagagggagaggcaagagagcaaggcaagagugagguguuacccucuuucagagcaggaugucugcagguagagguauuaccuucuuucagagcagaggugugggcaguuagagguguuacccucuuucagggcagggguguaggcagauagagguuuuacuugccugcucuauaugaaacccuccuaucugaguggugguuugccauuguaguugcagccugacucuugagauguugaucacacuaguagggagugucaggaacagugcaaauccaugaacccuggugaagguccaagugugccagcaauaguggugaaucaaagagguuuucauguauccugucccugcuuugcauucccacaccaauauucagagggcuaagagugaacuccacaguguucugcaucuuggcugucucuccaaagcuuacaucacuugcucaggcugucuaaacuugccuucuuaucugcaaguuaggguacuacuagugccaacccugccuaucucagggucaucagaaagcccagauguucuccauagauaagagggaaggacaaaaggcuccguagugccagacagcaugcaggagucccagugagcugccagcaaauuagccaugaagcacgaggaucagaggucauugguucguguaagauggcagggcugggguuugauccuggauuagaucaacucagcaucccugucuuagcaagacgagaccagugucaugaguccuuccuaugccauuagcuauaaucccguuuagcaggcuugaucugugcuuccugguugcacaaauaaauaauaaagaacaguaaacugacucccugucauccuugagaggacauacauuauuaaaccaauauacuauuucgucucucucccucccucccucccucccucccuccuucuuuauaauuugacuugacucaagaagaguaagcaaguagccuuuuuuuuuucuuuaaauggaaaagacuuucaggaugacaaggggacucuugcuccuccuuuucacaccuagcaugaggccuuucucacaauaugccucaccagugccaacaaacaagcaggagucucuguagcuguaccugugcucagaucggugauuacagccauggcgcauuaaagccaguuagagagagaaaaauaaccgagccgaguguugacauggugccguggaaaugugaauagacuuuggggaggcaguggcagaccccgaguucagggcaccaccaccuuaccccaaaccauuggaaccagguggugcauguuacuugagcuugcaaagggcugguucuuuccccggugauauggggugccacuacugaccccacauggcuauuguggggauuucucccuccucggcuguagagacagaauaugcacauagacuuagaugagcacgugcucugggaaaugaacaagcaugcgaaguaaggcguuauuuaacgcuuacuagccagucacauaucacuuuccuacccuauguccuccagucauucucgaaaagggcacagucguggagccaugaugggcugacauugugaggaaggugggaaacacaagagacacgggcuauuggugcagcugcuugaaggaacuccuccugugcgcuguuaaugagcaggaugagggcucgagagcacugagcacccugcgagcaugacugcgcucgaccugcugagaaugccuuucgagcaugcgcucuacccgcccgcagagaacgccugccaagcugccucauccuccacuugcuccuugcuuacucagcucaacucugccuucaaaucucaguccgcaugaguuaaacacacggaagcuuucucucacuucccaaccgugccagacacuguuauuagacauucuguuugaugaguucuccaguuagguuuuaccuguauuguugaaguuauccaguuagcgucagucccacuguuuaauuccgugagagaaagaaauugggcuuguucugaacgagguguagcccccacucucugaccuucuacaguguggggcucuuagaaaggggcguaacaaacuaaacugguaaacuuuaguacucagugaaauaaugggcuagauaagaaacaauuuucugagauuguugauaucaucaggaaccaaguguugucuuaacuccuuuaaucuuaaaacaguccggugauacuucgucauuaauuugauuuuugaagguggagaagcugacacacgucacuccacgacagcugggggauuugagccuggcuuugagagaucuuaaccuaaccaugaccugcugugguaaagagcaagguuggguucacaagcagagccaggcccuguuagaacccugaggauguucgaaagaaaaaucagcagaaaagaaugauuuuagguaugaugucuuacauuuaugcugcuucugcuuucugucagaguacguuagccgaauucacccagagagcagccuggcuuuugaaacugugaugcugaggaaguucuaggccacucaucucuuguuaccccuuugaagaaacagcaaaugcuuuuccacaguaggucagggcuaucugagguuaaaaaaaaaaaaaaaaaaaaaaaguacguggcugacuaagagggcuauaccugagcccaugacuuguaguucuuauucuaaaaggagcucugacccauggacccagaauucuagaagaguuuuccuucaucagggaaggccaaggaagucugauuguccccaagaagggcagcugacacuagaauaacauaguauuuuguagaaaaauaaaacauagcaaaagaaagaaaauaaauguauuuguagaaaacuaacaaaacacugcaauguaggaaaaaagaaaaaccuuccccuuggaauugaugugggccaaguaucuuccagccacuugcuucaaauggaccuauuagacauccucuaagugagggagcaucugacagucugagauagccccugaggguuguccucuccucugcugaguacuguugugaaguguuuguguacuugaauguauauauuccucauuaacagccccuugaacauuacugaacaggugaagagaccaagcaaggucacacagacuggaacugccucucucccccagccagccuagccugucucugaaguccacacucuucccauuccgagcagcugacuaugcaggauggcuccuuuggcuucuuaccugugcuugagugcuuacaauuaagagucucuguucagauucuacucucagaaagaccuuccuaguagacaguugcccucuauaaacuuuaucuucaagagacguaauacuuccauucccuucccagaauaaguuucuacauugguguugaauaccucuuggccacuauggcaugauaaaugaugguuccaagaaaucguugucaagguuugccugugccgcacagcuguccccacaaguaaggcuuucuuucucucagauggcaucuuggaaaguacagaaagcccagggcccucccuguuuucauucuguggucuguguaaaaaccaaaugcuaccaucccgacuacacucuuucagauggaucaaacagcacauuggucacuggcagaucuuucaggucccucaccucagaguccucccaguuccucauucuugccgcccuucaaccaugaaguuagucguaagaaaaacaguaagugcuucuugaaugcaccucccaccucuuuccaucagcgccagugacuaacuagccugucagcgcagcuucagaaggcucggauuccaaacucucaggccuucucccaugaggccuuucugcuuaaguggaaagccugccugauuucacccaagugaagcgcuuccuugagccuuccugugcuguguuccugugcacacugucaguuaaaagugggaucacgugacucgcugccucugccgaucauuagcagaccgaugugaucagccaucuagagcuggaaucagccauccagggacuuuguaggaagagcaucaucagccuuggagcaaaaccagaacuugguauucauuguccuacacuuaaauggggaaguauuuggccugugaagaaagacgacuugcuaaauucacuucauuuuaaugucagagagaguuuuaaguucugugccuaagaaagcaacucaugcuuugggacagucaagguuaaaguuaguacaaaaccuuucucugaauuaggucacucuguaacuaugggaaggcaguccugcugauggccucgccgcucuggaagaaguaugcccuggucuguuuuauguuguguugguugacaagcaaauuacacaggauuaaaguuugcuugggcugggguuugaagccugggaggguucagguuguuggucagccauaucugacaggaacuuugcagcccaggacaagacaggaaauuacauaacaagagaggccaucuuggcugaaguaucucuuccucuuuguauagcucacagcuccguagaugagggcuggcucuuaugguguauucgauuuuaccuccuaaagaucaacuuccagacaccaucacuggauuacauuucuaggcucaaaacgucucaugaguuucgggguggguucagaagcaacucauuauaauguuguaucagggcucaggcaggcaggccuccuuggggagucuagagagcuggcucgcuggccagaagggagaccguuguucagggcaaugguaucuuuucuccauacucucuggggaguuacgcgagcagugaucagcuucccggcucugaccaucaaagguuacacuggagaaaauccauauugagagcaaacucuguagagcccugccuccguggagucuggaccccgcugauaguaaugauauuauaagugagcaggcugaggaaggcugugugucuuuacaggaagcuccuuuagcagaugcaggcucuucacguucacguugacauuuauccagagaggcgacguaccucaugcauuucuaacaauaggcgggauuuauggcagguucucacuuaaucgaauucagaggggaauaaugccuccgagcuacucauggugugagucucauggugugguucucauguugggccgucuugacgaaaaguucuacgcuguagaggucgggauggucaacuagacaagaaagacuuggucaucuccucucuccuguccuguccauugcuguucuuaccacguuaaaaauacacaagugaaaugaucgccucacauggaaaacuuaacuuuguaaaacaagagcuaaaccaccaaaugugaaaccuacaaauuuucagucagaaaguuugcuuuuuuuauuuaagaaacucacagacaucugaacauauacaguauaaugucagaacccaugccuggggaaacuacucaagacuaguggguguccuguuaggugauguggaccaagccaugggcuuaugucauuaaaaacagccuccagagccaagccccugaacaagacuaccuuucugguaaucacaugacaaggaguuaggacucagucuuuguuugucucucuuacuucaucagucacccauucccuucucgugcaugguuugcccaguuuucaucacugaaaaucgugacaagguuucagagaagaaacaguguugguuaguaaggacccuugugacaguccuaccuaaugaggcauacucuguuuucagugacuuguuuccuggacauauaaacaacccccacuaccauuuugauuuauuuccauccugucauguguucauuguauauuuuuuaaguugagcuauagucaaauauguauauaucugcaaaauguuguauuucugcugauugguuccauguuacagucaggucagauguacuaacuauugaaaaugugcuucucauauagauuugcaacuauguggggccugcaaagguuaucguucaguuggucacaaauggaaaaaacauccaccugcacgcccacagccuggugggcaagcacugugaggacgggguaugcaccguaacagcaggacccaaggacauggugguuggguaagugggcugugugguauggagggagcgggaacacgcgggugugaaauccauaggccccuuuccuuguggaucugugcaaagccugagagggucucacacacgagcaagcggauaaagccaggggaauguguguccucuccuuugaacugcuaaggaaauagaggugaccagauaucuguccugccugagacaauccuugcaucuguagucuuggccucucaaggauggguuuggacaauguuauaauuauaagcccuugaccuaagaggcauuugugccacuuucaauuauauuuuucuucuccuggaauuaaagaugaagaaaagaaugaaacaacuaccuuaacuauauagaaaugauuaccauggagaugcuuuuugcuuccuugaaacagcaucuccacuauaguuuaagcuuaccuugaacucacauagauccuguugucucuaccucccaaguguuugggugcugggauuagagauguguacccccccccacacacacagagcucugauuuuugccuauuugggauuuucuuaauagaguucuagugggaacauuugagacaugaagcagauaaguaaauauuguuucaacucugcgcuacuuauaaaaugugugcuuuuuaagucaacaagacaugcaaauugguuugggcacucauuugaucuggaacauaaguagaaauuaguguauucuuucaaagucagucaaauacaacaauuuuuagugaaugaaauuuuauagaaguaaucuuacuucaaaagaaucacaaaauauuuaauaagacauaauuaugggcugagagaggaugaguuuaguuugcaaguaugauggcccaaguucaaaccccuggccucucauagcagcgcuuuucagagcacaggcauuuauccucccagcuccugcaggggagcaagaggcaaagacaggagaaucuggaaucucaugcaguagcuggccuggugugguggacagacaccaaacagaucccaugucaaaccugaaguucuccucagaccuccauaugcacagcacaucacauagucagcugcguucgcacacauaaaauaagggcacucacuaugcuaagguuuuauauuucauuauccugaaacacuaaaauagcagacaauguaguaacuuaaacagcaaaaaaugauguaagcauucagucaucucaaauacagauaacuccuauuuuccagacucuuaaaaagcaaaggggaugguucagugguuaagugcacuuuccaccaaaucugagagccugaguccaacuccuguaagccacauggcaggagagaaccaacuuccacaaauuauucuccaaccuccacaugcaacaaagguauaagugcacacacacaccauguaauauaauuuuuaaauaaaaaaaaaguuaacuaaaauauuuuuaaagccagaagguaagaacuggggagacaggucaguggguaaaguauuugcaaugcaaacuucagggccugaguucugagcuccagcgcccacaugaaaauccagguguuaaaaaaaccaaacugauaaauaaaauaaaaccgggaaagggcagagcacagcggugcaugccuuuaauccuagcacucaggaggcagagucuaaggccagccuggucuacagagugaguuccaggaccgccagggcuacacagagagagucugucucacugccccccaaagccagguguagugaugcaccuggaaccccaaugucuggccacagggauggagcagauccgcggggcucacaagccagucagaaagcacggcccaguccaugacccugucucaaaaacccgagaagugacugaggaaaauucccugccuguguucucuguggugcaugcagauacauuguuguuaauuuuauuuaauuguguacaucaucauucagaguucuccagucuuagaucaaguagugucugggaagaccccagugaaugugugcuuuuuuuaggagauugcuuagccagccuugaugaagucugacucuguugcccugcaaucuugggagguucagcuuucaaagucccaggcaucauuucuucauuugacgacgaagaugcucaagugugagaagcucccagagagagggcccuucccuuuaagucauucaucucuggugcuuuuugacguuagggagaaaaguauccgaauuggaggaagcugaaguuaguucucguggacuucagcuugucucggcaucuccuggcugcccugcuucucagucugccgaaacugacaugcagggugacugucaguuuuagacaacugaucgguuaguguauucccugauugauuggccacaucauagccaaucguuuugaagcauuuccguucuuuucgucuugcuuaaucugucuuacaaucauauguucuuaaggaaaucacaggugaacuuuucuaucaguauuucugucaguaauauuuauuauuauaaaacuugcagaguguugcuucucuguuggguuuaauaaucuuucaugauuuagaagaaacuaaugguggcugugucugcugcucugagguagacacaaggccuuggguugcucuccccugcagcacuaccgccacuaaaaacacuaauggcuguuuaugcuggagccuagguugcagcgauggagguaaauucaguaccuguaagcagagcggagagguccgucggugucuuuuaguguaguggggcacgcggcucuagaguugggagugugcauuacucauggauuuagcaaacauuuucgacauccgauuccugacuaggcucccugugguuugaucuagucauagcugggugggauuuucuaaggugaggaaacuuucucggagagaugcagucgaggagaugccgccugagugauaggggguaaccacaguagcuuuucccacccaagaaucucucacuguagaaugucugcagucgcuuucccgguuggcauuuagcugagagaauucugcucaugguauuuuccccagacaccauuuucuucgugauucccuugucucugugucucugaguuucuaacacgguccuacaccuuuugccuuuucuucuguuucucuuggauggaaaagcagcgugcuagcagccgggaagucagagcuccuguaugcuucugucacucugcacggcagaagggauggaggccaaguugcaugacuuucuaaagacuugaauuccuuuccuuacaaaaucagaaagacacaggcucugucuaucuccaggcacucaguguuuaacccucuagaccaagcccacauuagcuaauguuauaaaacagcaggaggaaacuugccacuaucuccucaugguaugacaucgguuauuuuauuuaguucugacuuguaggccagaaguuuaggaagacagccaaagguguuucuuagacuugucaauacuagaaauagaaccaagauaacauuuuccaauacuacagauuagacugaauauagauucacaaacaaggcaccaguccaaacuaucaacauauguaaaaaugaccccaagaagaccaagcuuugaacacaucaaaaccaaacggacccccuuuguuuacagugucuuucacacuuucuucucuguuugaauucuuaauaaguuuaguuucuauuuuuccaaauuauuuuaucaguauuagaacuaucaucucuugggguuugauuauggauuugauuguuuuaauauagggucauuaacuucaguuagcuuucauuagaccucuugucucuuaugcacuuaguuagacuucacugccuuucuuaauaaaaaaaagaagaagaauccuguuuaguauucuauuuugaccagaauguuaauauuuuuagcaacacucuaguucucugaaauuuuuuguucaguggaaaaugucugugcauuucuacuuugcugucggccacguccaccaaaagucaccacacccuguuugcuuacuggcaaccuggguugaaagagauguacaguucuuuuuauuucccccucccaacuaauuuauguagcuuauugcaguugguaagcaggagagcagagauucucaaccugucgguugcaaccccuuugggcgucaaauggucuuuucacagagcaugccuauggagauuuauauuaagcuuuauaacaguggcaaaauuacaguuaugaagcagcaauggaauaauuuuaugguuggaggucaccacagcaugaggaacuguuaaaguguugaagcaugaggaaggcugagagccacugcccuggaugauaguagauaugagaacacacaggagagccuuugggcucccacaggagaacugcuaccuuaaauuacugcuggacagauccaguguaauuguguagcuaaacacuagcccacaggagaggcacugccuagagaagguuggacaaauauggacuuagguucaaggugugccguaccaaguugguguaugcacugugagacgagagcugcuuuugaacacugaaaucaaggucugaaacaacaaaggccaaagaggggccacugugagccccaacccaguguuagacacaucaaaauuugagcaacagcuuccaaaugaugaugaagaugaaacaucugaccuacuucagcauguuuauugauggcuacagguuugagucagccugggucacuucauagaaaacugaugccagccuccaucccauagagugggauuucacagagcagugaaaagccaggcccuccagccucagcauuccucuugaguuaauggaaagguuuguuugaaaaguccugauuccguaggguuggauggagccccagauuuuuaguaaauucuaaaacaacacugauguugcuaguuaaagacucccauguugugaauaugagaggaagaagcaagguugugguuucagcccuuuuauuagugguuguagccuuucuguuuuuaaaaugucauugcugcaacacuccuccucuccaguguucauuucugugaauuuugauaaucauguggcuacuccugaucugaggcugaugaguucucuuugguuuuaugucugaaagucgucccuucaucuucucuguucaaagguguuuuuugaagagcagaggauucuaaguugacaauauguacuuucaugugcugguuuuauguugauucaccgucucaggucuugaccuguuuccagcaagagcucucuguaggucugccucggcucuacuguucccagagugugauuguuucucuagcagcgucuugacuucucuuuagcacucguaagcagugugaguuuugauggguuugaggguagcuuucuuuuuaagcuugagcuucuuagucgucauagauccuuggauuuacauuucuuauuaaaucuuaaagcuuuucaacuguuaaguuuucugucacugucacugccccugcuccccauuccuguucucugucacuuucucucuuccagacuaggguugaguuggcacagugacuaagagaauaccuucugaauagucaaucugaugccucauguauuccgaggcuuccuguuuaugagaauaguagcucuuucccuuagccuaacagggcuuucucacaaauguuuccuuuggauuuuugaaaaucugugaugcucuggauauaaauccuaaucuucuuaaccucaagucuuugcaacugcagagcccuagcuggcugccuggguucuccuucccauccugcaaccuaagcauuaagccagguaauuguaagaguaccuuucuauuuuuuuuucucggaugacuguugugugucaccuaucuccagagcaugacaaucguuuucucguguguuuuggcuauuuaauucuagaggaaccgucuaggucuauauuacuccaccauggccugugguggaacacugguguguuguuuacuaggguaaacccuuccuucaugauucauauaauaaauaagcaugaugccuuucuccagaugugaagcuggguuacguguaagaagugcagccgaggugauggucacugauguucccaggagaugagccugggcuccuagcgggggagcagucugcacaagagugagacccaaaagggcagacacaagaucuguuagacacaaggaccuccaagcacauuagcagguugggugcauaauguuugugaugcucccuccguucaagcuuuccuguggucagcaggcaccugcugaggacccacaugucagccugcauucuaagaccuggggaucucuguccugaaggagcuguggaaacacagcauguugacuucucugugucccuguaacucacuccacaucuggccuucugugugugucuguuuccuucugccuucaccucuucuccucccuuucuccaguuuauaugaccuuugcacaguagcuuguucucaugugugcaggcaaguugucagaucucuuuuauugucauuuuauauuacauuuaccguguguguguguguguguguguguguguguguguguguguguguguauguguauuucugcuugucgggggaggcuaucuguucucucucucucucucucucucucucucucucucucucucugugugugugugugugugugugugugugugugugugugugugugucagugucaaagcccagaacaacuuguggaagccgcuucucuuccccuccuauguggguucuagggauugaacucaugucaccaagcuuggcagcuaguguucuuacugacuuagccaucucacugaccuguaucauuuucuuccuucuacuaauauuuauuuuacuuuuagaguaaaaguccuuacaaacaucuauauggcucugagagacccaggcccugcacuuuucucuuugaguucaucuguccccucugacucugcuccuuacccucagcccaugugccaccuuucugccacugucaaaaacagcagaguggcccugccaugcggucuucacauucaccagagugguccugccaugagguccucacacucaccugucugcagcucugauacuuagaauccacuucuucugaccucccucaggacuggcucagcugugaucucaggguccugccuggguucucccugucuggcucuccuacccucucaccccucccaggccugucuucuuuuucuuguuuacauguauuucucuuuuaaguuacacugugaaaucuaucaucguguacgcuagcaugugcauugugugagagcacagugaagccacacaagccuucccuaguaaagcauacguacaagggcacccguacucugugacuccugaguugacaucuaauauguucugagacguaaggugauucaaguuuuccuccaacucuuuuaguaacccaguuuaaccuggucugacaaauccacuucugugaugagucugguuagaggccucucugcagaaaugucaaugagcugaguccauggugcaccccagcccugccaacagugucuagugacguacagcauaugccauauaucacccucauaaagucccaaauucugauguucaucugacuuuggucuguguaagaugcugagugcuuguguacuuuuuccggugugcugucugcugaccugaagcccgccccccggccaugaccugccugacuucugcucucacuguuuuucuccagcuuugcaaaccugggaauacuucaugugacuaagaaaaagguauuugaaacacuggaagcacggaugacagaggcguguauuaggggcuauaauccuggacuucuggugcauucugaccuugccuaucuacaagcagaaggcggaggagaccggcaacucacaggugagccagcugacccagccuuaauuaaggcuucuauguuccaggaugacugcagccaucagcgugccaggcuaucagagggaaggggaucagugcagcccggucuuuccuuucugugcugggcaccguggagaagcggagcccacacacaaagacucugcaugcuuguucucaccuaugucugcgcagccggcggugcagagacgugcauuucccuguacuccucgcauucuaugugugccuuaucucuuagcaagcguaggagaguagaugggugagcaugggagaagacaauauuuacaauacuccagagaaaacgcagcuuaccuuugauggguuuuuaggcaauuuaauaagaccauuguguaaaauuuuacuaacaguuuaaagaauuucaggccaaaguaaccaaaagaaaaaagaagacucaguuauuaaaauuaaaggugaaaaucagggaaacauuaucagagguaauggucaaauccaaagaaucauuagggcuuugaaaauauguauuacaguaaauuagaauaucucacagaaacggguaaguucacagguacaucugaccugccaguguuaaacuaagaagauagaaacaacuuacacagaccuaagacaagcaauaaaauaucucccaacugaaaaauacccgguccuaaauggaaucauggcugaauucugucagauauuugaagagauaacguaaauccuccuuaaacuguuccauaaaguagaaaggggaagaauaucaacaaacuuauuuuccaaagccagcauuacuuuuauacccaaaccagguaaaagaagaaaagaaaagaaaagaagagaaaagaaaagaaaagaaaagaaaagaaaagaaaagagaaaaggaaggaaaggauaagccgauucauacauucccaauaaaauaauagaaugaaaugaaaaauauacaaacgggaaaggaagagaugaaagagcccuauccacagacaauauugucccacacacaagagcccagggcugcacuggagaggcuuagcucugauugaggaucagccugcgucaucaccacacagaccccgugguuuuccuauaucgauagugagugugucgagaaagaagucagcaaacgcgacggccgagcacagucacaggcauccccgauagcuucaacaugagcaaauaaaacuccuggcaauaaacuaaccaugugaaaaguccuuuacagugaacauguuaagacacggaagaagaaagagaugucaaucaaugauggaaaggccucccauguuccugggaguuaacagaguuacuaccacaaaaauauggccaaguguggucuguagauugaaugcaauccacaaugccaauaccguuccuccuagaaaauaaaguucacuugggacgacaaaaggucucagguagccaaagcuauaggauaguaagaauauuucagagguaucacagcugcugauaucagagguaucauagcugcugauuccaggucacacuacagagccaugguaacaaaaaaagcauggaaguggggucaaaacagacguguaaaucagcagaagaggagagucagaaaggaacacaauguagccaccugauacccgagaaagaugccaaaaugugcauuagagaaaagacgggcuggagaagaagugaugccgguggggaaccggcuagcacauauaaggaagggaaccagaucccaggcuccuacccuaccaaccaauucaacacggagcagagaucuuaauggaaaagguaauggucugaaacagcuaaaggaaaacaugcagaaaacgcuucgugauguaggcaagcccuuuccgaaaagggcuccagcaacucaggaaauaaaauggagaacuagcaacugagauucaaaggcgucacagcagaggaaacaguuuccugaguugaagagacgacagccuucagugggggaaagaauuguugcuagcuauguagcugacagauuaguaucuagguucuauaaaaacucaaaaaaaauuaaauucuggaaacaaacaacccaguaaauaaaugcgcucagaagaaagagaggguucuccaacaaugagugcaaacagccaacaaaugugaaagcaugcuucacacccuuagucuuuaaaguuccucugaggucccaccucacccuggucagaagucauuaagaaaacaaguccaggagccugccaaguagcucaggugguacaguacuuaccucuuguguaagaaguccuggguuugauucccagcacucccuacaaacggcugcacucccagaugaguucaaggucguccccagauguguguagcagaugucuuagcagguaacccauacaaagccugcugcccugaauucagucuccaggacccacaugguagaaggagagaaccccuccccucaggugguccucuacccuaaacacacguguguuaugaccaacaaaugcaagaauguaaauaagaaaaucaaaauggagauuuagaauaacaugaaguaaaacugcauagacacagcuauccacuccugcggauauuuacaaaacucuaacuccacguacuauaacauacauauuucccugcacauauguguuuauuucagccauauucaagagcuacaucaaacaaccaccguagcucuccauuagcagaugauggauuaagaaagcaugauauacaugaguaauggaguuuuuuuucagccauuaaaaaaaaaaaagaaaaaagaaagaagggcuggagagaugccucagcaguuaagagcacugacugcucuuccagagguccugaguucaaaucccagcaaccacaugguggcucacaaccaucugucauggaacucgauacccucuucucuugugucugaagacagcuauagucuacucacauacauaaaauaaaaauaaaucuuuauuuuuaaaaaagaagggaagaaaaagaaaagaaacauuugcagggcaguguaugcaacuggagaucucuguaucaagagaaauaagccagaacaaagaagaugaacaucaccuaccgucucucucgguucuagauccuagguuuuauauagauguacauaagauauuuugcauaugcgugcauaggauaugaaaguaagaggaagguacuccguugguagggaggggacgaguggauaugaggaggggagaaggggccuuagguacggucacagugcuuguucuaggaugaaaauguuuucagggaguuaucccgaugagcacugaguauaugccaagaaagacuuuaaggaaguguuucuagaggaaaagaauuggucuuugaggccauuugcugucaaauguucacacucugaccugccugggcaugagcagacuguucucugugacccuagacagagagaaggagaucauccgccaggcagccgugcagcagaccaaggagauggaccugagcguggugcgccucauguucacagccuuccucccugacagcacuggcagcuucacucggagacuggagccuguggugucagacgccaucuaugauagcagugaguacucguucccaagaugggacaguuucaucuagcugcauggagggcagggccacuaugucacuuacuccccagagcugaggccugcagacugggaccuagucacauagagccucuaguuuauugucuacaaaguuaauacugcagucuaggguaaagggucaauauccaguuaagcgucuuaagaacaugucugccaagguaacacgucuuccucagagagugcauuauauuccuuacauguaacaccaguuucuuacuaugaacacaugacuguaaggauagauugcuggugcucuaaaaaaaauuaccuuaauuuuugcaccuggcagcacggaagaaaaauugauagaagacaaguaucccucuugucucucuuuauccccaguuugaaauacauuuauuaagacaggaacgucaagguaacuaaauaaaugaauaguaugucaaaaucaucuuucaggcugcagauaauagaaugugcaggguuuccaguagcuuguagaauuuacuguguggcucuauuguucgauaugcauugggcuuaacaaacaguuguuucaggaacccugcaagccucacugaauggucauagaauacgaugcacaaggaaaucccauguucugcauccagccacgcaugggucugucugauuuaaacaagugugaagggaagugaaaaguuuauugaauggaaaagagucuuacugaacagagaugagcuacagcuguuggaguuuuuaaagggggaagcuuugccccacucaccacuaugggcagcuuugccccaaaccacacagaaugcuaauuuagguugggggaaaaaaaccagaacaucuucacuuuucuuugaagaauguguguguguguguguguguguguguguguguguguguaaauguguauauauauauauauauauauauuagcuuaaaaugucauuuucuuaaaauuuuuaagaauuuuacaaaugacauaaaguuagcaugaaacaagccauugguccagaaacaucagacagcucucuccuuccucaucagccuguguguuagagaagccauaugccaccaucccucccugaccugcuccuuucuggggaaccaugagugccccagacccaagaacugcuccuaguaccuuggaagucuuucuugcucuauuugugucuuguuaaaggcaguaagagugagcaucaucauggaaucuuugugaggcuaaugcuaagccaggguaugcauucucuucucccuuugaacagaagccccgaaugcauccaaccugaaaaucgugagaauggacagaacagcaggaugugugacgggaggggaggagauuuaccuucucugugacaagguucagaaagguacguacacaccuggucucuagauguaggguguggcugucagaguucucuggaaacagcggaccagggguguucuccuuuugcugugggagucucaaaaagacagcgcucuucaacaccauuacacgcauugcaaucacaugccugaauacgcccguuugcagaugacauccagauucgguuuuaugaagaggaagaaaauggcggaguuugggaaggauuuggggacuuuucccccacagauguucauagacagguagguggguuauuauugcggguuuuauuuuaaugcacuucugccuuggugaaauucagugcucaguuuccacauauuaacaaagaaaccgucauaagucucuuugacauccauacagcaaugcuauguuuauggcucuuccaguacucugacauagaggcugagaagucuaaagggcugaagcugaugcuguccugaugagcuggugucucuggcugauugguuacaugaccagggucucccagcugaugacaugagccaccacaguaauagucacucuuugacagugacugagaaaugguguuucaaauaauuggcaacaacccaaauguuagccaguaaaugacuaauuagauagugguguaucuauguaauggaacaucauacaguuacuagaaaagaaggcucugugaaugaacaaagaccucaaaauagaaugcaaagauuuguaacaaucgauauggaacacacuguauguagaaacaauucuauguagaaacaauucuguguucacgugcacaggaagccugagacaauaacaacaucagcucccucuaggaucucaaguuagugcaugagugggaagcggggaggcagggagaacugucagcauaugcuaccuauugcucauccuauauuugaugacaucuugauccuuauaaacauagaaagaccgaaacuaagucuguccaguuccuuauuaucccagcacugcccaggacuagcaugugacaccuccugcgcagccucacuuagcaugacugucugcgggcugucagcggcagcccugguucugucugcuuccacauccacuccuucucuugcugcuagcagugauccuggauguuuucaaggcuaaucugaaagagaaauggcugagucgcgugauccgccaucaugcuguuguguuuuacuuucacgggggcaguauaaguguggguauaagguacuaacugggaacuuucuccaggugcuggguuugcacacacuuuauuuaaguucagaguauacauagacguguauagaaugugccugaugcucaccgacacuagaaaacaaauguccuacacuaauguuugggucuuuugcacccugcaguuugccauugucuucaaaacgccaaaguauaaggaugucaacauuacaaagccagcuuccguguuuguucagcuucggaggaaaucagaccuggaaacuagugaaccgaaacccuuucucuacuacccugaaaucaaagguaccugggugguuuagacucuugugcuugcucugaaagaccagugggccccuccucuacucagccucccagaagcugcugccuggaugccuggaugcacgcugcauaguguuaggggcaaggaaggucauaugccaaggucauggaauuagccccaggaauuuauguuacuauauugcugccaaacuuauaugagacuuagacauuuggcuauuguuggguauuagaaucuaguauggagccagcaagauggguaaaagcacuugcugucagggcugaccugagccugagucccaaagcugugugcugaaaggagagacguaccugccagaagaugugggugguccuccaccaggagggggcugggcggggaagaaagggaaaguaaaaaaaaaaaaaaaaaguaaggauuuuucagcuacucagaagcccuuaagaauuaaccagaaggcuuagccacuguccagcccagaacuauaaaaugagaaggucacuauacuuuccucacaaaagacaccucaggaaaggugcacuauaguuaaaaugcagauuacgauucuuuuugacgugcuagacaucauauucucugggccuuguagacacuaggcagcugcucuaccauugagcuguaacccugguucucaaaugauaaguacccaaagggaagcauccacaaacuguaugaaauaguugaggagacaguccuggauuccuuggucuaaagaaucagccaaagaauuucucuucagugggaagccacuuaccacauuaugaaggugaauggaagucaaggcucuguuuaugaaagagagauguucagaggcagagguguggcagcugguguuuguccugggagaaaugauuacugugaaucuguguggacugaggaagguugauuuaggcgagggaggccagguccacgcagugaagcguuucugugguagcuggagguuuuugcuuugacucugauggcuaggccugccugcucacugucuggaaugauguggucagaauguugcuagaauucaguggugccucagcagaguuagaaaggguucuagcagccagaaguuagcauccagcagauacuucucuguuggugcuguggagaccuggaccuugggugaagagaaaggaagagagacucgagagucucagauuguucuaggguuuccagacuagaaguguauguauggagugguuaaguggauaagaggaacaagggagaagagucugagaaugaaagagaagcuuaguguaaacauauuucaguuggggucaagugcaggaagggggccagucaaaggcaugacucaagugggugggggcucagcacugaagagaaucccggccccacagaguuuaaguguagggacgcacagugcugccgucaaccucucuguaccucuguuucguaaguuuugucuugacggccaugguucugagaagagauccaugaacuuggaggcuacacaaggccugggaucugauaaaaucagaaaugucuggcucagagagaauggggcuggagaggaugucaccagguacaggguccuagguccagggccaccaaggcccccagguaucggucccuugaaggcaaagcgugaugguggccaggaguuucugggaggccaugucucuuuuugagguauggccuccccauuccugggucaggcuuauggugagcucuguggcuggccuacuuccuuccucaccagcuugaggucuucuagauccuucuguccagacaaggcaacaugaaauuacugcuuuaccugaagccucugcccucugaaaacaggaaaaaaagauuauuuuucuaagaaaaaaaaaaaaacaguguaucuccugaaaugugccuuuaaaagagcguugucauugcugaugcagaaucaugagaaaaagaaaagaacugcagguucccugugcaggaugugagccuugaaacgcugagaguuugguugccaggcaaccucuccugcuagugucugcaucugaagaguacaguagacaaggcccagcuuccugggcacuccacgccagcagagugggaguuuucuaaugccuggauuagaggauugggguucccugaaguccugguuaccucacaucuucuaggucaucaugaauacaaaugguauacuugaaauacaaaugaggcuccaccuacacacaggauggcugagguaccuguuguguuccguguuucuacacuggaaacauuuucucugugagauccacaguucauccacugacuaaaugaauauagcuauugguuuugguauaacuggugggaaaacuuuauaaauauuucuccgagccaucaguuagaaaguagacagucucuucaccucagccucacuccuuucuggccgaaagccguuuucuuccuaaucauccuggugugcccaggguugguuucccagggacuggcaaaguccaccaugcucuccugcuuuccccaucagcugcaguagacaguccaacauaguccaaaaguccuugugccacaccguggggugauggaaacacccacagaacuagagaaguagggaucuuucugaacauagaccaugaugaaagccagcauuaaucagucagacacaggacgauuguucaguauuggccuauuuccuggauagaaagcaccauguugacuauuuaauguaaacacaaaaccaccuucacuucucagccccaaagacaaagaaaacaaacaaacaaauaucugcuaggauacucccagaccacaaaggaacaggagcaccaugucagaucucccacacagugacaggacugagaacaugguggcugaagaucacacgggccaugacagaacugagggcacauggcugucgaucacauugcaguaacagaauuaggggggcugucuggguuaguaaggaacacagacagugaaagacaagaggaacacagaacucugugaagagcaccaagauaagucucggagcaccuggaccugggcaggccacugucccagaggucacucacugucccagaggccaucuuuauuuuggaguccgagaucucaggagccaaaacaucucuguacacccucucuguguuucuaggaucgacauuauaucucuuaccacaauaaccaguaaggacucggucuccauugccucaugccugcacugucuuccuuagaguuugacucuagauguccuguauacagugauagauguagcuccuaaaaugcuguccucuaugucauucucugagacauucagcaagucccucacauuccuaucccugaggcuccucagcaugggugaccccaguccuccuuuaaccuuuauuaucaaaagcacccacccauguuaucccucugagaagcccugugucuucccagaauaucauguucuucggccauaguuguuagccuuuauagaggcuugucaugcuguaaaucuguuuucacgugauuucacaugaugguaugaugcauaccaccauaauccaucccacuaaaucccucuuugccuugaaauugacgguccuugacagcagagauguguguuauguuucuguccaucccagcaccuugcucaguguauguacggaauaaauguaagcugguuauuauaguugucuuaggugaacaaggacaacuguucugaacguuagcugggugugguggugcacaccucuaauccuaguguucacgaggcaaaggcaguuuugagucuuguucaaaaccaagcuagucuacauagugaguuccaggcagcuagaguuacauggugagacccuaucucaaaauaaagaaguaaaagugcuuuaaaaagaaaaaaauauguguaucuuuggguuaucugaaucuugagaagcaaugagaucucucaccaucuuguuagcacugggaacuuaggagggggcgcucaggagaguugggugugugccgcacuguggucucugaggcgugcucuuggucuucucguccauuggaauaaaaaccaugcuuccuccucgggugccuguuauuucccuuuaaugcauuuaaaaauaucaugagaaucaaucgucucucugcggcugcugguggaacccgaucagucuuuccccccugguuucccuuccuguaaauacagacaaagaggaagugcaaaggaaacgccagaagcuuaugccgaacuucucggacagcuucgguggcggcaguggagcgggagccggugguggaggcauguucgguaguggcgguggcggagggaguaccggaagcccuggcccagguacgagaaacaucucuucuaucuaaagccuuucaugaagaggaggggguaguuuucuuucccagguugccaaacaugucugcccauggagugauggugucauuacuaauuauuagauuucaauuaauggaaaauuuccuacagauguaaaagaauuuuuguucucaaagaaauguauguccaacucaaggcacagccacuccccacccacccacccaucaaguuucacuuucugugguuucaguuacacgcggucagcuugagucuaaaaauauuaccauuguguugacagagagagaccacacacacaaaacugucuucacagucugcuguugugacugcccuauuacucuguguucuuggucuccuucugucuuuuuacguugugaacuuuacccaggucuguaugcaucugcaguuuuagggauacacugggggucucggacguucucuuucaggauaauaugugucuagucccgaaaaguguaagaaaaaagucaacugaaggguuucuggaagaaaaccuuucucaaaucauuuuugaguguuucccuccucccccuccccuuugcuuuuggagaagcaguuagucuauuauucugagaaaauauuaaaacaacuaucauacccaccgcaugguagauggguauaauaugccuacacagcauacugugggcuggagacacuguacuguaaacaaacugagucacagaaaaucaugccagggaagcacuucaaugguguguaaacuacugcuccuaacugccacgcauacggcacagucaguauuuauguguuccucucggguccggcuaugauccccgugcguggauuuccagccaucuaguuacacucaguuuuuaagcaucguugcaucaugcuuguggaugcugaguaacgcugcuuuugccucagaucuagcuagcuuaagcauuucaauggaaauacaguucuuauagcagcauaagugugcuguuuaaugacucacaccuguagcguaagugacuugaaugcuguuuccugucuccuguguaaaauaacugugcugagcauggccuuucuuuauuccagauaacauguaaaugcuuuaaaugucagagaguguagugcuaagugcuggcugccccucuaaauuuaucauucauuucuccacuaaaguaucauuauauuacguauuggguucuucucaccaggggucuucauauuuaacuauuuuuucuguaggucuaagucuuggugugaguacuuaccguuagcuuuucccuucaccuggaagaaagggaccugcucagccuuaaguccuccaagcugcuagucugggcacugccuguuuguucagcugucuguuucccacagugauucugcuaacucucgggcagagccagccuguguaggcuugugccuccccaugccacagccugccucccugaguggguccccauacuguuaacaaucucccugauguucccuuugucucauugcugguucaggguauggcuacucgaacuacggauuuccucccuacggugggauuacauuccaucccggagucacgaaauccaacgcaggggucacccaugguaagucggaucggaauacccagagcacugcucgggcaacaggaucaucucuaaaagcuuuggaaaauuacuuuccaauaaauuaauauucucagguuauucuaggacagcauaagggacaccccugacacguauuugcucaucacauuguguggaagcaggacagaggcucuagacaaaagaugagacuugacuacgcaaacacacaaauaccaccuucacaucugucccuuuaccccaaguccuauccuucugaaaucaguuuucauuuuguaggguuggccuuuuccacucuugggcauccucugaguagcuguggcuacaggcugcucgugguuuauauaaagcugcauucuucuguaccauggaaauuauucuauaaagucuuuccauauauaaugccaauucaugccagaugcguacaucacuguaaucuuuuuuaaagauuuuuaacuggcauugucguuuauccuauaaucggguaaccauucaucccauaaaauagaacuauucuuuccauuaccuauaaccucaugaccccugugcaaggccagugcuaggcuuggcaccuucuggacagaggugagguucagaaacuugacuuucagaagacacuguagcaggauuggguuuugcuccagguuugcccaggagucuuacugucacucugucacauaacgagguuccuacagcaaccacagucagucuagugauggugcccuagagcccuccuggccacacagaauggaaaugagcucugcucggcucccuuucccuugccacucaggauuaggaaagaaaauaacugcuuucgagaacuuuccaacuggcuaucagcgcacagaacuuuaucucauuuuucuucuucacagauaaacaaaaugagauccaugccuuguuucuguuugguuuuguuugagagagagagagagagagagaauaucacuguguaaccuugaccuucugggacauuguggguggagcucacuacagcuggcuacagaaugaguuuugggaaggcaggcuuuuaaauuguuucugaauauuuaaaguauuuccgaaacaucccagguuuuuuugguacacaccuuuaaucccagcacuuuuugugaguuuaaggccaaccaaagcuacacagcaagacccugucucaaaaaguaaauagagaaggaaauauaaacuauguccagaacauauuauuuguguuauaaacauuuauaguuuuccauuuccugcagauaagccuucuuccuauuuuccuuuuuucugcccuauguugagacagugagcuauagcuuaauagauuuucuacguuuuuuucccuaggcaccauaaacaccaaauuuaaaaauggcccuaaagauugugccaagagugaugacgaggagagucugacucucccugagaaggaaacugaaggugaagggcccagccugcccauggccugcaccaagacggaacccaucgccuuggcauccaccauggaagacaaggagcaggacaugggauuucaggguaggugagcuugcccacgagggcuuccagggacagcuagggugggguuucaggguaggugagcaagcccacgagggcuuccagggacagcuggggugggguuucaggguaggugagcaagcccacaagggcuuccagggacagcuggguaggggcaauucuagguacaggaagcugucuccagaagacagguuuccuuccuguuaaucuaaagcugaugagucagcaucuccucugagugcucugcaccgugcccugugcccugcaagagaggcguccuguggauccagucaucuuugcagccucagcucugauuauaaagugcagaaacuugcauguacauugccuagucugugcaguucuggguaugagaagaggcaacucacuuugucccuggcccagguaacaagucuccauguccuucgcgcaccucccucccagcagccggcucagcugccacacugaagacguuugccugaaaaugggaguuuuccuuuauucucuuguccuccuugaagaaguagaauugaaagggaacguuccaucugagcaggccucauuggcauaugagucaugauucucgaucagacgccaucuguaaagagauaguaacuauuuacacauaguggccguacacaugguuacuaucacauauuuuuuucccuuuuuucuguuuuuaaaauacuucuucugagaugcacaguauauguguacagagccauauggaaacaggguagauuugcccauuuggguugagguuagucugcugucccuugaccuuaagauaauaaaauuuccaaaaccccugggguuucugagacugccuggcacccaaggguguguuuccucacuuugacucagacaggauuccagaagagacuuuguuuguaaagugauuggcuauuuaaaauuauggcaaaagccaaguacccugagauugguugcuccccuucaaucauagacacugauuguucuucucaaaauagcagauguuucuagauuguuccucacagacacuuuaaaaucaaccucuuaacuguauuaucugucagugagacaaugcccgaaaugcccgauugugcuuguucuagucaacacaauccagaggcagcaaaaggagcauuuucagcuaaaauggugugccaugccgcacacgcggggcgagcaaaugacacucagcugugcuugugggcauuaccuugcagauaaccucuuucuugagaaggcucugcagcucgccaggcgacacgccaacgcccuuuucgacuacgcagugacgggggaugugaagauguugcuggccgugcaacgccaucucaccgccgugcaggaugagaauggggacaggugaguugaguggggacuguugcacagcaagcucuguuucaggacggggaaaggcaaggauacugcccccacaaacugccuuugaaagggagcugcccucaucugacaagaccucgaguaugcugucucccuaggcaagaaggcucagauguguguaaucaugcuaauuuuacaccccugcuuuguguacuaaaauaguaauugagaaaauuauugacagcccugcaaagucccugaaguguuauugucauaguguacccaagaaagccagguaagaacaacauuaguagaguaacuaagaggaaaugccauucucuccuagcuacuagcugcuucucuguggccucuguuaagggucacgaggaugugagugggucaggcucugccucagcuccaggccaggcugugugggagucugacauuccagaugccaugccugcugucucuuccugagguucugugcacauagcuaccuggcuccuuccuaaaugguucucuuaguccuuccauugagacuucugaaaugaucuaaaagccuauaaauauagccagagacagcagucuugagauucaagugcuuuaucuaagugauccuaaaauagcguuaacacugaaaagaagcccuuugcuguggaagcauucuggagugcugugugcugagucucaguuuaaaaacaaagcgcuuuaggagaaugccaaccucagggguuucguacaaggaccuuuguccucgucacuugcaguguaacuaaggaugugguauaaccgcuggucuuauccuacacaguacaagaggaacccagacgaccuucugugaaaaaagcucugaauaacagaaggcgccuuuagaaggaaaucauccaguuagcauucaauagcaaauaaccacaaaacagagcagauaaccagagcaggacaccggugcuccaagggucaucuuuaaggacuggcgaaauucaugaguagugagggcgaguggauuaagcaauuaggaagugagaugcugcugucugaaggagaggcuguggaaagggaugccaggcacaugcaguccagcaagugugugcagaggaaugcaggaauguguguguaaggaccuggguguucauggggcagcugagacacuggccuucauucccaaguggguacaauacccagagccucgucaagccaagacuuaaacaagcaggcuccguguaagguuagggguaugagaccugggagacacagaggacccacucaggaguauacauaagggacuauucugguuucucuucuuuauucaucuugucauauuuggcuuauaaucuggacccugucaccauuagucaucauagaaauacaauaaagagaaacuauagaacccucugguaucggggaacuucccccagggguaugaagaucugaaggggaggggacgugcuucugugaagugcugagcugcacauggaaauguugaaguagcuuuugaagcccuuuuacucgacgugugucuguccgcaucaccucucacaagccuccugucagggucccaucaggagcaccacaggagccugagguguggcugcggugcuucucgucaaagcgugcgugcuucacuugcaguuaacacaggccuggggucaucuaaagaggccaccaugaucuucccugagaaguauugcuaagugaaauaucucagggauaaauaacaagaccuuguuuagaaauagaagucacuucucauuguuacggaggaagagagcucggcagcugaguuuucccaagcugcuccuaagccuaggcauuaccuuucuucauggucuuguaugucagggagagaccagggagagcugccagggacagaggcauggagacagagcuggcuuggagcuuaaugccauuugguuuccgacccggcaggugccuuugcacuucaugugucuggucagauguuaacacuccgggggcaggugggcacgaucaguguguaguagccugcgauaggcaguggagaggaaguucuccagagaaauaaugucaccucugaucaguacauucaguacaugguagggccaaggaaagcuacacauaguagcuagucuucagcuccagucauuucuugacauguuuuuguuucugucgcuugcuacauccccaguuaauuauugccacugugugucauuccagugucuuacacuuagccaucauccaccuccacgcucagcuugugagggaucugcuggaagucacaucugguuugaucucugaugacaucaucaacaugagaaaugaccuguaucagguaagcagccaccacaaggccgucgagaagagaaaagguugccuuaguaacacgugcgugagcuguucucagugaugggaaacaggaaaacagcaucuucucagaaguggcaucuuaaaagcauccuuaguugggaaugucauuuuacagagagauggguugggaucacggguuugauggcaaucacacuccauggaaauucaccaucuucuagaaaaggcagacuuuaagaccuagaagucagaguugauaaaguuuugagggcaaaccuuagaggggaaaaagucacagcugucaggagagacauguuaaaaagaaauccaaguuucaaaagccagaguuacagagacaaaguuuggagcugagaugaaaggauggaccauccagagacugucccagccggggauccaucccauaaucagccacaaaacgcagacacuauugcauaugccugcaagauuuugcggaaaggacccugauauagcuguuucuugugaggcuaugcuggggccuagcaaacacacaaguggaugcucacagucagcuauuggauggaucacagggcuccaaauggaggagcuagagaaaacacccaaggagcugaaggggucugcaacccuauagguggaacaacaauaugaacuaaccaauacccccagagcucaugucucuagcugcauauguagcagaaaauggcauagucgaccaucacuggaaagagaggccccuuggucuuacaaacuuuauaugccccaguacaggggaacgccagggccaagaagcaggaguggguagguaggggagcagggcgggaggaggguauaggggacuuucgggauagcauuugaaaugcaaaugaagaaaauaccuaauaaaaaauuggaaaaaaagaauauuuucaaauuaaaaaaaaaaaagaauuuugaggucugcggaaggaaggguauucgcacagcaacuggaucaaguguaugucaaagaaaggcucugaggucagcuccuggagaggugaaaggcuguaagaacaggaagaggcaccucagagucccauccagcucaggugugagaagguaagggagccccgaaaacuccagaggaaacuaccuggagauggcacagugagcugaggacagaggcagaugguagggcaaagcaaaccagaaacuccacuggcagacacagucugggagcuguggccuggcccaggaugguggccugcucuacggcuccuuccucucucaccucuauuucucuccaacccuuuugugccccuaccccucucucugggccuguuggucuuauccucuuguuggcuucuaaguuccucugcacucucuugcccagagugucauucugauccccacagccaggcccaugcugagaccucugcuuccaggucauauugcuuucauugaaaaacuguggccagcaaccgugaauaauuuguuauuuagaagagaugagaugagaacuaguggaauucuuacuuguuuguuuguuuguuugugauguuuuuuguuguuguuguugguuuuuuugguuugguuuggugcuugggacuguacccaaagcugagcacaaacccuuccagcaaucuacaaccauguuacuccauuuuuaaaacaaguuauucaaguuguuaucucuucuuauccaugcuucucucugucucccucugugucucucucugucucucucuugucugucugucugucucuguguguguguguaucccucucuaucaaucucucucugucucucugucucucucuuucucucccugugucuguguaucucucucuaucaaucucucucugucucucugucucucucuuucucucccugugucuguguaucucucucuaucaaucucucucugucauucugucuccgucucucccccccccccaauguguguguaucucucucuguugaucucucucuagcguacccaggcuggcacugagccaucaguguccuaccucagccucccaaaucauaggcuugacaagcaugugccuggcauguuaucucauuuuuaauuuaaaaaaaaaucauuauuuuagaagaaauuaaaaagaaacaaagagaugacucaguggacgaaguaucugcuguacaagugugaagaccauguucagauccccagaccaucgccagccagauuuaguaccacacccccccacaccccgcccccgccccccccuccccagucagggcaggagacaagcaucuugcauaugcggggggggggggggggggacaaaagacccugccuuauaaccuugcacaaggcagggggcaguacacacguugcccucugaccucaugcacgucccugcacccacacacucagagaaggaaagaagggaaggagagagggaaggaagaaaggagggagggagggagggaggaaaggaaggaaacuaacugcacauacacacuaaaacaaaagagcuaaaaaaauuuuauuuuaaaggaaaucauuaaauucuuauuuuuuaauacaauauuuuaaaguuacuuugaaaauaugaauuggaggcuggaaguggcucacaugcuuaaagccuugaguucguucgcuccccacaccaaagaaaaggcugaagcuguuaguucguuggccuguagcucucagacuuuuccguuuucagaggagcacagcugcuuucugcacagcacucugcacuucucugucugcagugauuccuauccaggggagaugacuaggcuaagguguuauuuuagauguguucuucaagaucugucuuccucgggcuuccaugccaucuugggauacuauugguauuuggaaagucauugggccccgaaaguugaauucuccaaacuuuuaggcagauggcacuuuuuaaaaacuuuguauugauucucugugaguuuugcaucuuuuuuuuuuuuuuuuuuuuuuuuuuuuuuggguuuucgagacaggguuucucuguguagcccuggcuguccuggcacucacuuuguagacuaggcaucaugcaccccagucccacucaucucccuguccccucauaucugcccucugcccuugcagccucccucccacaaaauaaacacucaaguaacaggaaagacaaaaacaaaaaaagcauagagaacaucucgaugugggagcgauagugugucaccgggcaucccacaguguaucccucuguccacacaucuucacuugcaaugaguguuugguucucugugacacgguaauucugaguuccccaaaguauaagcuuuuauguuauuucaagauuaugcuuauacugaauuuacaauaauaacaaacauguggcaaaagugagagccugagaacuaacgacauaaaaggcugugucacaugccggagaaugcaagaagagaacgcaguuuaaagacucacacuugggcuagucuagagaguggguggguuccaacagggaucugauagugacagauggucacagaaauguacuaugguuaguggaagauguuuggggagaauguuugagauaauuuacaaauaauccaaauuacuuagagaacuguauacuuuucugccaagaauaguuauuaugucaugcaugauggugcauaucuauaauuccagcccagaggagucugaggcaggaggauuguugugaguuuugggccauucuggccuguacaguggguuccaauuuugucuguauuauauuauagggucuuguuuaaacaacaagaacaacaacaacacaaaaccaaacaagcaaagaaaaaaaacccuccaaauuaaaaagaaacuaguucccaagcuggguguggggcacacauuuguauuucuaacacccaagaagacacaggaggacugacagcuucaugucaaucugggcuacacagcaaguucugggccagccucaaacacaggaagacccucucucaaacaaaacaaagcaaaacaacuccacaaagccaaacaaagaaacccaaaaguuaugagaaucacaaacgcugccugucuauguccuugaggcuaagaagcugguauggcagggaauguuugugcccauuaacugagugaagccaaggugggaaaaacuggggagaaaggucugagggcuccaaaucagagcagcuuugccuugagcucaggggagagguuccauccacaaagagcugggucgcacacaauagagccugcuuccgcagauccuaucaccaacagccagcagggcuuccugaauccaaccuccagcagccgagggaagcagguuuugcaaagaggauugggaaguagcaacuuccucuucuucaguuuauucuuauacuugugaugguuaaaaaugcaaucugccacuugucugcuaugagguagccugggugcaggggugaugccuuccuccaccucgccucucacuaccugugcaggcagucaggagagcuggccuggggucaugcaagggggugagcuagcccuguccuucacaggcuuucgagagcaggccuugcaucuagccugugcugcagaguagagaggacccucguggagggagcacagugagcagcccugagggugugagagcaggagaacuggcccugccccucacucacaggcuguaguguaugggagaguggguccugcccuuugggcagcacaguggagccagcucuggaggcauagggagauccgacagcucccuauuuccagaugugacuguugcauguauacaggaagagugcucuuccaguguuggcuacagacagcugcucugggaagacauguauucuuuagugugcucacaugcacuccacacgguuuuauacauacauuuccuaucccacaucagccuuucccuuuaaguuucgauuuaaaauacuuucucaauucauaauuuuugcaaaauucaacugagaggaccuguauauuuccugagauugaaccagacgcuuaccuccuaaguucccccagcaguuacauccuacuuaacacaauaauacaauuaggaauugcaacagauucuaaucagaucucaauauuuguauguacucauaugcauggauagcucuguaagauuuuuuuuuuccuaagcugaacauggugguauuguguuuuaguuccuguuauucagguagcuaaggcaggaagaguccuugaauauagauguuccaauguagccugggcagaaagcaagacuguuucuaagcagagugaaugaaugaaugaaugaauggucaauccaugugcuuguggauguguauguagcauuguacugugucccugucuugggucuucacgcuguuuauccuuuaguuucauagacagcugguuuguucucauugcuccugaagagaaugcugucauguccccuaacuagcugcucacuguccacaggcugugcacugcagugagcaccugcacuguacccaugggugccacaaguggguuucaagggcagugugagcccugagcuccacagauggauucuagggauuccuugaggcacgcauuuuaugcguguguaaaauguaacccuuggguguugguggcccaccagccacugcuucccagcaggaagaacucccugaaugggaggucgggcaaguccucacuacacagccugggcuucaguguaaagcgccuacaacacagacuggcuggcauugagaguuggugcuacucucuaccagugaucucagcuuuuugacagacacuuuugugauuggguuagccccacuuguuucugaaaacaguuuuccaugcguccuacuuacaaccauggaagcacagcuuugaggucaggguagucagaaagaccucccagagccuauuaugcacagugccugggauuguuuucugccugaacuuucuuagggagagugcuguauuggcuaacuaugcccugaggaucugguagcaccugugauaguauuacaguggagcuuguaucugugcgucucuugaagccagccugcagcaguguguucugguuuagccuauguacuuccagaccauuguggaaggaugacaucuuucuugauugcuuucuuuuaauagucuauuuauguuuuguuguuaaaaacacagcauugguucgauuugcaaauguauagaauuaccagcuauagauagauaccuaucagaaauucagagaaauuaaauuuucuucuacaagaguuaaaaaaaaucauguagcaaacguaucccauaaccccgacuguugaaugcugguucucuccgugggccuuugagccuggcaugcagaacaggaagcuccuugagugacaaaugucccuacaguaugacuccauaacguagccugaagccaggggcuacagacaucccuaagcaauggcucucccucuccuucucuguguagacaccucugcacuuggccgugaucaccaagcaggaagauguaguagaggauuugcugaggguuggggcugaccugagccuucuggaccgcuggggcaacucuguccugcaccuagcugccaaagaaggacacgacagaauccucagcauccugcucaagagcagaaaagcagcgccccuuaucgaccaccccaauggggaagguaagagcagucgccuugcuggcuaaccguccccucucggcugcagcauaagggcuuggcauuugacaaaugcaucugacaugacuuucaccaugaauacucuccucagccagcuggaguuugucauaucuugugguuauuucugcuguuuauuacagcaaacgcccuuaaagaguauuugugaguauugcuuaguaaguggaaaagcaagcccgagcaaacauuagucuuuauaaagcaucguguguguguguguguguguguguguguguguguguguguguggagaacguuuacauaguagcucagugucucccgagaacacagugggagcuuguggcuucugaaaguagaacaguggaccgucugaggcuuugaagcacgcccugaacagaaaccggaagugcugcgaccugguggugucccuccuccccgcagcccagcucugucagucucacccacaucucugccuuuguucggccuuaggucuaaaugccauccacauagcugugaugagcaauagccugccaugucugcugcugcugguggcugccggggcagaagucaaugcucaggagcagaagucugggcgcacagcgcugcaccuggccguggaguacgacaacaucuccuuggcuggcugccugcuucuggagguaaaggcguacuugugaucuugaccuaaaucccccuggaaguuuuagggaagucuuuucaaagaaugacucuagggccagcucgcugucaguauuccacugucugcuuucugcauccccagcuccagcccagcucucaaccuggggaugccagugacagagccagcccaguauagcaguugggugaaugauguaaccugaggugcaacggagauguggagguagacaguggaggagagagccccugcuaacucuuucuuugugggcggauuuagggugaugcccacguggacaguaccaccuaugaugggacuacaccucugcauauagcggccggaagaggguccaccagacuggcagcucuucucaaagcagcagguaagacgcuguggucacugauaccagcaaagcaaacugccugcaaguucaaagcugccugcggaagcugcgguucugcccugggaaagugccgguaaaggagaccugcacccgggccacccugcagcggcugcacuggaggcucugcuuggccucggguuuaccuugaugcucacgcuaguucccacucucugguuaucuacguugccuuuggguuguugagguugacucgguaccuauaaaaucuugagcugugucagcuucuggucauauuacaagucucccagaaggaaaauaucuaaagacuuccuuuugcaaaaaaaaaaaagucucuuagaagcugaaagcaugggaaaagcaaaugagcccuguauuuguguuacugugcacgaggcacuaagacuugcuggccuccacugccuuuccucggcuccaggcaccaugcuggcaucccauauucacagucuccuuuaucacaucuacuccucaguaacucucugagauaagaacuguugcuauuaaucccaucugagcaccaagaaggcagacuacaaagaugaucaagccccacucccagugucccggaaagcugagucacagcaccgcagccugacugcagacucuuauucuucacgcugucuuucuuucugcucugccugggguucuaguccuuccuguaaagcacucagaaacauuccagcucaucuccugucuccggcgcuuuguguguucaguguuaacacaugcuugaugagguuggcuggccuuccgggccugcccagacacaccugauuuacuucagagguugauaagggaggauuugugaacgacacauuccuuauagauucaggcaaagaggccuugguuguaauguguugagucauuuuggaagucacugauuauacugggggaaaaaaaaaagguugucucuuagucagacaccugaaaucucaacauucagaaggcugaggcaggagaauggccacaagcuuaggcuaccuugguccacauaguucuaggcagaacaaagauacauagugagauacugucucgacaguaaauauauaaauguaaacacuuuuacuugaauucaccaugaaaagguagcaaauaauaucuugugugacauaaagaaaaccagacaaaaagccuagcccugaccuccucggagucacaaaggucacuucagggacauguguagcccucgggucuucaaacucauuucccagucauguuccuggccauguuuugcucacguuauaaaagagcaagugaggcagcagagaguggcaaggcagcaguguuggcccaagucagagguucugucggcagaacugaagcaaacacuucauuccaaaaggcugugcugagccugccugccugccugccacuguuggccaacccggagccggacacccauagguagaauagccaggaaggcaugacagguaacuccacuaacauuaggguuacguuuuauguugucuugcugggagcugaagaacaggcaauauccccaagauuuguuagcacauuuuuuccccauaacaacacauccugccuagcauagcggccuugcgguguccauuucucuguugcuuaggaacuagaacuagggccccaacaguacagcacucaaggacagagcugaccaagcaaaucugcuccacacaaguaagcgagagugugagaaguguguauugguagauguaaaugugaagguucaggacuuuaccccugugggugcauaaauugccaccuacuaguccuuagguuaaaauguauccuuuguaguauaauaauaauaagaauaauaauccugcagaguuacaaaucccaggaguacuugaagucuuucauguauuuacuuuacauccugaucacguccuccccuccucccagugcccuccacauggcuccuccuccccacccccucccucucucuucacaggguccuuggcuaccuacuuccauagaagugaauuaaaauuuuuuaaaaaguuguuuuaaauuucacuagaaaugaaaaguuauccuguaauugccuuaaugagcuagagguaaccugucccucgacaugggaauccugugugugauuggaggcggacaagcuuuuucuuuuacacaacacuguauuucccugacuccauaggagcagacccccugguggagaacuuugagccucucuaugaccuggacgacucuugggagaaggcuggagaagaugagggaguggugccagguaccacaccccuggacauggcugccaacuggcaggugagcccuggccagcccaucucauggguauuuacgggggagccaguggcucaggaauauaaaacagauggucuucuuggcaugcuccucccuaaagaacaugccuuuguuuuuaugaggucuuguuaccgagagggucuuaaucuugaaagauggucuucauccaugaaagaugaagguccggugagccagaguguaaagcuguuuccguaacuggauuagaguucagauaugagagguuagaaaagcacaaaaugcacagaagaguuacccugucagcacacgaccagaguucuugccauuucugucagaagcuagcuugcucagagcuuaaguaagagguuucugaacauaaaaauaaacuagaaauucucuuguggauuuccauaaacauauuaaaaaccuuccuuaaaacacaauagggcuuacacuuaaaggagaaaacgcuagguguuuggaccaagagaaaagagccagaaggcaaaguaggcaguguacggguccaacacagucggguuuguaggaaucuagacucucugugcacgucuaggaggcuguuugcuggcuggguuccuacagggaacacagaagacugaccccugaccugauuccuacccuguguaccaucagcaaauucaccucagagaacaccaggacuuuuaaaaaucauuucugugaauauuuucucauguuuuucuauccgacagguauuugacauacuaaaugggaaaccguaugagccuguguucacaucugaugauauacuaccacaaggugagguguggcaggacagauucucucagccaguguugccccaugcugugguuuacaggagaggagaggccagccugggcgaggguguacugcaaaccgucuagaucuuaucucagaaucugagaucccuggagguguggcccugagcugcuagaagcaccuacugcugcugcugagcagggccucuggacuuggcagaagcuugguggccuccaucagaaguuggacaaugaccuguccucucagauugauugucccuggaagguuaaagcagucauguuucuuccuuaggggacaugaagcagcugacagaagacacgaggcuacaacucugcaaacugcuggaaauuccugauccagacaaaaacugggccacucuggcacagaaguugggucuggggauacugaacaaugccuuccggcugaguccugcuccuucuaaaacucucauggacaacuaugagguaacgcgccgccguaccauuuagaguugucuguguaacuauugguaguugaccgugucagcuccacugagcagcacagccuacccccuuacauaguaacuuuauggaaggaaaccagucauugccuggaaggcaaagggagccaggccaggauggcgccuuuuucuugagaagacugguuacccgucucucggcauucccuguuuucaaauucucagagccuuccugugaaaauacuacugcccacaggauggggaccccuccaagcugugaucggugugugcaucccuguuugcaagagggagccccccagggccauggcuucauuguucugucgggugacuccuauuagagcaauuccaaacuaaaaaauagacaaacaugggcgagcuacuccgaaugaggcugucauugcuagcugcugucuucccuggauuucugugcguagacaucaccguaggcagucuccugucuccugucuccaugaacucacaggcuucuuucccuuccuuccccucuuuuuucuuuaucucucucccccuucucccucaucuucuccaucuccuucaucuucuccaucucccuuauccuccccuucuccaucucccuuauucucuccuucaccucuccugugauuuuucugaauggauuugauccaagaugggaacuagaaccuaagcacuguguuucuucagguuccuucccugcccucuccaaaccccccagcucucuggagcagacacagagaagggacgcuaacagccugcaaacaggcuggaacacacgaacauacucucccuuuuccuaccaggucucuggggguaccaucaaagagcugauggaggcccugcaacagaugggcuacacagaggccauugaagugauccaggcagccuuccgcaccccggcaaccacagccuccagccccgugaccacugcucagguccacugucugccucucucgucuuccuccacgaggcagcacauagguaaagaggcugagagaguuccuuuccucgcuggcaaggucuuugugcucugggacguggcacuacacucccuuucccuagucuuuuuccugacauguguuccucuguggcaugccacccgcucccuccccacagugcuccucugcgcacacaggaacaggcaguucccacagacacucacauuggcauauaggucacuuagaaucccaguagacacuggacauggcggggaggguuaaagaaacacuacuucucauauuuguuaaauuuggagaaagauucuaagaaaggugcacagcccugggccacaggacaagaaguaggacccaggaaauaugcauacuguaugacccuuccuuucaugccaccacccucaggucccccaccuccucccucccucggcacuccccguccuucagcucccacccugcucaugguccugccuuugucuucccacacuaacauccaccugucacccccaacacaugcauuuguacgaauggaucucgguacaggcuugaauuaugucauuguucccggcccgugcuuucucuaaccucugcacccuuucuucuuguucauuuucuacccuagccacaaacuccacugagaccaggaacaacuagcauucucccaucuuuguauuaugccagcacccggguggcaggccuuccaucugggcucaguagguuaugucugccuuccaccuggggcaguccuccccugggagccugccugucaccuucagcagguccuggacaccugauucuugccucuuuguccuguacuguccuuccuuccccaccugcuguggagaaccucuugcuaggauguaacuucucaucuuuaaacacuggcccgccuggccacaggcugcuuagccccgcuuugauuaauguuacaucucaaugaauggcuuuguccauugauagcgcuuugguuagcucauguuuucacguuuguaugauacaugcuguuauuuuuguucgcauuucucauaugggggaaucuacagguaaacacagccuccaaguucaguagaaaaaugucaucauuaagaguauuauauccaauaaacaguaaacagauuuuuuaaaagagaaagaaauuuagagaaaaacgagacaucacuuccuuguuacacccuuuaguugaguucaaacuucucagaagaauaugauaacugcuggucagcucaccaccucugucugccaucugcuucuguccccuccucuccuacacucuccuccacguugcccgauugacacucauccugucacagcugauagcccucacucaccaguguccucucagggccuugucacccacacccacccugcugccuccuccucacuccugugcauguaugugugcacugggguccuuagggcauuuuuauacauacuuaguucugguuuauucucaugacucccucagcucccaucgccccagcccuggacccucuacucccucccuccccccccccccccgcacucgcucccuucccauuuucacauguguucccuacccuuuccaucccuuuaaagccuguuuuccgcccccuggaggccuuugcuaguuuucuggccucugcucacgcucacuuccacaugaauauacauacgugacuguuggaagcuaggauccacacgugagagagaacgaaugguauuuaugucucugggcugccuugauuaguauucuccauuaaccugcaaguuucaucucucuuuacggccgaauaaacuuuuaucaucuucacacaacucuuggcucuugcacaaacucauacuggccaugacugucaaaaguauagccaggcuguaacaaaaucuaagaguggcaaugaauacuuucuggcauucagguccucaugcuuaacccugaaagggcaucucuucuuggcagaugccaaguuccacccauccucacugcuugccugaacuccaacaguggcuccuagucagccucuuugacucuuugcuugccccuccaucaguucucugcaccacggugaugugacaugauagggcuccagucacaauuaaaaacuaaauacuuagcagcuaggaacacggcaaguguccccuccucuaccuuugggaaagccagguagggugacaaauauguacaacccgguagcccacucauagaggaaaggacaccgagagagguggauccacgggacucacuggccagucucuaaaaacaagauggagaaggaacaaggaagucacacaauguugaccuccccacaccccacaccugcacaugagcacacaucccacaaacacaaagcaaauacuuaaauacuguauuaaauuuccaucauugugaccaacuuaggagagauuugguugggcacacaguuuuuauaggucccaugguccacugccuucgggguauagcaaaacccuucaucacggaggaagcacaugguagaggaauccuacucacuucaagguguuuggaaguacacagagauggggaggagccccaguacagaucucuuucaaagccacgcccuccaugaccuaacuuccuucugugaggccccauagucaaagaguuguaucaccuccagauaaugucacaggcuagaaaccaagccuuuacuuagcacacagccuuugugggacauuuuaagauccgaaccauaauacacaguaagccuuucaaaugcugcccagucccuguuacacaacagacaguugacuggaugagguaacaccaggacaccgcucuggcauggucauugagucucaguguucugacguuaagauucaaugaugagagucaaacauuugcuuaguaaguguuaugcuucuguuucuuuagucacucuguacagaaauaaucugcucugguucccaggaaugcuuuucaggcgauagaauuuaacuuaagcuuuugguauagacacauuuaaaaaaaaaaaaaaaagccucauuuucuugcaccaaaagaaaauuuucuaggcaauguguauucuuuaaaagcucauacagcucagagaaaggugccauuuuuaguuccugcuucuguuaugaguuuauuuugccuuguauucagcaguuugcccagccguuaaaaaaaaaaaaaaaaaaaaaaaagacaaaagguaaaaugauagagcaguuagaaaaauaugccucacuuuacaaaggaaaacauguuuauccugaaccaagagaauucagaacagauucuguucaacagaaagacugauguacccuguagcacucucuaaugucauuugauaacccugccauucacacagccaagcagcaccgguggcaugauggggaggugggaugccgugcugcgcaggagcuagcaagcacaacccuccauaccauaguccacacggagccugggagggagcccacugcuguggauggugcucuagggcacugugacaaagcucucuggguuuauaucagcccccagcuccuauccaucauggaagggauucagggcaggaacccaaagacuuugaaucugaaacugcugagcaccccggcuugcugccucaugggcucaugcuccacuggcuuucuuacacagcccuggacugccucucagggaguggugcugucuacagaggauagguccuccuccagucaguuaacugucaggacacgcccacagaccagucucaucuggcugggcccucccucaucugcaccucccuccucaagugauucuagacgugugaaguugacaguugaaggugacagggacagcaggcagaacaaagcccuugccauggccuaacucagccccucaugagucugugcuuucuccgcagaugaacuccgggauagugacagcgucugugacagugguguggagacauccuuccgcaaacucagcuuuacagagucucuuacuggagacagcccacugcuaucucugaacaaaaugccccacgguuaugggcaggaaggaccuauugaaggcaaaauuuagccugcuggccguucccccacacuguguaaaccaaagcccugacaguccauugcaucgucccaaaggaggaaggcaaagcgaauccaaaggugcuggagaaucgccggccugcagggucacucgauuucauucaaggccuuccgaauuuggcguccuuucuugguucugaaaugaaauguaguugccacgcacagacggugucuagcaaucauggcgcucgcucgcucagcugcacucuauggcucaggugcagugucuugagcuuucucugcugcuacuggaucacauuugcuuuguguuguuacugcugucccuccgcuggguuccugcugucauuaaaaggugucgcuguccccacccgguguccuuucuagccaucuacuguaaguugugcauucaaauuaagauuaaggaaaaacauauuuuuaaaugaguaccuugaugcgcaauaaaaaaaagacauuucuuuuuuuaaugugguuuaucugugauuuaaaaauaaaaaacacaugaacuuacaauauuuaaaacaugcuacaaucagugcugaaaauaguauuuuccccguuuuaugcauuuuacuauuguaaauauguuuucuaaaucaaauacuuuaaaagaagaaauguugaauuuauaaaugcuauuuacuuuuuuauuuuacuuuuauaauaaaaguacaagcacauuguugaccuaau

SEQ ID NO: 12085 - RNA, 35775 nt, Mus musculus
gagcugcaggggcagcgcauacacuacaauggcugcuggaaagaggcguaaggaaacaauuuccaggcccgccgcguccagcccgaaauaugagaaaaaaauuauuagaaauuccgcgggcgguguaaaggcggcggacgggccggagggaggauguuaaagcuccgcggugaguucuccggggguccggggcggcggggaggcguuuagcgggaggaauaucaggguuauuuaaauuaugggacuagccgagggggcagaggagccgcggcggcggcaggaggaggaaaaguuugugcuacucccagccccugcucaggaccccagagagaaaaauaauaauaaaaaaucaaauaaaaucgugcggcggggcugcaaggacucccgaggucgcugcugacagggcagggggcgacgcgacuggggacccgaaggugaggucggugggaaaaaaaaaacccuuuuauucagggucuggaaaguuugaaaaguuuuccuccuccuccuccuccuccucucuggugcugugaauauugugacagcggcagcggcagcagagagagcggaagacauuagagacccgaaaaauaagggaaaaauuaauauaaauucgguuuugagaggaaacucuccgcguuuuccaccaaaacaucccgggggaaggucgcuucccagagggccuggcggagacccgcggucggcaauauuugggggguacugggagugacuugggguaacuuugcccccuuuuccgaagagguuuuucuuuucuggagaaaugcauuuguuuuugcccuccugcccaggugggagagccgagucggggugcgggguccgcggggcgccggacccagccggguggcgacgggggcguagggggagggggugcuaaaugaaagcaggagaucgggacggagcagggacagcuuguugucaguaucauaaacaaccaaaauggagggagaacucaggcauauaaccaaauaaaaauuguuaaaaaaucgcaaaaaaucccuaaaaauccgggaugcgccccccuuucucgccaaagguaaaagugugaaccgccuuuccccugaaguccauuuggacuuugcagggaccaaggaguuaauauuuauuuauuuuuuaaaacuuucgaagggcaaaagccuuuuauaacuccaccgacaaugagaaaacgugaaaauccaaugcaagagaagcagggggagggagggggaggugguagugcagaaacuacuaaacuuauugguaauguggacugaucugagauaagauaaacacuauauuugcuauuuuauaacucccuuuuaaugaucugugaggagguugcuuuuugggguaggaaaaaaagugaugccauuuucuuaauagaguuaauaugugugauuggaagaauaaaccuuuccggcuuuagauugcauuuucgucgcauuuaugccucggguuuuguuaguggcucccuccuuucuuuaagcugggcucuccagaggagggguggaaaggugcuguugcccagagagacuggagggcaagacuggcgaaccuucuggggagggguggggaguuguuugguuucucccuuccuggcucguuugcuucaccuguucgcccucacuaaggaauguuggacugaaguuuucugguuuuauguauauaaaaggauggugccucuugcaucacauugauguuagugggaaagugcugcugauguugguuccacgugggaucugggacagagcagggcauuuuaaagggacagcuucucuuuucuuaggguuuucaucaccuaugcagacuuacagaggaccaaagucagaggugcuggaaguguguggugauggaagagccuucucuuuccauuacucaagugcaccccccguuuaggagugauggagggagaggagggauaaacaagcccagcagaagauggauguguguguggcuuaguuuucauccacgcuguucuuuuauguaacaagcccucccagaaacuuuucauguuacauugcuuugcucuggaagcugauuuuggaaagaauuguggaaaaauggaaaaaguugaaggugugugguguaaugguauagcauuauugaacacuuaugaauucugugcagugagaucaaagagccauguaugcccauaauggggguuuacagccauuuuguaaaauaccuaaugcucaguuuggcuucagguacacugaggacuucugguugaaacuuacaggcaaagugguggagacuccuuaacauuguaaacaguagacauuucuggggaggcgggaguggcucucaugaagaccauggaaaaguuuauauauauauuucaaaauuauauauaguccauccuaugcauauguuauaacuuugcacuuugaaaaugaaaaugcuuggauauccugaaaccuauggauuuguaucuuuuccgcugaaaugauuuguguuuaccaggaaauguuugcuaaucguuagcuccuaucugcucuugugucugcucuugugucuuagauguccgcaguauuuucaaaagguaaaauguguacauuguuaacuguacaguauuuaagauuacaacuaaucugggauggaaacuacuuauauucaguuuccacagccauauagaguuugggaaauaaaucucuauuuugcuuuguuuuuacaauuuauagaaauggaccaaaguaagaacugaguuuuuagacuucuuagguaguguucucuuuugccauacugcauaaaaauuauuuugugacaauccauuguguguuaguuccuguuucuaacugacuuuucucagcacuuucuguccauaccuacaugaaaacaguaucagugaccugugagcacaucaucuugugguuucccacuuugggaacaacuacagcuuucuaagaagucacuaaggaaagcacaggggcacaaaucccugugaaauccugaugcuuggaaagagauuaaagucucaaugaagaagaugaccccuccccaccauaaucuuguguccaaagauuucagaauuccaucacuacuuacaaaaaaaaaaaaaaaaaacccucugaaguuuauuuugcauguucauuauguugcuggcucaagauaguuacucugacuauaaguagucaggauuauacuuugugcuuaaaaugcaugagacuuucggauacugagcgguugccacuuugacaaaccaaauacaauuaccaauaaauucagugucaguaaaagucaaggcaaguuuugcuuuugguucuguuagcucauugagcuacugaagguguuugggcacuuaaaaauaggaucucauucuuuguugucaaccucaacacaaguucaccuauuaaaauagagguuauucuuucucauauagaguaauauacacuuuguugggguuuaguaaaaccagcucuuuuugaaguuaaaaaaaauacacucauaauguccagaugaaaaccuguaacucuuagagucuugcuuagauagggaguagcacaagagcugaguugaguugauuguacuaaggcuuuuugaugcuuagaaacccugccuguugaacuuccuuugcuggaaguccuauuaaauuauaccaauacagagagauagucuaaggacagcagcccaugcuccauacgaccucacuuacaguuagagaaaccccacagaggagaauucuucucugagacuuagaugcccaguggcacuacugaaaauucugaaaugauuauuuccugcagugguggaugauauagugagugugggauaauacugauaaaaccccuuaucuguguauuuauuuaugauaaucaaaauaguucaauaagcagacauuuucuaguuaaaguaguugaauuuuccuuuaucacuauaauuugaaauuuuaagaauuuuuuuugcuuuaguaucaauucaaaaaugagaauuuuuccuucauuauuauaauaauccugguugcuauuauguacauuuucauaugauauucuagaaauuuaccuaaggguuaaacuauuguuuuuuaaauuaaaugucauguuccuaucacaacugggauuuuaaaagacguacaacugaaaccuaugccaugccugccuuugaagguuacuucaguaaucauuuuacucaagcuguauaaucaaacuagccauccuucuaggaaugcuuuaauauuauuucuuuguaauuuuguucuuugacaauuuaacguguaaaaaauuaaccuguuaacucaugagaugagaguuucagaagaagagugucuugucaaguaaaagcuaagcaaguagaucuguucaggguggaagggaaacugucccuuaagccaucguuuaaaggguuuuaagaaccugguaaauauuuuuuucugaaacacagacuauguugaaagcaugucagucauugcuugaaaacaaagauggauuuuuauuucuuuaguuuuaacaggaauuaauguaggcagcauauuuaaccaauuaguaaguguuuagguacccuuagaacaguauuuacaaauaaguucaguucgagggcaggcuacaucggauugaugaacuguaagguucacugugguuucagagcucaugaagaagaacucuuuuccauucuaacacaaggacacaguagaagugaugugugguugcuuuuuguaaucaucucacugcuaaccuucuuagaaacucucaaaucugaaauccaccgguuacugcuuuccuucauaucaaggcaacuuuuuuaucucauguguaaauuuaauuucagguuuaauuugagaaaguaaaugaauauuucuagguuauaaauuuuuaugaaaaauuggugugaaauuauuaaaauuugacauuauaagaaauauaucuguauaaaagcuuaauagaaauuauuacagaggcauagcuugauuuuuacuuuuaaauucauuggccuaucucccuaagguuugcauucuaccuagugugcccuccugucucugucuacuccuuacaggggagaguugaccaggauaucaugauguucacauaucaaagacauuggaauguuuuuguauucugauuuuguauuuauauugguguuugccauucuuaaggauuuugcuuuucuaaaaugcauaucaaguacaaaaaauguuacaaaacaaauaauaucucauuuuuaaaaagugaaguaguaugauauuacacuaaaauuguuaguauuuaaaagucccugaacgucuuguaaauagaguuacuacaggaucuugguauuaaaacuaaccacaguuugugcugggagcuuggagugacuccuuaugaagggugcaugugagugaacuucugcacuuauauccuagguucauagggaaagcaggcagcuaaaaauaacguggaaccuuuuccuaauuuaaaauuauagaaaaccuagaaaugugaagauaccagagaacaaaaauaugguuuugaugccuuuuaaauauuaauacuuuugaacaaugagaauauuguacaacaucaguguaaacuaaaauauucaaaaauaauaaugagaaacugaaaaacuaagaauuucagaauaaaauuggaauuaugguaaauuuaaaauucagcuuaugugaauaaagaauaaccaacuacaaagcaaacccauaaguuuacaaaagaaagaaagaaagaaacggaaagaaaagaaucagagugguacuuuggggaauuuuaucagagaauauuuuuagugcaaauugcaggauuuguaaucaccuuugaaacaagaguucccaagccuuugcuccuucuucuguagauguggauuaaacuaaauccuaauuaugauuucuagugaugauuucuuugaaauucauuuuuaacaaaaggaaaaagagaaagucauuuucugcuguuuuuaaaagagauuuuaaagagguaucaaauguguagcaaugugaaauggucugagagccuuagaaaucaucgaauaauacuucccuuguuaauuaucagaaagcuuaaaacuuguuuagguuaauaaaauaaauuuuaaagcuucagucuaagaauaauuuugcucuguggauuuuuuaagggcaauuugaauaauuucuuacagucuuaauagcccuuuaaaaacuuugacaagacaaagauaagaguauuucaccaauaagauuguuaauuucuagaguguuuuaagguguaagcugcugauuaaagguaugucucuuucucauucauuaguuaguugguuuucuaaaggagaauugaaaccuuuugugauaucugaaguagaauuuaccucgagcucuggaaacugcucagagaaugcauggggcucuuugcaguggugggagagagagcauugcagagucuugaaaucuaucuuugagcaggagacucucauuuuacgcuuuuuaguuguuaguacuuaaauuauugucucauauuaguguugguguauugcauguaagcuguuuacagucuccuauguuauaguuucugaagaugaaaauacuaauucucagaguaaauaccacaauuaaaaagcugacauaugacuuuuaaaaaauaucuaaugucugaucagugggcauuagaaucuuuaauauacauuuuugggaaacuaaaaucaguuuuuaaaugaggacuauaaaucuuuuguguaaaaggcagaaucagaaaguguuccagucagcucuguuucucugaagacacggcagucgauuguucuugagaaagagaauuuuaagaaaccaaagcuggaagcuuaagguuguuuaacuuugcagguucaaaacaucaccaauugauuuuacucugcuacguuuucucaguaaaucaauuuuauuuucuuguauuguuuuaaugcuauaauuucagagcccaaguuaauucucaucaugcccaaagaaguuauaauaaaaauguucuagugucuugucuucaggcagugagguagaacaguauuuguagaagagugcauucccuuucuuagguugucuuucgcauucucuagguauaauuucugagaguguaccacucugaagaagagaaauuagcucuauuacguugacaugaaauuugucauaauuuuuuaaguucauugaaaaaauguuacuuugcauauuugaguaaaacauaucauauucuuuaaaucagcacuuguguguccagugugcccaauugcaugcucagccucaaauacaaauuugcucuccuagcgccuuuaaauuugcuuagguaaauguuagaaaauguucuucccguguuucgguaauuuguuauugucugggauaauuuaauugaguaaauuucuaucuugguuuucuuucucuucaaauauuagucuuuuacuugaaaauuguugguaaaugcaugugauuucagcauuaagauagaaucggacauacaauaaaauagguuaucccaagaguggugaaaacaacgcugcugguucuugcuuggacguccuggugaguacagugugugcucugucuccugugcauccucagagcugaugcugugcagagcugacuucauuuugcucuauggagagugcauggucagccuucccagggauuucuuucucaguucuaaaaaaaaaaaaaaaauaguauuaaggcauuccuugaaaauacuuugucaugcaucacagcacugugugugaagauguguuaccguaguuguuuacccaaauugggauuaaaacaaaccaucaaauaauaaacuuaacugggcaaaaaugagauuuaaauauuuaucugaauaaauugauuuacuggugaaaugacagaauuuuaaucaaaagaauugguuuuucuuucagaaucuguuuuucagccccagaaguuuguaaguaaaauaauguuaaaaauaauaguaaugauauaaaaucaaaaaguguggagcucugcaaaaggucuuaagcauuugucuuugaugguuaguaaacauauuuuaaaugaucaaaaugacaucaaagaacuuaauaucuucaaucauuuugguuauuuuuguaagaaaaguaguaacagccuaguaccgaacugcacaucuguuguguuugggagcuuuaauuauuacguguuuacuaggacagugcuacuucaguguuuuuuaaaaguacuguuaucaguguuuucuucagaagcccucuuuguggauauuaaaacuuaauuccguuuuccugaagcuuuucguacuacuuuuauuuuuuaagcaugcccuguucucacagcaugcuguucuugaaagaaagugcuguccugaagcacuuuaaaccauagcucagauuagcucaacauaggcacugcagguauagccauucuguucgacauuggcccugcgucauacuugaaugaaauuauacucaauucacccauuauuggucacugcaugaauaggagaagaaaacagcugagaagaggagaaaggaucccguuccgaggcugacucaugauagccuuucugcagacuaugauuucuuugccagaauuaaaaggagcuuguuaauuagaaccaaaaugcccgugugucuacgaacucuuuuccuaaucaggauucagacacacuggugugcuuccuuccauuggcauccaagugugcuugcugcuuggcucugcucucuucucagugcugccacccuguggauggcagugccgcugcggcaggcacacauuugcuguguuaucaagugguaccguucuggagcacugguggaaagaagcugagcugagcgcagagccuguuguguugcuuugccgcugugugugcugcuguacuccaguuagguuuguaaaaguuaugcagcgcagaaggacgguacucagcugccaaaaacaugaaaauuuggaaaaacuuuaaagguaaaugcuguuguuugucuaaucugccguuucacuaaaauaaagcagaguuagacuagugcuucaaauguggcuuacaaguagccaaguaagaacacagagguucagaguguguaaagaugagaaacgucaugagauuuuuaauguuagccaaguuauaauugcaaguucuuccuuaguaaaagcaaaaccaaaaaacuaacacucucucucucucucucucucucucucacacacacacacacacacacacacacacacaugggugggggagucagggacuguuucugcuuaaaaggaaaggaaaccuaacuugauugguuacauucuucucugaaucacugaccaacacgacuugcauuguaucagcaucauauuuaaggagugaugcugcgccucggccauaaagcgcuugggcuggaucacaggauuagucccuugcuuuucccugccuuaucucauuucauuuucaaagcagucugugaguaaggcagggugugcacaacaagcacuaaguaagccucauuauagacagacuauaaaagcuaauuauaaauuaauuucuuaguguaaaccuaaguugugucaguacaaagauuagcauauuuauaguuacaaauuuguuccaaaaauuuaaauuuuuucuuaaaguuugcagaguagcucaaguuagaaaguguuguaagaauucuuauuaagaaauaaggcauugauggaaaauguaucugcucuguaaguuaaaggcgauuuuaaaauauucuaaaucuaagcuuugcuuuacaguaugaaucucagacacaguuucuuuuagacggauuuauggccaagccaccagacuucugacugguuacuguuucuuucaaaaguuuugaaugguuugcucuaggaaacaauguaauuguauaugguagcuguagaaaguauugcuuagguugguuaguuuuagauacugagcuucuaagaccaaaauguguggauggguguaaaagggaucacuguaguauaugugcuguccccuauuaaaagaccaaguucaagugcuccaguuuguacuguuccucauauuugaggguugggaauuucuuucaucucuguaaauaccauuuuauauuuuuuaaaaauuauugccgugaaaaugugauuaaauuuugaaucaguacuaaagaguuaccacuuuaaaagaaacuuuaagaaagacuauuugcuucaucuuguuccucuucauaguaagcucagauaagacuggauccgcugaccuuauuuuaacaaagcaguauaaacaguuguacagauuuaucuaaaaucacaagcuuuuauaguguuuuaaauacgaguauaacuuucuugucuucacucagcuacagagcaucgugccacucuauaauuuauucuugugcuaagugggagacaaaauaggaaggguaccuuaggccacucuguugggguaccuauauuuacugcacacuauuuuuuuuuucugcuugcuuuuaaaauugcuguuuagaugguggguagacauaccaaaagaacacaaaggcagugcauguuuaaaugcccagugaauaauauagauaucaaacacuauaguauucuuggaagggagaagggaaacuugagauggaccuugggaaaggcacaaguuaaaaauagacaaggagagagagagagagagagagagagagagagagagagagagagagaaugagaacacaacaucuaggucaaagaaaugguuucuacaggaggcagaaaugugcugcuugucugguacgcugagguaguaguacugaagaggguguuucugaggagaugggugugcugaggucugaccagagcaagaccucauaaccagccacagaauuugcuccaugugugguagaaaguuuuuagcuaugcaagcagaggauuuuggguuaggaaacuuaaggugccucuuaauccagaauaacuuaagcaggaagaaaugagauauacuccuacuuugacguaggagccuccucugcucugguauuccccauuagguccaugcucaccagaacgaucugaacauuuauuuauuuauuuauuuauuuauuuauuuauuuauuuucaauaaugccuggcucucaacacaccuacagcuugcagcuuagacgucaguaaugaccccaggacucgugcuucuaaucauaaaacuacucaugaucacucacuuggaacuggaguugcacuucuguuguaggggcguaaucacagugggcagguggaggaagaccaagagagccaggcucacagaggagcagccugggaacaaagguacaccgcuccauggaacucugucccuuggcuaaguaucaggaugccagugagcagacacuuagcaagggaggcuagccgaugagacaaggacugugcucuaacaggucuuccgcagcaccuuguggugauuauccugauugggagagaagcugggccucugguaaugcagugguacucaguacuaugcucaguccucucccugcaggcuccacccuucauuucuacugagccucugguaaugcagugguacucaguacuaugcucaguccucgcccugcagucuccacccuuaauuucuacugagccucugguaaugcagugguacucaguacuaugcucaguccucgcccugcagucuccacccuuaauuucuacugagcccuucaccagguguccugccuccacuccaaagcagacugccuucugcauagucucuacuuggcauuuccuugcuucuggauuucuguaguguugccuaacacuucuucagagccccagggagaauauaucuagcugucuagcuaccuagcugagguggcuauaccauaugcuaugcauggcaugucgggggcuguggcaaacaaccuguuaugccagcccaauuuaggcugcccucccugggcuggaauuucccacucuuccucucucccuacauccuguccccaguaucuuuuuuccucaacaaagccaaucucaugagaaaaguuuguguuuuguguauggucccuuuucuuuaucucuccauucuugccauccagccuaccaugaaagaaaacaguaaacgccccccaggagucaaauccagggacaucuuuauuaucccuaggggucuguucuguagugccaucacucuccacauucgagccucuuucuuuccuauccucuucugccaccuccuuuguacuuuccuuuggugcacauucuuccaccuguccuagcucacuagcauguuggcauuuccuggaacuugccaagcuccuugaccagcugauucucugugcaugcucucccugagcaccagcucccucccaugguacccuuuauaugaugcuucacacuaacgaagccgcuaccucuccuuccuuugugggccuccauacuucuuucuauauaagccagcucccuacaucccucaguuuuccuccugugucuuaugcauaccagacuguguaguaccugcuuugaguuagguucuaagcuauauccuaucagauuauaaacaaggcuuccucaggcuggcaggugguaggaaagcaguaagaaggaauccaaggaugaauaguucugaggggcucaaugaacaaggaccauuggagacaacagcaaagacaaacgagcauuuguauaggagcuguaacaaugaggaacagucuggaaaaauccuggucagauaacuaggcagaaguccuguucuaguuaggggagcuaacuagacacaaagggaacaaguugaagaucagccugagacacaaaugccuuggggacuguccuaaaugucuuuggggacuacuagcccaaaagugagugguacuccugaaccauguggagguugcccuuggcaaggugacugugacaaccauccucuugcuugucuuaucaucuugugcucuguggcuagaggucaggggcaucugguaggcauaacacccugaaaagcacaacuccuugagacaagagagcccucucuucuguguccccuaccugcucuuugagaugugguggaacugccucaucuacagcccccguguuaaccggcuaagagcucaguccuauccuguguguaucuggucuuccuacugaacugacauuggagggcaaaggccauagacaaccagcuuucucuuuacucuguuugagaauuaggcauauaguaaaugucugguacagccuacaggaccaauuguggugaagugucugaacaaacauuguacagcaguuaggagcuaugugauaaaaagucaucugccugaaaagcauccugaagaauaaauauuucaccaccuugaccuugaaccccuacauuuggaggaagcugugacuacugaaauuguguauuacaguguuacuuguacaguguuacuuguauauccaucucaugcuaagaaaauaaguauuuagccucaguaauaugaauaucauacuagaauaacaguucaaagucucaaaccaguugugugcauuucuuaguuccuggagccugugaccauuguacauuguacauaaauuguuugucuuugacaugauccacuaucuuucaugacagaaccaccguguuuuuagcauauggacaacagguucacuguacaacacuaagguaaugcugccuuuacagaucguuugaacucuuuauugugggccaauacaagauagaaaaaaguugacagaugaguagaauuaauucuuguaucauaaccaguucugacaacuccagagcaguuaggcuugcuucaaccacucccccacccaaauacagccgccucauggagaucguuugauauaaaauuguuucaugucauuuguauauuguuuuaggucuuuccuaaaaguacagacucuaaaaguuugacuuuacaugggaugauugacauuuguuugucucuaagcuucuacuaauaccuuugugcaggugagggggaggagaauaucuauuccauuaaggaagaggaacuuucuagucaugaccacaagguggcacaaugacuacagcuuucugguauccauugagaauuggccaacucaagaaaaaggucuuaucuccuuaaauguuaaauaugcauggaacaugcagagaauuuuccaaucuguccauccucagucguuuguagagacaacugucuuccuuauccguugggccaacagaguagaaagggcccucuugcccuuccuuccucucccucuuuucuauucacucagcaaacacucgaucacauuccuccuauguguuccggauucuaaaugcugagaugaagacaugggcaguagaagcaagacccuggcucuugcagucugaauccugugccugagagcuucucugcuguccuuguuacuucugaagccaucguuaucugucuuccucaagcugaauccaaccauggguuuauaucaucuacgucaguuuuuguucagcaugcaaaagaaguacuaaucagcaucuaucagugauuaauuuugguuuauucaugauuaucuguggcuuuucuacuucccauuuacccaguuagucaagaauuggcaguguguuccuuauaaaugcaaaauuacauucagcguuagacggauauaaauacaaauaaauguauacauugaaguccacauagcauuucuuuaugaucaaugccaguaaaacgguuucaaaagauaaagaaggccaauaaugcagccaauacauggaguuauuacagauuugaaauauacuggguugguauuaacuuuuuaaccaagugaaccuacuguaaauuuauuuaguuaaaauuacaucuaguuuagaaaugucuuuugcaaggaguaaacaagaauguaaaaguauuguuuagaaacuauugcccaaauugccauucuauuucacucaaaaauaguuucuuuuaguugugauuuggguuuaacugugacuguaagauauacucugucccucuauauacauagaaucauaaguacuucaccaaaugucacuuuacugcuugagugcauaagccuuuuauaugaaauguucuuuuucuuucucuguugacugguaucuauaacaggaggaguggucaguccuuauuuuuauaauuuaucauuaugguaugaauguguguauuauaugggagagacauacuuguaucaugacacacaacaugcaaaguuacauucagcauugcacagauaaaaauauauauaaguguacacauugaaguccacauagcauuggaggucagaggacaauuuuguggaguugauucucugcuucuaccuuuuacuuagguuucagggacugagcacagguuucugggcuugcucagcaaauaucuuuucccacugagccaucucaccagcccuaguccuauacauaucaggacauuguaaagcagcacucuuugcugaguagcccacuaaaugcaagagauauguauauuaagcccucaggacuauacuaaagacuaugcguguuacucuguuuagcuaacacgacauuguagauuaaguauucacuucuauccuucuaaggaaaauguugaagauaaauaagguucccauggcuagcaccaguccugauggccugaguucaauccccaggacccacaugguaaaaggggaaccgacucccacaagcuguccccugacuuccauaagugccauguacaugcaugcaugcauacauccauagugcauacauacauauauacauacauacaaucuuuaagagagaaucaacuguacaaaauuacgcugguuaggcaggauuuggaccagcccuuguucucagaaguaguucaucuuugugguugucuccugcacugcuuuagccugagucagauugagaaguuuuguuuuccaaauaaacuuuuaaaggagcagugugcaaaggguaaaugccagaagaucgcugcccuauaaucauacugucuagaaguaugaagugacucucuaaagcauaucacaguaggaaaaggacccagagguguggagcaaacagaagaguugggguggugggaaggggcuugcauagcugcugugcccuaagcuacuuccuggggaguuuuuguuaucccucuugguuaucaccuguuagcaagcacaacagaguaaguuuacaguuuuauaauugaagaaguucuuuguuuguuuaaaugcuaagcuagcuauaaaccagaagguaaugaccacucauucuguuuuagaaagcagcagaggcacacaaagauugauucauucccaacagucuugagaauggggccaguaugcaaauuucaggaggaagcagggcaggcaccuacguuugggauacuuuguaauugaucaggauaauuuucaguuuuucauugucugguaacaagaccccuucauucaucuaaacacauagcuccagucuccagcauuuuguuugaaauauaauguauccccuaguuaccuagcccuguugcuagucccuucuaccugggauaccugcccauguauggcucauacuaguucucugggucacacuugucuuggcucugguguuuaaaauaaaaacagaaguauaauucauaaacauuaaaugucacauauugcuuguucuaaaacuagaugaagauguuucugguggaacaugucuaccaguugccauggaugucuuugcuuagaagguuguugcugaugagcacacaagugcuuuagguccugccguaaauggaccacagucuuuacuguaagauaaaguucaucagugcugcggcuuaaacauuucauuuucaaauuuguuuucuaaauuagcauacaaaguaaugugcuuuauuguggcagaaaguauauuuauuaugccuugucuaguaagcaucacauuagccuauauugaaugaaaucgccaaacacaaagccaguuuuauaaugaaauauugaacaucucaugucauuggccaaauacugaaaguaaagucaaaaggauugucugggugcauagaucuuuguagaagugugacguuaaaacagaaaucaaauuaaauggucguuggaaguccaagagcaucaguauuuaaaacagcaguguagaagcuacacccagacacugcaacagauacuuccuugguauuuaauaaguggaauguauccuagaacuauuuauuauccacaggucucaauuccguuaggguauauuccuggagucuuuaaaucaugugguaugauaugccaguuccuaagcaacaggugagccacacuggcuccuccaaguagaacagcugagaauguagcuccaaagccucuuagauguguguccuuccuucucagggauaaaggccucaagcuacacugaauuuucuuacauugucucccccucugaaugggaaggacagauuuuagucauuuugagacuuuguccuuauaacgaccacagcauuauaaucauuauauuuuuauauauguauauauauauaaucauuauuauuaugguuauaauugucccuauaauguccauuguuagaguauuuucucuugagaguucaguaaauucaucuggagauuugcuuguuuguuuauuuguucuguucacugauauuuucaauacaaaaacugccauuuguuuucucauugcuuuguugagguguggcugguguuuauaagguagacagaugugaagcauacaaugugccauuuggagcacugugaggccaucaugccaucagauacuaagcuuaucuaccguuucugcuggcuuaugaacuccucccuaucuaccuccugucccuagacaucuguuaaugugaauggaaccaugcaauauguaucuuuuuuuggccuggcuaguuucaacaagcauaauuaacuaauuugggguuuauuuauguuucugcaaauagccaucauucaguccuuauugcuacucacuagugaauuguguucacauugauaggcauuuggguuauaucuuauuuugacuauuaaaacaaagcuguucuggguacucaugcacaaaucuuuguaaagaugcauguuuucaucucuuccauaaguagauagaaaugaaauaaaugacugucacauggccagcucauguuugacuuuuuaagaagcuacaaauguucucaaagugaauugcgucauuguuaccuucuucucauucaugggugugcccacuguauaauacaguuucagagaggucuauugcacaauagcugccaaauccagucagccucuuaugaccgguggaaugaucucacugcuauuaauuugcauuucccuaauaccuagugaugccaaacaucuauucauguagaguuggguuuugccauuuguauauuuuuuuuaaaaaauacuauuuuauauguauauguguuuaucucuauguaguaugggcaugugagugcccacagaggucagaagaggccaccagauccccagaaguuauagacaguuuugagccacccgauagggguacuaggaaccagacuuggauucucugcaaaagcagcaagaacucuaauggcugagaaaucucccuagccccuauuuauauauuuucaugaugaaauaccugcucuugucucucuuuuuuuaauuaauuuugaauugaacuauuaugaucucauuggauuuuggaaguucucuuucuagguaagcucuugaucauaccaaugcccuauaaggguucuguccauccucuccaggucagcucuugaucgugccgagccccugugagggcucuguccguccucuagccuccucuccaggucagcucuugaucaugccgagccccugugagggcucuguccgugcucuagccuccucuccaggucagcucuugaucaugccgagccccugugagggcucuguccguccucuagccccccggcuuuugcuuuccucggggaugucuuuugaacauuauuugcaaguuugcugaaacccaguuuaugaauuugcucuuguaagggcuaugacuugguuugcuguaaacacauuuuuuccuguucacagauacuuuucuuuccaauauuuucuucuaaaaguuugagaacuuggguuuuacacagacuagucucugacccaucccagaguaaaggccuauaugugcuuuaagguaugacucaagguuccuuuuuugguauuugaacaucaaaauuuccagggcauuuguaaaaacauucuuuuugauaaaaauaaaauuuucuaauuauauaaauaagacauauaguaugaaugaguguucaguuuuuauguuaccaaucauuuauuuauauguugugaugagagugaauuuaaauacauaguuuacaaaguuagaguugaagcuuauauacugauuccauguaccagugguuaaauuuuuucacauuguggcuggagagaugccuugcuggcguugcucuuacagaggaccugaauugaauccccagcacccacauucggcagcugacaacuaccaggaguaacacugacuuagcgcagaggugagguagccccugagucuggccucugaggauaccugcacauaugcacacacacaauuaaaaauaauauaaguauuaaaauuagcauuguauauuuucccagguggccuaauauauucaauucuuuaauugcucuuuucuguguaauuucaugauuuuaaacuuuguaaauuuuuugauugguugauugguuuugucuuuuugagacagcguuucucuguguaucucuggcucccuuggaacccacucuguaggccaggcuagccucaaacucauaaagaucugcuagaaauagaaaaugccucgugaguucuggggauuaaaggcaugugcuaccaacgccaagcaaaccuugguagguuuuaauagcuguauaauacucugucgcaugcacacugacuuccauccguuuuaugaaacaucaacuuuauucuuaaaaugugaaauuuugaauuuaugcuuaaguucucucuuucucuccuccccucuccccucacucucucuuucucuuuaacuuucaaaaguaaauuauaaguccauguauuuggauuuuaaagaacguaaagauucaacacuuuaguuuuccauaggcaauaacugagauuaaguucuuuguagcaaauuguuguuuuauaaaacuggaggcugucuugguuccccuggucuuucuuggucugcuaucuugcucuuuauucuuuuuucuuuuuuuuuuuuuuuccccccuuugguuuuuuucaagacaggguuucucuguauagucccggcuguccuggaacucacuuuguagaucaggcuggccucgaacucagaaauccgcuugccucugccucccaagugcugggauuaaaggcgugugccaccaccgcccggcuuguucuuuauucuuaagcuacaaacaaaacccucuguucugcccuggccaaugugaggaaacugaauuuccucauucuggaacaagaaaagaucagugggugaacacacauaccgccauguuagcuagagaagcggguuuucauacuucagacugacagcugacugguaucucugggugccauucugauucgugacuuuagaaggucucacugcuuuccacaacaccuucccuacaucuggucccacucaagacacacacccagccuccugaucuugcagacucugucuuccuccucuccuccauccuucugggaugguuagugcuaguuaagaagaccuaaaaaccuggcacacaagcuucugggcgcaccugugagggguuacuuacucucuuggcaugccugugaggcaucacauugcuuagguuaacauccucaaacuggauagcacaccauucucgggcuuggguccuagaaucuauaaaaaggagaacugcugacuacagacauccacagcuaucucccuccugccuggaugcaauggaccaacugcuuccagguccugcugccaugauuucccugugugauggacuguaccaucaaacucugacccaaaauaaaccacccuuaaguuguacugcccagguauuuuaucacagcaauggaaaaguaacuaaaaaucuuccuuuuuccucccuucuguuuccucucccuuccucuugccccucccaucuugcccuucucucccuuccuuuucuuucuaguccugauuuucucuccucuucuuccuuccccuccuuuccucucuccuccccucuuccucucccuucuguucuuccaggccucuuuuguacuuccuugcugccuccccugucauuauaagcccccccgacacacacacccauaguuuuuaucacuaaauuuaauguauuucugcccaaauagcuacugcucagcaguguuugugggugguuccgugacuuaguaacuuuuuuuuuaacuuugccaccuuuuccuuccuuccuugagaaauucuguugucuuaucucuugucuuaucucuuagugguagcuuuugguguccaguggcuuuguugugucuaagaauaagcugcacuacccuuggcuccccuccucuuacugcuuugagaauacugauacaaggcagucuuucuuuugggaaauguuccuuuugcugguugucacuuugucuucagacucuagucacaucuuucacucaagagaacaugcuguccucuccugccuccccaaguuguuguguucucagcacuuucauuggguauauauuuuucaaagccccugcuccuuuuguuaguauauauguggaucuguccacagcauuggagcugcacuguccuugucuuggcccuuggaaaaugugugaccaacauuacacaaaaucagcaggcaucuuagacuccagugcuggugguucuaaccugucggucucugcgugcacacacuuuugggggguuaggggguuucuuaagguaacauucuucaaggcaagucgugagaaaugaauaguacuuuccuccugggauguacuguggcacuuguacugucuaguauugugucccacugaucucaccagcaccaccucguggcaguguuuaccaacuggaucaacgacaggcacuaguuugcacacuccuacagagcagagaccauaucugucaguagcuguggcaauucagaucagcacuguauauaauagaugcugcuaauauuuauuacaucacugucagauacugacauaagaguacauaagaauauacugguauagaacugcacauugguucucauuuccacauaaagcagaagauuuuucuauauagaacuuggggccucucuuuucugucuugauuaugcuccuagaggucuaucuucauaauuugcagucaugggauaccaaaggcugacugcauauauggugcacuucaggacgcauuuuguuuuucuuccuauauuguugaugguggaucuggcccaagaaacucacauaaggcacacaauaguccugggaugagcugaggaaagaguuccuguccuugcuccaccuccaccuuuggccaucuacaguuugcacuuucugagaucacgcacagggcacacuuuuuccuuagucuucgcuuagaccaagaaagauaugacagaagaccuuuuugaaaauguucuggagaagaccggaugugcuuagaaaauauaaaacggaaguaaaugaucaauuuuaaaaauaccagaaaacauaagaauagcugaauuaaauuagaguucagagagaaaauauagaaguuguaaauauucauguguuugcuuuucacuuucuaauagauuauaaauauuuuguuuuacauuugcuuuuaacaggauuuaagauuaauccacuccccaauaaaguaaaaacaauaagugauaaugaaugaaaaauaauaugauugauauaguaauaaucauuaaccagauugacccugaacuuuuggaauuucaaacuaauucuucuuuucuuccuagguugccugucagugcugccugggugguauugggcacccagaaugcuucagucugugaugaucuauuaauaagguggccuuacuagaguuuggaacagggcuucagguaggugguuuuuaucauuauauggcaugauuuucaaagugaucaguuacuccagauccuuaauuauguaugcugugauagugaaagcuuugaaaagcaugccacauaauaagcaugccacuuaggaucuuagggcuuaugcacugguccaugggacuucaguaaaaucugugcucuguaaauggccaagagcggucuugcuucagaaaauaaagcuauuguaaagcuuguugguuuuuuuuccuccucucugagaccacagaugagcucacaaacucuugaucuucugaauaucccagaagggaaaacuacccuauggaaccacuguguucauguguugagaugaucuuaacugugggcagguauggaagcagauuaggucugcucccagaguacagaacccagugugaccagagcaacuuccuaucauuucugggaagaggacacacaaaaguaucuagauuuccaacguaguuauaacucaguggcacagaaucaagguauagugauauuuucagugucauccucauaucuuaaucuuauaugaagcauauucucuguaaaggauuuggaauuuugcuuuguaugauauuuuuccccacaaacugaauuccugugcuuaugggguuacuaggacagaacaucugaagcgcucacaaguuaguuuucaagccugucucgucugaguagcaugugccugaguccccugcuuucaccaugccuagucagagcugcuuaaaaggauguggaagcagcauugcugucaaauggcuauacugggcaugacaguuccuaccccucugccaaagcacauuuaccaaaccauuuaccuguucugggcuuucucugaucuugcuuuauagcccauugggauuuccagagcucacaacauguuuccccugguugcuuugauuccugaaacccuacuacaguugaucccaacaaguauuuaucagcuaaagccagguguaguggcacacaucuuuaauccaagcacucagaaggcagaagcagacagauagaucucugugaguuccaggccagccuggccuacaaauugaguuucaggaaagccagggaugauacauagagaaacccugucucgaucgaucgauagauagauaggcagacagacggacagaauuuaucauauuacugcaacauggcaggacaacaaagauaacuguuagcuuucgggguaaaagaugcagucacugagagaugguuuucaaauuggucaaggaguacaacugucaugucucuuaaugauguugcccaaaacgaauucuguuuauguccgagaugugguaauaaaaagaagucuuguuucuugaugugacuuuauccuugccagccacacaguguggcacagggcggacaggcugguggcaggugcagagccuucccugcggacuggacccugugucccugcauguccuguuccucgagcaucagcaugcagccugggcaguauuuauagcucuucauacccuacagguugcacuuauggguacacacuacucuaagguagcuuaacacugauuuccacaugaacauuuuuaacuaagugagcugauacuuacuccuuuucucacauuucauaugcuuucuaccuuuucccaaauuuauccagggauuuggugugagggccugaguguugagauaugaaacuuggauuguguuucugugaucugaauuguguaaugauuacuccuucuagaaggcauacccuaccuguuuaaggacuucaguguguuacaguaggugaugucagaagcccuuaugguaccccuaucaacucacucaauggcaguaacauugaccucauuacaaguugagaaugugaccugugggcuuccuccuuucuaauguagcuucauggcaaauguggaaaugguuugugcauuuuuagaagcccagaaacuucuguagagaugaggugcucucucaccguuaagguugcaguuauccacucguucugccugccauuauuacuuccgcuuucacaauuccucuuuugcuuucuguuuucaaggacugauuucccugcaugaagagaaagcugccuaguauacuuggugugccuugguuuucauuuuccuaacaacauacaaucauagagugucucuccuacacauaagacauaaaugcugacuccugaguccucauuaauccucuuuaccucacuggccuucucacuccauaauagaacuaaccaagggaagcauuugaauuggaaaaucccacuuguuugcuuuguccguguucuugggugguugguauucuaugcgggcccuccagagcaugcaugaccagaaugugaccauugaagacuaguaagagaauuucugggaacuuugcagugccaacuuugaaaucuguugacauuucccuacuguccuuaagaaacaagaaagaugagcuauuuccuucacuuuucuuuagguuuuuaucuacauuaaauauaagaugcuucuaaacauaauuagagcuaauuuugugguaaaguugaaaaagauuauccuagaacuauauuuuaaccaauuauucaaaaacaaauacaaaaaaaggcaaauguggaaaaauuuuuaaaggcauccccaauuuuccugguuaauuuaacuacaucuaauguaggaaaauaaguauuguggucuugcuccagucucaggacugaguucuugaggacccauaauucaggugaguuaaguguacaucuuggcugugccuccugcuucuucucagugagcuuucugcuccucaguucucuguagauaucacuagcucuacccaagagucucaccaucuuuuucccccgcuucagcccagguagcccagguagcaggcauguuuucacucuaagaauuuuuauuaagaguggggaugaauugaugcuguguacucaugccaguuaauuuuguaagaauaccaucagucagggcaugcuagcaaaauggauauuuugcauaacuuuuaaguuauuauaagugcuaguauuuaucuuggaaauguauugucuucugucugcuaugaugaugaguaaacuuauaggucauuauguuagcaguaagcacuuacucuguuuuaaucuuucucguucauucaacaguuacuuuacugucauuuaugggaaacagcagugaauaaaacuggccugagccugcccugagcugccuacaguugacugcuuauucucugaaggucuuuuuuguuuuuuguuugcuugauuuuugcauuuguuuuuaauuuuuugacagucuaauauguguacugaaugcauuuugaacauaccccauuacccuuucuuaaguuuuuauaaauacaagauaguuaauuuuuuucuucauuagcaaugaacucuauagaaugagagcuaacugauaacaauguccaaguuaggaucaaugacauuuuaaagcaauguuccuaauaugguaguaugucuccuucaaaguuauauuuaguuauguaaucuaauucaucuccuucauauuauucaagauucuauuagugcuucuuacauaaaaagcauuaucacugcuacuuuuccuucugugagccacccuguuggaaaauguuguaagcauacguugauauuuuucugaauugggaacuaaugguauguuaugauuaguauaaggaagagcaaagccuuggugagugauagcauuugcucuuagcaaaaucugacuuuuaaaagugaaaaaaaaauuaaugcugguaaguauugcucaaaauuuacaacuguuagcaguacaacucucaaaacugugggacauccaaugaaaacaacacaaacaaacccuguuuuaguauguacucauccuuuggcugacaucucauagagguugguuucaguagacccccugaggugcaauguauuugcuuauuauuuuucuucaugagccacuauuugccaagaauaaauuaaagcauaagaagaugaacuuuugugcucaagcauauaaccuucccucuucucuagcuucuauuggaugcagagucaccuuuggaguagaggguagaggcggugugucugcuuggguaucaucagaagcugggguauaguauucugaaacauuucacugcagagcaguguagaguggguauguguagucucugccuucuguuacaauucuucagacaaaggcaagguggaauuuccaucacugauguaaccagucuuugauaaauuauuuuaacuagaaacgaaaaacaugaauuaagguuuuuuccucuuugguuauagacuuuuuagagcaguaaagagacuuccuccauugccccuuugggugcaugaaagaggauacucagauaacuuuaguuaacauguuagcuaggauuauaugaauauaaacuauuuaauuuuuauguuuauucugucaaacaauucaaaucaacucuugacaucuuaugucuugggaaaaaugagcaguucuuugaaauuaauuggcaacuaauaaaaaauucaaaguaagguaaaaauuuagagaaauuaacuguaacuugggaguucuguuuuaagauaaaccaaaugugauggcuuuauuuauauuuuauauuuauauuauuuauauuuuauaugugacuauaagauauacaguggagguaauuuguagacagcgauauuuaugcauuguuugaaauacuuacagccgggcgugguggcgcacgccuuuaaucccagcacuugggaggcagagacaggcggauuucugaguucgaggccagccuggucuacaaagugaguuccaggacagccaagacuauacagagaaacccugucucgaaaaaacaaacaaacaaaaaaagaaugaugaaauacuuaguuucuaaagcauuucuguuauaaaaugccacuguacaaauaagcauagaauuuuaugaauacacaaaucuauuauuugcuugucagcuuuaguuuuagauuuaauucugcuuaaaucaucuacucagaguuacuaauuauuuuaaugcuuaguuaaaauauuuaaaauuuaccuugcaaauuguuuuuaaacuuuuuuaaaauucuuucuuuuuggaaguuuuauuuggaaguucucauagaaaacuaacccagaacauucuucuguucuuuaaguguagugccaacaugcauccacacacagguugauguauuaaucugcccuugucauagaucacaauacagucuaaguguagugggaaucuaagacagaaaucucaucgugaccacacaugugccaucacauagcccagaaucuuaggucauugacugcagggaggagauaaauagggaaguauucuauuugugaaguauuuacauuauucagauagugguguauaaaaugaucuuucauauucauaauuaccauaccaaauauucaguguauguccugggcaaguaaguauuuacaaaguaauuuugcuauuuugcaauuuuguuguucuucuacuuaugcauguccugugcuguauaaaaauggggcuuuugcuugaacuuuuaaagauaucuuuuuaucuaaaauuuuauuuuucuuuuaaacaauaagaguaauacugguuucuuauauauacucaguaauuuuguaaugaugcuugaauguccucuauuaaauauuuuuguugcauaucaucuuuacauaucauugaauucugaaaguguguaaagauuuuauuuaaagagauacuguuagauuguuauacaacauuagaagcuuuuuaaccuaauaugucauugacauauccuuuuauuacugauuuuuaaguauuugauuuguauucucucucucucaaguucuucuaauuaauacuugugaauacuuaagauuaaucacagaaugcuaaccaguguuugccuuguauucuuuguaauaaguguagguauuuuuuacuuuauaccauucucauucuugucuuuucuuuccuuuguaaauauuaacacaguuuauauguguguuaucaaucugcuaaaaaccuugcuacuaacaggcaucuuuaagcuaucuuuaagauuucucaacaauggucucaugcaacaaauauugcuuuuuucaugauaccugccuccuguagcaaaccuauacuuaacuucccucacauggaugucgaaucugagcggcagagugguugcugcuacauuccagccauccuuacggcauuccuuggucuaaauuggcagucugcaaguagcagaaggguggcucuaagaagccccagucacaaguguggcaguguggguggcagugcuguggucaggaggaaaccgaguuccauuauauuaagcucaaugaauuuuuaucaguuucccuuaccgucaguaacucuuguuuagauuucuuuuuuauuaucaacugggaagucauucagcaucacaaauugacauuuuuuucuagauaauacuauuuuuuuuuaauuugugcauuuauuuggucauguaaagugugcuuucaacuaaucaaaacaagcaacuggugggaauuaaugcacgacuaucagcaaaguagaaugugagcaugugcuaugaaaugcaguuugcucaugcuuuuuuuccugucauaugcacucuaguuucauuuauauuauaguccauucuuucuuucuuucuuucuuuuuuuuuuuuuaacuucuucauagauuggccaaaaugggaaggacuggauucugcucucucccacgaagaguuaguggacuggcuaagaucaaagucugaggcuucuccaucaccaaucagguagguauugaaugaaaaucacuaauucuaugcaugugccuuucaaguauuugauugauagacauauuaugaauauaauuuuuauuagacauuaaguuugcaacauuauacugauccuaaaauuguaaauguaccuaugauauguaauuugaauuuuguaauggauuaaaauaucagccaugaaaauuuucagcuggucuuagaaaaguguaauauuugguaucagugcaauuccucauugcucaguauguacauccagauacaauucauuucuuacaucauauugaauaucaccaaguuaauauaaucaaaagcuuguguguuguuucauggugcccuuuuaauauuuuggaggggaguaaucacauuaaaguugcuuuugucuucuggaauucucaacaucacaacuguguuguuacaguggugauuaugaccaauuuucagaccuaguuauuaggcaccuugcauucccuuugauuuggcaauuggaaaaugauugauuucugcauagucuaaauaagucuaugaaagcaucaagugaacaagucacaaugaaaauuaaagcucuacuaauuuacugucauuacuugccugaagagcgacuauuuuaucccuaaauaggagggagacaaagcaucugucucuugaauaagcucauaacaggaaaagaugagcuucagaaagccuacagccagagcuaacaguagcaucagugcugugacaucauacuuaacaacugcgucaguacugugacaucauacuuaacaacugcaucagugcuguggcaucauagcuaaaagcugcaucaaugcugcgacaucauagcuagcaacugcaucagugcugugacaucauagauaaaaacugcauuagugcugugauaucauagcuaacaacugcaucaaugcuguggcaucauagcuaacaacugcaucugugcuaugaaaucauagcuaacaacuacaucagugcugugacaucauagcuaacaacugcaccagugcugugacaucauagcuaacaacuuuaucucuucugugacauagcuaacaacugcaucuaugcuaugacaucauagcuaacaacugcaucugugcuaugacaucauagcuaacaacuacaucagugcuguggcaucauagcuaauaacugcaucagugcugugacaccauagcuaauaacugcuucagugcugugacaucauagcuaacaauugucgucugugcugugacaucagagcuagcagcugcaccaguucuauaucagggcuaacagcugcauaagugcuuugacaucagagcuaacacccaaaucggugcugugauacugguugcaucauauuaauuuuauuuguaaacugcaagaggaacauccugauauuuagaacagagcaaaggccugcaucugucuuacagaaaagaaacuguaugucuucaccuuaccugaaugcuguacugcuuuaaucaaaauagugccuuucuguuguuuuguuugcuuaggaacagcugcugugcuaaaguacagagagauguaacguacaauaaaguguuaccaaaauguagguauuuagaauuccugaaaacuuuuccuuaaaauugggcaaguaaguguaacagaccuaauuguauaaagacgugugucagucuaauacuagaacacaggcaagauaaagaaguugguucuauucuuuauaggauggcagauuuuuuuccucuuugggcuucagcuacuuccuuggacucauuaauugauaagucauuuaacucuaauauucagauccuuuuaaaaagagguuaugggugcuaucauuucugugauuuauuggaagaaccccuuuaaauuaccuuaagaaacauauaacuuagugguucucaaccugugggucaagaccuccaccagagucacaugucagauauuuacaccaugauucauaagaguagcaaaaguacaguuauuaaguagcaaggaaaauaauauugugguuggggggcucaccacaauauaaggaacuguauuaaagggucacagcguuaggaagguugaggaucacugauuucauuuauacaccaguagaaucuucaagcugauuuuccuacucugggaaauagaguuauauuuacuauuucuuaucuauggagguuucuguuuaguuuuauuucauuuuaacaaaugaaauacccuucguuacacaaaugcacauuucauucuuucucacagaauugaucauaaauuaaagcucuaacacaucuuuuacuaaccugaaacaucucugugagguuacauucaagaacaggugcugugcacuaagagaaagaaaucuccacagcugugccacacucagguucagguaugucagaggcccaucccuucucuugggaaggccuaauggcucugguuaauuaaccuuagagcaccuaguaagaauagccuucucucugauguaaaggcagcuggggaaaacugagcaaaccuucacaaaugacaaggauccucaucuuucaccucgugcuguacaaagguuuuaccauuucaagaauaucuguuaugaagauaugucauucugcuccugaucagagauccuuggagugucauaaugcugauuuacagagucaggucucacuuagggcagugcacccucucuacccuauagugucugggcuucagcuucuuccauggacucagugcuugcaaaauucuaagugcucaaagugccucuaguucauaugauccgugugcacagagugaugugcacagauugaaguggguguucagcuguaagauguguuuucuaaucccugcugaaaacugaaguuucuggugcuaccuuuagaacaaugcuuugggaguuccuaaauucaguaguuaugccuaaguacagcguuugucagguggaauuucaggguauguaugaacuguucauucugagcaaugcauuuauaucuguuuuggaaaauaccaagaaaccaacagauauuacauuggaccagcugaauccauuuuaugguuuccuuuuuuuaauucaaaagcaucacaaagcaaguaauuuuuuugaaaaauugaguuuaguuacaaacuaguuguuucuuauuuuuuuuuccagucccuuuuugcuuucuuuuacgaccacaugaaacuugagaagccaccuaaagcuauaucacuuaguggaguugggcaguucccagguguccaacaagaaggccugguuuaggcugcgauggccacugucauuccuggugauuugucagaaguaagagauacccagaaagccccuucagggaaacguaagcguggugaaagcaaaccaagaaaaaacuuuccuugccaacugugugacaaggccuuuaacaguguugagaaauuaaagguucacuccuucucucacacgggagagaggcccuacaagugcacacaccaagacugcaccaaggccuuuguuucuaaguacaaauuacaaagguacuacacucuauuugucuuucagauuauacuuucucuuguguuggcccucugaagccauuguaaguguguguauaucugaauacacauuucucagcugauuugcagagaggaaauguuaaguagauuagauauuggcuagcuugcaguauuuuaaaucacauacauuuguauuagugucuuugaauuuuuuuaaguaaaaugcuuaaugaguagaauuuucauuuauagagagaaguuucuacaugagaaggauguggacaguacaugaguauguucagucuugcuugcuuacuuuugucaacacugaaguggcaauuagauggcucaaguuuugcaguguguuaacuauccugugguguguguuaguuagguagauccuuuauuaauagagagagcugugucuuagcauuaauagauuaucugcccauuuuaaaagugaauacauaccuuugugcuaagauaaucacucacucacagaauauaucuauguuuaaaggcacauggcuacucacucuccugagaaaacccacaaguguaauuacugugagaaaauguuucaccggaaagaccaucugaagaaucaccuccauacacaugaccccaacaaagagaccuuuaaaugcgaagaguguggcaagagcuacaauaccaagcuugguuuuaagcgacacuuggccuugcaugcugccaccaguggugaccucaccugcaagguguguuugcagaauuuugagagcacaggugugcuccuagagcaccugaaaucucacgcgggcaagucaucugggggugugaaggagaaaaagcaccaaugugagcacugcgaacgcagguucuacacccggaaggauguccggagacacauggugguacacacaggaagaaaggacuuccucugucaguacugcgcacagagauuuggacgaaaggaucaccucacucgacacaugaagaagagucacaaucaggagcuucugaaggucaaaacggaaccaguagauuuccuggacccauuuaccugcaacaugucugugccuauaaaagaugaacuccugccggucauguccuuaccuuccagugaacucuugucaaagccauucacaaacacuuugcaguuaaaccucuauaacacuccauuucaguccaugcagagcucugggucugcucaccaaaugauaacaacuuuaccuuugggaaugacaugccccauagauauggaugcuguucaccccucucaucaucuugcuuucaaaugcccauucaguucuaccucauacgcaaucucuauuccugaaaaagaacagccauuaaagggggaaauugagaguuaccugauggagcuacaagguggugcaccaucuucaucccaggauucuccagcaucgucaucuaagcuaggguuagagccucagagugggucgccagaugauggugcuggggaccucucccugucaaagagcucuaucucuaucagugacccccucagcacaccagcauuggauuucucucaguuguucaauuucauaccauugaauggucccccuuauaacccacuuucagugggaagccuugggaugagcuauucccaggaggaagcacacucuucugucucucagcugcccacacaaacacaggaucuucaggacccugcaaacacugugggucuaaguucucugcacucacugucggcagcguucaccagcagccugagcucaagcacuaccuugccccguuuccaccaggcguuucaguagagucugggccgagggacucacccgaggugcuuguguagcccugccugcaaugaccauuuauauucuagugccuacuuuuaacauaauacaaaaacuucugcuuuuguauaauaucagguuuuaugaagccaguaaauaauaggaacuagccucuucgauaagcuuugaaaucguucguguuuaacuacguuugcuauuucuccugauuuccugccaguugucauagucucagaguuuaauuucauauaggagcgccauuauuaucacuaaauuuuacaaguccuauguucaaauuacuguuagaucuuaaauuuuucauuuuugucuaauagcaaugggcauuggacuuuuuuuuuuuuugcaaauauucaguacaguguaaaucuuaugaaguguguugugugaauaacugaaguguuucacauuuuuuuacuagccacuaaauggauucauaauuaaguguguuuuaaaugaguuaagaauccaguuuggggagaguauagugguuucuuaaauauaccaucauuucagaucaauauauuuugaggacugcuauugucuggcuaaaauauuuuaaguuucaguaucuaucuaaaagaaaccuagagagguagcaggguguuguguguuaguacuagcccucaggcugguuugccgcauuucaaucaucuuuccauaaacaguguguggcaucgaagucaucaggaucaguguagaaagguuuuguuauaugccugucaccuuucauaccccaggauggcuucaguauaccagcguucucauuuugcaugguggaccacaguuauuccagagucuuagagccauugugggacaauagacaguaaauaugugaaaccuacaauggcugggcugccucaaucgucggggugauagacuccucaacaggaagauggauguaaaacagccaaaccccagaacuuguccagagaauuccacuguugccagagcugaaaacugaacuccuugggugcagaguaaaagccuaucacaucacuucuaaagcagucuugcccggugagcucuugcucagugcguauccaucuugcccugcuguuuuugga

SEQ ID NO: 12086 - RNA, 60943 nt, Mus musculus
gauccuucuuccaagaagauuggggacauccaacuguauuccuuugaguacaucuaaauaccaaacucuacugggaguucaggcacccuacagaucuagagacaccuagccaguccaaccuccaccaugggggccgugaccuggcuacugccaggcaucuuucuagcuuuguuugcccucacucccgaaggugggguccucaagaaaaucaucaggcacaagcgagagagugggcuaaacaugacccugccagaagagaaucagccagugguguucaaccauaucuacaacaucaaguugcccauggguucccaaugcucaguggaucuggagucagcgaguggggagaaagaccugacccccacgccagaguccagugggagcuuccaggaacauacaguggauggggaaaaccaaauuguauucacacaccgcaucaacaucccccgccgggccuguggcugugcugcagcuccagaugugaaggagcuccugagcaggcuggaggagcuggaguugcugguaucgucucuaagggagcagugcaccauggguacaggcuguugccuccaaccugcagaagguaggcuucccagaaggcaacaggguucguugacccugucucugcaccaaugagaagauggugagcuuaaaggacuccaugagugauuuuuuaaagcugguuuccugggaaacuagacagacaagguagugauuucaaagagagacagagggagagauuuuaaggucaaggaaagguagagauuggagccauuucucuucuguucuuggaagaguugugcuaauaauagcucucacacuaauuuccuagcauuugaaaaaucuguuucauaaagcucuguuucacuuaauuauaucuguuggauuuauuggucugaagagugagcucagcaguuaagagcacuugcucucccagaggauacagauuccaucaccuacaugggcacucaaaacaucuguaauuccacucucagggaucaacacccuuuuagauccucagcguacaccagccauacaugcaaagaacucagaccuaugaaaugauaaaauaaauaaaucuaaauguucuaagauuuauuuauuugauuacuuuuguguauauauguuugugugugaguguguacacauguguggguauucagucaaacacucuuauaaacgugcacuaagggcagaagaaggccuggacauccucuaucacugccucucaauuccucugaggcagcauccuccuugaaccuggggcucacauuuucucggcuaaacuagaaaccagcaagccccagugaugccccugucucuacucacaugcaagaugaagauacaggcauacagucauaggagcugggauuggaacucugcuucucaugauugcacagcaagcacccucaucucucuagucccuacuuuaauuuuaucuuggucaaacauguuuggcucugaaauauaauuuguaguuacccuaaaacaucugagaauaacacagugucccuccucccaaaggcaucucucaaagagacugcuguguagccuuaucaacucacuguacaaauagggaaacaaaggcccagaggggagugagguucuccagguccuguugaguuagguguuaacacagucuuccacaguccuguguucuuacaauggcccauuucugccugggugguacugagccugugagaucaggaggagaguauucuaacgugauggaacaaacacagcgugauaaugggaagguggucaggucagagcugcccacacagccaccuguauguaccagacacaguaacuuucuucugugauccucccaacaacccuuuaagguaaaguuuaacaucucuaugugaaucuaaaaacugagguuuuaaaagucgaccaaauuucacaggaugauucagugauaaaggagaacacgcauagacuuuggaugugcccgggaacuucacucucucuggaggacacucgggacccuugcacaucuauuccaguaauccugcugcuuaggaguucauuauauccccccgccccaccucccagaauuccagaggaauacaaaagcauuaacuucaagucagaaaugaguaucuguuuccaccacuuagaaaauacuaucagaaagggcauugauaaugauguugagaguggaccugacuaccauaugcagggaguacugugggacucuaggcuucuaaggcaauuuucaaaaguuuaucuuuauuaauaaaucaauucauuuucucucugucaacccccuugaggaaacaugugucugagaagaccugguggguuuaaugucaguguggcuuaaaugugacugaauuccaucucauuuuuuccacuaagccucugcucuccacccaguugaugccuaggcaugcagcugaauuugagugagggcuuuuucaugugaguaccaaaagccagcucugauguacccagcuaaauaccuauuaucuucaaugcaggucgucuggacaccaggcccuucugcagcggacggggcaacuucagugcagaaggcugcggcugugucugugaaccaggcuggaaaggccccaacugcucugagccugacugcccugggaacuguaaucucagaggccagugccuugacggccaguguaucugugacgaggguuucacuggggaagacugcagccagcuggccuguccgaacgacugcaaugaccagggcaggugugugaacggggucugugugugcuucgaaggcuaugccggcccugacuguggccuggaagucugcccagugcccugcagcgaggaacacgggauguguguggauggcaggugugugugcaaagauggcuuugcgggugaggacugcaacgagccccuuugccucaacaacugcuacaaucgugggcgguguguggagaacgagugugucugcgacgagggcuucacuggcgaggacugcagugagcucauuugccccaacgacugcuucgaccgcggucgcugcaucaauggcaccugcuacugugaagaagguuucacgggcgaagacugcggugagcucaccugccccaacgacugucagggccguggccagugugaggagggacaguguguuugcaacgagggcuuugcaggagcagacugcagugaaaagcggugucccgccgauugucaccaccguggccgcugccucaacgggcagugugagugugacgauggguucacaggggcugacuguggggaucuccagugucccaauggcugcagugggcauggccguugugucaacgggcagugcgugugugacgagggcuauaccggagaagacuguagccagcggcgaugccccaaugacugucacaaccggggucucugcguacagggcaagugcauaugugaacaaggcuucaagggcuuugacuguagugagaugagcugucccaaugacugccaccaacauggccgcugugugaauggcauguguaucugugaugacgacuacacuggggaagacugcagagaccggcgcuguccccgggacuguagccagcgggggcgcuguguagacggacagugcaucugugaggauggcuucacuggcccugacugugcugagcuuuccugccccagugacugccacggccauggccgcugugugaauggccaaugcaucugccacgagggcuucacuggcaaagacugcaaagagcaaaggugccccagugauugccauggccaaggccgcugugaggacggccaguguaucugccaugagggcuuuacgggccuggacugugggcagcgcuccugucccaaugacugcagcaaccaaggacaaugugugucaggccgcugcaucugcaaugaagguuacacagggauagacugcucugagggugaguaucagcaagcuggccugcaaguggucaugaugguguauauacgcaaugccuaucagagacagauagugggauuuaucaacauaccaauucuuuuaaugugcccuguuaguauauuccuguuaaacacacacucuuuuucugacccuaugagggguuuauacucagucucuuggcacugggcaacuuagaucaaaggcucagagaaguaauacuguuguccaaaagacucaaaugauacuuaaauauuaucuaccucaacuguauugaaucagccauucauuguccuuuacuucguaucaguuuccuuucuuucucuacucuggcuaugaaccaacagcaaacaaaguucuuccauuugaauggaaaugauaauucccugggcucaacagacauuucuauuaaauaagauuaacuuauuaaugcagucaacuaaagaauggucucugguuaccugggaaccagaccugaugcguuuggugcuauccuuauccaaggacugugagcaucucccagaauacuguuuccaggaguuaucauaagcauaggcauauaguauguguucaagaaacauugacuaaaugaguacacagcaaagaacaaaaacaaacaaaaaaaaaaaccacucaugcucaaugaccguuuucucuucauuuuucucgcccucauaucaugauaaagaacaucuuacaaagguaggcaggaacaaauaaauagccccacuguuuaguaugucugaacugugcaagcuuaguaaagacauguggguucuaaaccugauguaggcaaccacagggaaaccucuugcccuuagucacagcuaaggaacaagagagucugguuagacaaacccuauaggacuaagucacaggggccaggcugaggugauaguuuucuauacccugguauaacucugagcuaagacccagaaaguggaaaagugucgaacacaguguugaaagcaacacuauuggccagggacuucaacauaaaggcaaugggcuaauagauuacaaagcuacuucuggugguaaaggucuguaaacccagcuccuacagaggcugaggcaagaagaucaaguucaaugccugccugggucacauucaagauaagccuaggccagguggucaaaauagauuggauggcauucucagagaacuaaugaaaauguuuuuaaaguaaaaagaaauagaggaggagaauuuucuuauagggaaagugacagaccucuuuuaaauacuuuuuagaguauuuuauuuuauuuuauuuuauuuuauuuuauguguguuagaguuuaccuugaauguauguguaugaaccaccuguaccugcagauguuaaaaaagggcaucagagucccuggaacuggaguuacaggugguugugagucauuacuuggauacugggaauggaacccugguccucugcaagaacaaaagugcucuuagccacugcguaaucucucuagccccuugacugacagaacuuguaucuaguacacucaguagagcucuggcugaguccagaagguugggaacaauguguuuuaagaacagacaacuucagaucucuauuguaaauagcagaagagacuuaucaagggaguuaagccuauaggguacuacacgaauacucuugaccuccaauauccuuucuuauuccucucaguguccccucccaaagaccuuauugugacagaaguaacagaggagacuguaaaucuggcaugggacaaugagaugcgggucacugaguaccucauuauguacacacccacccaugcugauggccuagagaugcaguuccgugugccuggggaccagacauccaccaccauucgggagcuggaaccagggguggaguacuucauucguguguucgccaucuuggaaaacaagaggagcaucccugucagugccaggguugccaccugugaguaggcagaggauucuggguagacucaccuagccuuggccaagcuguguagcacuaugcauacuuuaagugcccaauauauacuaacacacuucacccaaugagacagaagcaauuguuaaccccaugugcagaugaggaaacugagaccagacaguucaucaucuccucucaauccccacagcuaacaaagauggaguugggcuuuacccuggaaagucuuaggagauuagaucuuaaucuucuuaucaccauuguguggaguucuccucuauugaccucacugucucagguuauuccuuuaagagucaguacaauuaccuucaugccugagaagcaaacuguggcuagaaacuggcccuuacuugcuaagcaauaacagcauuggccuuuccuuacugagugugcacugcaugccaagagcuaggccagcagacuucacggaauguauuacucaguccuuggugcauaccugagggaagacacaguuaccaccuucucccaggaaaagcaaugaucucagagcuuuguauaaaucuuguccaaagucacaguguuaucggugguggguuagaugcugauccagguccaucugauuccaaauccuauguaugcuuugcuaauucaacaauaugaaaucauaaauaagcagucauaugauuggucauaauaggggcauucacauuuucucacaguagacugcaugccagaaaagccuuuaaguagaccccagauuugguuacuagccucaaagacagcugucugucacagguuuaguguaucccuagcuguguggcuaccuaggaucuugccuuuccuuauauccuauuugugcuguuacuuacagauuugccugcaccugaaggucuaaaauucaagucuaucaaggagacaucuguggaaguagagugggauccucuagacauugcuuucgaaacaugggagaucauuuuccgaaauaugguaaggggcucccuggaggaagucuuugauauaggagauucacaagguggucaaaggccccugcugcuucuuauguuacuugguuuccuuagcuuuggguggaagacugggcacuaucacuuugugugaucauuauguauuuaagugauguuaauuucuucccugcuguuaauaaauagaaaaguauagcauuuagagaugagaguccggacaaacacaaguuaaaucaucgauagguaccaacuugcaaaucucuauuugggauaacagaaacagaaccagucugcccuauacaguauuuccuggcacaucucaaguaugaguagaucuuccuaggacacaaagauuagguaaaucgguuuucugguuauaacccaggcccuguccccaauuaucugggaaagcauugggcaagccaccaacuuaaaacugcugacuuacagaaggaagggcugaguuacggaucucacagggugccguuugacaggaacaggauaagugcaggugucuacaggaggaauaaacaaacucgagaagcagcguucucaucucuguuuucucagcaucuaaccucccaaucugcugggcuacauaggaggguaccuaaugaauaaauuaaacaagaagcagaaacaagugaagcauaaagaugcauggcugucccugccucugaaucuuagcccuuuguuguuuccauccugcagaacaaagaagaugagggagagaucacaaaaagucugaggagaccagagaccuccuaccgccaaacuggccuugcuccuggccaagaguaugaaauaucucugcacauugugaaaaacaacacccgaggccccggcuugaagaaaguaaccacaacccgugaguaccagccaagaccugugauagagcugauugugucucuuugcaacuucuggcuuauagcauacccucugacacagcaucugcaucagugagaauuugcuuaccaauacaaaguccauauggagugccuuaagugauaauucugcagguuugcgauuuggacuugggcucagcugugugaugcuuguccuugacugggaucacuugugcaucuuugugaacugagacuguuuggccuagaaugguuccaguuaagacagucaccuguaauccuugcacucuagaagcugagacaggguauuagcaugagucauggccauccuggacuccauggugacuucuaggaugauauaagcuauggaaggagacacugucacaauaaaacaaaagcaaagcauaaugagauggcaauuuuuuuuuuuuauccuuggagccuccuugucauuggguuagccggggcaugguggcauggcuguugaguagacucaaaauugacauuucugucacugcugucagaggaaauucucaggccaggacacaugggagagacagagaaacagaugcauccccucucugaagcuccucaaagguauauucucaggacuguagaugcagaaaagguaaccauggagacgaucacaagucaucuaccacacgagcucauuuaauccuaacaccaagucucccaugacagaggugagguguauacggaugguacuguguaugaaaacgagugaauacgccuuggggaaguugagucacuuuaacaugauguaggccagacagucaugacucaagcacagcugagaaauggagaaaagaggauccccaaggcuugcugaucaggucaaggcuagccagggacccuggcucaaggaguaaguuggacaguccaaggaaagaugccuaagguugaucucuggccuacagauacauucacacauacauauacacucacauacaaucuuucacacauacacacacacacguacaucaaacacauacucucauacaugcacauauaaacauguauacucacauauaaacacaugcucacauauacacucacacacacugucacagucacacagauacucacaaacacacacaacuuucaaaaauacacauauacucaaacaaagucucauagauaauuucaaauacacacacacacucacacucauacaucuuucacuugacacuaauguccuuagaaauucguggggucaaguaggauuuaauaaacuagagacuucuaugggauauaacugaauuuagaauuguucuaacaguuuuguucuuuuuaaaaaacaagauacaggagaaauggagaaagagauccugcauuggcauuuagaaggaaaaugucucauuuucuucaagagaacagaggugccagcucuuuaagaaaucaacucugguuggcagggggugcugggaaaguuaaaucuguugacacaugacaaaaaggaacaucuugcacuuagaugcuugcacguuuugcauagcucagggccaguacgcaggacugucuccuucauaagcaaauguuuuccaucauccugacaacagcucucugugguagguaggaggcagguacugacaggaaaaaaaucauuagaucaccagcaaggcagagaaaagaucaaggaaaugcuuauccacuguagggaaaguacacugaagaggcaggugacuuuuaccugcccuuuccucuuuaauccaaauuauuuaaggcuuggcugcuuuguauucugcuuauuaagggacaaacccccagccuuugaaguuccagaauauguaaauaccaacguugauggacgugcacuucucuguuccuuuugugaccauuuuugagcauuuuugcagaguuaaaggaccuuaauuuuuuggugcaaaucauguuugaucccuucucccuggcaccucauugagguuuacugugaucauucuagacacaaaaaaaugcugacaagauccaucauccugugaugaugaagggauguggugguccugaguuuaaaucccuuccuugccauucucuuucacuuuggaacauccuacuucuuuaagccuuagauccaacguuuggaaaacuggguucauagcaucuuucucaucaaguugucuuaagcucaaggcacagauggcacaacaccaugggauguggucagcagagaguuaugucagucuucacuauuccgaacacagaguugggguuaucaguaucccuagccauacccuuagcaguguaaguggguuuguggcugacagcucugagaauggaagacagugucacugucuagguaauagcaucauuuucaugauguguuuuguggauucauuaaauacuagcugacacauaaccacuuagacuucaaaaaugaacaacacagcauccucacaaucuaucaaaaacuugguccuuuucccauacucugcaugaauccuggcuacuuccauuuaaaaacacuuaguggauggaugcuaaaagcauagacuaaacugcuuuuaaagauaaaaauaaacuuauacauuaaaugcccaggaugaccugaggaucgugaaggccaaacauccauuuucugaaugaaugaaugaaugaaugaaugacccagucuaaauguaaccuguaaggguccaugauuugcugaagaaugacaccccagacucaaauaguauguaaagcaaagaguguuuuauucugcagaaguacagcaugauggggucucccauuaccaaauuagagagacaaccaagugagcuugcaggcucaauuuaaaacacauuggaguuccagggcagaugagcuuugucuuacgcugucuuuaggcauucuggagacauuaucagggagugaagcuuggccauuuuucuucccucuuaguaauugacuggcuugggcuugccuggacuugcccaguucuuaggccuagucaacucaucugccaauuuggagucugucaugcaaucagccuagccuucucaaccaaacuguaaaaacaucugugacaagacaaugagcagcaguagcuacaaggaagaggauguauguacccuacagggaagaggaucuguguacuguacagggaagaggauguguguacccuacagggaagaggauguauguacccuacagggaagaggauguguguacccuacagagaagaggauguguguacccuacagggaagaggauguguguacccuacagggaagaggauguguguacccuacagggaagaggauguguguacccuacagggaagaggauguguguacccuacagggaagaggauguguguacccuacagggaagaggaugugugcacccuacagggaagaggaucuguguacccuacagggaagaggauauauguaccugguugacaugaaaggcaaagaggaaaaggaaaucucaauagauggaacaaaagaauagccuugucgagaccaggaggugaggaagcaugaaauccagguguauggggcaggaagugaguuuaacaggaugacacaggaauccccagaaugaggacaaaacaggccaugcuugaaacagaaauuacucuugcccugguuccuuucaucaaaaacauuuuuugaggcuggcucgguggcucaguuaggguaagggagcaugucaagccugauaaucugaauccaaucaucaggucccuccugcuaggaaagaaccaaccccagaagacguuuuccucuaaauuccacacgugggcuauacaaagacaugcagcacucacauacagacacacucagaaauacaugcacaaagagagacauguaugcauaagcaacacauauauagacacacucacacacacacacacacacacacacacacacacacacacacacacacagacauacacaacaccagcaaaggaaaggcuuucaucacccaucaccuguaugccagguuccguucucgaugcuuuauaagcuuucucuguuuuacuauuggaaaaaugagggcaaaagcccuccauguagaucuuacagucccuccuuucagcuugccagacagaaacugcagcucccaagggcaaaagaaaguaaggggucauuaugagucaaaugucuacuguggucugcugcaaaguccccacuacucucaaccccuucugccggcauugacccuuugguuccuuuguuggucucaggccuggaugcccccagccauauugaggugaaagaugucacagacaccacagcacugaucaccugguucaagcccuuggcugaaauugauagcauugagcucuccuauggcaucaaggauguaccuggagaccguaccaccaucgaccucacacacgaagacaaccaguacuccaucgggaaccugagaccugacacggaguaugaggugucccucaucucccgcagaguggacauggcaagcaacccugccaaagagaccuucaucacaggugaggaaagggcagaguaccaauucugccccacuccauccaugaguccuccaggcccauauagcacuaaagauggucgagggccuuuucaucucugugcauucauuuuagauaauaauuagugacuuuuucaaagaaagggggauuaaauaaccuuccaaacauacccaggcacaggcaaacaugugugcauaugugugcauguaugugugcaugcaugauagagagagaaaugggggaaagagggagagaaaagagaaaaaggaagggcuggucugauauucuuagacaacauuucugguuaaaguuuaauggcucaguggguaaaggcauuugccugacaucuuagcaaauggcauuacuucaaaggucaauuauauaucccauacacauuuugcaggaguuugguagcaccaggugaucaacacuaaguuauuaaaaauacauugauucaacagaacaguuuucauauccacagucuuauguugggggcuuuguauuauuccucagacacagaaaaugaaaucaauguagccaauugaaauuaccaccuaccaauccucaagaaaggaacugggacugugcucuuuaacuuugugaaucaguuaccaagacaggggcuucgggggaauucugacauuucuguccauuggcgggugccuuuugaaucucugauugaaaugucaaguucuccugcacucaucaaaccuggcauaaugcccaucuucccuuucccuccuaaacaggccuggaugcucccaggaaucuccgccgugucucacagacagacaacagcaucaccuuggaguggaggaacgucaaggcagacaucgacaguuacagaauuaaguaugccccuaucucuggaggugaccaugcugagauagauguuccaaagagccagcaagccacaaccaaaaccacacucacaggugagccgugacccagcggugcugugccacaggggcccucgaaaggacaggagcauaugucccuauuuugcaacccuguagagauuaugaaauaggcccagcuucuguccauuccucucacugucacugcaucaugugaugagcauauacaauucacaguggccagaagccagucuggggucacuuuuaaagucuucugggagccugccuucuacuagugcccaaccuucacauucucuuccaggucuaaggcccggaacugaauaugggauugguguuucugcugucaagggagacaaggagagugauccagcaaccaucaaugcggccacaggugaggugcauggcaaugcuaccguugcugaaguagacugaacaggaaaggcaggacuggugagaaaagucuaucuacaaauucaaagaaugagauuagaggagaaaugggccucuagugccauggagcccagaugucuacauuuaaaagaacgaaagcagaacucauaagcucacuccuaagggaacuacccuagcacaacucucuacagaggaaagagaagaaaggaaaauuggaagcaaauauuauaguaugccuguuuuuaguugucaacuuauucucuuaaaauaagccuguuuaauugguacauaugugaaguuuuuuuccccuuagcuucugagaaaauaccucccuagggcagauaguuaaguaaccauauagauuaacuacagcaucuacuacagcauccugguucccguagcauccuguagugccagccuugggugaagauuaccuagggcuggauuggagacuguuguuuccauccugaaguguuuuucugaaaaaaaucuacuacuagauacaucacagcuuuagauuucaguaguguugcacaguguguauguguguguuucugugugugugucuguguguaaaugugucuguguauaugucucucuguguguauguuugugugucugugugugugucuauaaaccacugcacauuauuuuuaauuuucuccaaaucccaaaagguaguguguaacaucuccugucuauaaaaggugaggucagucaggugacugcccugcaguuacaggucuccucagggcacacucagcuccagaagucccugugccuggcagccuaaagaugucucaucauucucucuccagaaauugaugcacccaaggacuuacgggugucugaaaccacacaagacagucugacguuuuucuggacgacaccccuggccaaguuugaucguuaccgccucaacuacagccuccccacaggccagucgauggaaguccagcugccaaaggaugccaccucccauguccugacagaccuggagccagggcaagaauacacuguucuccucauugcugagaagggcagacacaagagcaagccugcacgugugaaggcauccacggguaagucacccugagcucuaagcccucugcuaacucuggguggcagcuuugagucugccaggcuugucaggaaugugaugcccagaggagaaauaagcuccuuucucuccuccuggagcucucugccacacugaaauggcagcuuccuugucuuucgugaagauugacguuuuucuccugucagucaacugauugaaccaaauugccucauggagaaacgcugacuucuaagcaacacuaacuaggagaauguaaauagggagcugugauugucugucuugucucuuguugcuguuucauuugugcuccaugguauucuagaaauuucccauuucuccccuuuaaucuaaugacagcuuuacuuuucauuguuuuaaagaugcccaggauguuggacgucauuauuugaacaucuuccuaggaguguuuuuauuacagcucucuugcccuccucaggauagcccaggagaacggcacuuggucugaaaccugccacgcugccuucucacuuuauuucuagucaugaagcgucuucuggcucuccuugguugaucccaggucccuuuuaguccuauuagccagcuaaccuaccgacuuucucuccugucacuuuaauucacggacugaacugcagagagaaucuggagauaaaaaugguucuuccuguaugaaaaaugacacauccaauuucagccaugaaguuuucaagaucguuugaguuuucacaagugacagacuuagcuucccauuucauuagcaugcaugcaggcaugcagcuaccucaucuacugcagugugcugcuguuugaagaacgcugugucacaugaccaucauagccugauugacucccacacuccguagagucuuuggagaaaacuagaagcugggacuaucagagaucaggauguucaggggucacuagcgcuggucauguaacacagaagucacccagcugacccucagccaucugaaagagaaugacaaugaggcaauuuagaaaugucaugcagggcccaaguuaucuauuaauaucuucaacugaauacaacagaauuuucaaaugucagucuccuccauuaaauugaucugccaccaggcaguacaagagaaaguaaaauuguuucaaauuguucaggauccagacuccuucacucuuucucuuccaccauuuuuuuaggguuuagcuccgauucucaaaauggggucaguaucacuacauggcugcugcaauccuccaucauccagguucuaggcaguaggacggagauagagucaaagcuccaacccauggcucuuucuagagauuguaucaauaauuucccuguauaucucauuggcuguucuuacauaacacgagaaggcuagucuccuaucagaauagccacuguaaaguccacaggcauuuugaaggaaaacagagaaauuugugagacaaaaggacagucuaagcaaguaagaaaugagugcagugguuaauucugggaacagugcagacugcucccuccugagcuguagggugcugaggcuguccgagaagcuuagaaggaaaaguucaucaaagauagggaaauagaauugaaacgaguuagcuugaauaacuuguauaaucuacccuugcaugaguuuauuauugugugccaaaggcauuaaaaaaagggagaaccagaaauguaagaagaaaaagaacucucuccuuguuccuccucucccucuucuacucuuuccucuuucacaaagcuccagaaggagggaccccacccccaucuccccgcaucuccagaaucaaaggcagauguugcaagauuaacauuucuuaugcugguccuccugcauuuucuccaaggaagccccaugcuccagccacagcaguggcccaaguccagaccuccuccaugagguggcaccauauugaaagcagaguuaaucuucuuacccuucauuccugugcuccauaaaaaaaaccaaacuuguacauaacagcaccuuuccaagggcuggguggccuccagagucuggcuucucuggcuuagcuuccacuauucauguccuuggccaacacaugacuguccccuuguauguuugcugagccugccuccuccaccaggccugugcucccuuuguuauauuccuauucuguccccuguuuuccacuuaucauuugcucuagucucguccauuucaagugcuauucaaaccaagggcauucucugagcaagcugugaaacauacacccccccccagcccaccccugaugcugcuccaaggcuucguggcuacuuaccaacuugagaaugggcaguaaccaccucauugucccugaccuccacccacccgugagcagauuguagggacaaucuccuuugucuacugcugccugcagugccuggaacacauccaaagccagagugagggucaggaacaucugcagagauccagcugcucuggggacagcauugccacauuuuguuuucuccuuuuuguccuucucugcuguagcagcugucuagcacccuucaggagcaaggggcaagguaguuauucccuaggaauucuuuaaguuagugcaauauggaugacaaaaggagagagcaugaaagggggagggagagagggagagacauaaaaggggggggguagaggcaaggccugcucccauccagcacagaaggccuguguguuucagccuuguucucuucugcucccuccuccuaacucucccauacucuucucuccuccuucaguuuuuccuuuucucuuucugcuuuuacauuccuguuagcuaaacucugccuaaagccaaggcuacaaauucacuggaagcaauacaagacauaaaggaggacaauaggcaagagccaagggccaugaggcauauuuucacagcaaccuaagaacccaauugugucucgcaugaauuugggaggcggaaaaaugaaauuuuguuucuaaccacagcuucaagcguuaaacaacacuucgcucugauuuaccauuuuacuuuucuauggaguaaacugaaguggauucaaauaguuauccuuucaauguacauuuauuuauauaauauaugaugaccacaugcuaagaaucagacagaagagggggacauucgggacaaagagaaugagaaagagugcacugcagugggaaagauagaaccaacaugggaagaacguaguucugcuguuacagaggcauggggagucacaggaggacagaccugauccucaucacacaccugaaaaagagaacaaaaggcucugaggagucucaaaagaagagcuaccuagaugaguccuugaggagcaagaggaggcaagguucggggagagugcaguguccuucccagcagggggaauagcaucugagaggcuuagagucaagggauguucuguagucaucaaacaagcuuagcccugcugugugucuaaguagaaggacaguauuucuaaggcuucaggccuucuggaacaggugcaaagcacagauguucagggauuuuagcuuuauucuucauagcuacuaagaaccaccagaaagcuccaaggcagccaagacuucauauuucagguauuucauucucuagaaaaugaguuuggugccauuugaaguauucuuguagucuuccagcuugcauugaauucucugcuugcugugggagaaucacucucucacauacaaagcacaaaaagagcuucgggcucugcauccugccagccuaugguaaccaccaucuauacaauggugggaaucugaagggaugacgacauggccagaaauuccuuccugcagcugcuuggcccaccaugaguucagaugacaggagauuuggaaauucugacuuccugggcccacuggcauuacucagaggguaaauuccaaagcccagcuggaagagaaugacaauagccuuuucacuguggccuguaggaaagcuagggugcacacagacaaugcagugagcccacaaggaugucauucacccugaaaaugaggacucagcacuuauacacagcuuugcaguccacaacugccugcucugucuuuauucagagcaccccuccaucccucuaaguucaucgguggaaguuucaucuuucauauaugugagcauguguuuagggucagcuuagugugaguggugugccaacagcauccaguguagauaugaguacacaccacuuacauaaaggaaagcccuaucuguauccuucuugaucugccugugaaaagaaagggggaaagguggaggacuagagacccaaacaggauggaaucugagucccaauggagacagcauugugggauaguucucucaacugagggaagagguguggggggucaugaagcagaagcaccagagacacaggcaaaaacugaagugcagagaugaaaugagucucagaagagcucagucuaaugugcugucccuccacucuuuguaccugugagcauuuuaacagcuuucccugugaugaucuauaguacccuccucccuccuccgcauuaggcaagucuccuuacuuuaugcagccucaaaucuaagcucuuuucauggggaacaauaugauuaaugucaccauuagagauaaggcuuaagauaaauuccuggaaagaaaagauaguuacuuccucuucaccaugguauaaauucucaaugucagugaaguuucugauuagugguuuuagacagcaggagaaggaaauuuuuuucuguuuuuuuuuuuuuuguuuguuuguuuguuuuauuuucggccugaccaguacuuuccccuuaucccuacucuacugaagugguuuguuaaaaccugaccugaaacucaggaacugaaaaguccaaauuaaacuauaaugaccuucuaggaaaggccaaggcagcacaaagagaaaagaaaccuaagcagaucuaggaggcugcaaaaugcagagcgcuggaaaaagacccaagaccaagcugagguuauuccguguagugaaaaaccacucugccaacuggaaacugaggcauggagccucguuaacagaugagaauagucuucucuaggauacuuguaaacaaguaaacauauuuccaaaaggaaauucaacuguauaaaggcaagauuaaugcuacacuaaccaguuuauugcauuuugugggacagcaucgcugggcauacagugacagcauccugguacuggacucuaugggccuuggccaauggauuugcuggguucuuaaaaggcaagcauuugaugaauaguguaacugaccuugucucuguuauuguuuagaagaagugccuucccuggaaaaucucacugugacugaggccggcugggauggccucagacucaacuggacugcagaugaccuggccuaugaguacuuugucauucagguacaggaagccaacaauguggagacugcucacaacuucacaguaccugguaaccuccgggcugcagacaucccaggccucaagguugccacuucuuauagagucuccaucuaugggguagcccggggcuauagaacaccagugcucucugccgagaccuccacagguacuuucuuccuucauaucuaaagcuucuguuuuucucaacaggaaacugaccaaggauaaucacgcaucauugauuuuagaauggccuuguucagccacaagcugaagugacaugggggucugaugguggauagccaggccaucgcgugacauaguucuaaggccauguuaacauuucacauaaacaacacauugcugcuguauggaauccaucaucugagacaguccaaauaaaccaaggauggugaccccacauuaaggacugauuaugugcuagaguccaaaggaaauuagccacagaaggaauuccugaauucucugaaauugauaaacuaagaaagcaaauauuuccccgcccccuucuucugcucuuuccaagguuuaagauguuacaugaagcauguuuaucuaacaaaugucguguuuucaggggauguaaagccugcccuuggguucaggauuuccuauaucuuacaaugacuuuuaaacgcauucuuuguccuucucuagggacaacucccaaucugggagaggucacuguggccgaggugggcugggaugcccucacgcucaacuggacugcuccagaaggagccuauaagaacuuuuucauucaggugcuagaggcugacacgacccagacuguccagaaccucacagucccaggaggacugaggucaguggaccugccugggcucaaagcagccacccgcuacuacaucacccuucgaggggucacccaggacuucggcacggccccucucucuguugaggucuugacagguauuuuagaccgguucacuccuuuucuccucucccugucucugcuuaagaggaaucccaucucuaaaugagacuuagacccuuccauguuggggaaauccuagugaaucacuucuacuucaauaucuuaucccuuauuugggcagguccugcucuuagucuaguagacagcuccagacaaaauuccaccuacucuucuuuuucaaaagugagaggugacuucucucgaaaaguauguuucaaauuauaauaucuaagaaacuugaaagcaaaauuuguaagugaaaaauaaaaucacucugagcucauuuuacaaauacucaagagcuucccauaaaccuagugguauaucaagaauggaaguuuugagcuccuccaaaaacuaccuucuauucccaaaggcugaaagaaagccuuggcuuuaauucuaacaauuggagugugcucaguacugcaguaaaucacacaucuguagucaauacaaaccaaagagcucaucucaacuuuagucaaaccccaucucaccugaaccccagagagcaguucccuuuauaguaacgucaucccuguguauucucaugcagagaagguuccaagucugggaaauuucacagugacuggacugagaugggauguucucaaacuggacuggaacauaccagacagaacuuaugaccaguuuaucacuugaauccaguagaauagccaggcagaaugggcuggccuuauuauuccuggucgccuguguuccuuugaagucccaggccucagggcugguacucccuacacagucacccugcacugcaaaguaaggggccuccauacuaaugcaccugcuguagaguucaucacagguacaugaccauucuggacuggauuuuuauauaugccagucuggcuguucccagaauagcaaaacucccucauagguaggucuugccugaauaugguuugcaggcaacaugaaacugugacuuagcaggucuggauuagaauucuguaguacuggcuggauguuuuccuuugcaucucugagccuuuuuuucuugccauugaaucaaaaaugauacccugcuuuaguauccuuccaugagcaauggauggacuaagaaaugaaagggcuugacaaaauguucaucaucuagccaguguugaacagcuaagugaguaguuguauuauucagggucuucuagagaaacaaauuauagaaugaauauauaugagauuuauuacggaauacauaugggauuuauuaugaauauaaauauugaauuuauuaaaauggcuuacaaacuguagucuagcuaauccaaaaauggcugucuaccaacagaaaguccaagaauacaacaauuauucagucaugagacugggugucucaccuguucuuuaguaugcacugcaauccugaauacacaggcccucaugccagaaaaagaauggacucaccagcaagagugagaguagacagacagagagggagccucauucuucuguguguuuuguaaaggcugccaguuucauagagguuaccagcagaagguguggcccaguuaaaaagugcuucuuccuaccucaaaaaaaaaaaaaaaaaaaaaaaaaaaaaaaaaaaaaaagcuggauuaaagauauaucuuccugucucaagagagcuggauuacaagugggucuucccacuucaaaugauuucaugaagaaaaaaaucccgacagguguguccagcugguuagguuuuaguucauuccaaauguagucaaguugacaaucaagaaucgccuucacaguugucaacccaaccaugggaagacaaagcacaggaaguggguauuuuuuuggugcaggagagcagaacuuuucagagaaaucuuuucaauacugcccucagagacauuaaguaauacccaauuccgagucggaucccuucagaucuggaaacugaucuagucaucuuaugccgaagucaucuaagcccauuucugaagugcacuuaaaguaagaaccuuucuaagaaaagaugguauguuuaaguuccauguuuuccauuuaagcugaagagaaaaacaaauucaucucaguccuuggaaugccccuugaaauaugcuguuccaucuaucacacagagcuuuaugcuauuccaaggaggauggaaugaaugguaaaauuuguggugauaaaguuuugaugcuguaccccucuccauuugccuuguauccuuguauuuugauaaugccaucaaauuaccuaauucaaaccaucaauuuuccuacuuguuuauauauauauaaaguaaacuuguccauugcugugauguacacacauaccagauauaaggaagaugauuauguucauuuaccuaagucagccagguuaucauguugccuuauuccuggacuggguugagauaaacaaaggucgucugggaugucugcucuaggucagggaugcugaugagcuacguguacagucugcaagcccugcugcagcugccuagcuccuuuaguaaauggaauguucuggugaagucuuucgugcaguagauaaacaguucucagcaagugcacuucuguccccagaccucucagaaaacccugggucaguguugggacaucuuccccaaaggauccugggacacuuaggaacaagaauuauacacuucuuaaaaaaaaaggcuaagaucucuaacuucuaauucauggccacuucugccuuaggaagauggauaaggguauacuucaguuuguaaagggcuugccucucauccuugaggaccaggguuugauccucagauccucauaaggguauagaaguauaaauacuuagaaucucaacugagaaaaugggggcaagaggauuauauugaugauuucuggagagccaaucuaguugaaaugguguguuccagauucagucaaagacccugccugaaacuaaaguuaggagugauugaggaagacauuugaugccaaccucuggccuccugcacacaacugcauacauauaaacacucucucucucucucucucucucucucucucucccucucucucucugucucucucucucucucauacacacacacacacacacacacacacacacacacacaaauuagagcugagacuguacugaaucccaaacagugaauuuuuccauaccccaaaguuagacuuucuuaaucagcaauaacugaagaucguucuuacacaguuaaaaagaacaacuaacagugggcccugcuuugcacauguacuaagcaauacagacucacucuuaauuaaaaguaagcaagcugacuucacacagccuugcuuugugaugcagccaugcuucaugccaaggguuaagacagugggagagugcaagccaagccaggaaucuauuacguaacaucauguccuugaaaguugcagaaaaagcucagagauaaaccagaccaccugucaaaacuugggaacacgaguucuucagaagcccaaauacagagcagguagccagccacaagaugucccuucaccucaaguaauaaaaugaggcauggcuucgcauaugacuaagauauuccaaaacacaucaacaggcucuauguuuuauguugccauuuaucagacaguuucugugccuuguguaugacaugaagaugcuaauaaauaucagguaaucacagaacccaaugagaugguacugucacuucuacuuaaaacugaggcucagagagaaagccagacucccaagaugauacagcuugccaggucuguggaccuccaacuccugugcuuugacuacuccuacuuccuuaccccucuacaaucccacauuguccuggugccucuagccacugccugugcauucccagagauuuccaugcuucggccuuucaaggaggaaugaugcaaaguuuccuuuucugccuguuucaacucuucuccaaaaccauaaccagaguagcaaaaaucugaauacagaaauacccggagaucaggagcuacagaaacaaaacacucuuucucuccccuucugcuuuucuggaguaggguuguggggcauucggcugccuugcuugguuugcagcacuaacagcaaauucucugccuucuucagaggaucucccucagcugggaggcuugucugugacugaggucagcugggacggccucacacucaacuggaccacagaugaccuggccuauaagcacuuugucguucaggugcaggaggccaacaauguggaggccgcucagaaccucacgguacccggcagccucagagcuguggacaucccaggccucaaggccgacaccccuuauagagucuccaucuacggggucauccagggcuauagaacaccgaugcucucuacugacgucuccacagguaucaucuccacugcccaugcuuaggguucucucuugcgcucgcucuugcgcucucucucucucucucucucucucuuucucucucucucucucuucacucccccuucucucuccccacuccucucucucucucucugagauggcaagggaacuagcuuuucuuccuggcuaauuccuuucuacgcaugacgcaugcucagagcccuuucggugagcuguuccaucauuccaaugccuucgccacagcagugacgagccauguaagauacucacacuucuggccuccgacauccacuuucuugauucaccuagucaguaccacaauggcaccuuugcacggcggccucuguuuggagaaccagccuguuugguuuuaacuuccaucuguaguccuggcagagaaucaaaagcccacccuccccacaugugaguuugauggagcacagaccauuuauuuuagagacucuuuugcuguuugagcauuauuucaaaauuucucguggagauguguccuacagugcuuacacuuacacagugauucuuugaaaugaagugagcacaacaggagaacugaauuacccuccaguaggcaaaauucucucagcugcagagucauugcuagaacaucaaacuaucaagcuauccgucaaagagagaaaacauacaauucugaauggauaauauaccaaaguuacuguuguucuguagcaggacacucaguagcucucagagcaagaaguauuucaggcuauaaacggaacagaguugcuacccccuuuuugcucugugaaucaagaguuauuucccgaagcaagcucccaauuccuacaccagggaugcguucugguuuacucguuacacuguuacaguuauaaagcuuucaaugggacucuucccaagugaacggccuuuccuaacccuguuuucuguggcucgucuuuauggugugcccugaugaguucuuucucaugaaaaugccucccuuuuuuuauacagucacugugucucauagcaaaccauuacaucuuuguugauucaaaaggauaacucugugauuuugccucaguuguuacagaaacugucacugaugcauacauaaaacguaagcaaccccaggguggacagugaccucaggcugaccagagauuacaguugaggaucugcugacuuuucuccaggguucuugucugacauccacaaacuauucugucccagaaggcagagcaaucaaucacccgccacuucugaucuuuccugcagaucucgugguuuggaugccaucuguauucuuuuuuaugguagcaacauucuugucucugaggaguuggcccacggaggggaagggcuauaauuaaucugugaaucugggauuaagggucuuucuccucgcuacauagauuguacuggcuucacaaaugccucccaugugcacacacugcuugcuauaucaccacuucucaggaaaguaaaagcucuggcaggacaucuccccagaaaaauauuauuucuuagcuaaaaaggguugucugaacgguuuggcugagcugucuuggcugccaauacaggaccaaccuucuuggccuacauagacauaaguaaaagagaacaugcuauuuuaacagaugaugagaacagcuggcucucccuuaucuaaaguauggaaaaaaauaaucaagaguuacccugagaggugggaggaucuuuucaagugacaaaaucagaagccuccaggucccacucagggaggcccaugcugucagcauuauuuagcacucauuuagauagauaggcauucucucaaagcuaaugcaggaauccacauaaucuuggucccugagccugaaagcugucagcccucauaucuuuugacugauugccaauggcccugaggcagggcucucagagacagauccagcuaagaugaagccaauuccacugagacuagccagcccgucuucugugcugagguaucuugccaggccugaucaucaguggcaaaugcaggggagaaaagucuaacagcuauccccuccuuugcucagcuuccucuuaacaaaaccaguuucuccuucccuggcacugauuaguaguggcagcaucacuuugccuugcuauaacccugaacuaucagaccuuacuccccgggcaugauucuauuaaccaccuccaccuugaaacacagccaaauaacuaaaucauuugauuuuuucucucucucuccuucccucucaucuuucagccagagaaccugaaauuggaaacuuaaauguuucugauguaacuccuaagagcuucaaucucuccuggacagcuaccgacgggaucuucgacauguuuacuauugaaauuauugauucuaauagguugcugcaaacagcagaacauaauauaucuggugcugaacggacugcccacaucucagggcuuccaccuaguacugauuucauugucuaccucucuggaauugcucccagcauccguaccaaaaccaucaguaccacggcuaccacagguacaugagcguucucuaguuucugacgcuuucucuccacagucucucucagcaggaugaagccacuugauuucauuggccaaugagguauaaaccauugaauaucaacuuuccuagguugcugggcugcaucauugucuaacaaaauuuucuucugacagccaccuaaaugguacauuugcaugaauccauaucucugauuaucauaagcagaccauucuaaguaucauaugaaauuuuguccagguggccacaaauaaggaccucccuccuuugguaacuuuaaaaucaucaugauaauuguccuaggcuugcaaagaugucucuucuaaucaaauuuacguuucuuuuuuuuugauuauccuaauaucugucucucuguaaagucuugaauauccucauacccaaauauccuagugauuuaagauaauugucaacggugcccuguuuugcuuuuuuuuuuuuuucuccagcugggaaaauggcaagaaagagcaaugauaguuaacucaucagcuaagcaagagguacccacgucauccauauuaccucaaccugaaagccagcucaggaaaagauguccccugucuagaaugcugagagacacauagcaaaaagaugauaauaguccuucucagauaagaaaccuggguccaaagggagcaaacuguucuugcucugcauaugcaguccuguggcauguguucugugccagaugauuucuuuagugccuugaggaagacuccagagaggagagcauugcccacucaagcaacauucuuagcacauuuggggcaauaucuucacuuuacagauaaauuaacaugguccagacuagaaaaaaaauguaaggaaugcaguuuuuccuuauaguucacaaaagaagguccauauucuagggaacacaagaaaaggauugauauuauagcaucaaaauuaccuucugcuuagaucaccaaugguugauggagaccuaauuuauaugcuguuuuagacuguuaucaggguaguccuggaaaaaaaggagcuagggauacuugguuccuagucuauucauguuaaaguauaguaacacagaggggacaaaaguaaguugaccauguguacuuggguugaauugguuuucaacaaagaauaauuucuugccugaaaggcagagucuaaaaccuuauggacuuagucuucuguguuuuaaauuuuuucucuaauggugaauuugaugauuauacuuuuauauguaaucuuauugcugucauagacagcucuccucuuagccacaucucugccucaaauaugaccucaggagcuugccuuaaauagcuuucuuauagaaguuaguugguuugauugucaccaaacagugguauacucuaucaucagucaaccugaaacucugccaucuccagccucaaacaaggcaucuucuaauuacagcacuuagcugcccagacugauaggcagauagcguccucagacccugaugguccaugcagucacaaauacuacccauuagagguucuucggucuccauugagcucccuuugagcaacauuuuaaaaaucagccacugcuccuuuuucauccucuuacuucuaccagauccuuuuuaauuuaauguaggcaucuaaucaaagcuuuaaagcuuuaaaguacacuccaugccaaauaagggaccuucauagucuguuucucccauauaccccuugcaaucuggaguugcucugugaugaguuaauaugucuugcuuuuguuugaaguccuaaaucaucuuuuccucuucucuuuaacaauauccccucacagaacccauucucaccugucuguaguccuucuaaucaaagcuugccugugucccauucaaaggaaugucuacaugcuguucaaagucaaacaugaucuauagucucuuuucauuugccuggauuuuauauauugauugcuacccuugggaugcuaagaaagaacccuaaauugcaagcaauaagucucaugagaaaacccaguggugcccaucuuguucuugagauuuucguuuucuggauuccugacagauaggcauccugauagaugucucuuuugacaucuacucuguugagcaugcacugucaucugcuguugucuguuccaaagcacuagaacucucuucccauccaucaucuugucaaaguugcaaugcauguggugaauacucagagcauuaaaucuuuaaauaugucuaucuuucuuggaaguagacagcaugucaaggaaguguucguaagggaagugauaggagaaaaaugucccuugccugcauggaacacugaccaaauccuaacuagcauucuauuucuggguuuugucuuauaucucacaauucaccaugguugcauccucugagaguucacugaagguaaugcuaaccucuggaaccaaggccucccucccuccaucugcaugaugaauguguuagcacugccagacucccuacuguagcaugagaagaauuauagacuguaucuuuaauucaagagauagcuucuaaagcagaagacagugaagagcugaguuccaucuggaggacuuuauccuuugugugguuguaaaaacacugccaaagugguagcaaaacuacagcuuuaucagcaccucagaaugacaagacagaaaaggcaugccagcgcuaugacuguaagcuguuucugagccagauuggugggauccuuagagacuuuagagcauccaugccauggaguuuuguaguuaaauauugcucaaaugagccuauucuuaucucuaaauauuggagcugagacaaaacaacucccagguuggaaaaauacuuugccucuuuccaacucuaaauccuaucaauagcucaguccucuagggcuacugauucucuuuagaaucaaccugguuugacauacuucacauuuguauccuuuacuaaaugacuaggaguauggaccuacguacaucucaguugauacuagcuaugaaagccuauuauguuaaaugaguuucucauauuacuauuuaagaaacaagacuauuuuuuuuuugauuuuccgagauaggguuucucuguauagcccuggcuguccuggaacucauuuuguagaccaggcuggccucgaacucagaaauccaccugccccugccuccugagugcugaacaaaacauuuuuuuaccucaacagaauuuucucuuuacaaagguucuauuaagcaaacucccuaaucaaggaauuugauguuuaacuucaaguuuuccuacaucuuacauaucuacuagacauuuuuaauauaauccaucuucacuuguauagcauuuggggugagguauagauuuuccuauuaugcaggcauuuaaguuuccaauguccuugaagaaauuucacauagaugcagaugcuagccuuuaauuugugcauccauauagaucaaaugaacacuaagaaaacccuccagaagcacuuucuaaagacuacucagugggauaccaucucacugaggcauuuagagacauuccuaagauaugggauccauagccuagcaauguuggagucaacaagacugcauagauuuaguuauagaacaagcuuuucaaagccuuugaagggauaugugcucugugaaucuuauugguaaaagaaaaugguugcuguuuaugauggaugcuucaacaugaagcugucuuuaccugggacaucuugaccucagagauuuuggcaaauguagucacaauauauuuuauucguccuaucuguacuucugauggcuggcuaacuuaccuuuacaaauggcuccaaauguguuuacacuuuaaaagaacacaaauaaaugacugcagaaaaaucaguaacuucuuugucauauaguaaauguaggcauagauacugccugacauucaauuuuuucugcaaguauuugguuaaauacagacauuccucuuuuucucucuuucucucuuucuguuucugcccauguucuuucccuucagagccagaaccauaguugggcaugcuaaucuuuagcaauauuacuccugacagcuucaauaugucauggaccacacaagcugggcuuuuugcaaagauuguuaucacugugagcgauacucauucacuucaugagucucagcaacucacagucccaggagaugcgcagcaagcucacaucacaggcuugguagagaacacugccuaugaugucagugugacagggaccaccugggcuggugaccccagaggaccccuccccucacaccccucacugucuuugucauuacagguauucaaagguucucucugucaguuuaggaaucuggaaaaaggagauaggcacucuaaagaaaacuccaaucccaaacauagucuugacuccaaauauaaaggccuuugguuuuaaccuauaggaaaugaauauauauguauucaugucauauauaugucauauauacauauauauucauuaggauacauaugguacaaagugauauuuuaacauauguauuuauugaagaaucaccaaaucagaucaaauuaauuuaucaaucaugucaccuaccuuuugugauaauacuuaaaaucuaaucuuucggcuguuuggaacaucggcuacuauuaguuauuauuaacugaggcaacuauucugcgccuugguuagcuuauucugcaccucacugaagcguauuccuacuggccaguugaacuuugugccucuugaccaauggcaagcggccaaccccacuucuggugaccaguauucuucuuucuacuccuaucaguucaauuugucaagauucuccauaaaagggagauggugaaaugguuucucuuccucuucuuggcuuauuucacuuaauguucuccaggcuuacuugugacaucaagaaugauagaauucccuucuuuuauggcuauauaguauucuucuacauguacucagcaaauguuguuacuaauguagccauugagggaaacggauugcuaugcaauguuauuucuaauagcagagaggccaaauguaaauuucuagccacuaaaagcaauggcacuccugaaaggaggaggacccuuacagacccucuuggaagcucuuuagacauguauagagcuucgaguaucuuuuggccuguuuucuagaaugcuuaauccaugcagagagucugaagaaagugaaauuuaaauuagcgaugaucuagagcaggaauuauguccauaaauugagguauguacgguguaaagugccuaguguccuagaggguccccaaauccuauaauuugcaauuuaaaaaaaaaaaaaacaacccaaagccaaacaaaaaaacaaaacaaaaaccuuacucuuaaaacagucaagcacagaaacggacauguucaaccuaggaagauagauacaugcuaaacuuuauacacuuauuaaauuugagcugugauguuucuauggaucauauaaagagauacugccuauuuucuuuccuaaucuuaccuuaagucgaugguaaaggcugugcaugguuucauaaaaguaaaucucuagcuugacaaaccucuaaaaaaugcuuagaaauucucuucuacuaaacucucaggagauagacguagucaugacccuuaaacuaagcuagucccucccagagucuaaauuacuauaaaugagcuguguuaauaaguacagcuaacuaauugugguagcugagaucaaaucugguugauuucuaaaccuaucccacaucaucuuaccuacacauagcccuggcaaauuuguuuggagccugauguccuuauguuagggaagagggcacucacuggugcugcuggccaucuacauuaggaaucuagcagacacagugaaaaguaaccgccuagccuccacuggauccucuacuaguguuauguccuccuguugcuucccaacaguauaaggagagugggcuucuuaaaagucaauugggguguaggucaaaguuaaguccacaugucuggcaugaguaagaccuuagauuuguuccccauccacaagcccaagggaaacaauggaaacaugccucacaacuuacucuuagaacccuggguauguuuuagucuaagauuuuaaauauuuuuuuccuuucaauuaucaaauguaaauauaagcuggguuuuuuuuuuaaguacagcagaaagaauggggugagaggaagacucuuucuacccugagcacccagagcucaucaggcccuuacaugucaccuucugaaggaccucccacaagucagagagaagccagggaagcugaaagagcagcccucaggagggaaacagagauccaguuacagaauuguuucugcuaaucccuggugugaaaagacucuacauuuugaaagaggcauaccaaagaagaaaugaaaaugaauaggaaagacugugggaggaaaaaaacaagcccuugauugacuaauuagccugaaaguaccuguuuucucuggaauucacugcuuuaauagcauggaguuaacagaggccagcuaucaaagaagggcaccacuucucuaaacaaaaccaacauuugagaaccuuguuuuacaaaucaagacuguuugcaugguaaaaaaaaaauuucauauuugcuuugauagaguuacagcucuugggaaaucuuaugagaaaaauaaacucuaaaaauaaacauuaacuguuacaaaaucagcacaggaaguccaagccacaacaaagucuaauucucuacuuauggaugcauucacuuagccauccaggugccaagaacuucuuuuuaaacauugucuuuauauccuagggaaauuugaccauaagcauuaguacaaggucauuuaucacuuugaaaauucucaguuagaugcaacaacaugagcgagugagcaagggaaggggagaagagaagagaagagaagagaagagaagagaagagaagagaagagaagagaagagaagagaagagaagagaagagagagaagagaagagaggcucuaaauuacauguugcuaaagcagacuugggcaugggauuuucacccuucuccccuaagugcugaaugaguaugcaucggucuucucucucuuuucuauuagcgcuguguccccacucugagugugucagagcacuugauagcauuuacuaauuuuagcauuguguuaggaugugcaaagaauaccaagcuugcagcaagaaggccuuggaaaagucagagacuuucucucccaguugauguccuggaggccagcagacagauagcaacaccuaccuuacagcaucguuguguuagacuggaucaacauucuguagccuccucuacugggacuuguuuuggccaccauaaggucacuuuuuggaaagcucaaguaugugaaaagaucccuccacaacuagggaauaagugggcugggacacagauagacaaaacauaaaaccaagauaacaaaauauguucuugcuuucuaacuuaaccuagaaaaaccaaacaacuuaagaauugccaaacuuagaauuccuuccugguuuaagaacauaaaucguuaauuuggauaaguaacaacacaacaaaucuuauuacuccuguuauccaaguuuaugaacucaauaguuggcccaaauaauuguauucaaaauaugaaccagauuaagauaugaaauauaccagaaaaguaugcuugcaacaaccaauuuuuuuuaaaaaucugauuuguuucaaaacaagaaacagcaagaaguagauuaagguuccaaagugacacaagguguccuauuuguauagugagauauggauggcccaaguuaggcucagcuagaggccuugcucuaucauaccuugcuaaggugagacuugggcuaaaucaguuaaucauuuagaaacuuuucuuuugaccuaugauugggaaugauaguuacuguacagucuuguuaagaaauuuacucuauguaacaauaucaggcacccaagacauuauuacuaaauauuccuuuucugagcauuuaacucaugggaugcuugacucagaaucuaucaguguucuugguauuugagcauuuacucagaaucuaucaguguucuugguauuugagcauuuuaacucaugggaugcuugacucagaaucuaucaguguucuuaguauuugagcauuuaacuuauggggugauugucagggaaucuaucaguguucuuggagucaggagcauugaacucacaggaugguugacugggaaucuaucuguguucuuggggcugcacgcugccuuagucaaaucagugcugcuaaccugagucauuuucacuccucccuucuuucagaggccuugccccuucuggaaaauuuaaccauuuccgacacuaaucccuacggguucacaguuuccuggacggcaucggagaaugccuuugacagcuuucuaguaacggugguggauucugggaagcugcuggacccccaggaauucacacuuucaggaacccagaggaagcuggagcuuagaggccucauaacuggcauuggcuaugagguccuggucucuggcuucacucaagggcaccaaacaaagcccuugagggcugagaccauuacagguauuucaauucaagagagccaucugcuccucuuccuggucccuuuuccuguguagucugucuucggaucccugugguuucuaacauugucuguauucuccacuuaauccacacacguaccuuguucucucauguccuccacauuuucccuuuuuucagaaucuauugagugcucacacacaccccauccuagaaaggagaagauggaaacgugucucuuuaaugucccaaacccuuuaguccacgucuugccuguagcucucacgugcucacuacagucaccuucguuuguguucauccuggcugguugccagcuacauuucagcuuucucaaaagaaauaugccaaugaguauauuuugaaaaaguauuuuaaaaucuuuacuauuucagagucucaaccugugaucuuaaccaacuuacccaguggucuuaugauugggaacugaaugaaacuuacuauacaggccuuuaaaaaaaaaaaaaaacaacuaauaccagagagauucuucaacccagacuaaauccauaauguucucaagacuaauacuuccuauagaaauaucacauuaauaauuuuaacagucagaaaacuguguuucccaaaguauuucuagagaaaacaagcgcugauggcuguuuaaagaucucauuugauaacauuucauguucaguuaaauuuggaacuaggaucuuugaccacacaggcuuuucagaaucucuuauuaugcagagggcaguaguucccaaacuuguuugacaaggaaugcuuuguaaaggauggagccauacaacaggaagaguuugcuuugagcacacacacuuugggaaacucagcuucaaauuuauuuugacacugaguuuugucuaguuaccaaaaugaaacucuggaguacaaaguauauauaaugauaucucaagagguucuaagccucauccuaccaucuaaaugguaaacuagcaaggaaauaaaauuaaacaggauauacuaggagcccucuucuggauagcagcuccggagaacaaagccaaaagaccauaacauucuaaaucauuuugcucaggcucgagggaaauauaaucaucagaaucgucauggacagcuccacagaucauuaaagucgguuuauuugucuuuucaaaaggaaaagaaaaggagcucccagcagaccagcacucagccacuggaagacaaagagcaaauguaaacaaguuauggcuuugaacuuguuuaauaaugcacgggaggggccaaggccgaguccagauguggacugauacaguuacuuuuagacaaaacucacagaugcaagcgaaugcuuggcuuguauugaaugugucagcuccguguuuuccuucuccucccccuacuagacuuuuuuaauguggaaugauuuucuuuccugguaucucaggacacucugucucugaaaaccgaggcagcacugcauucugauacuccaccagaaggaagacugcauggauggcuaauuaaugcucugucuccuccuucuuccaccaucuucucucccucuagaagcugaaccggaaguugacaaccuucuaguuucagaugccacuccagacgguuuccgucuguccuggacugcugaugaagggauauucgacaguuuuguuaucaggaucagagauaccaaaaagcaaucugagccacaagaaauaucccucccuucccccgaacguaccagggacauaacaggucucagagaggccacugaguacgaaauugaacucuauggaauaagccgcggaaggcgaucccagccagucagugccauagcaacaacagguacuguaaacaagcaggugccauagcaacagugggaucuauacacaaacaggagaggaaaacggaaauccaagacuggaauucuucuuccuauaggguugcauaaucacaagagcucuggagcacagagaggcuucuguuuagauccugguuccuuuaagcauagacuguguucuccuggacuguguggacaaaucucugcaccauaaaaagaguaugauuuccuuagcaggguggugaggauuuagugaucugauucauguaaaaguaacaacauaagaccugggauguaguaagggcgucauagugucucuccuagaucaucaacuauuagacauuuaaauuccaaaaacuuccuucuauugaauaguauguaucggagaauaugaucccuuguucuuuggucagauguuacagucacacuagaugagugagggacaguggagacauggaaccgagaccugaaaggauuaugacauguuuauaaaaugucccacgugagccaucaguacugugguuagcaaacugaaggauggagcugguaaggcuagcaggacggucuucuugggcucacaaauacaagccgacacugcguguaagagcccuccacgggggaaauaagacccuuuuuccuaucagcuaugcuaaggagaaaggcaaagauacccagacacaucauuacuauggucauaaaacuuaugugacucuuuagagggagaaacaaagaccugaaaaugcaguacuuuaaaaaaaaaaaaaaaaccuggaggaauagucaagauggcauugcauagagacaacccccugaaaggaaucugaggaagaaucagaaaaucacaaggaaaggagaagcacugagaagugaugagccacacaccaaagaucuuggccuugucuauugauacaucaagaauccgaggcccagaaagcugaaguacugugccuaaggucaggcugcuauaaugggcuuauugugacagugugacuguaauuauuuuaauagucaaaccagaugacagguaaccagugaacagauauacuagcuaugucugacagauacagggaauauuaguccaagcucccuaagacauguuaagacauguuuuauuguauggguauguaggagcuggugugugugucuguguguguuugugugccugggcuucucuaugucuguguaucuguguguguguguguguguguucacuugcauguagaagccugaagucaacuucagguaucauucucagaagccaucgacuacucugucaucugucugucuguuuuucuguguguguguguguguguguguguguguguguguguuugugugugugugugugugugacagacaaagagacauacagagacauuguguauguccauuuauauaugguacauaugcaugugcaaaagucugagucuacagguacucaugccuacaugugcacagaggccaggggagaaaguaggguguccugcucuaucauuaucuaucuuguucuauugagacgaaguaucucacugacccuggagcugggcuuucagccagcaagcuccagggauuuccccucacauacacacacauaacuagcacuggaguuauacacacaaggccacugugccuagcuucuuauguaggugcaagagacuuccacccagcaccucauacuucccacugagccaucuccccagcccaccuuacuuuuuuauacuguaccucugacugacacccagggcuuaccaguccagguagacugacaggccagcaacacccagggauccagucacuguguccccaaugauuagaaagugugacaccauguccagcauuuugcauggcugcugggguuguggucagucaggccaucaugcuuaugcaguaagcaugcugcauacagaacuauugucugagcagcauggcaagauaauaguauugugacaagaggcaggaugcuacaaccugcaagaaucuacccauagaaacuauagccagugcuuguagacauggagacagugcauuagugugucgagaggaaaggcacugcucuuucugcuuacaguaccccccaguucacacacugguugcacagugcuuagcauagcugugcuccagaguaucccaccccaacauugaucuccaucccccauggcugccaaagaauggcuucagaucagaagcagagacugaucuugguuuauaaacacugcucuucaaagcucugaucacugauuuuguuuugcugauuuuuuuccuucuucuauaaucccuguaguucuaaagcaaaaacaaaaagaauaaucaugaguugauuugccuuuuuaagaacaaaagaaaaaccagagccuguuuuguuaggaagaacccccucuugggcuucucucugugggggucuuaaauucacagccaaagagaaaagcacauaugugucugugcagcguguguaagcaaugugucuaugugugccugcacacccaugcuccaggaccaggagaggccagaagacauguuguaagcagcacagcaaggacaugccuaccucaucuucaguccccagcuucaagugucccuuuuaucuguuuccacccccacauacacuucucucucuucccccaaagcaccuugagcucuccucaacaacagcaaccucucccucuuaccuccugguaauggucugcugugauuccuccuuguaacauauuucugucuggcuauaagcugcccacccuugagaauccagagcagcaaggaaggcagugcaagcaaguggcuagccaaugaucugggcaaacuccuggagcguagccauguuuuucccauuuagcagcugugugaccuugaccuugagcaaaucccaagacccucaucugaaaaacaaacuaacucaaaggucaacauaagauuuaaacaggacacgaauagugaggguuuaacucuuuccucugccuguugcaacaaugcuagcuauuauaugcuuggugaguuguccauuuuauuuuuaaugaacaacaaaaaccaauucuuaagaauauaacaguggacucugaccauguagcugcauauugauuuuaucuagaaguaauaaauaauaucacucucuugucucucuagaaacauacaaauagagaaaacacaacacguauugaauucuuugagcaguaacuucuuccuccucuaggaagauaaacacuuccacgucccugugcacaaccauaaagguuucugcaaaacaggcaagcagucccauuaacagagaaucgugacugcuauucucuuccagagacccuugcaacccaccaaaaauguuuaggguaaggaccugaaaguauuuccuuggucugucccaguaucuguccacacacucauguuccuaggucucucuuccaaucaugaggucuaaaguauaguugucaccucuuuucucaaacuucagaacagucucuacucuaaacugcccauauuucccaaucaggcacccucuaaacuccucagccccauuucaaucaagauagacuugaagccacacuuaccaagguuauuucuauuccaaaguucuugcccccaaacccaccaacuaccuccuaauugagcauaagccuaaugcauauuaaauaaccaaugcaaguuuguagaaugaggacuaaguguuagaugguagacaauugccaauaacagaaggcauucauuauagaauuugagaagcaagguuuuauauggauagcaagcacuuuaaggguuuuuaucaagcccaugcauuuagcuacuggaaguucuuuuuuauuauuauugagucuaauuggaaggaaagcauuguugcauagguaucucuaacucuugcauguguguguguguguguguguguguguguguguguguguguguguucacaccugugguacaugugugaaagaugucugaaagaugcaggugcauguguguuugugcuuauagaggcuguaugucuuccucuaucauauuuuaucuuauauauugaggcaagaucucacacuaaaacccagagcuugccaauucagugggucuagcuaccugaugcucauggaaggggaagagaucucuuuccucagcuuccugagaacuugaguuacagacaggucauugugucuaaccagcuuguauguggauacuggacaucuaaacucagaccuucauauuugugcaguuagucuuuuaguguuaugccauaucuccagccccucuccagcuuuuuaauagguaugacucugguguuuugugcuuagcuaucuguuguagggcucaggacuugaggaccccauagcagaaagcuacacacugaaguaacaaacaccuaggaagcucuuuaguagaaaaauaucaugcccacugcuccuggaauuccaucacgauugugacauugcuacagaugaugccugguggcuuuccuacuauguguuaccaaacacauggcccugaguaagucauggaugaggccacggguucugcagcauauaagacaguguagauauuacugucauugucuagaugagaaaacugagaucugaagaagaaagcuuuguuuauaagacacagauugugaaauguagcauaaccuacaucagccagcaagguuuccaguuagaacaagucagugaauugaauaagcagagaaaaauauuccaaggcagaguucauguacaucaguaggaucuacucucagcuagacucaucuagaucucuccugaggagugucuuaagguucaggguagacuguguaggaaaaggucgcauaaggaagaaacuagagaggacaauugcaccuagugaauucucugcaugccagagucuauacuaaggguuuuacauccauuaucucuacuaauccucaaaacauuccuguggguaccacuuucaccauuggaaggguguagcaacugaagcucacugaagggaagagacuugucccaggcugcccaaccucucagugguguuugaacaauuaagaucuuguagguuccucagacucuguggcuugaaaaagaaaagauuugccacguacagggagaauaaaaagaaaaagaaaaaaaaaggagugguagccgcagagaucuggguaguuucugggucacaggaaaaaaaaaacuguaggagcagauguguuagaugagagaaaaagacagaaauggguauggaaaaaauucucuccgaaaaccucuacguguuuccaagcuuaaugaccaaaacgggcugaagcagggaaguagugaggaagcaggcucccuugagacuggaaauuguuuccugaguuagcauggucagcugaagcaggcagaauccuaagccaaaaaacacacagagagaagccaaaggaauccagauuuggggaggagaagggaagacagcagccgggccccucuagucaugggcugcuucuugccaguggacccagugucccugguguagguuuaguuaugaccugaccuugcuucuuggcuuuggaucuccuugaagauacaugagugggcagucaaaauuagcuuccaaugagcuuaauuuccggaugccaggcugcccagugcagugauccagaaaggucccaucagaauaauguuaguuggagaagggaggcuuacuuuggucguuuguauaaugacuacaaccgaauuuucaucucaugcguguuuauaugagaaaugagcucuauaagaaagaaccaugcacuuuuauaucuuaccauuaaaaaagaaacguaaaacaaacaucuggaaaaaaugccaaaaauuaaaucaaaauaaguuauucagaucugugaagucacucuccucuccucuguggaaacuggccaaugugcuaacauccaucuugcgugaagccaauugaccaugaagcccacagucaccuggucuacguggucacuguaucugcugugaguuuucuuucaugucacaguguaaccauguaucaugcauucucuauuccugaggcuccguucagucaucaacucuagauacuaaaggcuccugggcaaggaauccaggggaaaaagcuauugauggacaacauagguaauguuucaggguuucuguuuuguuuucuccuuaacagccauggguucuccgaaggaaaucauguucucagacaucacugaaaaugcagccacagucagcuggagggcaccuacugcucagguggagaguuuccggaucacuuauguaccuaugacaggagguagggaaccuggagguggaagacgguggggagaacaugcaacauuaggguuaaauggcaaaugagacccuggguguucuuaucagacuuucuucaagcauuauggcuaaugaaaaucacuucccuccuucugagaucaucuagaaagaugcccuuuguaaagacauuuuggaaacuuggaaaaagucaccuuauuaacacucucugugaccuugauauuguaaaauauuuucaaggaaaugguucccuaguacuuuugaacacaaacacaagggaauuuauauaaacaaucuuuuuuuuuccccuuugaucacagucaucuggaaagcugagauaugugugagguuuuacccuuagggaccauauccuaucucacuacaggauagagaacugagucuuagcaauguuagaacuuggaacacauagacuuuaaugaagaccucagggaaguauaguucgaacacagccuagcagguagugagcugccucuuguuggagguuugaaaagacaggcugguugguaacggcaacacuguagcaucuccauuugggcguuuggccagcuggauugcaaauccuucacucuuccugaaauucuaagaaauauaaauuccagacuuccuaauaaauuuaagagcacacauuuaacugggaccaucuuuuuuaucaugacuaaaaucucuccaaguaagggggucuauagcaucuuaagucaacccaaugaguuacauagcuuggaucuaugcuacauugugagcuucccauauagugcauggagggacaagaauaaggaaaauaaaauuugugcaacaugccaacuccuucccgaaaggaaacuugccauuuuuaguauacugugacuucaugauuuuuuccuuuccugacuggguuuuuggcaucugcaccaauggaaaaaaacauuauacaaaaaguaaggucuuguccuucaugccagagggugggaugagaggagaggaacuccagagaaugaaauugaauaaagauauaauuuaauuuccaaguugcauccacccgguuuggaggcuaugacaaggaaguguggaagaggcuccccugaucuugcuuucgcuaaucuccaggugccccguccauggugacuguggauggaacagauacugagaccaggcuggugaagcuuaccccggguguagaguaccgcgucagugugauugccaugaagggauucgaagaaagcgauccagucucggggacucuaaucacagguguguguucccccaucauguuccauccuugcucuuggcauguugacucgugacugagaacagcacaaaugcuugcuccuggagucccagugggaagugagcuggaauuagagcauccagcaccucccucuggcucauccuuagccucuaauaaacuggguugccccagagacauccugaaugcccucuggccuccauuuccucugcuacuguggaaaggagugaaguauaggaaccauacugagcugagacccuaaauguguuagccacgugaguugucaguuaauuucucuggggucugaugaacuucucuguaaaguggguaugacucugcuucccuugucaguguugcaaggggucaguaagcauaaagacaacuuucccugucaccucacuccuucccccuguugccuggaaucauugugaucaccucccgggacaugugcuucugcagauaugggauggggaggacuguggccacgcuguccccuguuuagcaaggguugaccugaugcacuguguccucacugccguagucauuccaagcuuguaggagaggcaccugagacaugaggagauuacaaaacaacaggacuggaaauguggaagaaaacaagggucauucagacuaacccucucaaccauuuaaaauaaagguuguuuuccuguuaaaaucuaauuuaagaauaauggcugcuauugugggagaaugaaguggaaauuuucccuucagaagucucugucucuagacaauuuauccuuugagauaugacaaauuguccaacccaguccauucagugauccgaagaauaggccucccaggaaauuucaaaaauauacuacuuccauacaagaauugguaauguacaauuaaaacagccuaucuggacgcaaaguccugucuccucuccucuugggcuucaguuuucccuaagaaaucuugcauugaugauucuccacagccacagaaacaaaagcugggugugucuccucccaaggccacauugucacuagcaguuaaagaaaggucuguacacacaugagagaaucagggggacacugugaggugaauuauauugacucugacacugguuugucacuuccugacucuucagccaguucccuaaggcucggguaccagucugugagcugggcugcugucuccuaggcuguugagggaguaauuaaauuaucguuagaaaaaauaagagagagaucccgccuucccaucaacuuucaaggaagaaacucugaacaaggaacauacuccuuugaaagaagccagagauuaagaccccuggaauauccucugacaauauaagucauuugaaaguaacgcccaagggccagagcaguggcuuaucguuuuuacuuuccuuguuucuuucucuuuuuuguuuuuguaagauuuauuuauuuauuuauuuauuuauuuauuuauuuauuuaauauaugugaguacacugucagugucuucagacacaccagaagagggcaucggaucccaauacagaugguuaugagccaccaugugguugcugggaauugaacucagguccucuggaagagcagucagugcucuuaaccgcugagccaucucuccagcccauggcuuaucuuuuaagagcauacucugcucuuauuugaguccucgaauuuaauuccuaguauccauaaccgaagccuugaacaguuacacuuacaugcacauaccccauacagauaaauacauaccuguugucuuauccauauuugucauuguugucugauauaaucuuacuauguggcucuggguggacacaaacucaugauccuccugccucgggaccccaaggauugaaauaaaaaagacuaaaaaguuuuacaaaguauagcauuaauaacaaaugcugagagcuuccauguuauauaggcacacuucagugaaguggccuuuccaaagacauggagacacaggaaaauaagccacaauagaaucugacccuagagaccuccagguuauuaccuauaagauccccuaaauaaagauaucacccaaagcccagaaaagccucaggcaguagugaccauacaggucuccucuauguauguuuauuuauguuccuuuccuggaaaaaaggaacaugaauccugacaauaaccuuugucacacauuaaacauuguucaggaacugccuaccuguaacaucacauauaagucaaaaagaaaaagccagccaggauuaucaugcccauuuuacauaugaggaaauagagaccaaaacuaauacaacaguaaggaaaagagucaugauauaagucagguuagccuguucaaaggggccugacucugagcccaucuaagcacauguccucugauguuauccucuaacauuuugaagucuucuccuuuauuucuuuccagcucuggaugguccaucuggucuucugauagccaacaucacagacucagaagccuuggccauguggcagccagccauugccacuguggacaguuaugucaucuccuacacaggggagagagguaagguccugucccaccuucucuacacucugaugaggguucaucuuaccgcagacuccucccauuccccuuccaauguaccaugggaugagaaaacucagugguacgcuguaagagccagucaugucuuugccuaccuccacuguauccucgaaagacuugggcaagccauucaagugaaaagagaaagaaaaagaaggcgagucuggagcuuugcacguuuugcugacccaucccaccuugcuagacucuugaguuacuuuucucauugcuaugaccaaauaccugacaacuaguuuaagggguagcagguuuacucuggauucuaauucaagaagguaacucccaaaugucaagaaagugcucgcagcaguaacaggaagcugcuggucccaagguauccaaaguccggaagcaggaaauggggcccucuauaaagccuuagagccuaccucagguggcucacuuccuuaagcaggcuccaccuccucacuaaaccaaaaccuucucaagcaaggcuaccaacuaggaacaaaguuuucaaacccaugagccuguggggacauuucauauucaaagcaccucagggagggacagacucucaaggaagcagcucuuauucuuuacaaagaagguuuccagagucucaggucuuaaccaaauggcaucaugauguccuggggugccuagccuucucagaggccaugggagggccuaacugaagccaauuugacugaaagaaucugcuuuucccaucugccaccaucuguaccaacucacccagcaggcaaauuaaacucuugcugagaccaucaaccaaacacaaccaccaggaaguaaaucaaaugcaaucaaaugcaaaucaaauaaggaaaagagccgcuuucuucugauuccauucauauguuuaugaugaucuagucuagaaagaccucuguuauuucauuuucuaauuuucauauuuuauggcucaagacugcuuggcuuucacuggcaguauuacaggacaccauaacccauggggggggggccuuuuuuuuuuaaaucuucauucagcucuggcaaaacccugaguuuccugggaaaagagaaaagaugaggcaggaggagaaaauucaguucauccauucuccucuuuguuauucccuguaaggaaauucuccugagacagggagagaaugguguccccucccccugaacuuauggcuggagggaauggugaaaauuuuagaucaggacuaaucaagaccuagccaaagagguccagaacucugaccuucuuugcugugggggucacugaaagguugugucuuagaaggagguauaugugcuguuugccaagggguaacugccacacguguguguuucauacuuagugccagaaguuacacgcacagugucuggaaauacaguggaguacgagcugcaugaccuggagccugccacagaguacauccugaguaucuuugcagagaaaggacagcagaagagcucuaccaucgccaccaaguuuaccacagguaccaagacagccagagugcaaguucuccuuucugaguugcccacccacagccugcaucuuaaaccacauccccuccccugcucuuccucccuaagucaggcccuugcaguauaaugacaucaguaugaguaaaauuuaccagugcccacucaaucaagacccaaagaagcauaccauuuccccuugaacugaaaugacccaacagaugagaaaaggauauuuaagggaagcuuuuguaaguggaaaaacacuaccuacuggcucuaaacccagcauuuaaugauccaugcuccaggcugggaaauaguuuuuaagaaguuuucaggguaguuuccuuagauguucauugggguuuuauguauugagaucuuuuuacaaagcucaacauuuggagaaguaaaggacugucccuucuguuggggugagggccaauauuagcacuccucagcccugucggugagaaauaauggaucuguaaugauuuucaacccaaauccaacccaaaccacccaggaauauguugggcuuuuagacccuugaggugauaggacucauauaaccuuugacuuugguucaaguuccucaucgauagucaggugggauucuuguccaaggccaugguuaauguuauugaacaaacuugaggccaguucucuucuugcugucuguucuacaccuucuagcucauuugauacauauucucuucuccagaccucgauuccccaagagaauuuacagcuacagagguucagucagaaacugcccuccuuaccuggagaccuccccgagcaucggucacuggauaccuccuggucuaugaaucuguggaugguacagucaagguaucuauaaaucacacauugcuggguaaaacauuugaugugcauaaucaucaaaguagcaaaggauucgcugauacuguuucuucacuccaauacaacuaaacaccuaaaacaaacaaaaaacuaguagagacuggauauagaaccagaccuugugagucacaaaccacaugcucacuaaucuuucuuccuuuaaccaggcucaagcuaucugagcaacagccaagaucaacggcagugcuuuauaagacuuaacauuuuaagaguugggcucauggccaucuaauguuucauugagaaaguaccaacagccuuuucugcaucuuugccacguagugucaccaccugacugacugugaucuaucucaacacauccuugcaaugucacuuguuaagaccagcuacuucuauugcuaauauuaccuguguucuccccuccaugaacuuuacuguauuucuaagcuagguuacuuauucucuucauacuuagcuauaugcagcaucuccccuauauuuuuuauuagauauuuucuucauuuacauuucaaaugcuaucccaaaaguccccuauacccuccccccaccaugcuccccuacccacucacucccacuucuuggcccuggcguuccccuguacuggggcauauagacaagggaucucgccuauauucuguguagcuacuucacuuuugcucagaaauacaugucacugcuauuguagucuauagcucgggaauuauguuucuucuagaucacauuaguuuuguugcugugguuuggguuaguuuccacuguccaugcuagaaacuucuucccagugucuuuuaguccuggcuuauccuuucauacuuaugccaagaacaaagaaucugauuagaagcucagcugaacauaaggguuuguugacacugggguucaauguagagaucagcugcuguguaccuggaaauuugugggggaaccccauagugcuuaggcucuuauucuaugcaagcuuugcuugcucuuacacuuccaguguaguaucuugaccuccucaccagcugauccugguggauuugaauucagagccuccacuguaaugcagauugcucuguuccuugaggggacaaggagaauggggaaucaagcuauuccucgugcaaagcuucuaaacugacugaaccucucuugagucacacacuacauugccugcaaaggcagcuaugcuguuauacacaugcaucagaaacucgcugagugcuuccuuguaugucagccagccugggguaguucugcccacuccaggugguuccuagcacuuucugcucuggcacugcaggaauuguucccucuacuauacaccuucugcccagcaagguacauaggagcuaccuguuucuaucucuuccucccucccauucacuuuuguaguuucauuucuucugguccacuccuguuuuauaagauaugaaaaacacauagagaaauauugguauuucugaucugccauguuuaaccacaaguagacacauuucuagcuuuucuggaguugagacagaacucauaguaugaacugaagcugguccuuuauugucauggugucagugcccauaccuuuaagauacgagcauugcacuucuagaccccaaaagucuucugcagguuugagguucuaggauugugcuucccugguucauaaaccucauuucagacuauccagacuuagacaaaugaacacagaagcagagagcugauugccagucuaggcucaggcaauucaauaaaccuugcuuuguucccugagaguugauccuuccccagaaaccagagcugauggcaccacaaaggucacuaggucacuggcauugagugaacacacauaaaucauggauaagguggugggagacuaggaggacgugacacuguccucugccaucaacaaauuauggauugggagcaaguaucuuagcuucugggaaauucaauucccacacuguaaaaacauacauaacauacccucacuccaggaagucccuaggaagggaaauaaccuuccaguggccuccacucugaccuguuauugacuaaacccaaugaacuuggugaguucuagagaucagaauuguguuugccgugauggaggaggaauuccagucucaaacaccaaggccaucuauuaauaagaacuggagcccaguauggaucugaggcaauguggaucuuguagaaacugagcccaaacacuagucuagaacccagggacgagccauaagcauaguagggcucacacaucuguuccucccgggucagcucaagucuuuauccugccccacgcacuaggcuauuaacgucaucuugcaacucaagaguuccucgaccugaguuuuaguuucccuagagauacgucugccuccccaccuucugaaaauucagugagucuacacugaggcccagguuaucagacuguuuaaauguugugauaaaggcuaagcccccuuucagaacugcugacacaaauggucucagugucucuugccccuugugcaauucaccuuaccaucagcuuaagcuucuuaagccucaacagcuuaauccuguucaaaaccucucagaccucccaacuccuuguuguugauaaacgccaagccagucaagccaaagugcguaacaucccauuaaugguguccuguaaucccucuuugcccauuucuauuacccacccccaccuaaaauuaaguagaacuaaugcaaagcagugcuucuguguuauuuaaccccccugccuuucucaucccagagcuuuuacuuaugcagcacucuugcuaucucagacauuccagagguacacuuggaaucuggcaugcaguaggugcugggugggguuuuauguuaagugaauaaaugauugcauuagccagugagaggaagcaucuuugccgugagacuaucugggaccaaacugauucuuuugccugcccacaggaagucauuguggggccugacaccaccuccuacagccuggcagaccugagcccauccacccacuacucagcaaggauccaggcauugagugggucccugaggagcaagcugauccaaaccaucuucacaacaaguaagggguucagagaggaacacagucuuaagaucugaccuugugacagcuaaucaaccuuccacuuccccuucaacuucuaguuuacauuuucaaacaaaaaucugaaacguaucaauucccuauuagugcuuagaagccuggggaauguagauguaggcauccuagugaaaugaguagaggaccaaugagagcucaucuacauccaauccucacccccauguccuacuggauacagauuagaagacaccuauauuccaugagccuuacuuucuucaucuuugcaaagugauauaaaaaaaaacaaaacaaaccaaaagacuccccuccuucacaaguaucucaugggagaaguugagguaucauauuugaauuccuagcuuaucuguggcucuuauacuguuaaguuuaauauaagcucugucaugaggaacacagagaagcaggggcugccugcuuguaggaaccuagucacugcauagaugaacugaaguguguuuggacaguagccaccuccucccuccacucucacacucuuucucuuuauccugcaguuggacuccuguacccauuccccagggacugcucucaagcaauguugaauggugauacuaccucuggccucuacaccaucuauauaaauggugacaagacucaagcacuggaagucuacugugauaugaccucugauggagguggauggauugugaguacaacaguggguuuuagaguucugggacaugggcuuggaugaagggaaguguguacucucaaauacaugugcauaagacuuugcaagguaauccuugucacauggaagcccuucacaauuaucuauuuaaauaaaaaauagaaggcaaggacuggauauguaguucaguuaguagagcgcuugcuuagaaugaagaagguuuugaguucaaaccccagcacugcagaaaaacaagaacaaaguugcuaacugucuacuugcacucagaagguagaggcagaaggaucaggaauucuaggucauccuaaaauaucaguuuugagccauucuggacuaacagaaugagguggcaggaggaacucugcuaugaauggcagugacaaucaaaacuacuaguuacuauaaccaguguuggcuaaguaguuacucuuuaccagacuucugauaagaaugucagggcuuauuucaaucccaugaccauauugacuguauaggauuuucuuuuaucaauaaaacguguuuguaggucacacccccaaccucuccuccacuuucagcuucagugugaugcuucaugaagacugagaggcuaagauccaacgaugucaccagcacuaagaagcguuguccauuccuaguuuucugaacaccuagacguagggaggggagggacauuaugugcccaaagucacaaggcaaauaacuaagcaauggagaaagcuggauauggaugacuguucuucccucagucuggcaugccuccuuccaaaaagacaucuucucuucucuuccuuucuuuuacuuaaguauccauguuguuguagguuuuccugagacgcaaaaauggacgugaggacuucuaucgcaacuggaaggccuaugcugcuggguuuggagaccgcagagaagaauuuuggcuugguaaugcagcucugaaaguuugugacagauaugccuauuucuguccucuuggucacuuacccuccugucgugagcaacagggagaggaaaggaucaaaaggaaagaaguuugguaggagccacauaguguugaauuaauuaaauauuccaggucacaaaaauaaagcauuaucaagccagaccuguggacaaaccuugcauuaagucagacacuaaaaccaauuauggagccaaccucagugcugucgugaacugcuuuccucuuaagcucaaacacugagaugggucuccugguuguaaucuuucaccuagaacaucccugcaaagagcagaauucccaucuuacucaugagaaaacagacccucaaggacguuguaugguuugucuauggcaaucuagccaauugacaaauacacuguccuucaaauuuucccaaacuaguauaacagggccaucauucaucauggacacuuugcagcaaaccacauggacaaagcauuguuaucugcuccacuguccgagccuaagacaccccaucccaaaguuauccuuugcuucacauugguuauaaauuuuagaguguacaagucacgucccuggauuaucaccuuugaccuucacaauacaauaggaagcugauaagcaaagguguugaacuguuuucuucugaggcucagaaacaugagauuuguuuugucugccuucauaccagcaaacagagaauguuucaagcccaaguuuucaggauaugucccacuguugagugguagggaccuccucagucaccugugauugcuuaccagacauugcccgucauccacaggacuggauaaccugagcaaaaucacagcccaagggcaguaugagcuccggguggaccuacaagaccauggggagucugccuaugcuguguacgacagauucaguguuggagaugccaagagucgcuacaagcugaagguagaaggauacaguggaacagcagguaugggguagcuacacugugagucuggagucaugaaauuccuauggauucacgcauucaccacuccugguucugaaucaacagauauuugaaugucuucuggaugcugaucuagaagaacuaucauuaaaaaggucuaggccaacaucugcaacaucuggucucugagagguagaguaggucaagaaucuugucaacuaugguugaauuauaaugacucucauuaaaagaauauguuucuuauucucuuguaguuagugguuguagaguggugauaggaaaauggucuuucaaaggccuccaucuucaccagaagcuuccuuguaauggguaucugaugucucugagaaucugcugaugugugaauucugauauauugggaugucauggggagacguuaagaugaguuucuccuaaguucccuggugaugccuacauuccuagcauuguuagucuuuugacugccaagcaaccuuuuguucuucaccuaaauuauaacccuaaugggcuagguuaugauuaccugauacccaggcuaucugacaauauuuaguggucugaggucuuacuuaugacuguagccagauaccuuuguauauaagagacaugccaauuuauacuauuugggggagaauagagguuuuugucuuugacuuaaagugacccuuguacagcuuucuggcuccacauuaaaggagaaacuaauaacagagcuaugagauggcauccuucucuguagguauuuucaacuacugaacccucacaaacgucuuuuaggaaaaugauauaaagaggagaaaaguggcuuggaaaaauucaggaaauuucagcucacagaaggaguaugugaguguguguguguguguguguguguguguguguguguguguguguguguguacacaugcgcacccagccaugugugccuagagaacaguguaaacaaagaggggcugggucaagaaugcagaccaucuuguguaagccagggccucuuuggguggccuuauuuuaugauuauuuaaacaggagacagauuugugaccccucugggagccccuccagaaaggaaaaaaucuucaccuuugacuaauaggugccagagccagguugcaguaagaaggacacagagccccuuugagaggcaguuuggugugauggaagagagaaagccagggcuggaaauuauuuuaacacuuacaugccucaaaaaaaaaaaaaaucugacacuuuaucaccuaacaauaaauaccucuuuggcugagaucaugucaagaaggaucuuguuacuuggaaagaaaauccaccaaccaacaagaauaugacuuacguucucucuguaucucugguggaggagagcacuugguuuuucccuucacucagagccauguuuucagguuguagcuuccagcaugcuuuggugauagcgccucacaggaaagcuucaucaauaucugcuugcucuccugcaacucauggguaucaucauuaguuaaaaagacucugaaagagcuuugacagcuugcuccaagaucucagcaucaaauaccuggaugucuuagaaugcuugcacacagcccuauggcuugggaguaagaaggacucagauaauauucucaaguagcacucuaugaaaaagcagguucuuagguaagaaucagacaacaccagccugguacacacucuuuuaaaaaugauuacaagaaacccaggcuaccugacaacauuuagagagugaaggucuuaauuaugauuguagccagacaccuuuguauaugagggaccugcccucuguuauuauuuuugcuuuguuuguaaguuuauggggucccauuaugaagccuacguuggccucaaacauaugcacuuccugccuuagcccaucccaccgcaugcugggauuacagauguccaccaccaugccugacacacacaucauuauuaaaugcaaauuucucacccuguccucauaggucuuuuaugcaaagcaaauauagacaaaucauaaacaacaacccuggcucuuuguaugccacuucucccuguccagaaaaacguucuggacaguauauuagaacagcgcugugagcuagacagaauccacuggaugucugcauuuuuuuagaugagaaaaagaaagcuuagaggaagcucagccugugacaggucacaauuagaaagacagagagauggacuucaauggaacuuuccagaaccaccugcagccuucuuucuuaacuuauaacagugcuucugucagagauaagucuugggggugacauucaugucucaugcuuugauccucaguccgguuugagguucagugccaguguacccaaggaucuuucaguccccgccuuugauucugcccuugacaaccuucggagacuuugauuuggggggagucuuuauucucucuuaucuuucucccuuuuauucucaauaaggugacuccaugaacuaucacaaugguagauccuucuccaccuaugacaaggacacagacucagccaucaccaacugugcccuguccuacaaaggagcuuucugguauaagaacugucaucgugucaaccugaugggcagauauggggacaauaaccacagucaggugaguagucugacaagguuggagaagcaagaugugggugagggaaggacacuucaauuagaaaauguguuaucuuccaacacagugagaaaucucaauggcauggcagcugagugagcgaagaggaaaaacaguacaaauuaacucuuagaucccaaggagaaacacuguccaaauagcucacaaauuuagaacuuuccacacagauaaaauuacugauagaacucugugaagcugaucaaaguggaugcuauucaggggagacagggaugauauaaacccuggcagagcacaggcccacaagcaucuucauagucccaagaaggaccugggcagaaggcaugaacugcaaauccccuugacucaaacccugugagagcugaccuuccugagguugcagaaugauuuuggaagccagcuaugaaguuugcuucuucuucucaccuuuaugugggcucucaggucuccuggcuugagaggugaacuccuuucccuguugagcuguccacucagcucucacauggaagcacugauaugcaauccuaacccugcaugucaaguucaaagcuuauauccuaccugcacucuuuuuugcuguucuaugccaaacccuuaauaaaaugcccccaugggaaucuugugaauucacacacacacacacacacacacacacacacacacacacacacacacacacaguacccagcuucucauuauguugugcucauaaaaagauaauaaaaagguauuaccauaugcucuaugaggggggggggguaugggggaaggggaugccuugaugggcccaugccaaggcaucccuuccccugagggaccagccacacagugguauaguauagaauagaguuuauucaggguauggggaggggaguuaaaaggguauuagaggcagagagagggagagaauaagaaaguagaggcccgacaugaccauguggagagaggggagaagggaauggggagagaaggagcaagaggcaagggagagaagcaggaguaagagagaaaggagggggcaagcagcuccuuuuauagugggccaggccuaccuggcuguugccagguaacugugggaggagcaugccuggacauuuccagguagcuauaaaaguggaguuuagacaaaauaccaacaaaugucgggcacuauuuuauuucaagauggcugcccaaggcucuaugcaaauagcaaugauuccuaacgauggguaaagaguuuagauucagcuggcccauuugaaaguuuucacagcacuggccaucaagagacauucaagacacagcugccugcaaaaugccaagugguuauaagcuaaaaaaaaaaaaacccuuuguguuuugaugacuaaauggugauggcccaugaacauguguccaaauggaacuaacccaggggucucuguuuuuuuuuuuuuucugcagggcguuaacugguuccauuggaagggccaugaguacucaauccaguuugcugagaugaaacugagacccagcaacuuccgaaaucuggaaggcaggcguaagcgggcauaaauuccagggauaauuuggugagagaggaauggggcccagagaaaagaaaggauuuuuaccaaagcaucaacacaaccagucuaacagugaagcucuccuugggcauuugaugggcguccaagcagaccacacggaucacugaggcacugauguaggccccucugcaacgacuuccuuugcaccaaagacaacagucuacaaguuucuacuuucuuguuugauugagcaaagucuccuagugacagcaacaccaugaauuuuacuucucuugggugguucugggaaugggagaggggcaagcuggccauacaggggacauggucauucuccgagccagcuguguuuuacacaaagcuguacaauuguuauugguugaggucacaaagaugaaacuugugucauuggaaguuaccccuugccccacccccacccucgauguuuuguacauuuccuacaacugaagccagaaaagugauauuguuuaaauuucaaggacauuaauauuauuaauauaauaauggugauggugaugaugaaaacugaggacuuuaaaagagauuuucccuucccaaacgugucuggacaguaccugauuguauuuuuuuuguuuuguuuuguuuuuuaauaaaagcacaguacuuuucaguuc

SEQ ID NO: 12087 - RNA, 11222 nt, Mus musculus
gcgggcgggugggcuggcagcgguggacucgcgucggagcugcgggcggucagguagggggcgggaaggagggucugcgaccagggacuguggugggucgcggggauccaagauugaauggcaggauuuggggacuggaucggaguggcaggaucggauucggaagggacgggcucaggagcgauucggcggagaugagaugcagcugggggaggggagcaaaggggcugaggaaauuugcaguugcagcaugucgggagguaugagguaaugugggggccaugcggagagacggggugcagcaugugggagaugggaggaucugacgucccuggagguaucugggugcagaauaucagaaagcauaaaggaauuuggcaggccuggaugagguuggguguuggcgggcagaaucuuaggggcuuugaggagaucgguguaaugauagcaagaucugagaucaaaacagccaaggucuuggaagauccuaauugcugaagagaaagggauuucuguagcggaaucugggaaagacugaggggugaguucccgagggaaucaguacccaguuagaaaaucgcagcaaagguuugaaggcaacacgugaggcaggacgggggcggagguggggggcggggguuggagguggcccaguacaagauggggaugaugggcagaugagcgaucagauugaaggagggcagaaaucugagguacaggauuggaguuuggagauggcauacaggggugauagaugugggaauuugaaaauagauuaaaggauguauuggagggaugagggacacauaagagcuauuggugaauugcaaggcugcagcauacagucuaaaagguugaaugauagauuugggauuuagcguugagaaugagguuuguggagaaugaaugguggggagugaaugcuguaacuagauuauagaauucaaaaccaaaugaaauuugugaguagguucuuaggagguuuuuguuuguuuuuguuuuuguuuuggucuuggcauaacugaacccagagggucuucuggagacccagggaccugaaaguaauuuauaaauaaacuauguauaaaugaauggaauuuaggagaauguaaggguuugggaauaaagacaccagucuucagaaauccugaaggagaguuugacauucuuugaagggcagauucuuccucacuuacuaacuaaaggcccuuuaauccugaggcaggcauguauucugacuauacccacucugaccacccccaccuccucaucacagacccgauauuauaggccuuggggaagaagcagugaacuaccuaagggcuucugcuaccuagccuuuucccuguccaagguaugagccaaaaugaucuucaaccuaauauuaucuuauaggagguccauuauagcucacagagacaaugguucugggugagaaacaaaacaagguuggaacaaggcggagccuccugucuacugaguauuuagccugugccauuaccuaaagccaggguucucagacagggugcuuuuguucugccaggaaacauuugaccgugucuggauggaggcauugucaguugucauaguugagggguuguguguguguggggggggggauacuuggggggggggauacugguuucuagugaacaaccccuacaauaaacuaucauuuagcuagaaauggcagucaugccaaaauggguccuggcaucagagucaagaaugcucugguuagauccuggcauuauuuauuuauuuauuuguuuauuuauuuauuuauuuauuuuucucuuucugcuuuguaaccuuuaaagagucaauugaccucucagugcacaagcucuucagggaccuacgucauagaauggcugugaggacucaguguacuaaaucagggugcuuacuguuuggugcccaguaaaagugcucagaauuuacuacuuuugaaaauaugugugcuuucuucucaugauauuccuucuaaauauacauucacuguucaguguuacccacgaaacuaaggcuuaggaggucacuugucuaaagccacauuccugccauguagcuccccgccacauccucucuuccauugcugguuugcugcggucggcuuggucuucccuuugcagccucuccuaaggaaagggaggcuugccccguagucagaagcugggugacuucucuugauuaagagaagcccuggacuuuguucuugcuuugcucuuagaccagagccaauggggagauagugcaaggagcuuggagcuacacggcugagauaaggagggcucaggcucaagggcagugcuagacggaaggaaacugcucugaauguucuccuuugugcaucuugucucuggcacagaagggcagcauugucuuuaucaacuccaauccuagcuacgcuacagaaggcaguuuagagaacaaaauuagacuggagcugagggcagaacacuuagcugcgaugacaucaacucagaucgcuuaggaaaacaccugacggagguugaguuggccguggaaucggcuguuuuacugcuugcuugguggucaagcacuugccagccucugucugaaaacacagcgagcucggcugagugcugauuaaugugcauucucuccauaaggcccacaaucuaaauguuacuccugauucuacaaggcagaaagugaagagccacuuguuaaaugacauauccuggguuacagagcaaguggcuaauuugggcauauaaaucagaagucacaugcuggcaagccuccuagagugcacccuccuguaugcagaugguguuaccuuugggagacuucuuccauugugccuuucugauagaaagguauguuuuaaaagucauuccuggaugaauuuaccaaccucuaagccaacucuuaccugcagguaaaaguagucuuuuggucuguguuuucgagacaggguuucucuguguagcccuggcugcccuggacucaauucuuagaccaggcugcccuagaacucagaaauccaccugccucugccucccaagugcugggauucaaggcgugagccaccacugcccggcacaguagucuccgcuucuauaaaaguacauguuuugggugagcccuuuuguggcccaguucacagaugagcaacugggggacaacucuacuacauaccacggugggagaacaugaacagguuacuuguuucuuaaugauguuuaggauguggacuaacacuuccuucacacaguuaagagaagacaugcaguguguagaggguuccuggcacucguuacuccagauggccauuagaagacaugguuuuagcuaucagcaggcaccauaagugcccucaaucugaaguucacacuugucuccccagccagaacuagggugaauagucagucuguuagugaguggccuuuguggcaccgagucagguucacacuugguucgaauugaguuaaagugcauaaggaguaaaugcagcuugagugcuggccugaauaggggugauaagucucaacaacaucaaaacccuacaggccaugugagaagcagaguaauuguagaaugguucuucaugucaaguuuuuagaugauuuuuuuuuucacaucucuuucuaaacguugucuccaucuccauccaucguggcaggacuacacuagugguaauugcuuaggaaagaucugcuucguuaauugcuuaagguucgacagguuugcuuauggccuaaccccccccccccccaagaaacaaagaggggcgugggaaagcuugaggucaaauagcaaucuuccagaaggcccugaguuuagauuauuucaauguauggcugcugccuuaggcaucugccuuccgacaggagccuguucauuucauaucacaggcuggccaauggcuauggcaagcaguagcaauuguagucacuguuccugauaauuauaauaaaggcucuguacacaguuaguucugugccuaguuuggugcuguccaaagugcuuuuugcucaaucucuucuaaucucugcuagugagaaagcaucaccuugaaaggcuauuucauaccuaaguugagguguuaggaaaccuuucaaaucuccacuggaagugauagagcuggaaucuaaagccggaaugcccagguccugcaaguacuuucuuaguccuuguagcaccguuagcuuccaacccaugccccuuugccuuaggaugugggaguugcuaauuucccucucuuagucucgguuucuucaucaguguuacucugaggucauugcucacucuaccuuuccauacuuagucucugcuagaaggggcuccagcaguugauguguugauuggaagugauggguucauucacucauugcuucguggccugggugaccacauucucaacccaaucccucccaaguuaacuauuccuuuuaguaaucuuuacgugccuuugcuguccaggagaggacaauucuucauuccuuucaaaacuuggauuguaaaccgaauuauuuugcuaauaccaguacugguucugauucuuguuuuguuuugguuuuuguuuuggguuuuuuuuuuuuuuuuuuuuuuuuuuuuuuuuuuuuuuuugagacaggguuucucuguguaucccuggcuguccuggaacucacucuguagaccaggcuggccucgaacucagaaauccgccugccucugccucugcuucccaaaugcugggauuaaaggcgugagccacgacugcccugcucugguucugauucuugaugcucuugauugcuaacagaauuaaguuaaacagucauugccaucaacuaugaaaaagucauugcuugccuaccaauuauuagcuuaaguaucuacauucauuauccuuaguucucaugguaauuuucucucucucucucucucucucucucucucucucucucucuuucucucucucuuucuuucuuuuuucuuaacuaagaaaauagguaaagagaaauuaaagaauuugugaggccuagaaucucugaauagcuugccaggcauggaaaacuuaaguaacuugccaggccuggagagauuagguaauuugccauuugccccacauucuguaagugaaggcacaacaaugcugucuuguucugucucccuucaagguuuauguuaucugcuuacucuugguucuuucaacucccuggcuaccuauuucacagacuggacaaauucaguggugucaggagaggaugaggcugucuuagaucuaucugugagaacacaugcaacuuuaagagauacaguaucuggagucaaagaguugugcuggggucagggugggcuguacacugucaaucguguggagugggugagcgaaccagguaaauggagguuauguaaaauggaagggcaagacuugggaguacagccugaacaaugggaaauguguucaagggaauguggaggcagccaagguuguaaauggcguguugacuuuuccuucugcucgguuacugauuguucuagcuggcaggagaugggcagcagcacaucugaaggcuuggcauagggaggcaguuccuuucacugcaacagccuuuccagggaaguugaagucaaauugagcuucuguuugauucaaucuugauauuaaugggaguggucaggcaugccugucuggaggagcugggucugccagacuggugggucugucuuaggcuaagugaacgcuguguacugggaugguggugguaacagaaauaaguccaggcauuuuucagagcuacacuucuccaaagccagaaucuuuagugcauggauuuuugacaucuuuuuggagaaccugguaaaacuguagacuggagaaauaguuugccauuggaugugggcauaaucaauucauuucauaagcugauagcuuacacaggcaggaagccuuugaauugagagaagucuggggaaagaauuugcuaguauuuuuauaaauuggcagacuuguuuaacaagcuggucugcagugccagcuccaggaagaacagaugucccagcacaauguaagguaacaugcuugggacccaaacaccaaaugcugcugcccucagucuguucucacagaugacaggagacagaagaaagcuauugguuaggauugagugguucucgcagaucuugggucagggcuucuauugguguuuccgcggggcugccccacgcccacagcguuugagaauugaacauucacuguuguaauauccacaggagaccauuuaaaguucaugcugcccgguaauuuguuguuuugucaaggcauggauuugaguuguaaugguuguaaagccagaguguuggacuaggucacccagcuaauaaaaucgauucgcuccacucuguuggcugacucagcuagaugauuguucauucuuuuagggagaaaaguauguuuuaaaggcagugcguccuagagcagagucgagagcacucuuuaauaaauaacugaaagacauuuaaaaaaaaaaaaagaaaacuuggaaguaauguugggguaaaaauaagucaaaguacuauguuugaccgcugagaccuugagcucguuuuuucaaaacuucaaugcucucauugccaaagugggacaguaaaauucuuaccacguuuccacaaugaggauuaagcgagaauaagcaugcacaguauuguguaucacauaguagguacuaggauaccagagcaauuuucugccuauagagggacguccuagagguaaaugugaccccuucccuucacacacacacacacacacacacacacacacacacacacacacacacacacacacacauacacagaguccuuuucauccuuaagcauaccaguuccuugcugcuaagcgcuugcuugcccuagcauacccuucacaaagaaugucccacguuacuugcacaugaaagucacuuuguccuuaagcucucuaaucauccucaaaugguuagaucucugugcaucuccuagccccugcucuguuuuccuacaguuuucacauaaggcuaagagggaaccgaaguucacuaaggaccuuucuggugcagaugugauccuucgguaaacccaggaaaggauaugcugucuccauuuuacagaugcagaauuuuagauagaccaagcguccccuguucuucgucccaauugacagaacucugugcuugccaucugcuuucucggcuguauucaggcuaugcccuccgccuaguguuucguucucccgucucauuucugugcccuugcaggcugaaaugagugcuccagccucuccgaaauuccauuuuucuuuaaguaaaaaugagucuacuuuccuaucuaucagaaugggucugccuugauuccuaacuuacauacucgccuugcuaaagcagagcaggcuggguaugcugaaauguaaugucuugguucuuucugaugccuagacugcuauggguggcuagguuggaagaugaacaaaugaaaaauguguaacacgccccaccccccgccccccaucugaugguuugcagguugcuuaaaggcaaucaucagaauuuucucucugagugaaacaucagaggccaucaacugugauggaaugaaaaggcuuggaccccaaacuuacacaguguucuuugcguacaguuccuguaugugucaucgccucuaagauuuguaagacuucucuuacaaggagcaccauuuaugaguagccuuacccaguugucaggcuccaucccucuucccacuguaccucacaguguagaccuucaugugacauucucugaucggcaggguuauucucugcuuuccugcuuguaugucauauuauuuaacccuuccaguaaugguauaagauaggcaauuuaggcucuucccugaauuccuccauaacauaaugcauuaaucauuuguguguguguguguguguguguguguguguguguauguaaggggaggggggugggagagacacuauuuccuaagucauaaucacugcaauaaaaugcuuauaaauaaguaaaugauucaauggaugauuauagcuauucucuaaguguuucuagacugaaauaacuuauaugggaguagaaaaaugaauaaugguuuguuuuuucucuuuagcaggaaucugacacuggggcaugaauauuaagcuguguggcucuaagcuguguuagcaggaaccuucacuggaagagcaauggcugcggcugcagcagcuucucaccugaaccuggaugcccuccgggaagugcuagaaugucccaucugcauggaguccuucacugaagagcagcugcgacccaagcugcugcacuguggccauaccaucugccgccagugucuggagaagcuccuggccagcagcaucaauggcguccgcugccccuuuugcagcaagauuacucgcaucaccagccugacccagcugaccgacaaccugacggugcugaagaucauugacacagcugggcucagugaggccgucggccugcucaugugccgaggcuguggccggcggcugccucggcaguucugccgaagcuguggugugguguugugugaacccugccgggaggcagaucaccaacccccuggccacugcacacuuccggucaaggaggcagcugaggagcggcggagggacuucggggagaaguugacucgucuaagggaacuuacuggagagcugcagaggaggaaggcagccuuggagggcgucuccagggaucuucaggcaagguauaaggcuguucuucaagaauauggccaugaggaacgccgcauccaggaagagcuagcccgcucucggaaguucuucacaggcuccuuggcugagguugagaaguccaacagucaagugguagaggagcagagcuaccuacucaacauugcugaggugcaggccgugucucgcugugacuacuuucuagcgaagaucaagcaagcugauguagcccuccuggaggagacagcggaugaggaggagcccgagcucacugccagccuaccccgggagcuuacccugcaagauguggagcuccuuaagguaggacacguugguccucugcaaauuggccaggcuguuaagaagccccggacaguuaacauggaagauuccugggcaggggaggagggagcagcaucuucugccucagccucgguaaccuuuagagagauggacaugagcccugaggaaguagcucccagcccuagggcuucccccgcgaaacagcggaguucugaggcagcuuccgguauccagcagugucuguuucucaagaagaugggggcgaaaggcagcacucccggcauguucaaucuuccagucagucucuaugugaccagucagagugaggugcugguugccgaccggggcaacuaucguauccaaguguucaaccgcaaaggcuuuuugaaggagauccgccgcagccccagcggcauugauagcuucgugcuaagcuuccuuggagccgacuugcccaaucucacuccacuuucaguggccaugaacugccaugggcugauuggugucacugauagcuacgacaacucccuuaaagucuauaccauggauggccacuguguggccugucacaggagccagcugagcaaaccauggggcaucacagcccuaccaucuggccaguuuguggugacugacguggaaggcgggaagcucugguguuucacuguagaccgaggagcaggaguggucaaauacagcugccucugcagugcugugaggcccaaguuugucaccugugaugcugaaggcacagucuacuucacccaaggcuuggggcucaauguggaaaaccgacagaaugaacaccaccuggaggguggcuucuccaucgguucuguuggccccgaugggcagcugggccggcaaaucagccacuucuucucugagaaugaagauuuccgcugcaucgcuggcauguguguagaugcucggggcgaccucauuguggcagauagcagccgcaaggaaauucuccauuuucccaagggcgguggcuacagcguccuuauucgagagggccuuaccuguccagugggcaucgcccucacacccaaggggcagcugcuggucuuggacuguugggaucacugcgucaagaucuacagcuaucaucugagaagauauuccaccccuuaaaagaugaggagaaauaccacuuucuucuuucccucaauagaguuuccuucccuuuccuuccuucguuguugauggugccguagaguagauguggccuguggccugauucuaguaggguugcucuagaaucguagaagcucuaguuuucagugauuuuguuuguuaugccccucuucccccccccccuccccuuuucuccuucuaacuuuagagcuuagagcuuuaccagguaccuuaucccaaguagaauagaugaugcucuuagcagaaguugcuuagaaguuagguacuuccaaggcuuuaguaaagagaaccacuuuaguccuuugcccuuguguuugaaauuuguauugguauugaauagucauugauauuucccuuuggacuaugaggucccuagucuacugucuccuuccuguuacagugugcuucgucuguggcuuuaaaucuggcugcauucugugugcaugcuccagugggaucugcuugacccuucagugauauuauauucuguagcaugaugucuccuuugaucaccuuuaccagugugagaguauaucauuaagugccaccaaaggugacacauagucccuuugaaagcaggaccucuugacgggaauuucugccaccauagauugucuucucauugaagaugugccagaggaugguuugacugacccuaguuggauaguguugaacacuucaguccagaaaucacuugccuuuuaaaggaguuuauagguuagaauuaugccauggccaaggcagacgggaacauauaagcagaugcuaacauauccagcaaaugugggauauuuucuagggcucaaagcguuuuguacuccuuccacugaccuaugcuaagaguuauugaaagaauuguguaaugugagcuucgaccaacaaugugaggagguugacacauccauuuucauuacuaaagaacaaacuguuagguagcuagcucuguauuuucuucaagugagugcauauuguuugacuuugagauuuagcucuguucuaucaagcauuaaacuaauaaaaguaauaacuuucuucauca

SEQ ID NO: 12088 - RNA, 153915 nt, Mus musculus
ggcgccccgugcgcgugcgcagcgaacagcugucacccagugcggaacaagucuuccaaagauucccaaaacccucaggggaggccgcacuuuucaucccuuucauucggguggcgucuggaccuccgccagcggcgcagguaaccucuucuuggucgggacggagcgggaaggguggcggccucgguccggucuucgcagggcagcacgggccugggcgcuccgcggugcaaagcagucagcugggagggaggaggcggcccugacaguccauucuggcccucgggauucgggagcucgcucgccugccucccgggagccgaucggaggugcuguugcuccggacugccacgccuguguggucuggggcgccgaccgaccccucugcggccgacuccaggaaggccgggccugugcguccuccgagccucccuugggucgggauguccggauccgcgagguagcagguagcccgacccucacucggguucguucuuggcccuagcagaugaucuuucccuuuuucuuuccuccgucuugaggccauuucuuugugcgguuccuggggggagccaugaugcgggguagacagugggcgcuuaauagaugcgacuucguugcggcaugugaacugccagggagagagggcguguugugcgaugggaaugccaagaaggcaggcggucuagcucgggcuggaaguugguguucucugcucagcagugaaagcagcuggacucaguucugaggauuuucuuggggacccagaaggcagccgccgguguggcugagcccgcaagcucgcacguagucagucaggugcucugagagaagacuuggaagacuugaccaacuuuuuuuuuuuuuuuuuuuuuuaaaucuuggacucaguacggucacucacacuuggugauuuaccuaguacugcuuagaaagcuuacguuagaaaugaagcaauucggaacccgggagacgcuuuugauaggcucgguaagcuuagguuagcaccaaucuuugcuguauuucacccacuugaguuuugcguuuaaaaagggcggaagggaguggagccuaacucuuucuaugggaaaaguuauuaguauucuaauuuaaaagugugaugguuaaaacuuuugguauuuuugguuguuuuuugagucagggucuuauauguaguccugcccaacuuagaacucuguaugguagcuaaccuggugcuccaggaaauccaccugccucugcaucaccagugcagggauuccugcuggucauauuucugcacugcuacugguuauuuguucucuaaaauuuacgguccguucccaccgccuggaauauauagcucaagugguagggccaaugcuuaguaucugaacaccuuaaguucggucucuaagauugaaaaagaaaaaaaaagaaaaaggaaaaaaaaguucguuuuuaaaauuuaaaaauuuuuuuuuacuauugagcauguucacuaauguuuucuuaaagcuugcuggccugguaaccuaucaugcuuuguuuuggaaugcacugccuaguuaaguaguuuuaggaccuccuucccauuuuauuuuauuuuauuuauucauuuauuuauuuauuuauuuauuuauuugguuuuucgagacaggguuucuaccuucccauuuuaguguuuagaguuuacacauaauguuuacaguucuccacgaaauugguaauacaauaaaauucaacgcuaaggcuugcuuuaugguacuaaaaaacuuacuuaauuccucccucccccaccccacucucuuuccuuuccuuuugucuugagacugucucuuguagcccacauagauuggugaauuggugaucuuugucucuacuucuugaguguuggaauuacuuuguuugacucagaccuggggacugaauucaaggcuuuggcgcaugguaggcaaacucuauaccaagcuacauuuccaguccuacauucuguagcaaggauucuuacugcuauacccuugauacccguuauuauuuacuagauauuaaaugauaaaacaaguacauucuguacugucauuaaguucaauauguaaugcagguuuuuuaaaaaaauucucuuugaagcaguaguucuggcugaguguuuaaggcgauggaauagaaaaaauugucuccuuuuuuuguauguuaauauuucaugguccuguaaauaccauuuuuuguuuauuuauacuuguuucaaacaauagauuuugauccugauguuuucccuccacauacuccugucagauccucucucuaccucuuuacauacuucauuuucucucucaaacuccccacaaaacucaaccaaccaacuaaaacucaaaacacacacacacaaaaaucaguuucacaauuaaacagaacaaaaaguguauauauacacacagacacaggcccaggcaaagggagugggggggagaggaagagaaagagaaggggggauagaauaugaauaucuuucgucuuggucaacuaauucugggcaccagggccugcccuggauagaacugacuuuugcaggugguaucaauuacaaauagcuucuugguuaguggugggacuacagguacacguaucccucuuagcugagaccuuaucuagcuugaagcuguacauaucuuuuuuuaugcugccacaggcucaaugaguucauaugugcauuauuguugugucuggaagaugcccucuuucucuggaguccuccauugcuauggccuuguagucuuuccaccuucuuggucuucagucccuugaucugggacuggagaaaaaaauuuuuuuuuuuuuuuuuuugguuuuuucgagacaggguuucucucuguagcccuggcuguccuggaacucacucuguagaucaggcuggccucaaacucagaaauccgccugucucugccuuucaagugcugggauuaaaggcgugcaccaccacgcccguuugggacuggagaaauuugaugaagauaucccauuuagaccugagugcuccaaagucucucauacucugcauaugguguagcugauggucucuguuuuaauuacugucuacugcaagauucugugaugcuggcugagugaggcucugaucuguggguauagcagcaugcuaagggcagucauuuauugcaguguccuuagcaaaguaacaggagauguuuuuccuagacccauagccacuuaaucagugucauggauucugucucaugguaaguucaauaaaaaagugguuuuuuacugcaguaaauaccaguaucccuugcaggcaggucacuguuguagguuauaggguuuguagcugggugauacugaugauuaaccaccuucucugguaugguauaaagugccuuccagcacuguuaaaguuucuauucggauaccagcuccauuucuucauguuugaugauauaaauaggugauauacgucagcauuagggccuuaucaucugguuguggcaaguaaacaauagcuuauuacauuuugcagacaugccuaugggagccauuuggccaaugacucaaaaagauguaacccauucccaucauuggggguuugugucagguaucuagcugugguauugccucccucaguaugugaugauuccauuuagauuacuuccauagauuauauguuuuaggaacguguaaaguaguagguuuccauaugguuuuccaaagggccuuuaguguaccuccccauauuuuuucuucugcucugcccuuccauuuccuucuccauuugaucuuccuauuaugucuuuccauuugucucuccauaacuauauucuauuuucccuuccuugggauauggucuccccacccccaacuagguacuuaaacuucugugacuauucaaaucauagcucacauaucuaaagaguaaaaacugacauccacauagaagagauaccaugcaguauuugucgccuugggucuggguuguccgggaugaugguuucuagcuguuuuccauuuacuggcaaauuucauuuugguuaacaaccaaauaauauuccauuguguaaauguaucacauuuucaugacuuguucuaauaguugauuagcaccuaggcuguuuuucuggcuauaauguauagaaaaguaaugagcauggauguacaaguaucacuuuaguaagauguagauuucuuugaauaugaaugcaaagagguagcaccaucccugauuucaacuuguauuacagagcuauaguaauaauaacagcauggcauugccauaaaaaguugucuugcuaaauagaauaaaguugaugaugcagacauaauuccacacaccuuuggaaaccugaauuuugaugauggagccagaauuacaccagggagaaaagaaagcaucuuuaacaugauguaguuagacuggauagcugcauguagaggaaugaaaauacauccauaucuauuuuucuguacaaaacucaacucuaaauggaucagaguccucaauguccuaccauauacccugaauacgauagaaaugaauuaggaauagccuugaacucacugucacaggaaaggguuuucugaacagaauguugauaggauaggcacuaugaucaacaauuaauaaaugggacuucaugaaacugaaaagcuuuuauauggaaaagggcaccauaauuugggcaaaguggcaggcuauaguaucuugaaugcacaaagaagaaagagaacugggauccaggaaacaacucaauuaaaaauggggugcagaacuaggcugagaauuauaaaaaaaaaaaaaaacaaacucacaaaacaaacaaacaaagaauuaaaacucaacaaagauugaaaugcuuaaauguucaauaucuuuagucaucagggaaaugcaaauuagaauuugauauuucaucuuaacucagaauagccacgaucaauaaaauaaacgacagcagucugugguggggaaaggauucuucauuauggugggggugcaaacugguaggggcagucuagaauuuaguguggaggucccuccugaagcugggaaucaaucuaccucaagauucagcuguuuguuuauuuuuuggggaaaaugggucucacuuugcaguucuggcuggcuuggaacucacuguguauagcaggcuggccugcaguuccuaaaucugcccccagaauucagggguuaauggugugggcuaccauuccuuuuucuucacuauugagucucauuugaacuucuugggaaguauaguauacugucaucuuuuuuuuuuuuuaagauuuauuuauuuauuauauguaaauacacuguagcugucuucagacaccccagaagagggcaucagaucucauuacagaugguugugagccaccaugugccaugugguugcugggauuugaacucaggaccuucagaagagcagugcucuuuuuuuuuuuuuaaccugccuccucccucccccauacgugcucuuaaucgcugagccaucucuccagccccuugucuuauuuauuuauuuauuuauuuauuuauuuuugcaguucuggggauagaaacuagaguucuggaaauagaagccauauguauacaugcaauguguauuuuugucuuuauaacuauaguguugugaauccgaaaguacaaauuuaaaaaauuagugguaaaugaaacaagauaccauuaacaguaagucuugacagggagcugacagaauucauaauuuacuucaggugugagguuuaauuagagugaaacagacucaguuuuuacuuuuacauuuuccauuuacauauugcagcucauuuuacuuuucaccccccccccccacacacacacccaaagcuucccuacacacuucccucucugucucuuggaauuaagugauacacugaaaauauuucauauuccgugguagcuuaauccacccacgcagucagaauaaucccuuuaagaagguuagccuccuugcuccacuuccagcagcucuucauuugggguagcagccugcaguugacccuguguuugugaggcuuuguucagcccaucauuucccacuccuuuccucuguucgcuuaccucucagaguggggcugauccuuuguucuuccucccuucugauuuguacuuuacuguuuauuuaguuucaccgccccagccaccuuucugaaagcucagcuggaguccagugccuucgugcacgucuggccuguaacccagacuccuccuccucuucuuuuggugaauuguuuauuaaguuuuugaauagugacccauuaguugcucugcuuguuuuugcaucuacauacauuuaaagaaaacaguaacauguacaacgugcuaaguacuugcuagauaugggaggaaggcaaugcuaaaacugcagcuuucaucuuagaagggaauaagagauucuccagccauuuugaguaaccauggccugggaacacagacuuaugugaccucaaauucuauguuccaacauggaagcaagcaauuuaggaucggucuuaucuuacuguuaccaggcuacugaacucauaauguagcccagccuuuaaguacagugauccuccuugaccaaguguccaggguagcugcacuugcaggcugggcucuuugucucuauuuuuuucaaagacaggguccuauuauccauacugguucugaauucuacauagcucagguugaucuagcauuugugacuuuccugccucagucuccugagugccccaccacacuuggaccccucccuuuuccuuauuuucaggcgugguuuuggucuacaucuccagcugugcuuccugccucagcuucucaagugugaggauuuggggcuacccccuccuuccccuugcccccacccccacucuuguguuugaacuccauccuagugcaugcaaagcaagcauguacaauugagcuacacaucuccagccucaguuuagaaaucuugacuuuucuuccuuuuucauuucuguugugaaauuuucuucagaacauaccaaauacuaauuggaucucacugcacacuauauacauucacuucuguuuugucuggcuaaauuuucuuuggauaaaucucuuccuugguguuucccccuuuucauccccccuuccuccuucuccccuccuugucuuccuuacucucuuucuucacagcaacaagaaaugaaaauaugagcaagauuccuuuuuugcuucaguuuccucagaagagguauacuuagggagcuuaguucuuugaauggugugacgaaaaugacugaguucaggaacuggauauguuaagggguaaagguccaaaauuacuugcuggcauacucagauaaacgccaaacuucuuuuuucuacucucucucucucaaccuucucugucuuguuuucagccauaucugccuucuuggagaucucuugaagaauagagcagaacugaaccuaagagauaucucuuccuuuaggcuucuccuggauuuuauuucucugaaccaccuucgauugccugcuuugaaaccggaacccccucaguuggcccugcauuuuuuaguaguuacuauuguaaaucagaacucuugaaaagcagcuuugucuccagagcuugccugacugauuagaauuucaauacuguggagagguuggaauguugcaggcccaggagguaguuuuaccuuaucuugggcugguuuuccucuucugcacgcaguagccuuucuuuuuuccuggcagucuugugaguaguaggucauuucuucuuggacucuauuaacaugguagaccaccagcuuccaccaaccaaaugcuaagaaugucaucagagacccuucuguagccuagcauauagcauagcauagaaaagcuuucccugucuugcugugacugcccccuuugauauucuguguguuuuaaauuugccuugacuuauauuucucuuuguucugcaacauguucuguucucauaguguaacugaaacucaugaaacugcuuccauguuggaauauggaguuuggagugaucuaaaucuguauucccugugcaacagucauguuaaaaugcuccagaaaaauuuauuucauauucccuuaaaaaacaaaaacaaaacaaaaaacugcuuuuuuuuuuuuuuuuaauuucgcauugauaccauuuacuuacuguauuuuaugugucauuguuagugccaggacuguuuuguccuuucaaugucuguggaacuaaaguuaggaauucaaucacuguugaauugcuagcugcauuuccaguuccuucaguggcugcugacucugcucagacaaauaccaaggugacuuguauuuuggccagaagaaaaggaauguuucauuucauauagcugguguguuucacacagauaguuuguaguuuucuuaguuuccugcugugguuuuuuuuuuuuuuuuuugcuagugaaacaaauuagauuuguuuauuguuuuguuuuuuguuuuugagguaggacucuagcugccucacccagaguuugguauguagaccaugcugacuucugacuugugaaaauccucuugccucuuucucucaaguaccaagauuauagauguguuuuucaugcuaggcuaaucugcuuucugaauaacuuuuguuuaggacaaguuuauuccuuuucccgaaugugacauucuauguaaugucuuuuuaauauuuuauguguaauauuauauguauaugcauagucuguauguuagucaccauguugauucuggaaauugagccaggcaggguccuauguaagaacaacaaaugcucuuaaccucuguuccuugcuucuagccccuugauacucuuuucuuuacuuuucuugaucccccccucucucccccucccuuccuuccuuccuuccuuccuuccuuccuuccuuccagggguuuuuuuuugccgucuuggaacuugaucuguagaccaggcugucugcaaacucauagaaauccaccugccuccuaagugcugggauuaaagauaugcauuccuggccaauacuucuuuauuauuacucauauauuauuguaaugauuauuguauauaauauuauuauagcagaugugaggaagacuacgugccaaucugucuuucuuuucagugcuugauaacucaauggcuagugggcugugccagcauugggaggaaccccuugcugucuauaguauggguguagacaaggagacagagcacaggauggcucguugaguucuguauugcacagacaguugggaacucacagcuaggaagugugcagaggcugcuucaagggaaggaauaugugaagucacagauuacuuaacuuguuugagaaacugggugaaguacaguuggcuuucuauauuugaguuuuuuuguauugaugaauugaaucgaccaagggcuuacaaaaaauugcaucugguuaaggauguagcuuagcugguaagaguaguuaccuagaggguuugaguuugauuuccaguacuacaaaccuccuaugaaggagauacaggcauauggaucagaaauucaaggucacccucaacuacauaacaaguucaaggccagucauggcuauaucagaagucucaagaggaaaacuuggcauguaaaacauaaaaaauaauucccugugcuggaugccuuuaugucaacuuaacacaagcuaaggucacucgagaggugggaaccucaauuaagagaaugcuuccaugacuguuaccgagccuguuggacauuuucuuaauuaaugacuggugguggaugacccagcccuuugugcauguugcggucccugagcugguugcccuggguucuuuacagcaggcugaaugagccuugauggucaagccagucagcagcauuccucuauggccucugcaucagcucuugccucugguuccugcccuauuugaguuuguauacugacuucuuugacuaugagcuaugauauguucaaucuuacucucuuucuugaaccuggaguaggcuggagggcagcaaaucccagugaugcuucugucccugccuccucccacaaugcuaggguuacaaaacauggccaugcuuggcuaggcuuuuuacauggaugcuggaguuugaauucagaacuucaguuuugcacagcucuuaucagagcuccucugguacuguuuucugucuucaguagauuaguuuaguuucuggugguuuugucaugugauugguuuuuaauuauuauagaaaaccaucuuauaaaaaacuggaagacacuucagcucugugcuagugauauugaacauccuucagcauauauaugcuaggccuuuauauauauaugugcauaugugagauaguggaccaguacaucuguguguuuauuugaggaccauuaacaccugaccuccagguuuucccagcagucccuccucagcauaccuuguccccaacccugaacuuuacagcccagcagcuacgcugcuuuucuccuucagaggcuucuccuuggugucugucucuauguuucucuguuugucugucugucugucugucucucucucuguucuuuucccucucuuucucuccacucucuuugugggcucucucuccaccuuucuuuccucuuggggccagugaacuugccuaagaacagcuucccaauaaacaugccuuuaagauaaucaaauuuggcuugaacuggcucauuuucaccaguggagaaauaacuuaucucugugguagacuguacuucuagaaaauucaguuuuacuuggaaagguuucauggaggucaguuuuacagucaggucagugauucuguauccagaauaggagcauguuaggaagcccugaggcguccuuuuugaggaguccauuauugauggccaccuuuucuuugcagaaacaucuguggccaucauggaggugguggagguggagaguccccuaaaucccagcuguaagauaaugaccuucagaccuuccauggaggaguuucgggaguucaacaaauaccucgcauacauggaauccaaaggagcccaucgagcaggucuugccaaggugauuauauucagacuuguccuaaaaaguauccuuugacuucgggaauuacauuguuaguuuuugguucuuucagugucugcuaucuagcuggaaugcuuaauuuucuuuuguuuggauuauuuauacuagacuauguucuagaauuucucuuccuuccucccucccuucuuuccucccucccuccuccccucucucuuucuuuuuuuugguuuugagauagguucuuucacugucuugaaucauagccaucuucucucuucaacuuccugaaugcugggauuauaggcucuagcaacuaugcuugucucguguuaaaacaacaagauacaauauccucaaucuacaguuucuaauucagugguguuuguuuauucaaauaguuuuauagcuguuacuacuaucaaauuauauguggauaucacaaagagaaacuauauauuuuaaauggucauuuccaauuuccugguaucacuguugcccuaggcaaucacagucugcauucucuaucaauuugccuuuuuaccuauuuuugaaaaaaaaauuuguauauuauuuauggguggugccuauguaugacauguggagauguauauauugccacaacucaucuguugaggccagaggacaacuuuagaguugguuuucuguuuuuaccuugaugugguuccaggggacaauauuguuuaucaguauuucuuuguucuuauuuuguuuuguuuuguuuuguuuuuguuuuguuuuuucaagacuggguuuccuauguagcucuggcuauccuggaacuuuuucuguugaccaggcuggccucugcuuccugaguucugggaguaaagguaugaauugucauaccaggcuguaacaagcauguuuaccaccgagcucuuuuaccagauccuagccuacuuucuuucuucaagugugaagugucugcuguguagcagugaugauggagggcaugcaggcagagucuauaauucuagcacuugcgagguagaggcaggcggaucucuugaguuugaggacagccuugucuucagagugaguuccaggacaggcaaggcuacacagaaaucuuguuuccaaaaaaaccaaaccaaccaaccaaccaaccaaccaaccaaccaaacagauaauuagggugaaagaauccagguuggagacaugguucaguagguaaaauauuugcuaccaaacugugaagacuuacagucuccagaaaucauguaaaaacugcggccaauagcauauauuuuguaaucccagcccuccagugucaguggcaaaugaagacucauggccagccugucacagaaggugguaaagagacugucuuaguuaggauuuauugcugugaagagaaaccaugaccaugacuacuuuuuuuuuucuuugguuuuuugagacaggguuucucuauauuuagcccuggcuauccugaaaguacucuguuagaccaggcuggccucaaacucagaaauccaccugccucugccucccaagugcugggauuaaaggcaugcgccaccacaccuggccaugacaacucuuauaaaggaaaacauuuaauuggggcuggcuuacaguuucugagguuuaguucauuaucuucauggcuagaagcauggugaguaggcagaaauggugcuggaggaggugagaguucuacaucuucuucagcaagaggcaggcagaaaacugugagccauugagccuggaauugagcaucuuaaugcacgcccccacagugacacacuuccuccauuaagaccaaccuauucuaacauggacacacccacaccgaaugggccaaacuuucaaacaugagucuggggagccauuccuauucagaucaccacagagaccugugccaaaagaguaggagguaggaguuaaggaaaaacauucuagguuguccucccugccccuccacuaauagaugugguguguguguguguguguguguguguguguacacgcacacgugugcgauugcuuaugaaguauauaaaagggcuuugaaucauuuagaacuagauuuacugguauugccauccacccaguaugguuacucggauuugaauucugguucccgugauugagcaguaagggcucacagcugcugaaucacuuuuggagcucacucuauuauuauuauuauuauuauuauuauuauuuuauuuuuuuaagacagaguuuuuuuuuuuuuuuuuuuuuuuuuugcuaagugcuaggauuacugagguaaugcauuaggggguuuauuccaccugcaguaagaagugaggguagucuugaauugaauagauuagucugacaaaacaauuucaggaaggaaugauuuauguuggcuguuuuagaauacauuauggugguagggacaugaggcagcuagauggucauauuacaucuacacuguggaaggaggaagagauaaauacuguuguucaacuuguuuucuacuuuuuaauacaguucagaaucuuagcccacacuuagggugggucuucacgucucuguaauacaaucuagaucuguccccuaggugacuucuaucaaguugacaaucaauauuaacuauuaaaauugggaaggaagauguaguaguagauguuuccuuguccuguucuuuugcuaugcugagacauugcuugaaaaaaaacuacacuggcaucuauguaaaaaaugaguuugguuguaaagacaaguguccacgggaagucuuaccagggauagugugcugaucuacugaacagcucucgguagcuuugaacacuuaaaaagagaagccaguuuugaguagguucaucuauucuuguucuuaaagauacgaaauuauguguuuuaaaaaauaaugguaaauggugugcuuaaggucguaggagaguucaugaggucccaaagacuguaauuucaucauauaggugcauggcacuggcagaggcuguugcuagugauacguucacugggaaagguuuuucccuggacuuugcauaucuguuaugaaggucaaaugguguggauaaugacuguuagcugaacagagaacuucagaaauauagguuuggaguacgaggacgagauaucuugauucauacuagagacuguaauccaguuuuuuacuguuuguggcauuuuguauccagaggucauuccuuuuguuagguggcuguugucaguaguuaugcucugacuucuacauuugugcuauguacuccccaugccuccauguccccccuccucauacacagaauaaguaaauguaaaaguuguuuagaauuugcuuuuucaguuuuggucucaacuugcagauuauaauuugagguagacaugggggaaucuuucuucaguugaacagaagguguuauuuuuccgucauuuggcaugaguaugaaaugcuaugucauguauuaucuaggaacugggcuuuauuagcccagagagaagcuggagaucaccuucuccucucuaguuuucuagcugucugucugucugucugucuagcuaucuauuuuuuuuuuuugaaacagauuucucauauaucccagaauagccuggaacccugaauuucaugguuguucugccuccaucuuugaaugcuggguuguuggcauguguguuacuauacuguguucauuauuugaccuuuuuugaaaaccuuuuuuugucuccuuuuuuguuucuugaacacaucuccugguccucuguaauuaguaugcugucuaguggugagaugacuuguuaaguaacgagaagaggagcuguaggcacacugaguacacccaugacagguauaaauuagaaucagaauaaaauuaauaugagaauuacaaauacaccugagugaguccaguguaccucacccucaauggaacacucuuugacaaagacagcguucucuaauaauauuagguuugcucuccuaggaugaagcugaacugcuuguuucuucuaauaguauuuugcuguauucuuauugucacauaaauuauguuuaaccuaguuucauucuuacucuggauggugaaguaacuuaaguguauagagcuucaacaaaccaaguuacuugguugaaaauccagacuauauagauguggauguuuuucuuuucgugggggaauaaagguccccugugguuccuuucuuaauguauuauugacauuucguggacuugucuuaacuuauaauaauuucuuuaacuuacaauaaucaauuuuugaguacuucaauaauagugaguuuaauuucagaguagcccaauuuuguuuuuucucuaauuauuuauauacauacacauaaacauauacauauguacauauauaugugugcauauauguaugugcuucauaaaauacaagagagugaagauauguaccuaugccuacaacaugaagauaacaucguucuucuuuugcuacuuuguagauagcaucuggcuucaacauaucuagugggcaugcauauuuuagcuggcaaugccuggguuugggaaaacagugacauaaaguauguauucugucuugacauacucaggaaguagucaauauaguugauagaaaugaagcagaauagguuuccucuacuuuaacucauuaaauaugaagguguuacuauuaaauuguuuaaugagcaaauauguuguacuugguuucgaacugugugaggugauuugauauuuaaagacuuaaaauggaacugaaaguaugacuguagguaaagcacuugacuuaccugcugcugacuguugaguucuggaucccgugggaaagagagaaccaacuccugaaaguuguccucugaucuccacuugcaugccacuuccaucacucaugcacguaggagaauaaaauaaaaucuaaaaugaauucaaaagaaaauaguugguauaggcuuggaucaacaugccugccugccuuccuuccuuccucuuugacauggggucuuucuguguauaccugucuggccuagaauucacugcauauacugacuggccucaaacuuagaacugauaggcuuaacuuuguaauaacuuuaauuuauuuuaugcuuuauucucuggcauuaaaaguuacuuaaaaauauuccuggugggcuggagagguuagguuuaaugauuaaaaccacuugauguuauugcagaggaucuggguuuaguucccaguaccuacaugguaguauacagucaucuauaacuccaaggaugccagacaaucaugugguacauguaggcaacauacuuacacauaaaauaaaaauucaaaaagaauaaaauauuccuagccggguguguuggcgcacgccuuuaaacccagcacucgggaggcagaggcaagcggauuucugaguucaaggccagccuggucuacaaacugaauuacaggacaccuaggucuacauagagaaacccugucuugaaaaaccaacaaaacaaaacaaaacaaaacaaaacaaaacaaaacaaaacaaaacaaaaaauauuccugggaaaccaguuuacuucuuuuauucuuuuuauuuuuaaaauuaauuuuuaaaaauuauuuguuugugcgugugugaugugaguauggguauauucagagaccuuuggaaguuuuuuuuuuuuuuuuuucuucccaccaagaauucuagggacuacacucuggugguggcuugaguguauaugaaccacuuguguaggggaucucaagaggucagagguggacauugauuccccgggaacugaguuauaggaaguugugaauugccauuugggugaugggagucuucuguaaaagcauuaagugcuuuuuuccacugagauauuucuuaagccacuaauuuuauguuuuauuuuugagacaggaucuguugucucaggcuggcccugaccuugcuauguagcuaagaacauuucuacugucuagauguacagccuuguacuaccaugccaagcuuaggugguucuggagggagaacuccagacuuuguacaugcuagauaucucucuuuuccuuccuuuucccuuuccuuucuuccucucuccccucuuccuccuucuccucgucuuauuuauucugagacaguuuucucuguguagccuugccuguccugaaguagcucugaagaccagcugaccuugaacuuguggagaucugccuucuuuugccucccaauuaaaggaguacggcaugcuuaccuggcuguaugcuugauauuuuuguucuuuuaagauuuauuuuuauuucccuuuguguguugaugugaguaucugcugugucuuugcaggugucugcagagggcagaagagagugucagaucuuguggagucauaggcauuugugagcuuccugauguggguauuggguaccaauuucaagaccuuuggaagagaagagcaacaagugcucucaacuguugaacuaucgcuuuugcacucacaguugaucuuucuaauacuuaaacacucugauuuccuuucaguuaccaagauuauaguauagugucuuaaagauuccuuuuuaacgguuuucugugugagcacguugaugugcaugcggguaccccuccuggagcuagagugcuggcacccucugagccuuugcucaagccuuccacuuuuauauaguguaccuuucaaauaguaguauugauguagacuggagguguugaguaccugcuguacagucaggagguccugaguucagauuucuaauacgcauguuaaaaaaaaagccaggggucauuaugcaucuccauaaugcuagugcugggaaggugaagagaggacucggcuccaugacagacucuguuuccaaauaaaauauaauaaaauacauacauguguauccuaaugcauauauacaaacacaaaaaugucagacauguuacauacacaaaacaaaacuuuuuuuuuuuuuuuaaagauacauuuguuuuauguaugugaguacacuaucacugucuucagacacaccagaagagggcaucacaucccauuacagaugguugugagccaccaugagguugcugagaauugaauucaggaccucuggaagagcagucagugcucguaaccacugagccaucucuccagccccagacaaaaacuuaauauuuagugaagcauagccacaugcauuuauuaccaauaaauaugguaguuguugccacuugagcaggauagaccuauuuugaaaagaguguguggaggacuugggagggguaauaguauucugcuucuuauacuugcccaaguggguccucugugcuuugguuucuaauaauucauuuucauuuucuguaaauaaaucuuucaauguuaauuuuuuuuaagauuuauuuuaugcauaugagugcacuguaacuuuucagacacaccagaagagggcaucggaucccuuuucagaugguugugagccaccaugcgcuugcuugggaauugaacucaggaccucuggaagagcagucugugcuccuaaccacugagccaucucuccagcccucucaaucuuaaaauauuuuaagaaauuucuuagguauucuggcgcauucaugcagucccagaauuugggaggagcaggagguauuccugggcauuccuagagacguaacaaauucaaggacagucuggguugcuuaagaagagacauguagauaaaauucaguaaaggugaacuugcuuguguucugugaggaagaguccaucaacaguugagagguaacacguggugaauuguuuguucuggugucauugguguuucaucuaacaucucagccugccuuuuuuuuuuuuucucgagacaggguucucuguauagcucuggcuguccuggaacucacguaaaccaggcuggccucgaacucagaaauccaccagccucugccucccgggugcuggaagguaugcgccaccaugcccagcucagccugucuuauaaacaccuaauaaauaucccagccugucuuaucauuagcucuuacucuuagucauucuguauacauaaaaaaaucauaaaaaaauaaaagcaaguguuaugaguggcauuaaaaacaagucaauacaaauguaguuaugggugucagugaauuuuguuauuaagaaucauauccuuacugcaaaguauuagugaguguuuacaguacuuuuguuacagagguauugagaaaauguguucuucugaaaaauaaaagguauguaauacuuaguuuggagugccaaguuaauauuuuguuuugcuuccaggugauuccuccuaaggaguggaagccaagacagugcuaugaugauauugauaauuugcucaucccagcaccaauucagcagauggucacagggcagucgggacuguucacgcaauacaacauccagaagaaagccaugacugugaaggaguucaggcagcuggcuaacagcagcaagugagucaguugaguuauguuuguaauucuuccaaaggggucugugagguaagaagccacguggacagagcagccggaaaagcaggaaccuccuuugucaucucuugucuucaucccugguuucuguucuucaaaugacggcuuacucauauuugauuauuucuaaagaaauugauccauauuuuauaauccuguuuauaaaaucuagaagugguucuuuuguguuuuuuuuuuucuguucuuuuuaguugucagagguuuuuaguucuuuuuagcuuuguuagggaaaauuuuauugauaauuuuguuuaagacuaaaaugagcaguagcaauuuaaaaacaacguugaaugaauagggaaacaucuauuauaucaguuauauggcauauaacaaauucuuaaaguuagucccuuaagccagcucauaauuauaaaagucaggaagcuaggagucauguagaugaaugauuaagcuuaggaugucugccacguuuacugcuaaggcuuugacugggagggcggcugcuugagaacuuagcuggaagauuugucuaggagggguccuuguaugaggcuaaaguucaugcugcucguccuguaaguggagcuuugcaaauguguagaaacauggacauauuacuguuuccuuuuuccuauaccaguccugcuaugcacucacacaucuuuaaaaagcacauuugaguaaauugcagacauuguggacuugugcauguguauguaacuuuggaguucaagauuugcuuucuuucuuucuaucuuuuuuuuuuuuuuauuauuauuuuguucuuugucaauuucauauguauuuaacauauucugguacuuuacccacuacccauucuuuuuccccaacuccccugucaguucccucuccuaauaggucccauucccauguuuucuuuuguuauaugaccuacuguguuuaauaagggguuuuugagugauuaugggcuuauauugaauggagccagguaggcucaccaguggguauacaacugaagauaaugacaucaucaucaucaucaucauuuuuaaaaauuuauuuauuauauguaaguacaaguugucuucggacacccaagaagagggcaucagaucucauuaggaauaguugugagccaccaugugguugcugggauuugaacucaggaccuucggaagagcagucagugcuuuuaaccacugagccaucucuccagccccuggacaucuucuuuucuaaauccaucacuagccaguagguucccccuuccuuuacuuacaguugacaguccaauauuguucacacccauaguagacagccacagcgucagcgaguucauaauuaaaaugucuguguccugucuaguagauggcauaucucuguuacuucucuauccuucugauccugcauucuuucuguuuccucuuugucuguguugcccgaaucuucauauaguggccguugucuucuuccagagaaauugaguagguauaucauauacugaauggggagaagaaugaagucuuacuuuguuuuugaggcagggagauagcuggccacuauaaagcuuaggcugacaaugaauuugugguccuucugucucagucucucaaguucugggucuguagguauaugccaccauaccuagcaaaauuuucuuucuugaagggaagacuauuaaagaauuuacggaaaaaaaauauauguguguguguguguguguguguguguguguguguauaaauauauuguuguuuuguuuuguuuuuguuuuuuguuuuguuuuuucgagacaggguuucucuguauagcccugacuguccuggaacucacuuuguagacaaggcugaccuugaacucagaaauccgccugucucugccuccugagugcugggauuaaaggcaugugccaccacgcccagcacgaauauauuuuuaaaccuuguguuuuuuaugugguauuggaugcccaauauaaaaaucuuaaucugaaacuggggauucagcuuagguguuguuuuuuuuuuguuuguuuguuugccuagcaugcaugaggccuguguuuaaucaccaguacuaauaaaccuggcuugaugguauaugcaccugacucuagagggagaggcaaaaggaucauuaaaagcucaaagucaucugaaaaucccccuaaaacugacugugcccaacuccugcuuuucucuccuuuuccuguaaaaucucagaaaaaaguuccaccuuagaacaauaauaaaaucuccaaguauuuuaaaaaacaugccaaaaauguuuaaauuucuuguaugguugugaauggaagcaaaucuuuggaugaacuuagcugauacggcauaaaaguaacuugcguguaugagugcauuauuugauauaguauacaaaugaugaagagucuuucuuguuauuucuaguuuaguguaaaaauuaaauuuugaauuaaaaaauauacuauuagaucccauucuuuuggaucuuauugagaauaggacuuuaguuauagauugagcaccucaucauuuauacuauuaagaaacuuuauuagcacauguacgugugugugcauguguguauguguauauguauguguguguauauaaguaugauguguuugugugagcauucauguuccauauaacuuuugugugguggucuuggaacaacuuuguggaauugauucuaggaauugaucucagaucuuuaggcuucugaggcaacuacuuuuauccauugaggcaucuuacuggccacauaauuuuucugcugcuguuguuguuguuguuauuuuucugcugaggauuguacucagggccuuuugauugcuagccaaauucucuacuauugggaauagagcagcugucaacauggcuaugcaaguaucuguggaguagguuggagaauuuaugccaaguaguuguauggcuguguuacaugguagauuuauuuuuagcauuuugagaguuuuuuacaugauuuuuuguagugcaacacuaauuugcaccucuacuacauuacccccagcauauguugucauuugcuuucaugauuguagucguucugauuaugguaauauaaaacucaaaguauuugucugugucugugucucugucugugucucucucacuguaggauauaggcuuugaacucauagaaaucugccagccucugccuccugagugcugggauaaaaagcgugcaccaucacuuccaguuaccaaacuaguagugauuuacauuuucugaguugcuaaggauguugaauacauuuugagauggcuuuuguuaccugaaccucauguugucuucuguuuguuccauugguaaaaaugucaguuuuugugccugucccaugcuguuuuguuacugugacuauuuuguauuaauauagcucaguaagauaucucguaauuuagaauggcaaaugcauucaguguuacucaccuugugccuucuuaguuuagauuguugaucucuucuugcuuugacuuugcugguuuggaugaaucuagaaauucauccauuucuuuuagauuuuuauggaauauagguuuuaaaaauauuuccuuauaaaguucugaauuuccuuggugucugucauaauguuuccuuguucauuucugauucuguuaacuuaggucuuuuuuuuuuuuuuuuuuuuuuugcugaguuugucuaugggucuguuauucuuacuuauuuucucaaaaauaagcuaucagacucauucuuuguauuguuuucauuguuucuauuuuauuuauuucugcuuugacuuuuauuauuguauccacauacuagauuuaaauuuuauuuguucuuuuuuuguuuguuuguuuguuuuuuuuguuuuuuguuuuguuuuguuuuuuucaaaacaggguuucucuguguagcccuggcuguccuggaacucacuuuguagaccaggcuggccucgaacucagaaaucugccugccucugccuccugagugcugggauuaaaagcaugcgccaccacgcccagcuuguucuuauuuuuguaaauucuucaauaguauuaguaauuuuuuuguguguguauguuuagauauauguauuauuauuauuauuauuuuucgagacaguauuucucuguguagcccuggcuguccuggaacucaaucuauagaccaggcuggccuugaacucaaaucugccugccucugucucccaagugcugggauuaaaggugugcaacaccacugcacagcagauauauguauuuuaaugcauggucuuaggauuccuguuauaggaauacuuuuaauguuucccagggauauuauuuuguuuucagaucuaaauuuuuuuaaauuacucuuauuucucauaugaccuauuuaucauuaaguaacaaacuguuuaauuuccacaaguauguguauuuacuagagauuucuaucaauuuuaacuuugauuauauuguggucagauaagacauaugaaauuauuucaguuuuuauaaaguuuuaagguauaguuuuugcuccagaauauggucucuugcguggaauacauuuuuccauccuuccauuuuaaaguauugccuaucuuuuaaagcuaaaauuaguuucuuguagacaauggaaagaugcguuuucuuucuuacuccauucauauagccugugccuuuugagauuggugaaguaaagcuauucguauuuaaagguacuauugaaagguacagguugauuguaguauuuuuauuguuuguggucuuguauuuguauuuuguauuucaauaauuauaacuucauuuauuuucuuuuuagcuuuggcuuguuuauuccucuauucagucauaaguauugcuucuaguauucucugcaagguuuguuugguagagaugaaauauaguaauaauaauaauaauaguaauaauaauaaugugauaacaauaauuauuuauuuuguuuuuguuuuuuguuuuuuuguuuuucucgagacaggguuucucuguguagcccgggcuguccuggaacucacuuuguagaccaggcuggccuugaacucagaaaucuaccugccucugccuccugagugcugggauuaaaggcgugcgccaccacgcccagcuuaacaauaauuauuuugagucaauaucucauguagccuuugcuguucuggaucuugaccagaauggccuugaauucauagagauuagguaugcgugccucaguguucugagugguaguggaauuaaagauguguaccacuauggcuggcugauacuaauccuuuuaaucucuugauauuagaaaaacuuucucuucuuccuuugugguagacuguugugcuggauacaguagucuaggccggcaucugugguguuuuagaaugcacuacuucagguuuuuucccucuuaaaauuuucaucuagaaauaagcuaaauguuuuccuucauauguugucuguguuuuuuuuuuuuguuuuguuuuguuuuguuuucaguuuucaaauacucuauauuuguguuuuacguaugcuauaucguuggacuuuuuuggucuugcuuauugguguccugugugcuuucugcauauguauguauauguaugauuuuacuugguuuaggaaagucuuuucuuugaucuuguugaagaucugaugauuuucuuuaaguccagauauuuguucuacuuaauucaaucaacuuuuaagacuuuuaccugagcuuuccgauugaguuauugaguuuuguaauuuugucuuucauucauucauuaauucauucauuuauugagauucucuucacuauuuuuauuuuacuuucaaauucugaauuauuuuaguuuuauucagauuuauguuuguuucuuuagcuucagguauuuagugcuagcuauucucuuuaucuuuggucugucuaugaccuuuuaaaauuucacagcgaaauuuagguucugugucugugguuuauguaggaaauuuuuauuggagaacauauauauaggacugguggauuuggggaaagauauguugccuuggauuuuuguauugugauuuuaucauauaucccaggcauauggacuucuuugcuaguuguguagccgaugugcggaucuacacugccucagguuaggccuguguuuaggcuguguggcuggggcaaggugugagggaccaggauggcacaggaagaugaggucucuugcauucaccaggcuguaucuuugcauagaugucugaucugguuuaugccuguaggcuggauaugguacagccugcuagguucugguggaacucacuggacuagacuagugcacaugguacacagggggugggaccagugccaagccugaagcuuggaaaggcacuagcagcaacugaucagaaugggcaagcauagaggauaugagacuacugccaaacuuggggguuggaaaccccacaggcaggacuggccagacuaauuuugggggcuggaaagguaugcaaugguucagggaguucaccacgguggaccugaguacaggguuggggaccagaacaggggcuguagauuggauuugccauaagcaacuggaguggaggaggaggagaggcagcacacagguugucuaccugggucugccgugguggcuacauggucccuaguagcaaguggggcugacaucaucuguauuuuuuuaauuaaaaaauuuuuuuuauuagauacuuuuuauuuacguuucaaauguuauccccuuuccuaguuuccccuucugaaaacccccuauccucuacccccuucuccugcuccccaacccacccacucccauucccaguucuguccuuccccuauacugggguauagaaccuucacaggaccaagggccucuccucccauugaugaccaacuaggccauccucagcuacauauauaguuagagccacaugucccuaucaucuguauuuuauagagcaauaauaagcuucugagaaauucagcacucaccccagagauauuuuaguuuuuacaugucaaaccuugauguuugugguggcucuuaaucguaguuagaauuguaggguugcuaaggcagaaggagccuggucaugagccucucuuuuagaacugugcucagugaguaaaugguucugagaauguauuauggagucaguuuugaguaaauugggguuugaacaacugugauggucuggcagcauguuaggacggaccuuugcuuauuuucuucaugaaaaaaaaaaaaagguaucugucuuaacuucuuuucuuguugcugugacaaaauacccaguuaaauuaaagauguguuugaagagguguuugguuuaaaguuucagaggauacagccuauaggggcugagagagccauggucgaccagagucagagcaaagaccuguagugaaggcuggugcucaucuugcuuucaucuuuuuauucaguacaggguggagcuuuccacauuuagggaaggucuucccacuuaauuuauuuuagguaaucucuuauagacaugcuuugaaauuuauguuuucagugauucuguauccugucagguugaacuucauuauaucuuucauaucaauaugauugcuuaaaauaaauacaaaauaauucagagaaguauauuucuuuaauuauuuugugagagaaaacuuuuuuaaagacauuuuaauuuuuucuuuuaugugaaugcauguuuugccugcaugcaggucucugcaugacuuguauuaaauggcugcagagaccagaagaggguguuggauccucugggauuggaguuauaguuuguugugagcugccauauggguagugggaaucagacccuaggccuuugcaaaaaaagcuaguaccuuuaaugucugagagaucuuuuaaucuggauuuaucuuuuaauuuggauuauaugcauguucauauguggcuauauguacucaggggggccagaguuguuggauucccuggagccaaacuacaggcaguaaauggccuguuguggguacuagaaggcaaacuuggguccuuugcaagaguguucuuacccaccgagcucucuauacauuuccccuauacauaggauuuuauguauguauuuucaggcaggauuugaauuuacgguguagccaaaacuggcccagaauucuugcuugauccuaaugccucugcauccugaauauugaaauuauauacauguaccaucaugcucaagaaguuaauuguuaauuuuaacauuucuuuuuuaaaauuaggguaucuuucuaguccaaguuggcauuaacucuugauguagcugagguaccuuuucuaucuauaauuuaugauuuuccuucuaucuuucaagugcugaguuuauagggauguguuaccaugacauauuuagguaaucaggguauuuguuaacucuggcauccugucugauagacaagcagguuaccaaggagcuggguuccuaccuccagaguuugguuuuuaauuuaacuuaacaacaacaaaaaaaugcaaugugauuacauuauauauacacaguaaucucuaaacugguguagucagcauggaaauauuuuaaugucauuacauagaagacuuaccuuauuuuauguuuuaauaguuaauugcuggcuauucagucugauaguuaauauucauugugaaagugacaggaucuaggaucacuuaagacaagucucugagcaugccuaugaggguuuauuuauauuagauuaauugagauggaaauacuuaccuuaccuggacagugccauuguaugggcugugauccuauauuggaauagaaggagagcuguacugaaaauuagcauuaaucuuucuuugcuuucugagugcaauuguaugcagaucagucaccucaagcuucauugcuaaagcgaacccugcuuuugucagaguuugaucacagcuacaggaaagugccucuuacccauuguguuucuaguuaugcugcugugcacuuccucauuugucauugucugcauuucugugcuggcaagaggaauuuauaaauucagaucgaggguguguaaaauuuugauaagauaugcgaugagaaauuaugcucuggaaagauugugcuagcuuauucuuccacucuaacuacauaaguuuuuuuuccuuuuuuucugucauuaguauauuaggcagcaccaaucuaauaacuacagaguaucuuauuuuaguuuuguugucuuagaauuuuauaaaguuuucuucucaguuuucuauagauguguuuuucuacauaaaugugcauaauguucuuauauaauugauuacauauuuuagaaauauuuugaaagcuagcgaaugaugccuuuauuaguguguuuuggaagcccuacugauaaggaacauaagaaauucuauagagcuuuuaauaugaaaucauuuauauauuacucauuaacucugauaccacaugaguguacaauauuuuuauuuagaaaguaaauuaaauuagauggguagaaaaccuuaaaauugccuuacugcuuugugguuuuuacuuuuuaauuuuuuauagauacuguacuccaagauacuuggauuaugaagauuuggaacgcaaauacuggaaaaacuuaacuuuuguggcaccuauuuauggagcagauauaaaugggagcauuuaugaugagguauauuuacacuuauguugugguuuuuaaaaguuuuuggugauguuguuuuuguuuucuauuuuuagauagcuuagaaguacucaauuauaucuuauuuauuguauucuauuuacuuuuuuuuuugguaucuauacuuuuuaaauaugagagaaagaaccaggaggauucuuuccuucuucuuuccuccauucucugccuauggcucacuuuuucuguuuguuuguuuauuuauuuauuuauuuguauuguuguuguuuaucuuaaauuaugugcauguguguaucuguggguaaggcuauguauguuuguauagaagcuuguggagguuagaggcauuguaucccuuagaauuuguuacaggugguugugaguucuuugauaugcauacuaggaaccaauuucagguccucuagaagaucagcauucacuauuaaucacugagcuguuuuuuucuccagcccuccccaucuccuuugcugucuuugagccagugucuuagauaguucaggccaguuuaaaacuugcugcuuaacugagcaugaccuugaacuucugaucauuuugccucuacuccggguugacaugcuacaacugugacagaugucaauuaauauauaggauauauugagguugccauaauuucucuaacauuacuuauaguaacuccucuccuauagugaugaauuacuccuuuagggcuagagaugcaggucagugacugagaacuugcuugucaugugugacaucacauuuugcaguucuggguucaaguccuugggcugcaaaaacaagcaagcaagcugggaaauagauaaauagaagaauaauaaauuucacuguguaguuaauaagggaguaaauaguagaauauuguaggguauuuuuguagaaaauauuuuguuccccaacaaucuuccuuguacuuuaugcauugacacccauugcuaacccuuaccuuaguuuccuuauuacacuuuuuuuuaaaaguaagacaaguugaaaagugcaggucuuaggguuucuauugcaacaacaaaacaucaugaccuaaaagcaaguuggggaggaaagagguuauuuggcuuacccuccauauuguuguucauuuuguugaaggaagucagaacauaaauuuaaacaggguaggaacguggaggcagaggcugaugaagaggccauggaagaguggggccucuuuuccaugucuugcucagcuugcuuucuuacaguacccaggaccagcaccacuaccccaggaaugacaccacccaaauuggacggggcccugucccucaaucacuagauaagaaauucauuacagauggaucuuuuuggggcauuuugccaguugagcuuccuacuuucagguaauucuagcuugugucaaguuggcacagacuagccagcacaguacacaaagcacagauucagaacaucaugacuucuuguauauggaaauuuuuguguuauuucugaccucaagaaagaauuuuaucagcauccuuuucccucuaagcaugcauuaccuguuauaggcuccagcuuucuccagugauaauaauuguucucacuuauaguaacucucuuuuuuuaugacaacauaauucauuguggccuguuuaugaacuuuauguaguuuagaucaugugguguauguucuuccuuucuuuuccuuccucuuacccuucauuccuacuuuuggacaguuucuugccauguagccagguugaucuugaaaucuugucccucugcccuuucaucucuucauccucaguucugggauuauaacuguauuguaucagacaaccuuuuuuuauuuccaaguaauuuuuugaauuauuagcuguaguucauuaguuuuaacgacucuaugugauauaagaauaaguuauaguuugucuuuuuguuauucguuauuuggguugcuuuuaauuuuaguuuuuaugaucgaggcuucuaugaaucuucuggaaauguuuccuaaggcauagaaauauacuuuccuguugguauagauguagauauacaugacuggcaguguuggagagauggcucagggguuaagagcacuaacugcucucccgaagguccugaguucaaaucccagcuaccacaugguggcucacaaccaucuguaaugagaucugaugccuucuucuggugugucugaagacagcuauagaguacuuacauauaauaauaaauaaaucuuugggcuggagcaagcagagguccugaauucaauuuccagcaaccacaugauggcucacaaccaucuguacagcuacaguguagucauauacauuaaauaaauaaaucuuuaaaaaaaaaaccugcgggcgugguggcgcacgccuuuaaucccagcacuugggaggcagaggcaggcggauuucugaguucgaggccagccuggucuacggagugaguuccaggacagccagggcuacacagagaaacccugucucaaaaauaccaaaaaaaaaaaaaaauaaauaaaaaaaaaccugacuggcuuuagaagaaaacauugcaguuuauaguuauccuucuuggaacaacguuugaauuuuuguucuuccuuagccuucuguagauuuuagcuauuuuuuuagguguaguaucuuguguguuuuguuuuguuuuguuuuccucuugagacagggauucuucuguguaacaaacaaccucgagcuguagaucaagcuggccuugaauguacagguuuugugauuaaaugugugcuacuaugccugguuagcuuguguuuuaaaauugcauuauauuaucugccucccucaagucguugugaaauauguuuguuuuccacucccaucuccucuccucucuuuucucccucuccucuuuuacucuuucuuacucuuuuguuucuccuucucuccuguuuuccauucuuuucuucccucuccagucuguuccuuguuuccccuucccuuccccuccccucccccccuuuccccuaccccuccccccuccucucuccuuccagcuugugggaaccuguaagucccuccucuuucuuuccacccagccauuggccacuggcaucuuuacugauagaucaaaaaccaguugggagcaaggaccuucagaguuaguaaacagauuccccauaagaucaucagaaccaccccucuacacagccccaccaccccccuccuuuuaaauuaagacagaaucuuacucugaagcccugcaugaccuagaacuugguguguauuucauuucagccuggccucaagccucugguuauccuccugcaucugcuucaccaggggugggguuauaggcaugugcuaucaugccuacuuuuggcuuuguuuacccuuuuuuauuuuuuuauuuuuuggacgcaggauuacuauaacugaggcaggccagaauggaucacuaugaagccaagucugucaucaaacucauggaaguucuaccuucaugcuuauaauuccagcacuuguaaggcugaggcagugaauucccagucuuagaucaaugguuguccaagagcacuauauggugaaugaaguucucucagcuuaacuuugaaugccacaaagccaaaauuggucaaaaagaaaggaauaguugcuuauccuaauauauuuuucaguggucaguaggauuguucugugaauacccauaugacagaucacagcugucugcaauucuaguuccaggggaucugauacuuucacacaaaaauaccugcagaugaaacaugaagucacguaaaauaaaaaauaaaguugaaaaaauuaacuugugggcuggagagauggcucagagguuaagagcacggauugcucuuccagaacuccugaguucaguucccagcaaccacaugauggcucacaaccaucuguaauggguuucaauguccucuucuggugugucugaagacagugauaguguacucacauacauaaaauaaauaaaucuuuaaaaaaauuagcguguuugaauccuuaguuuuaguuaauucuccucuccguuuacuucccagucguccuccccccccccccccauuuccugcuuauaccggugcacgcucuauccuuguacuuucauaucacaugcauucuacuauuucucaucucuaaaugucuagucuaacaucuacuacucccagugaccaugugcuagccucuugcuucuucaacuuaaauagacaaaucaaaaugaaaauaguggcuguguauaagaggaaacauuuaaguuucugccuuucugggccuagguuaccucacuuaauauauuuuccaauuccauaaauuuuccugaaaauuuuauaauuccaguuuucuuuauagcuuaagaaaaucucuauuguauaugugagccauauuuuucuuauccacacagcuauugugaauaaaacaucaaugaacauguuugaugugggaauauuaaaaagacuauuuguauccugugcuacgccgggcacuggcagaccacauagcuuuagcuggguggucuccacucaaucucuggccgggagcugcugaaauguuucccuuggccggucauucucaugucagccccaugcaaggaccgcccucccagccgucagcugccacaacacccaguaacccgguagaaacaaaacucuagaaguuaauaauuaaucagucagauuuauauaacaauaaauucucauuucacaggaugcccucacaauaaauucagagucaguugauauugguacaagaugcccaccuagauuagacaaguuacccuaauuauucuuuuuuuuuuaauuauuacauauuuucuucaauuacauuuccaaugcuaucccaaaagucccccacacccuccccccgccccacuccccuauccacccauucccauuuuuuuggcccuggcguuccccuguacuggggcuacccuaauuauucuaucccuauaugauauaaaucuaccuauggcuauuuaaaaccaugcggauuaugaaucaucuugcuuguugcccuccaucuugcuuccuucuccucucuccugagucugucugucugccugucugucugucucucucucucucucucucucugcagcacuuagcuccgccucucuuuucccugucuaaucacaagucuccugcugcacuaauaguaauuggacagggacuauccugccacacauguuuguguggguagcucugcaguagaauucaaaaucuugggggguaugccuaggaaugguauaguugggucaugcagucauucuuuauugauaccuuuuugaguaaacuccacacugauuuuuauaguugauaaaacaguuuacacagacacuaagagaaaucagcauucucucuuccuccacuugccuguauuuguugacauuugguuucuugaugauaaccauucugagugagaugaaguuaaccucaaaguaauuucuugaugacuaaagagguggaacucuuucaaaauauauauacauuugcauaucuugagagcuuuucaguucuauagcccauuauuuggauuguuaucuuuguguguggguauauaugugcacucaugugugcaugcuccuguuaauccuaugccagaauauauggcuccuaaauacuuucucaucguuuuggaaagccucuuuacucuauuaacacuuucuguugcaguaucuauccuuugaauuuuuauuuguugauuuuuuuuaaccuauuuccuaagccacuagaauccuacucagaauguccucagcuaugucuguauuucaaaauauuauuuuucuagaacagugguucucaaucuuccuaaugcugugauucuauaauacaauuccucauguuguggugaccaccaaccauaaauuauuuuuauuuuuguuguuguugcuacaucauaacuguaaauuugcuacuguuaugaaucauaauguagauauuuguuauguggcccucugaaaggguuguuugaccccuaaaggguuccagacccacaggcugagaaucacugcucuaggaacuauagagguucaagucuuuuuuuuuuuuuuuuaaagauuuauuuauuuauuauauguaaguacauauaguaagcuaucuucagacacuccagaagagggagucagaucuuguuacagauggcugugagccaccaugugguugcugggauuugaacucuggaccuucggaagaacagucgggugcucuuacccacugagcaaucucaccagcccgagguucaagucuuauguuauggguuuugaucuauuuggagcugcuuuuuuguuuauuuguggaucgagaaaagcuguaguuuccgauuucugcauguuuguauccagcuuuccugaugcccuuugugaaaagaggcugucauuccuuuacuuaauucuauucucucugucucugucugucucucucucugccugucucucucucucuccugucugucugucugucugucugucugucugucugaggugaguacauaugagcaugugaauucagaugguugaagagccccgaaguggaucagaucuccugcagcuggaguugcaggcaguuguaaccauucauuaugggugcuggaaaccaagccugagcccacccucugggaaaacagcaaucacuuugauccacugcaccauugcuccacccuagaugcugucuuuacuccugaguuuaguuuucaugucuuugucaaaaaucauauagcuguuacuuguuuggguuuuugucugguacaaucacuuaauuacguugauuuaguagccuacuuuugcgauagcauauuucugcuguuuuuauuacuuuuguugugcaauauaaccugaggucagauauacugacaacuguggcauuauucuguuugaucaggauggcuauggcucucugagcuuuuuuauauagccauacaaauuuuaacaauauuuuucucauucuguggggcauuggaauuuuugcuuuuccuucuccagcuuaguaugcauguggugugucuuucauguuugugcagucauaucggugagaauuuauggcuucggauuucacaauagagacucugaccuuuugauuuuuauaguccuucugcccccucuucagcaauguuuucugagccuuauuuguuauacuguuuuguagacgaaaccaacugggacuggucugcacaaaucugcauuuuggugguugugguuuuguaugguguuuccauuuguugcaaagauaaguuuccuuaaugacuguuaaagguaacacuuaucugugggcaugaacacauauguuuauagauuauaguuagggauuauguugauuuaauaaauuauugauuguagauucuaccccaguuuccaugauuuucauuaguacugaguagugguuuccaguuucaagcauggucucucucucuuguugaaugggucuuaaauauaaugagagagcaguugguuacuaccaaguauguguucuacuacuaugucugguaugcugguaauugauguaguucauaggugacagagauggguaggacuguuucuacuucccuccuuuggaaauuucccuucuucugguacuaugaaagcuuguccuuagagaggggucaggauguucagguucauuguagcucagggccucuggccauguuucugaaguguaugaugucuucagcaguagguacuuaccuucuaucucuauuuggcaaccaagggcuaaaguaagaguguguauguuuugggagucucuuagacagcccuggucaacaacacaaaagaaggcuucucauguuuggcauugggguuuuucucagguaguuuugaccuuugaagggaauauuaucagcucaaaagagaaaagcucauuaauauuauauaucuauauuauguauauuuauacauugaauuacaugcauuaagugauuuuuuuucuagguaaguaauuaauaguaugauaucuugugauuuuucucaaccauauuguuauuuaccuaccuucuuccuucuguacuuaucucuauccccuuuucuuaaagugauguuccaucuuucccauuuuccuuauccagucacuuguaucaugcaugccguuccccuuuugccccgucucaccuucuuuuguauuuaccuaccucuuauuccccaacgaacccucgauuuucccauuuuccuuaccagauuucuuauaaugugcuauuuccuucucuauugucccucagauacaguaucuugauaguggucccauuuuacuuuccugguuucuguaguuacuauaggguauguacucacauuagaagauuuggagcugaaaaccuucaguaagagaacacauaccacauuugucuuuugggucuggauuccuuccucaauaugaucuuuucuaguucuauccauuugccugcaguuuuuaugauucuguuuuucuuugcugcuaaauaguaucccauaguguauaggaaccacauuuucauuaucuauuuauuauuuauagaacacuuaggcuguuuccucguccuagguguuauuaaacauaacauucgccuuugaacauggcugaacaaguaucugugcaguaugauguugaguccuuuggauguaagcuaauaugugggccauauaguaagauuuugagcuuuuuggagaauuuuuuuuaauaacaauuuccauagagacaauaccaguuugcaauuccacccguagugaauggggucccucuuccucacucuuuaacauuuguugucuguuguuccacugaucauugccauucugaauggucuacaaugaagucuuauuuauuuauuuauuuauuuauuuauuuuaauuuaauuuauuuaugugaguacacuguagcucucucagacacaccagaagagggcaucagaucuuauuacagaugguugugagccacuaugugguugcuggaaauugaacucaggaccucuggaagagcaguuaguguucuuaaccgcugagccaucucuccagccuccuaaaaugaagucuuaaaguaguauuguuuuacauuuuuauaaugucuagggaaugaugcacguauuuagagauauuuugguauguucuucacuuucaucuaauucuagguauauuguuguuuguuuuuaguuuucuugauuuucuuaguggcuccauuucauuacugaguaaugugauguuuacuauccaugacuuugugaauuuucuguguuuuuucuuggaauugauuucuagcuauauuccauuauauucagaauauaagaaauuauuuuaauuuuuuucuuauuuguugagacuugcuuguauucuauuguaugaucuauuuuaaagaaaauuccacaggaucuugagaggauguuuuucuggaguguuugauugccauguuucauagauguuuguuaaauacauuggaucugugaugccauugaauuccacgacuuuagggcuggagagauggcucagugguuaggagcauugauugaucuuccagaggcacugaauucaauucccaacaaccacacgguggcucacaaccaucuguaaugacaucugauacccucaucugguaugcaugaagacagcuacaguguacucauaaaauaaauaaacagaucuuuaaaaaaaaauuccaauacuucucugguuuuuguuagaauggcauguuuauugauagagcauuuugauagugaaaccaugaaguauuacuguguuaggauuaaucuuuauauuuaguuguauuuuauguuuaggauuauuauguccucaauagauuguuucuguaauaaauaugaaguaaauucucguaucuuucugggccaguuuuaaguguaagucuaauuuugucaggcauuuaaauagagacaccugcuuauuccuuaguucuaucuauuugcauucuaagaaugaccuuuucuauccucucacuguuagggucaugucugucauuucugguucuccagugauaaauggauggaugcuguuuguuugucugccugucuuucuuuucucuucccuucucuucccuucucuucccuuuccuucccccuucccccuccccuccccuccccuccccuccccucuucucuucucuucucuucucuucucuucucuucucuucucuucucuucucuucucuucuuccuuacuuccuuguuaguuuuaaaagcuacucuauaucuuuugauuaaagcuaauuaauacucagaauuauugaaagguauauuccuuuuauuuuguuguuuuuguaguguuugcuguuucucuaaugcuucuuuguuucacaaauauguuacuuuucucccucauguagcuauuagaugucuuuaucauucuuuugaauaugaagaauuccuuauaguauccucuguagagcuggcgugauguacauuaguuuuuauaaugaacuauuuuaauuucucccucagucaugauagacagaauugcuacauauuguagucuggguuggcacuugugguauucuagaauguucaaugcauaugaccuucuggcuuuuaaauuuuaguugagggguuauuuguuauucugaugguccugccuuuguaugugauuugaugguuuucuauuguagcucuuauacacaucccuuguucaauauauuuaguguuuuaacuauggauaugucauguggguuuugguuucuuguuccaguugcuuuuuaaaauaccuuuuauauguggaugagcccuuguuucuuagguuugagguuuuauuuauuuauuuauuuauuuauuuauugauuguuacaauuaucuuaaaaugcucuauccuuuuggaauaaauuaacuucuuagagucaugcccuucauccuuugaguuuugcccuuguccauuuuucuacuucagacuucugaggguuggaccuaggacuucacacaugcuaggcaaaugugcuacacugcaccucaucuccagguguuugcaugaugccuacaagaguuuccuguucugucauguuauaaaaauuuuauuauuuucuuucaguguaccaauuccucuaccucuuccuaaaacauuuucacuugacuuuauugaaauuuuuauuuuuaccaucauuucauuugguguuucuucaauauuugucuuuauugaauuccauucuuauauccuguauugaccuccuuuuuuuauucaguugucuuuuuucccuuguaguuuauucauaucaccuuucauuucuuuuuuucuuuuuuuaaagacuuauuuguuugcuuauuuaauguaugcgaguacacuguagcugacuugagacacaccagaagaaggcauuggaucccauuacagaugguugugagucaccaugugguugcugagaauugaacucaggaccucuggaagagcaguuugugcucuuagacacugagcugucucuccagccccccauccuucauuucuuaaacauacuuuucauucuuuugaguuauuuguccaggaucuuuacugaucuucucuuaucaggcaggggacauuauuuuggaauuaguagacuuuagagaagucauaagguauuuuguguucuguuuuguauugggauuuguaccuuagaaguuaguuuuuuugacccucccacccccauauuacagcaucuguaaugcuucauaggaauuaagucguaguggcuuuuugguauuguuuucuuuuguuagacuuguauucaggccauaauggucuguucccagccguucugugcaacaacaguagauucacaaugaaauagagucuuagucaauuacacaaagucaucaccuaagcacuaaucgcuccuuggacuaaagggauauugguaguucugugucuauuacuauauuaguuauuguguguuugaauggaaucaaaagaaaauagaaagaaggaagccaacacugguaggauagugauucgcuuugucaugauagagaccaaacaggagaggaagacauaaauaggauaagggauugcagcaaaugucaugggaugagagaugcuugacuagcagacuggagagaaguaaagcuaugcugacugauaguauggggcaguugcauuuuucaggagccccaccacuaguuucuugggagcguaaagaaauaaaaggaaugaacgaacaaggagggagggauguagaaaucaaaaaagaaaagagaagaaagaagaagcaauacagagcaagaacagaauaaggcugagguggcuugaugaaguaauauucggauauuaaauaggugcuagagaaagagagaaagaaagccuagaagaguugaaguuuaaggaaacugacuagccugauuuguuaggagcauuagcuggucccccccgccccccaccccagaacugaggacugaacccagggccuuucgcuugcuauaggcaagcacucuaccacugagcuaaacccccaaccccagacuagacugauuuguggucucaggauucuuguauuuuuccuaucugcugggaguggucugugaugucuuugugauuguucauauuggaucuaacuuugggaauucagauuacucauauccugauguauguguauuacuuuguagauggaguuucauauauagucaaaugucugaauuucuuucuaggcaucgcauugccaauguucuccacaucccuaugcagccuuaggcaguauucugcaagaugauugccaucugggugaauguugcucuuguauacuuugguuuuggccagauuaucgauuacugauuuguuaaaugcuguucagaucuggcucaguuuguccacccccuaucccccuguaguuuugcaguauugucuguaaaguuuccuauguagucccauaacccuuggucucagaguccugagacucugauuccgagagguucucaggcugcaacggcaccacuguaucaaaagcucuuuuuaaauggucucuugcuuuuguuuucucaaaugccaguguugagugagcaggaaugggaaugggaugcuuguauuaauggcuuauuugacaguauuuaucuguuuuaaaugauuacuuucugcuucaguaccucaagaagaggugagcuaguucuuaauuuccccaaaagaaaguaaaguccugugaugcauauguuauuuuaaagaucuacaaggucuauauguagauguauaaaaguuagcuagguaugcugacacacaaggaagcaggcagaucucuggugaguucuaggcuagcuacauagcuacaaagauagccagugcuacacauaaugauacucugucuugaaaacagcaaccaaaaaaaucaaaccagucaacgaaucaaacagcaaaacccuauagcgauuauuucuuugagguuuaaaauagcauuuuuucuuuugguguaugugugugugugugugugugugugugugugugugugugugagacaugugcauggcacuggguguguugaagacagggugcaggagcuaguucuuccuuucuagcauuugcuucucggggacagguccugacacuuggggacacucacuauuguuuuuaaauaauuuauuauuuucuuuuauuguuacuuuaaaaagaaguagacugcauguuugugaguguguccaugaauguucuuuuuggauuuagcuauuucuaaauuuugaugcaccauucuuuuaauacaauauaaaacaaaaugaaacaccaagaaaacccagagacccaaaguauuacauuacugaauuucaaaguauuggaaagaauuuuccuuuacuuuuuaaaaaaaguguaaauuauacauggaucagaguugacuuucuggcuuuugcuuggccacauuacuuaagaaacagagccagcccugguuagagguguuuuuuuuucuuuugagacaggguuucucuguguagcccuggcuauccuggaacucacucuguaaaccaggcuggccuccaauucagagauccacccgccugccucugccuccgccucccaagugcugggaucaaaggccacugcccggccugguuagagauuuuaacuuuacuuggauaaucccuagcuuuuuaggcaugaacuuugggauccugagcaagugaugccuuucuuacagugcuuucagaugaaauggcuuuugaggacacaugccacuuuauuaggagagaaugagaugacaugauuaaaaaauuguaauauuguauguucugucuuauucacuugacaaaauucaucaccacuugugauaauaguacagaagggcaauguagaaauccaugggcuuuaaugauagucuguaguguaaucugauaacagaaaauuuauuuuauaguuguccuuguaaauagaaguccugccuaacaucuagcuguuuauaauuuuucuucugucugucaaaguuugaccaagccaugagaagugcuugauuagcagucauugcuuaggaaaaugcauguauuauuuuuaggaacuauuucacugucuuguauucaauaagaucuuguucugugaguugccuagauggaaaguuugacauguaauggaacucaguagauagucuuaugauuuuuuauaacuuauuuuauuucucguguaugaguguuuugcucacauauauguccaugaacuacauguaugccuggugccuggugaccauggagaccagaaagggcauucaauuccccugaaacuggaguuaacagauuguugugaaucaccaugugagugcuaggaauugaacccagguccuggggacgagcauuuacugcucauaaaugcugagccgucucuccaaucuuacuuuucugcuuuuaaauaaacuuuuaaaagcacaaacucuuugugggcaauauauuuuaauauuuauauacaaugaugaauauucuacacugcccaugcagccagcaaucaggacauagaaauagugcucgcugaugugcuuuuuguaggcugccuuucuauuggaaucccaucacuuucaguuagccugaauugcaugcugauugaacuugagcaccaccccaugcuugcucauucucucucucucucucucucucucucucucucucucucucucucucuuccucucuuucucucuuucucucccgccccccucccaucauucauucacauacacacucuuuuuggguguccagugcuuuaagccuaguauccauaucuaagugauuacuaugcauguccuuuugggucuggguuaccucauugaggaugacauuuucuagcuccagguguccuugugguauuguggagcaucuuuugguguaugccuagcgggguguaggugguuugggagguggugcucaggcuagcaggcugcagcagcacuaaggaaguuuggcuagacuggcauggagaacaugaaggagaaucuaauucccucacaugaguuucagccuagucuggcagcugugggucccugguagagagauucauguggggcagcacaguaaaaaagagcugaaggucggcuagaagggaagaaugaauggggcuuucagaagaaugggccgaucuuggguaugcacuaagaugcuuggugcaucauugcaccauuaggagcuggagauggaucgugaaguaauguuucugugcguagagugcaguuggacuaaggauccugaggugacuuguugucaccuaagaauuucagugaaagaguuuguuucuuauuccuauggucuuucagauuaaaaugguucucauaauuaugaugcucguuuauuaauuuagauuaguuauaucuguaaagauuuuuuuaaaagauuuauuuauuauuauacauaaguacaguguagcugacuucagacgcaccagaagagggugucagauuucauuacagaugguugugagccacuaugugguugcugggauuugaacucaggaucuuuggaagugcagucagugcucuuacccgcucagccaucucuccagcccccuguaaagauuuucaaauagguuucuuacuaaaguguauggacugaaguuaaguuggacuuaaguuaagaaauaggauacuauaaauacaagagaaaaaucuauguaauuuuauugaacuuuuaugaggucuccuaaaauuaaaucugcauuuuuaaaguucccagcauaggccuucaguuguagauagaacaguuauuuagggaacuaaaauguuuaaauacuuucuucuucuucuucuuuuuuuaacuacuucaucacuauuuuuucuuacacaauagugcuaggaaaugggauuagcuuauuaagcaaagaauuauuuaaagaguaaaaugaaaacagaacaagccuagaggguuuuaguguaaaagagaaauugguaagagugaccauuuguaaggcuguuuuaguacuauaguuauuagggggcccuuuuaggucauagagaauauuuuauucucuuuguuaaaggacugugugcggauugaaauggauuuuauaguugucuuguaaacugacauauaugcgcccaauguuggauauuagacuuugacuaugaguaaaguauuggggguugacaauauaguuugcuaaaacauucuacauaguuguguauuacaguaaauuaguuacugauugguaaauucucuuaaacucagaauauuucccuauuuuaaaauguuuuuaguauuguuuugucuuuaugagacaacacauuauguagcuaaggcuggccuuaaauuugcuauguagcuuaguugaacucguccuccuggcugcaguuuccaaaguuuugaaauuauacacauuuacuaccauuccagcuaccuuuaaugaaaaccaacaaacaacaacaacaaacucccccuuaguuuuacugacagucauucuaauuauuucuuuucuuuaucaccagcucuaugggcuauuccaguaauuuugccagaguuuagaugaguuguuaaaugcugacguuauguauauuuuaucaauauaugcuauaauauaugcuauuauugcuuuuugaggacuagucuuagcgcagggucuaugauuuggaaaacuugaauuuuuuuuuccaguagcacgaaauuuguaggacacaguggaucacaugcuacaguaaaauggacacgaccaagggagaaggagguguuuuuugcuguugauuuccuaagauuauguuucauguugaacagggccucgaaacuauugggcaaacaugaaacaaacuaaaaauuucagccccugaauguaaauacaugccaauuaucaguaucauauuucagauuaucugcauuaaacuaggauuauuacuauuucuuaauuucacugagaaucaugcaguuguuggauauaauuuuaccuuuauaauuauauauaaaaauauguugauaguaauuuuagaauaauuuuaauaauaauuuaauguaacuuuugaauauguucuauauuuuccauuauuaaaugauaaaauacacaguauaguaguauuugauaaauagcuauuugauuaguaaguacuauuuuuuauuuccuaacaccugcuuuugcuuuuucucucccugucuugucucuaggguguggaugaauggaauauagcucgccuaaauacagucuuggaugugguugaagaagagugugguauuucuauugaggggguaaauaccccuuaucucuauuuuggaauguggaaaacaacauuugcguggcacacggaggacauggaucucuacaguauuaauuaucuccacuuuggggagcccaagucuuggcaagucacuuguuuaauauucacacccauuagaguugagaaucauugauuguuguucauuauugaugagaauuuacuucuuuuauagagugaguguaaggaaguuuuggguuguaaucuuauaauuauucuuuccugccucugcaauuuaauauauuuuuaagaauaacuauuuaugccguguagugguggcacaugccuuuaauucuagcauguggggaggcagaagcaggaagauuucugaguuggaggccagccuggacuacagaguaagguccaggacagccagggcuacagagagaaaaaaaacaaaacaaaaaaagaauuauucauuucuggucauauuuggaaguugggucagauguggcagugucugcugcugauuaucuaugaauaguguuguugacaguaagccugcauuagggagugggaagguuaucuggauaucuaacaccugaaaauuuaguuuauuuuaucuguugaguauuuuggaguugauauuaggaaggaaagguuuucauuaaauuaaaaaaaaaugucaacuaauacuucauaaugacccuuucaugaaaaaguauuguuagauauauagaaaguauuaaaaaggcugagaagugugagaucuaauuucuugaagauaaauuuuguguauuuauuaugucacuagcuuuuauauuaaugauuucagacacaagcauuuuuauguguuugauugcccaggauauaaauuuucauagaaguggcuacugaaccuuauuuagaauccuggauugaacagaauauauuuuuggugauuaauuuucuucacugugccugucugcuuaugcaucuuacuguuggaauuuuuuaaacucagagguuguauagggauauuggugaggccauguuggguuuuuccucaggacuugucauguauuauacuuucaggcucagcuuaaguaccuuauuccuugccauauuuauagaugucuagccauuucauuuucaggucugcuauuuccugcaaagauguuauguucauuguuauuauuacagcucagaugguaggaaagauuguuuugaguuuugugugcccuauaguuucaggguagucucccaggagugauaccucugagaagaaaggaagguugcacuagucauaagcauuaagcaguguuggaguccugggaagauucuauagacagaugugaagcugccaaaauucuucagaauggcuuaggaugagacaaugggaucuggccuuuauacucaaguugucccacacauugcacauggggcucauccuuccucagggacuguauuauauuauuuuagacggaaugugagcuuggaucucagugaugugaagugaggagcuuguaagagaacaucguuuggggguuggaaagauggcucagugguuaagaguacugacugcucuuccagagguccugaauucaauucccagaaaccacaugguggcucacaauuaucuauaguggggccuggugcccuccucuggugugucuucagauaacuauagacuacucauauaauaaaaauaaauuugaaacuauaacaaucacaucuauggaauguauaguuguucaguuuugcuuuugauauaauuuauuagggauaugcuauaauuauuauauuauaaaugaaauauacuuaaaucuuauaaaaaguaguauuaaguauuuuacuuuuugacucauguuuuugugaugagaaauaagaaacaccaauucuuucaaauuaaugcucccuuuaggaaguagauugauggcuuucuuuguuguucuuugauuaauuuaaaggugaauguguccuugaaagaguuacagguuccuuaaccuggucacaucuuuccuauugucuccuucacagugauccuugggauauaguaguggaacaugaagcugggaauggcucucagacagauuuguguagggaaccagcuauuucauccuuuguguuucaucugaagugaugacccugugccuggacuuucucauuuauaacaugcagacaauagaaaacauauuacugugucagcacaugcuguuguguuguaaauacugaauaaauguuagcugugguagacugcaauccuauuuaauuggucgacucuugugccuuucagccguuucugaacuguagagcauaagucauacauacaaguuugugguuguaaaaguggagaacgucaugguaggaugaacuacuacaaauugaccauaaaaucuuugguuugauuuauaggcuaugacuaugaguaaaauaucacuuagcagaacuauaaauaaaggagcuagggagaagaagagagggcaccuguauuaguuaggguuuuauugcugugaacagacaccaugaccaaggcaaguuuuauuaaaaaaaaacauuuaauuggggcuggcuuacagauucagagguucaguccauuaucaccaaggcaguaaguauccaggcaggcauggcgcaggaggagcugggaguucuaugucuucauccaaaggcugcuaguggaagacugacuuccaggcaacuagggugaggaucuuauacccacacccacagugacacacccauuccaaccaggucacaccuauuccaacaaggccacaccuucagauggugccacucccugguccaaggauauacaaaccaucacagcaccucuuccuguuuuaggucuuuauuaaccuggaagggguucuuuguggccuuugacacuacauguggguagaagcugucccugauagaaauaccagcagugcuuaugaguaugagagagcaguggugacugccagugguagcagugacagaguucuggauagggaaagaguguuucuaaguaaauuauugagaguucuaggacaauuaacaacacuaaggagauaccgaaggacuaaccugaagcaaagaagccauugaaugagcaggacuaguuaacaagcaaguggucugaagguagcuuuuaaggacgcauaagaaggacacuucacagaaaauuggagccagcagcggguggaguuauauaguauguuuuggaaaauuuagcuuuuucugccaagaacuugcaauggcagucuaauaccguucaguuaaaacuguaaauuuuguuucuguuuuccagcuuauuugguugauaagauuuuaagucccuuguuuuuuuguuuuguuuuguuuuguuuuguuuuguuuuguuuuguuuuuugagacagauuucuacauugacagcccagaaagucucuauguagaccaggcuggcauugaucucacacagaucugccugccucugucucccagguguugggauaaaagaugugcaccaccaguacucucagugagucuagcuuuuuuuuuuuuaauaaacauuaguuuuuuagcguuuuguuuuguacaguguguuuugacuauaugcacucuuccuucccuagaucuuaccagauauauuccuuccauucauuccccaacuuggaguccccuacccuacucccuccaggucaauuugugcugcugagcuauuuuuggaugaguggucauuuacugaaacauggaguuaucauagaaaauuaaucuuuucuuucccagcagcucagaguugccaauagcuucucagcccaacuccccuuuccacggagggguuugauuuggggcuguuagaagcacugcgaauuuguauguguagcuauccugcaaugugcagacaacacugguuucuucucacucuuacagucucuuucaucuuucacacuaugugcagacucaugucaucugcauauaaggauacuuggauuucuuucuuucucauuuguaucuucucuaccuccuucacuugaccuaguguguuagcuaacacuggaaguacugugccuggggugcgugcaaaugguguuaaauuccuaguauugacugaaaaugaaaacauaacauuucaaaaucucugaaggaaauacaaaugaaaacagucaccagaugaaauuuuguaaaacuaugucccuauauuaagaauagucaaaggucucaaauuaauaacuuaacaugcaccaaaaggccagggaagaacaagaaucauaacaccuccuaaaaguagaugagaagugcuaaucacaauuaaguaaugaaauagaaacaaacaguagcaaaacaaaaauguaauuuuugaguugguucuuugauaagaugaagauugacaaucuuuuauucaaauuaacugaagaaauucaaucuaguuaaauaaaauuauaaguuaaagaggaaacauuauagcagauaccauggaaacucagacaguccuaaggaagaagaaauggauaaauuucuugguaaaugauauaccaauguuguuaucgcuggggcaucugcgcuuuucugaguggaaauggaggaacagugggucuggggaagagguugugauggaguggcacugagaggaauaggaggcagcagacagagugagggacacuguggcaaggauguuuuguaugagagaagaauaaaacaauaaaaucucaaaagauagaauguucuguaaugugagguagugacaaguauuaugauccaaaguaagcuaauaaguggaaaaggaaaaaaaaugaacucaaguauagaauucuuccuauccauuaaaggaccauuaaccauuaauauuuuugaaacuauuacaguaaauaguaaaagaaguaacauuuccaauuuuuucccaaagccauuauccuaucaaaaccucacaaauaucuaauaaaaaauaagaauaaaacugugggccauuuucguugaugagcacagauguaaaacuugucaauaaaauacuuacaaacugaauucaugaacacaucaaaaaauacuacugugauaaaguuaccuucauccuagagauuuaggguugguucaacauauguaaaauaguaauuguaauuuacaacauaaauagauuaaaugauagaaacuacaugaucaucuugcuaaaugcagaaaaguccucagaauacauuaucucuaugauaaaaguucugagaaaacagggauguagggaacaucucucaacauaaaggcaguauacaacaaacucagcaaacaucguugaaaauggggaaaauccuuaaaguauugacuaaaauuuucauauauacauauuuuuuggaacaaaucacucagagauauacuuacaaaggauuguguuuucuugaccuugaaaauaagaaaaauuuaaaacaaagauauuggauuaaaaugaaaauguacuauuuaguaucuaaucauugcuaccuuuaaaggaauuguaccuguaauaucuaaugagugugcuucccucauuagggagacacauuuuguucauguaagcacagaucuugccaguagucuuuacagcaggacaaugaaauugucuuucagaauucauuuuuaccuuguacuuugcugacuguuaucauagaauugcuaucaauaugaagaauuagcuuuacugggaacuauuucauuuuucuuucugggcaauaguguuaaggaauuuuuuacccuuuaaugauuucagagaauauugaauauguuggauuaaccauaggacauuuauuugagucgauuuguaauuauaugaauuggguuuucuggaaaguucagaaauagaccaaaacauuauucuaaacauaaaaagaaaagcagacccaauuaaauagauaaucuguccacuauacugcauuauuuagaaguuugggcuaguaaggucacacagguaauguggcagaagaauaucuaaugagagugauuuauauacuagaaguaaauugaggaucagaugugggauagaacaauguuaacuuucuauuuucuuaacaaaugaaugcacuugcuuuuucugugaacugaugauuacauuuaaaauggagggaauuuaaccuugccaguugcuuagaguaauauggguauauaacuaucucuucacauccagcucauuuugugcagccagauggugugugugugugugugugucuguuucugugucuuugucuguguguaugcacauuugugauguuaugaagagggaaucaccuugaaugggauacacccacaauuuuuucuuuucugaguguauuccugguauaaaccaauaagaaaaauacgacaagaacuuaccuuaaacguugauuauuuucauuuccuuaugcuaaaauuuuaucucuccccaauucaguugguagaauuuaaauagcaguauuuuaagggacagaacauaugguugaacuuucauucagagaauugcuuaguuacaucaaaaucaaauacauuuugaguacagaugcuauuaaauacaaccaaaugugcuacuagguaugcuuagaaaauuguaucagcaaaaaggaauuuguauuuauaauauacugugcuaguaagcaggaagucuucauguuuaaaagcaguauaucaucucaccuaacucauucaaugauuauuagauaugcuuguaauauauguacuguuugguuuuugugugucaacuugauacaaacuagagucauuagaaaggaagaggccuccagcucuaaggcauuuucucaauuaauagucaauagaggaguguccagaucaagguggguagcaccauuccugcagugauguuccgaguucuauauuaaagcaagcugaggccgggcagugguggcgcacaccuuuaaucucagcacuagggaggcagaggcagguggauuucugaguuugaggccagccuggucuacagagugaguuccaggacagccagggcuacacagagaaacccugugucaaaaacccaaaaacccaaaaaaaaaaaaaaaaaaaaaaaaaaaaaaaaaaaagagaaggaaaagcaagcaagcaagcugagaaaguggggggugggggugagggggaagggaagcaagccaguaagcagcaugucccuguggccucugcauaagcuccugucuccagguuccugcaguguuuauguuccuauccagacuucuuuggugaugaacagcaacgagaaaauguaagcugaauaaaugcuuuuuuccccaacuugcuuuuuuggucauaauguuuugucauaguaauaaaaaaaaaaaaacccaacuaagacaauaucuaaaguuuuuauugaaggaccuuuaagauuuaguuuuguacuaaaauuuucaguucaaaauucagcaaauaauucauuuacuucauguuugaaagcacuacuauaguguuucucaacuuguuuguugugacacauuugguaaaccucuaucuugagcaauacuuacauuacaauucguaacaguagcaaaauuacaguugugaaguagcacugcacaugauuuuaucgucggggggaccggucaccacagcaaugaagaacuauuagagucacaguguuaggaaggcugagagucacugcacuuggaacuuuaaaugaauauuucuuuucuuuagggcaaacaaaucuauaaucaggauuuuaaaagucauauacccacaaaauaaauaaauagaagcaagcuacauuuaagagacaacaacuagguucaugagauggcugacuggauagaugcuugccacuaagucugaaaagcuaagcuugauccccagaaacuaacucaguagaaggagagaaucaacccuuacuguauccugugaccuucauaauacacaugcaugccauacacauacacauacacauacaugcaugcacauauauacauaugcauccacaauacauaugauaaagauguacaaauagauaguaaccaauauuuucuacgaaauaauacccaaacucaccagcuucuaaacaaauaagaauaccuauguccagaaauagcuacacuacauaggaauguugugguuaguggguagucuccaggcuuagacaaggaaggguucaguagucuugaacaucuguucuguaagcuuuaaauuauaggugauuugugacauuuaaguaggaaguuuaugcucauuuuucuucauuucuaugucuaagggacaggcuuuuuuuuuuuuuuuaaguuuuuuuuuuuuuuuuuuuuuauuuuauaugaguacacuguagcugucagacacaccagaagagggcaucagaucccauuacagaugguuaugagccaccaugugccaugugguugcugggauuugaacucaggaccuuuggaagagcagucagugcucuuaaccacugagccaucucuccagccagggacaggcuuuuaauauucuuguuuccuaguucauuuaagugcaguucaguuuuuguaaaugaagauauuuaaauacucuucauaagcuagcuaaaauauuauaaacauaauuuuuuuuuuuuauucuuaacauuuuagguaugcuauaccuccggagcauggaaagcgacuugaaagacuagcccaagguaauacuugcuuucaauuucuuacaucguaggcuuuguguuuugagguaguucagcagcuugcuuauuuauuuauuuauuuauuuauaucuucuucaaacugcuagcuuuuaaauguuaaccuaauugaacaauauuauuuauuuucacauuaguagguaauguuucuucuguuguauagucuucauaaugaguuuagcugacucuuaauauuucacugggcaguuggcauuucaauauauuguaccuauucuuaacuuucuuuucuuucuuaaacacugcugaaauuuaucuuguuugcuggccacccuuccucuaaagaugucagcuggacaggaacuauuuguaauaacaauuagaguugaauuugagugauaacugguagcaagcaucuugcuuuaucagaacucacuauugaaugaguagaacacuucugcucaugcauugguauauguuauguuaugguuuauuaaaaugaugaagaaaguuuuccuucuauguaccauauauauucacuuaaaaaaugaagugugagggcuggcugauuaagagcacuggcuauucuuccagaguuccuaaguucaauucccuguacccacaugguagaucacacaacuucuauaauccuagucccauguggucugauacuuucuuuuagcaugcagaugaaccugaaagagaggggugggggauguguguguguauauacauguguacacacacacacacacacacacacacacacacacacacacacacacacacauacaguacauuaacaaauaaaucauuagguuuggagagauuucucagcgauuaagagcagugacugcgcuuucaaagguccugaguuuaguucucaucaaccacaugguggcucaccacuaucuguaaugggauccuaugcccgcuuuuggugugucugaagacagcaacaguguacucauauaaauaaaauaaauaaauaaauaaaaugaaaugagggcauugauaaaccucauuggccugaaaguuugaccagaaauuauuaauggcaucuacgauuuuuccccuucccccaauuauaggaaauuauuaaaaguggucauaggaucaccuuuauaagacacagugcuauaauuuuggcaggacaguguuuauuauauuacaguaauaagaguaguucaauugugagugugaauuuaaggauuauuuucaagaauacugaaguaauugaauacuguuuaggguaauagauuagaguagaauguuaugauuauuauauauucagaaugugaagguaguguacucuguguuaaaacuaaauguguuaaaacuagcuauucuuuucuguaauaaguccuacaacauuuaaauuaaccucaucacuaaagaacguuaagaggaaguaaggucagcuuuguggcgcaggcucaaacacugaaguuuauccugugaacuaugauagaugacaucccagggagguaaaggaggaccaagguuuuaaucaacagagagguaaaacugcuuacaguauuuugagaaaggaaacaaacgaaaaaguccuauaagacagugaaagauuuguaucuguugugcagauaccagccagauaauuacaaugauaaaauagugcaguacauaugauagacuguacacuguaucuacaucaaagcaguguaggaaacaugaaaugaaaaacagguugagauauuuucccuuaucuugccuuuacaguguaaccauugcagccaccuuuuaugcacaggugcauucgcuuuugauuuccaaugaaaucuugcuugauuguggcauuuaugaauauuuuaucucagaacucuaaggccuguauuugauacuuaugaauauuuuaucugaaagauaucaggcuuguauuuaacaaaaccaggaauuugaauuugccuuucaguugcuuuuucauuuuuuaaaauuuguguguguauguagguguauauagguauagaacuuuaccauccuuuaguaguuuucuaauuuaaguuaaauuauguuuuccuauuguucauguccugauuacaaauccaccucagaugcaaauuaauggacacuuuuuucuucaguaauuuuaacauaaaauuuaguucaaaauauagugcugcacaaaguuacagauuuggaaagcuucccagauguauucagauuuuguuauuaacauuguuggcuggguucugaauuugaugaccagguagcugcagcugggugccuuccugucuccuuugagaaggcuuagggcauuuaauuguacacauuuaaucuuuauaccguacaacuuucacuuccuauccauuaaaguuucauuuaguguuuauauuuuaugauuauuaaucauccuuagauugcuaugaaaaugaccccacagggcaaaguuacauuuuuauuuguguuagucuuguaaagagugguaguauuccuaaugucuccauagagaacugauuuugcaaacucccccucugucccuuuucuauuuuuaaacaggugaagaugcuuacccagaauguacuuaagaaaaaaacuuuauuuuuuaaaaaugaaucaugugucugucugucuaugacauguaugagucagugaagguaccucuggaaacuggaaaagaccaucagaguccuaguagcuaaaguuacagguggcugugggccuccuaggauggugcuaagaacugggcucacgucuugaaagaacacuaggcuuuuaacugcugagccaaccauuuagaguacaauacuuuuuucuaccaagcuguuccuuaaauuccuuugucugcauacuagcuauugugugcucgugcacuucucucucucucucucucucucucucucucucucuccugagcacuguagcauaaacaaccauuucaauuaucuaaaaguuucugugaauuuauucuacaccauuaugaugauucgugauuaaucauuuauaucuaccuugcuguccagaggccuuguguggauaaggauaucugaaaucaaucuaacucaaacauacuuuuuuuuucuaauuaauugaguucuaaugaguuuuucauuaagguacccuacuccgaguuguguguagagcacuaggcaagccuucucuucauuuuagauaugaggucacauaguaccucuacuucuaccacauuccuggaguccacacuccaucauuccuggagucuucuuguuuccucuuucauguuccucuaucuucucuuuguccuuuucauugugacuuguuuuccacucucugagauuucucauccuuugaaggagaaagggcugaauaaaacaucaaauaugccaguuuucauuuuccucucccuguaucaccaaggugaugauaacaugccucagcuagauugaaagcagugauggagaaaaucgaccaugaacuaaagcacaauacacugcugagugaacauuuaauacauugaggaaucaaagauuuccuuaauguuuagcguccucucuuaaaagcucccaaaauaggcuuguaaggcaaguuuccaaucaugugugcuagguuuacucagaugggauuuuuuuuuuaaauuuagauuauuuuauuuauguguaugaauguuugcuugcauauauguaugaaugugcaccauguguauucuuggugcuguggaggucagaagauggcaucagauccuuuggaacaugaguucuaggugguugugagccaccguguuggggcugggaaacaaaccuugguccucugcaagaacagcaagugcacuuaacaguuuaucccucucugcagccucugaaguauuauuucaaauugauauguaguaauuaugaauguuuuuaugguauaguaugauauuuucaaaugcuuauaccaugcuuggaaggggaaaucuaucauuuaagagcuacaucacuuuuuucauguuagacauauuaaaauccugucuguguuggggcuggagaaauggcucaguggauaagagcacugacucuucuuccuaagguccugaguucaauucccagcaaccacaaggugguucacaaccaacuguaaugggaguugaugcucucuucuccugugucugaagacagcuacaguguacucauauacauaaaauaaguaaaaucuaaaaaaaaaaaaaaccauaaaauucugucugugacuuugaaauaauuuaguuaauuguugccaaacauaguuauuguaggauauuguaaguuagucguuguuagugugaaauacgcaggaagauaagaaaguguuuggugcauauagugucucaggcuuuuggaacuggugcuuucagaauaguuaguucucagagucuccacugagggauuggcuaguacggguguucuuaaucucacuuucgacuugaacaggaaguuugaacaguuacuugcuguauauuuggcaacuguauuucaauuacgugccaaauugaaauucuuaaaauuaagugauuuuguauguacaaauguaauucuggguaaauaguuuugaaaagaucaaccuuuuugacauauauauauuaccuuuuaaggauuaguacuugggcugauuuuuagucauuguucuaaggacauuagaauugaaguguguuuuccaaccauaugaaauguuguuuuagcugacugcauuucugcugcuccuuaggcuucuuccccaguagcucccaaggcugugaugcauuucuccggcacaagaugacccucauuucccccucagugcugaagaaguauggcauucccuucgacaagguuagcggcucuccgacuuuacaaguccauugcucauaucauaggauuuguauuuaagaaaaguucaaaauggcaaaacguggucuuggauuauuaaauaauacuuaugacgggugaagagaaauuuaaacuccuauaacaucaauaauuaauuuaaaucguaauuaaauauuuuaaaauguuuuacucagguuuauauauguuuaauuuuuguuggaguauuucauacauaaauauaauaugcacccacuauucuucccauccagauuuuucccuaccccauggucacuuuuuucuccaaacagaauaaugcccuuccuuccuucuuccuuccuuccuucauuccucucucucucucucucuuucucucucucucucucuuccuuccuuccuuccuuccuuccuuccuuccuuccuuccuuccuuucuuucuuucuuucuaaacucacagugucuauuuaguaauacuuacaugugcauggcuguagaaccauguaucagaggaugaauacauucuugggggcccacaguuaaaauaaaaaaccaaaaaacuaaaaacaaaacaaaacagcagacaucaguugccaguagcucuuaugguagaacuucaugaucuccuuuuccauccauacugauuugguggcuugaaugaucuuguacaguuuuuguauauauaauuacagcugcucugagcucauguaugaaaugguauugucaugaauggcagauagguuuuucucgagauaucugcuaucucuggcucuuucuguccucucuuccauaaugauucucaagcuuugcggggaggggauaugguauggauacucugagcugacucagucaagucaguacaagucagugauggugucccuggaagccagaagaggccaucagauuccccacauagaguuaacaggugguugugggucccgcagcauggugcuaagaacuugacucagguccucugaaagaguagcauuuuauuuauagcacauuuucuauacacauuuuuagguugguggguaucuaggcugcuuuuuuucccuaggcauuaugaauaccacagcaaggaacagggaggaacaaauauuucuguaguaagcuauagauuccauugaggauauaccagauaugcuguaacuggguugugucauauaucuauuucuagcuuuuugaguuacuuccuuacugauuuucauauucgcuucuaccagcuuauacuuuuuccaaagugcauaaagauauuucuuuccucacagcauggcagauuuguugucauuaauggagguaagaugaguuucaaacuaguuucaguuuucauuucuuugauggguaaggauguuagacuuuuaaaaaauaaaauauuucacagucauuuuuacuuuuuuuuuuuuuugagaacucuguuuacuuucacgugccaguuuuuguuuuuuguucuguuugcuuucuugguuuuucaaguuuuucuaucuuuuagauaacuacuuucuuccagauauaucauuguuuaauaccaccccccccuuucuacagauuacaugaauuaucauguccuuuacuuuauagaaguuuuuuuuaguuuuacuaggucccauuugauaguuucaguuagucugaaugccugugcuacuggguauuguucaaaaaggguuuuuguuguuguuguuuuguguguguguguguguguguguguguguguguguguguguguauuuucgagacaguguuucucuguguagccuuggcuguccuggaauucacucuguagaccaggcuggucuugaauucagaggucugucugccucugccuccuaauugcugggauuaaaggcgucagccaccacugccugacucagaaagcucuuucaugucccuauaaauuaaaguacauuuucuauuaaaucauggugucuagucuuauuuugaaguuuuuccauguauggcuguuuuuguguauggucgaaauuaauauauaauuucauucuucuaaguguauauaucaaguuugacugguacuaucuguugaagaugcugucuuuucuccaauuugcuucugaccucuuuguuaauagcuguaguaaugugggcucauaucuggcucucaauuuuauuccauugaucaauguguuuaugccauuguuguacugcuuuuugguuuuucgagacaggguuucucuguauagcccuggcuguccugcuacucacuuuguagcaggcuggccuugaacucagaaauccgccugccucugccuccccagugcugggauuaaaggcgugcgccaccacgcccggcuuauuguacuguuuuuauuaccauaacucuauaguauaguuugaauucaaugaugguaaaacuucuagcagugcuuuuauuguuuaauguuauuuugguuauccuaggucuuucgugacucuguaugaauuuugugauucuuuucuucaauuuaugugaagaauugcaugaaauuuugauaggaguugcauugaaucuagagguuacuuuugauaaauuuagcaauccaugaacaugagaguucuuuuaauccuaugagauaggaaggaaugaugugacguucacgaagaaccuuugaagugagaaggagugggccuaaguuguguuuguggggagccucagagagcugggugggccuuguggcaugggaaagggaagguacaugaaguaucucaaggaggggucccacaggcuggguaggaggagaacuugcuucuuugaaauaagaaggaacuacaacccagcauaacaaaggucccaguguuaucuucuuuuaggggcaaagcuuuguucaaaauaggauuuuucauucagcuugaugugauaauguggcuuucuuuaaauugggccaguaauguaguugcaggacauuucauaaucaacaacuaacaaggccgagauggccguuugauugcagucuauacuucuauauuuauauacuuugacugcaaaauauuugaauacaaaucucuacgugauucauuuacuucccaaaauuuuagaacuggaauaucaagagaauuauuucccuuucgucaguaacuucaaacacaacauuacuugggcuuuguuucaaauguuugagaggaaucuuugggcagugagaacuggauggugaaauucuucgcuuucuuauuuguuaacauacuaaauaauaguuggugucuuuucuaggauugacaaucuugucccucacuauuauucucuugguucucauuucacguuguuuauuuagucauucuuuugccaacuauaguugcuguucaggacuggaaaucacuguagauauuuuauguuuguucuaaugguaauuuuuuuauccauaaguauaugcuuaccauuauuaguagacuuaccauuaagaauauauagaauauauggaaggagcaguaaugauaaauacaguaucacaaaugggagagguuuggggucauaagacuugcagaacacagauggcaauagugaauccuuuuucuguguuguaucugcagaugagauguucacauucaauucugugauugcugaaaauacacaauauguuugcauugugguccauagauugaacucaaguuaucaggcacuauuaaccacugaaaugaaacaacaucuagaacuucuguuauuugaaaacacuugugauauuuugacaguuuuuuuuuugguuuaaaaaagaaaauguaaauguauauuaauuauuaaauuauuuggaaaguuauugaacauucugucuccucaaacuccacagaucacccaggaggcuggagaguuuaugaucacuuuuccuuauggauaucaugcugguuuuaaucaugguuucaauugugcugagucuacaaauuuugcuacagucagauggauugacuacggcaagguugcuaaguugguaagucucuccugacaagugaagcacacauaguaugcaccuaaggagcaugugcggcagucguguuccccauucacacugugccucucacuacuuuagcuuuugccagguuagcuacauuuacuuuucauacgacgaauggccacucauuacugaauuugucuguuuugagauuguuauaggacguuuuauucugcugggauuuuuuucuguccgugcuuacuuucacucucaaagcugccauuuggauuuccugcagcguuuuuuuuuuuuguuuguuuguuuguuuguuuuugguuuuucgaggcaggguuuuucuguauagcccugacuguccuggaacucacuuuguagaccaggcuggccuugaacucagaaaucugccugccucugccucccaagugcugggauuaaaggcgugcgccaccacacccagcuccugcagcauuuuucuuggcuguguguaaaaugagauuuggacuucacauuaaaguugagucaguuguuuagaaaacagcagguuauagaaggaaguuauuaguuaaauugagaacuguugguuauugagaaaguauaguaaaaagaaauuaaggcuuccuuaauguaaaauuauacuucuuagugguaacagucuaaaacacauuuuauaucuuaaugauaaacuugguauaaagauucguuugcaguuuuaguuuuaaaacucuguauuuguuuuaguucauauaaacaauaacauuaaacuuauauaaaguuuuguuuauaguuuuaguuuuaaaaacacuuuuauuucauguacuguguauuuucaucugcaacaguuuuucuugaauugaauugcuuucaccuugaggcauuaaaacagagacaucuucaaaacaauugaugauaugacccuuuccuauggcuuuuagggagaagcaaacugggagagggcuuggucuuaaugaaacuauuucaaaguauaugaaguugacauagucagggugaaaaaugauaaaugacccuuauagccuuuuccuagcuaugucaugguacacgugacuguucauccuacucugaguaagauuguaugugggaccauuucaugaacguagggaaaaucacucguaaguuaguuacagguguaauagaagauuguauacauuaaaauacauaaaaaguucuacucuuuggcaacucagaaugaauucuuguuaaagguuuguuuugguucuuugacaggauccugcauauacuugugugaucguaaauuggucauuuagccuucagaaccucuuuacaucuucuucucacuccuacugaauccugucuuuuucucaaaugguucccaucugauuuucuauauuucuguuauggucuugucuaguuuguuagcuacaugguaauuagaauuguugagaauguuugcgguuauacagucaagcacagacaaguuugcacgacuacaccacaagugaagaaaaugauuagugccuauuucugaggggcugcuuacgaaggcauaaaacugaacuagcuccuacuaaacagcaucauucuuugucuaaugagaaauaggacauucagcauguauuuguuggccuguaacaucaaugcuugcauugaggucagccauuuuuuuaauuaauacaauuuauuuuaaaauauacaacucaguauugacauuuuuaaaaaaugauuuauuuauuuauuucauguauuugaguacacugucgcugucuucagacacaccugaagagggcaucagaucucaucagaugguucugagccaccaugugguugcugggaauugaacucaggaccucuggaagaguagucagugcucuuaacugcugagccaucucuccagccccaguauugacauuuuuuaagucaucaaaauaaucuauaauaguuaaaugccucuuaaauauacaugauaucuucugaugcuaaaaauaauauguauauacucaaucaguuuuuagaaucuguuuggaacauuaaacaugauagaaguagaaaaaaaucucauauuaaguucuuuaugaaaggaaauugugacagauuccugauuagacagaaacuguuccaucuccaagggagaauaugcagucuaauuguggcuucacaguuuuggguaguguuccuucuguuucuauuuuguggaauaguuugaggaguauuggaauuaggucuucuuugaaggucugauagaauucuucacuaaauccaucugguccugggcuuuuuuugguugggagacuuuugaugacugcuucuauuucuuuagggguaaugggacuguuuagaugguuuaucuuauccugacuuaauuuagguauuuguuaucugucuagaaauaucuguuuagugcuugcauugaaaugaaaugcuuucuucuguguugaaaucuugccauaaacaugcaguuguacugugauguuguuuuuugcaucuuuaaauuuggcagaauaaguaagcuauuuuagauauuuggauaaucagaaaaauggccuagugcuuguuuauuacaggcuucaaaacuauuggguggaauucaccaaaauaagacauuucuuguuuauagucauuggcaaugagaucauuuuucuauauuuuuauaguaggaguggacagccaccagugaagaauuguggauguugguauaccuuagaaccuuagcugccugagguguuacagaaguggaucuaagcccaauuuuucuauucuugcuagguaugauauguauauucaggaaaguaacuuauuuuucaacaaaauuagaaaguccucuuuaaagauuugcuguggugggagaaaucauaugcacgugaaaucacucauuauauuacuucuuuauuugguuuugaacacuuuuuuuuguuuaguuuguugggcacaugacuauugauacauauauauuaggcuagcuaauuuaaaauguuccacauauccuauauagguauuuccccucacucuacucuuccuauaggccaggugacauggcuuugcuuugagcauuugcuuugagugguagcaaaagcuuguaggugguauagaggugggcuuuaaaaccucaaagccagugacauaccucuuagucauucuuaaaugauuguaccaaguggggaccaagcauucaaauaugaaugaaccacugcucgcuaaauuuacuucuguagaguuguaagaguagggucuuuuccuagcuaauugacaggcuccauccaguauauaguuaauucaggacaaacaauguucaaauauauauauauauauauuuuuuuuuuuugcuuguuugcuuguuugucuuuuucauuuuuuaaaaaauuggauauuuucuuuauuuacguuucaaauguuauccccccuuuccugguuccccccccccccaaaaaaaaaccccuuccuauuccauccccccuccccuugcuucuaugaggguguuccccaccccgcacccauucacuccuaccucucugcccuuacauucccuuacacugggguauugagccuucacaggaccaggagagucuucuccuguugaugccugaaaagguugucuucuguuacauaggcuggagccaugggucccuucauguauacuccucgguuggugguuuagucccagggagcucuggggagucugguugguugauauuguuguucuuccuuauggaguugcaaaccccuucagcuccuuuaguccuuucucuaacucuuccauuggggaccccaugcucaguccaguguuuggcugugagcaucuacuucugcaauugucaggcacuggaagagucucuuggggauagcuauaucaggcuccugucagcauacauuuuuuucauauaagguaguacacagguuuuagagauuuggaugacugcaucguagaugcuaaccuaaucauuugcccacaaaugaguacaaauuagcaaaugaugaguaauaacugaaaaucuacuuugccuaaguaacuggugucugcuuaaaaacaggaacuuacccuuuuaauagacaguuuuuaaaguuucauuaguuuaucaccuuaguauuaugauuucuauucuuagucaauuauuuuucuuguacuaaaaugugaugugaguuucuuuuagacuuuguuuuuugucucuauauuuuugauauaucuaagguagaucaccucacuaauuuuuaauauuauauauagcuuuuagccauuugaaauuguguuuuaggcacaaguuuaccuguuuuguucauuacugauacaauguauguguuaguuauggauugaagucaacaggcuuuuagcuuuguuagucuuauuauuuguuccuuugaauuuuuucuaaaugguagaacucaugacuuguaggugcuuuugaguaaagcuuuuuguuacuuuuuaaacagacugcugcuuccuuauagcuauacaaggacuuggcuccuccuuauggcuugaguauaauguaagugugugauaaaagucucuggacauagaacaauaauggaugaguguacauaacaugaguguucugaaucuucuuuauaauauauaacauuuauauaaaucauucauucauacacucuaaaacauguaaccucacauuauuccaaauuucuaauuugaugucugagaaaggaauucuuacaaaaggcuauuuuuaaugaaaagcaccuaaccauuuucuuuggagauucuugauuauaagcuaucaaguuugcuugguagagaaaucugucacuacuauauauggcuuguugaaagagagaaaagcuacauuuacugagacugugcuugauuuauguuguugccggucuggagaccagaggugagaguagaggguacugccuggguccaauacuccuucuugccccuucugcuguuguagugauuucugaugauauuuuauugguuuccacugaaauuauuagugaccuguagguauguagugaagaaaacuucauucuuaaugucuggcuuugguugaagguucuaaguucugcagcuugcuggagugggaacuuggcccucuuguucuucacagguuuccuguuuuugaugauuuauuuuacuaccuaaacuugguuaucuuggaucuuggucuauagacugaccuugaacucagagaucugcauucgucuucugaaugcugggauuaaaggcauguacuaccaugccuggacauaagcuuuucuuuacuuggaacuuacucaauaucagccuggccuugaacugcuugcccaugucuccugggaauaaaggcauguacuacacauggacauaaguuguucuuuaaauccuuuaauccccuaugccauaagaucugaaucacaggugugcccuauauuuccaaauuacaguucauuccauacauuucaugcagguugacaacugagaauaaccaucacaauccaucccuugucgauuugacacacaauaguauuuucuuauguucaaaugagagcaauaaccaggucauaacaaugccuaacuuguuuaacugcaaugauauaaauaguaagguuaggugagugguaucuuucccuguguccagcauucccuuaacuuuguuuauuauucugaaacagaggccccauuccacuuccuuguacuccuuugaucauacauuuuguaguuuuccuuuuucaauuugcuccauaagaaugaaccacagggcaguuaaugcuaaguuguuucuagaucucuaaaucucuuuauuuuagccuaaggcagaagacuuuagacaaaggcaaaaauuagccacauucuucaccaaaauaucagaagaacaaucucuaggcaucaugcuaaaauucuccucugaaaccucuugauccaggcccccacauuuuaaaucacccucagcaccacuguguuccauacuucauucuaugaguaugacccacuaagcucuucuuaaagcauucuacugcuuucguuuuuuuuucaauuuuuuuauuagauauuuucuucauuuacauuucaaaugcuauucugaaaguccccuauacccucccccgcccugcuccccuucccacccacucccacuucuuggcccuggcauuccccuguacugaggcauauaaaguuugcaagaccaaggggccucucuucccaaugauggccgacuaggccaucuucugcuacauaugcagcuagagacacgagcucuggggguauugguuaguucuccacugcuuucuuaaaguccccaaauccacauuccuccaaauauaagcauggucaggacuaucacagcaauaccacaaucccagucuuaguuauucaaccaacagagcuuguaaaauaaaacauagugcucccgagcaacagaaccuuauauuuaacaggguuauccuacucaacaagguguuuauguaguuuuucaugauauucuuaauguaagguaugauuuucauaaaauaugcauaguuccuuguaggcuuuucccugccagcuaagccaucuuugacugguaagugcucagagucugcucuggcaaaaguacugggcugcauuuauguguaggaauauaugggaaaggauuuucugagaaaugcuguucagaucuugcucuuacaaaucuaacauucagucaacuguaaccaagcuaauaaugugcuuucagauuauuuauaacuauauacucacucuuuuuauguacuauguacuuaauauucagaauuaucugcccuugaagaaaagcauacuuagcuugcugacgucuugugcuuuuggggauuccaugguguaaucuuuauuuugcuuuugugugcaugcaugucccugacucagaauaauguauguguaugugaauugugaugaccaggucuaagaccauucauuagaagcagugagauguugaaggcaggcagcacccucuucccucacguauguaugaaugacauucugcacugcucugcgucagcagggacagcaaaacuauuuucugccuuagaagaagacaagcuccucauuacuugucauugccaugucggcucugcugcucaguauguaaagagaauggcccuauucaggguuacgaggaugaaucagaaucauuuagaguagaguagacuacucuuagauacuaacaggaagaccuaaagucuugggaauauaugagagccucucuuucguaaaggccacuaagaauuugccuuuucucuuuuauguuacagagaaaauacaaauuuccuugucuuuagggagccuuccugaaaggccuuuaguaauugcaugcgcaaagcuuuaauaucuguagaauauaguguuuguugacuuaauuuaguaaucuucauugcuuuaaaagaagaguaauuuagaauauaauguuguuauaacccugguaaagauuugaaaauaugugacagacaauguaucaauugaagccaaacauugcugcauauuucaaauaacugcauuaaauuuuauagcauuccuuuguggaaaaauggagccuaugaauauuucuuuguaucuauaguggugcugcaucaugucuaggcuaaaucaaagagcuaacuuauagguuuugauuucauucuuucauuggguaggaugaagugucauauauaggaugaugaugaucuucacauuaaauaaaaccuggcagcuguuaaauaaagcuuugucuuguauuuggccuugaguguuugaaaacauuugugaaagucuuuuguguugcuaauauggcaguuguaaacauugugauuaucuuaaagagaaacaguuuuuaacuauacugauuguuuucagagacaaucaugucuucccuguaucuuuagaaacgguacuuauuucagugugcagagugagagacucgccaggacaugauggacauuguugucuuaggagagggugcaguagucagugacauuuuauuuugaggugaucuuauuaaaaguaacuauugcauagugugugucugaaucuugaaaauugaacuacagaucugaaaauauuuucugacaagauucagaaucauuagguuacuaauuuaaaguuauuuuaacauuugaauccuuaggcauuugaauaaaucugaauagauaugguaguaauauuuaaaauuaauuuggaauuuauuucaaaugugaaaauuuccuagaauuaaugccaggguauggauucauucuauuuuauauuucagucuuuuuuuaaaugaaaauaaauuaagucaguuaaaacauucuuccagcaaagucuucagucucgggcagucuuuguucaaagacucaaguaucauuuuuaaagugaauuucuagcuuuuaauuuuauuugcuucguuuucuagcugguacaguuaaaaucuccuuaggcagcuuggccauuguuuugcuccuggggguuuaccagcuaauacugaacuuaguguggguaccgaauaggcauuaugaacuacaacucagaauuugugaauuguagacccaggaguaacuaguuuuuacagauguuuggcauugacuuuuuauugugucauaaaauguuaguuuaauguuuaucuguucuuacuguauguaaaggaaagaaaauccagacugccucgcauuuguucauuuaacaguucuuuccuccuuguuucucuucuucccuguguugggcucaaacccauuaccuuggacagauuagaggucuacuauuauguuacaucaccagccuccagaucuauuugucuuaaaguauuccauauuuuguguuaugcaguuguagcuugugaaguucauauuuaauaacuaaguaacuaaugcaguuauuuacaaagauaaguggaaaauacaccucacagaauuuaagacaaugucagcauuuaagccaaggcagguuuaccacuugaccacuaaaccuacuucauaacccccgccagacuccucacuuuccuauuuaagaacucaaaacaucauucucacuucaaaguugaugccacaucuagucucacugagucuuuaucauaaagaaauggggcaaagugggcauaacuaucuagcuagucccucugcggaagcccuucaaaaugaagcagcagcuucccgagcuguggggaaugagagcuggggcaggagugcaugcucuggcgcugucgucuuguaagcccuccccaguacacgguuuuauuuuauugucugugucuguauaugcuguuuucauacagugcuccgcucguaaggaucagagccuugaacagauugcgagagaucuguaaauaaauuauagccaguucacaaaagauaacaguucaauuugaugaugcaaacacuugguaaguagcaaaugaaauuuucauuuaauaaauaaaauuauaggaaauauaaaugauaacaugaauauuuuuuacauaauuuagaaucaucuuuuuagcauaaccaaauaaggccaauaauaucccccaagagaguguuagauuaggaaaagaaguaggaggagaaccauaguuccagaggacuagaaagagaugcuauguaguagugauucacacuacuguggaaucaugaguuugaaaacaaaaauagugaaauauuauaauauauaauucccaucaucuugauguaauuuacaaaauguuuuuuuuuaaagauuuacuuauuuauuuuauguauaugaguacaucauugcucucuucagauacaccaagagaaggcaucauuggauccuauuacagcauuucaggugguugugagccaccaugugguugcugggaauugaacucaggaucucuggaagagcagucaguguucuuaaccacugagccaucucuccagcccaauuuacaaaaucuaauacaguuuugaauauaaauggguaauaagcgcuuaauacauauccuagcaaaagccaauaagcaauucaaaauuuacaaaaaaagaauaaauauucuuucuaaacauaguuacaaaacauauauauauuuuggggggggguggguuuuuuguuuuuguuuuuguuuuuguuuuuuugguuuuuuugagacaggguuucucuguuuagcccuggauguccuguaacucacuuuguagaucaggcuggcaucgaacucagaaacccaccugccucugccucccgagcacugggauuaaaggcgugcaccaccaccacgcccaggcacaaagcauaauuuuguuuuaauuucuuaaaauauaguguuuuugggauguauauauauguguguauaagauuuuguguauguguguguguguacacgcuuuuguguuuguauguauauuuacuuguauguucauauguauauguaugugauguaaauaaguaugcuuguguguguguguguguguguguguguguguauauauauauaugaaugcauauguaugugauuguauguuuggguuugugugaccagcaucuuuaucuucugagacuuaacaggucuauaaaacucuuuuauuuauacacacacacagacacacacgauaguaauuuuguuacuugaaaucuaucuuuuuaaauuuugcuuucuuuucuguuuauuaaugcugucucugcuucuguccucccuugaucacuccaucucugcugcuuuugacuuaauauguuuuaaaguguuauuuuuaagucuuauguuucagaagucaguacauaauauuauauaguaagugcauauuagaucaaaauauucacagaauaacaugacauaaaaauugaaaacuucccugacuuuacaguagguaacagagaguauggauuuuucaaagcaagugcauucucgccucuccccacugcuucaccuucccuccuuucaguagcuuauggagauauuuggcaucucccauaccugggccuguucauuguauuuaucuacuguaagugccuaacuaauucugugucauuuacugcucaagauucuaaaacuguucgaucuuaguaaauuauuuugacauauuuaacuuaauucuuugagaauuagaaugaaaauuggucauuuauguauaaugccagugauaauacuaagaauugaacuauagaagaucucugcugaauauucaugguaagacuagaucaauacuuguuuucuguccaagcuucaagaagguuaauguugagaauucaaacacaucaauuauuuuuuccuagaauuucugacagagcucuacaugaaggaauuugaggguaaugagacuguauaagaacuuguccauuuucugaaugggguuuguauuucugaccugagaauguauuuagugaagacuuagaauccugcuacuauugaaaugcaccucuacuuguuuuuaugaaguugaguauuuauuuguuucuuuaggcccauggucuuguauaguccaggcuguccuugcacuaccuguguaguugagguugaucuuuaucuugugauccccaggcuucaguuuuuaccccgugagugagggaauuacagguaugaggugccaguccugguacuaggacagagcaaggaaaugauuucauccaaggccaguauagugaacaagugauuuucuuuggacuaucuacaggaguauggcugacucauaggcaacuuaccagccaacuuaucccagcguuggggaugcagccccugaaggcuucuuccuuaaggcuucuuguguaaguuguuagaaacugggucaguaggagcaguuccucuccuugguuacuugguuacugcuuuuguaacuuuuuggaugagccuuaugauaauuuucugagccuuguaaguuugcuuacuucuugugucuuagcaacuucucucucucucucucucucucucucucucucucucucucucucucucucuuucaggaagcagugcaucaauucagaggagaugaauauagacuuucccuuaaguuacaguguuucuuucucaauugcuuucuaguccuuucauuuguuuucuucugacugcagauacuauuauugauaugcucagugacuuguauugaagacaguuaggcacauugaucucuaugacaaggaaauaugacagugucauuguuggcaucauauauuggaacugcugaguguuagacaugaagaaccacaguuuauucuaaaguuaaaacagugcugaaaauuuaagauccuauuugagagaaguuaaaguaacuuuugugacaguagauuguuuagaaaugguauaguuagagaaguucuuuauauuuauuuugccaaaauccagggucuguuugaaacuggagcaauguugcgagaaguaacggaugcaguggauacuuuacuggcagguuuaacagcagaucaugucauauucaguguguaaggcuuggggaguugcaaggguaugaaauuaugaagcaacuuaguauuauucauagcugucaaauuccuauauguaguuuaugaaguuggcuuaaucugacauaaauguuaugaaauaucguuuauuucuauuaauauuaaaacuagccacauauaguaacucacaucuaucauaguaacagcuccuuagggacagggcuuuccaagauucggaguuucugcuuauaguggguuacuugucuauauagccugcuucuaaaaauacaaaacaaaaauguauagcucuauuaggggaaauucgccaguggaaauuaaacuuggaauuaauuuauaugcaugugauaauuguaccaacaauuuuaaaaucacauguucugugacuagcuauguaaggaauuauuaaguuaucgcagcuaaaucauugagccuguuacuauaccauugcuugcugcaaagacuguuggauucaaccuaauuaaauugggugaaguuuuuauagaaagcuuauaagguaugacugaucacuguguauucaugagaaauagucuucuacuaaguccaaaauaacuucgucugaaauucucaauccuuuuagccuuuuaucuuuuucuauguauguuugguccuuuuuuuaaauuuuauuuuaugaauagcaggcuuuauuauuaguguacgaucaauagauauaaaaauccaacaccugcucccccaacaaaaggagcuuguacuagggagucagaaauccugugacaugccaucucugcuuugguacccagaagagggugugagccucuucaaggcuuucaaagcuucagggagcccagugucauuuuuggaggacuccucaggguucugccugggugucccucuuguuggccagugauaguuguaaauuuugcaauucuuguucaagagcuucaguaaaccaaauguuguggcaaacuucuuuuuuuuugggggggggggauaucugagacaggguuucccuguauagcccuggcuguccuggaacucacucugugaaccaggcuggccucgaacucagaaauccgccugccucugccuccccagugcugggauuaaaggcgugcgccaccacgccuggcugguuugcucauauugaacauauugaaacaugugcagacuaaaaccucucccuaccuaagaacucauucaagaggcucuaacuaguuccuugacaagagaagauccaaagccaugcauaacucacuuaauagaaccccauguuaaaacaaaguacaacacuuucuuucacgaaggccugaauaguaauccuuuacaaaaaccagacgugguaaaacugguaccaggacuuuaccagaaggaauucagacgcugcuuacuaucaaguguuuccacucuuggucucuccaacuauaacacgaaagaaaaaaaagaaaagaaugaagaaaagccaucucagacaugaaugauacgcuuucuucuccuaaagggaaaucuggaauauauugaacuaauaacugaacauauuuagguuuugaagaaugcaaggagauaggaggcuuugcauaugaacaaguaagaauacagagguggaugcucucagccaaccauuaggcugagcacaggguccccaauggaggagcuagagaaagaauccaaggagcugacaggguuugcagccucauaggaggaauaacaguauauuaccagagcucccagggacuaaaccaccaaccaaagaguacacauugagggccucauggcuccagcugcauauguagcagacgauggccuugucggacggacaucagugggaggaaaggcccuugguccugugaaggcucugugcccuaguauaggggaaugacaggucagggaagcaggugcauuggugagcagggagagaggggaugggaucggggguuuucugaggggaaaggaggaaaggggauaacauuugaaacguaaauaaagaaaauaucuuauuuaaaaaaaaguuauaccuccagcagaugcuggcauugggacaagcuguaaagguaggaagguggggccaaaauggaagaagcaggccauugaggucuugcccuugaagaacacuggagcucugaacuuguccccucucucuguuuccuggcugcuguggggggaaagcuguguucugucucagccuucccaaacagugggaccaaacacccauggaugcaaacuucugauacuaugaaauaaaucucauucugacuuaaauaaaaaaagcaaaaaaacaaaaguuacaaauguucacauauagcaaacuacuauaagaacuauuuccugcauccagugaauuaaaaaccaucuauuaggccucaucuaucaauauucuuuccauuuguaccgaacgucuaauuacaguggaucuuuggugauguucagaacauaccuaaauuggcacaaacauucuauauaguauugguacuuuggaauuuuguugcauaucugagauaguaaucauuucauacaaacacuacuugcucuacuacagauguugauggauaucugugauaguagaauaauguuucguuugcuggacaaccuuugaagaaauauucauacuucucuauaacuuauucuuaagugguucauaugaauguacagacuauauuuaaaaguauuucucauuuuuaaguuuccuuugaguuuuuuuguagauguaaauauuauucucauuuauauuuucauuaaacauucauauucuaccuauguuauauaauucacaaaauauuucauugucaguuuuauucuguuuauugcguuucagugcacuugucggaaugacauggugaagauaucaauggauauauuugugaagaaauuucagccagauagauaccagauuuggaaacaaggaaaggauauauauacuauugaccauacaaagcccacuccagaaucuacuccagaaguaaaaacauggcuacagaggaagaaaaaauuaagaaagccucccaagagguaagaagcccaucacauccugcuguagcauguucuuguaugaaauggaaccaaauguucucuaggccucuuccuuuauucuuguuccuauuagucauaccuuuacauaguauauuacugaaauuuuguguguuuaacuuuugagucgguguuuuagaauuuaggaaucgguagucagauaugcagaguacuccugaaauugauauacacaguaaguagaacagcauggaacauuuuagaguuuucucauuaauuuaucuuaaacauguauuuguuguugacauuauucaccauauuucaaacaacuucagauacuugauuuccaaauuuuaugugcuacuauuuuaagacauuuucauaauaauuuccuucauuuuuuuuucacauggaugcuuaugcuguggcauuuuauucaguuuguguuaauucuuuucuaagacucaaaggagaauguguuaauucuguccauuguggucuucuuaaacuuuaccucugguccacuuuugugaucuuugucacaagcuuucuugacuuugucaaaaauccuuuuuaaaauccuuugaauauaucuugucuauggcucagguccuuaggcuaauguaauagcucguaauuuggaauuuuuauuccaacuuucuuuuuaauauugcuuguuauuccuuugguuuauaaaaguaauauuugagaauugcuaaaauuuuauaaauucaggaaaaaauauccagugaauccaaaucacucauaaccuaguuauccaaagagcauccauuuuaagauuuuauguauauucuuacauauguauuuauuauguauauuauaaaaauagcauguaccucguucaaaaugagucuaugcuuuauuaacaauugauuguccagguaagugaaugauuuuuauauaaucaaauuauuuucuauagcacaauuuuuaauaucuacauguauuuaauaucuuacauuuagaucuauggcacuucuguuuauucuguaauaauacuauaauuuuaaaauuuugcucagaguauaauguucaauuuguucccccuaccacuugaauuuauuuuuuguuguuuagacugguugugagcaggagaaauuuccaaacauggaauaguacauaguuucauuuugccaccccaccccucauuuuuuguuuguuuuuuuaaagauaggguuuucauuauguugugguuauccuugaacucauuaugguuauccuagaaccuguaacucagagagaucuaccugugcuucugcuuuccugauguugggaaaaugucucccaugaauaaauaaauacauaaauaaaugaaagaaugaauguaauacauauauaaaaguuauaaaauguauaguauaauauauguauuguauauauuauauaauguguguauuaacuauauucauauauauguauuauauaauaaguauuauauauuguauuuauuaucuauugauuaguucugucguguacacacacacacacaaaacaggacuaguccuuagcuaaucuaauaauaauaauauuucgguuguaguauagagcaaggaauuucaaaauaguguuuguaaaaauuugaaugaucaaaugcaguguuuuaacagacaauaugaauuuaaaagucuuacaauggagcgggagagcuaucuuaaaaccacugaaugaucuucuaaauaacucaaguucucagcauaugugccacagcuaacaaccaucuauaacucccauucuauaggaucugaaagcuacaauaguguuuuaugugagggaaaugguugucaugguuuguguauuugcauguauauaaguguugucucaaaauguguaacugauugacuaaaugcauuuagagauugauuauuuaagaaaucaacaccucuagagucauucaggagacacaccagucuaaauguucaugagcugagguagcugcuaaagucuugaaagucugaggcaucccucucccugaggugccagccauaggacagguguaguauagaauagacuuuauuuugaggacauuuaaagaggauaggugagggaggcgggggauaaagagaagaggcuggccaggaacacuuggagagaaagggggaggagggagggaagagagggagagcaugggcagagagagggggaaggggaggaggaggaagggagggggcaaacauucccuuuuacaccaagccauaccuaccugccuguggcuagguaacugcuggacauagcauagaaggaaugccaacaacauguguaucugugauacucagauugccaguguuuuuaucagaguagguuucucauuucuuauaaaugcuaauauucaggaguauauuugguuuuuuuaguugguggcuuaaagugauugcugaugaccuuuuaguccucagaacauuuccucagaaaauugaagauaguacuaccugaggacccagcuauaccacuccugggcauauacccagaauaugcuuccacauauaacauagucagaagcuguaaacaauccagauguccaucaacagaggaaugaauacagaaaaugugguauauuuacacaauggaguacuacucagcuaucaucauaaacuuauaguaugcaaauucaguuguuaugaaguugauugaaagcugacauaaagccauuaugguuuuaacuucagacuuuauuaauuguaaaaauuaaagaaguuuuuuuuuauauaaguacauaauaguagcauuugcauugcuguauauuauuuguuuugaacuuuuuugcucugaccagcauccugcuuuuaauagcuuacagggcaauaagccacuuuguaaaaggccuaaaccugaagaagaugaggaauuugcugaauuuaguggggaagagggugcaaacccugccaugggcccuaggcaccucaaagucacugaaaagccagaaaaagcauuaaagcuggggaaauuagaagaaucuucagcaaaagaagcuuuggauaccaggauacaaguggaucaaagcuuacugaacgacaccaagcucucggguaagaaaauagcugguugucugucacaugugacuagggagcuccguaaucugacucaccaagcuaucucacugacuacgcagcuugucaaugaguauagaaacuuacagaugauuuaccugugaggaaagugaaugcuacacaauaagguaaacagcucuuauguguaauagaauucuaaaauaaauguccaauagaauacuugugguuuaauuaaacaugaagagaucuaagagcagaaaguuuuagugaaauucagcuuauaauguacgaaaagaaacuaaguuacagacaauucuguucagauaccuuguuucagacuucauuuuaaggcaggagcccgauauagcuguuucuugagaggcucugccagugccuggcaaauguggaugcucacagccauccauuggauggagcgcagggcccccaauggagcagcuagagaaaguaccgaaggagcugaagggguuugcagccccauaggaggaacaacaauaugaacuaaccaguacccccagagcucccugggacuaaaucaccaaucaaagaaaacacaugguggggcucaauuaaaauuaaaauaaaauauaaaaucaguaauuacuuuguaauuguucaaucauuguacucaguaguaaugcagugcaauacuuacuaugaguuuuuuguuugcuucuuaggaaaagguugcauaaguucaucaguaacagcugaaauuccaccagaagacaacagagccagugcuguaauuucaccaucucagcugaaggagggcgcugacugcauaccacuuucucauggccaucaagcaggcaaagagucacaucuacuuaagauucuaaagcuugaaucucccaagauaccuuccccccugccagaaaguaauaaaguauugacagagggagaagaaaaugaugaagagggccauggaaguaaccuugagccuggggaaaucccagaagcucuuagugaagagagaaaugggcucaacauuccuaagguacaugucauuuuguaauucugcuguguucauugaauuguggccuguaugguauaaugaugcucuaugaguauaguuuauuaacuccugaaaucuugcuuuagggcaaaaaucaauaguauuuacauuuuugaauuuuaauuguauuucaucaguggaauaugauuuuggcauagaaauacuauucuggcuuacauuuuaauucauuaauacaaacccuuuuggcuacuguuaaagucugauuuuuuuccacuuuauacuuuaaaauaagcaacaucuguauuuguaaauaaugcaggcuucagugccaacaguacacagagaguuaauugauacucauuaacugcucuucacaaauacuaguacuugaugaacuguauuuugaaaucuuagucauguugacauucaggcagucauggugcaaaacguccccauaacaagcagcguuauccaggcugagcucaggugucucuugggcacugcccuacugacaguagaaaguauuugagucaguuucauauagucuuggucuuaacaucauggcuacaugaucaguguuuccuuugacucuucuuacucagaauauuagagauauacuuauggucacguuuauuuccacaaaccuuuugccucucagaaaaguuaaguuucccaugcugguuuuauggcuacagccuccucucuguauuucuccuuuguucuuguuuaguguuauaauuauaugcuuacauacugaacauucgggcgagcuaaugcugugcuaccauucugagucccucaccggggacuuaaggagcuucucucucauuugaaauggcagcugagcugucugcugaccugaguaacaaucuugcuugaucccauuuuacuaaaccuacuaugagucuuuucauauccuuuaguaacaaagcacguuauaaaaagaguaauuuuaaagagguuauuucuuagucaucuuaaaguauauuaaauauaauucaauaauuugaucaaugcacuuaaucauuuuuuuauaucauuguauauucuacagaaauauguaacauauuaucucaaaaguauuaaaaguuaaaagguaaaguaucucauaggggcuuaaaaauaucucacaauuuaaugguuuccaaauaacagaauguuuuauuuaaaaauaauauuuuccuauugaacucauggcucauuacucuauggaaggaaagguccucuuuaccacuuggcuaaauuuucuucucugagaggauuaaagcuggaucacuugccaaguauucauauaugaaaggugauacaacuuaacaguuuuucaucauuuuaacaguauauaaugcuggaugugggauaguuuuaaaugaucuuugaaaccuuaauugucuucuaugaaacaauauuuguugaaggagaauuaauugacuucuuagaaaaaugcuaccuucuuccuuuaccuccccuuucucucccacucuuccucucucacuuucuccuucuuucccccugcccucagccuuucucccuaugucacccugguaguacucuggaugaaaacucagggcuuugugcaugcuagguaaguguucuaccacugagcuguaccuuagcuuguaagucuaaguuucuuaaagugcucauuucuuaaauaaguauaagauauaacuuguaagccauguuaucauuuggaaguauauauuuuucccugaaacaaauauuuauugagucugaagaaauagcucagugaauaaugugcuugcuaugcaaucaugaagaaaaguuagacauggcugcacuagucugggaggcagaaacagaaggauccuuggagcuuccugguuacccaagcuagucaaagaagugaucuccagguuuauugagacccugcuucaaaauguaaagcagugagcuaguagaauguaagcuccugcauauauacaggcauagaccaaacaaaguaaaaccaaaagaaccaaaccuuguucauggauauuucuacuucuuuuuuuuuuuuuuuuuuucuauauccagauaauugaaggacagccaaaaacuacuaagaguuggcgccauccacuugguaagccuccggccagauccccaaugacacuugugaagcagcagguagcgagugaugaaggugaguguauagucuuuuguaauagauggcuuaugcaauuaacuguaauacgauuuuucaguuagagaggaaacuuuuacucuggagcaaaucauugggagacuauaaguaguaaauaguuuauagguaaaagcaauugaaguuuagaaguaaugucaugcuucauauacuuuaauaauaauacuaguacaaauauuuuguuucaugccauaaguaagucauuccugacauagccugaaaauuuuccggaagaaucacuucaagucauggcauauaugaauuguuaguacuuuuguguuuuuuuaaagacaggauuucuucauguagcccuggauguccgggaacucacucuauagaccaggcuggucucugccuccagggugcugggauuaaaggcauaugccaccacugcccucugcacaguuugcacuuuuaaccugaaucauuuaaauugauuuaaauaccuuacagucagaaaccagcucuuauauaccuccauagcagugugugguaaaucucugucauucuuugauagacuacucugaugaggcuugauguaaaaugauuucuuuuauaggucacguaucccaauauaguauuuacuuuucuuguuuagcuuguuccucuuucucucugucuguguaguguuuaaauuuacuuacuacuuuccuacauuucuaaggguuuuguuguuguuuuguagguuuuuuguuuguuuuuugaguucuuauuugagaaucuccuuuucugauggauauugacuaaaguccccugucuuugaugauguaguccagguaaaacaggauagugguucuuguuuauauaaaauaacacucacaauaugugucagcauuauuuuccacauacaucucuucauuuuuauuuuauuuuaucuguguuggggauuugccuacuuguguucugugaagaugcuugguccccuggagcuacagaaaguccugagcugccaucugggugcugaggcuugagcucaggaccuguggaagaacagucaguucuguuuuuguuuuuuucuuaguuuguuuguuuuuuuuuaagguguuuauuaucauggcgggaaguggagcuaagaggguaggcagagaaagaaaggcagagaggaagaagaguauagaaguagagguugccagguaacugggguuggagucacagccugugugacugauggccacggaauuauggagcuggggccucuuguccggaacuuagugucugggagcauguggcaaacuuccuuuugucccuugcagauuaaucugcugugucuccagggauuaaaccuagcucgaccagaaaacaggcuuccuuucauggucccauaacucccccuuuuacuuuuuucaaagggaggggucacuggaauggaucuaucauuugaaguaaacauuuuggguggggaagcaguaucaaaagaaaacacaauacaggucggagggguaacacaacuaagccagugugguaaggaggguuaaguguagguguugggaaggcaagggauuauugaaucuauuguuccauggcuaguacaguuugagggcaauagcaucaguuuuaaacagcaauugauuaaucuagauaaacaucauguuuuccuuacuauccuguaacuucccccaaguucagcagccauuugacuuuggcaagagaguucaucuguagcugggaggucccaagucuguccucugugggacucagugcaugucucugaaucucagcaugugucucaggagucuucugucagaugaggugucuggaggaaggcagcuuuguugucccaggcaggucucaggagauggcacugucucagcaggaucugugcagcaggcacuggccuuuucuuuugugggaauaaaccuguagaguaaucauaacagaggugcagaaccccaacagggggaugucugcauaggguggauaauuuauguuaagccugcagugguuugcuugggagcauaucacugucugcuguuaugguccuagaaaagcaaggguuuuugaggaauuuaguucuggaaggcaucauuuaaaucugcuuuggauggcugaggaacaaaauaucauguuaauuaugcauccuggauaugcaguaaccauuugucuguaaaaggaaauugguuguuaauuaaggauugaauaaugguaaucaguauaguugauuugaccuuuggaaguagauuaggugacuuuuaaaccuuaaaagaaaucuuaaacaaguugaacaauuuugaacauacaucgcgaauauuagggagcaaagcaaaccuuuaaauaaagaagcaagaaaauuuuagguugaaaagccugaaaacuguuucagguguccccguuaggaagagcaagcauuuaaacaaaccccaaaaagggucucucucaggugugguuuuucuuuggggggcuuagauggaggggggaggggccuacucugcuaugagguagcugugugcucuaucaaacagguuccuguuuuccccauuuguguuuucuuggaaagcaggagaugaaaggccaaccuugaagaaaagcucaaaagaauaagcauagaccucuggccgaauagaauaugucauacucagggaaugguguguugacuugcagacagaggaagcagagaguucagagcaagagcugccuucugaaaggagcccuugcuacagggcugggggaggggcagagaguggaggcuaguccccaccuagggaagaagguggccuggaacacauggauguggggugauggccggggguggggugguggggguuugggggggugaucagaggacggccuagucuuucgaacuaggucagcuuacucauggucuugggcuaccuggaguucugaugugggucucucucuauguguggguccccagcugaggguauguuuuagcugguucugccccaaguuggucaucagauguggauuaaaagugggguccuguccggcccacagcuugugccacugggccaggcggaacacugaggaaguuuugacugagacacggaucccacaccgccgggcugugagaagcagcaggaccuaucuccugggguugggaaggcguagucuggggucccugcagaacugcagaaauuugcucgggguucccaggccugcauggaggccagggacgacagauucuagcucuugggcaccacagucauggcugaaugcugcggaagagcugagaauggagugggcaggaggagagcuccagcugggucccaaguggaggcgaguucuuggcuugcucagugggcugcuuggcuugguggagaccauggcugagaacauagagaggccucccaugugaaauuagacgagaggcuaggggaagaccugcuccauugcuucagcaugguggaucccgaugagaaguggcaguucaugguuuuaaaguguuuauuguuauggcaggaaggggagcuaagaggguaggcaaagaaaggcagagagugggagaagagucgagaaguagagguuggccauggccauguggagagagggaagggaagguggagagaggggggaagggaaaguggagagaaggggagcaagagugcaagagacaggggcaagagaguaaccagagucagagcaucucucaggccccauuuacuacauuuauuuugugacacaugcuuauguaggaaaauagaacacagugguaguacuuucuauaguguacaguagcauuuuaguugaauaauugaaauaaagagaaauauuagauguuauuucuguaugaauuaguucuaguuuuuguuuccuagauauaaguuaaaguuaaagucuaggcagugccgagacuugaucaccugcauacauccuuccaauugcuaggauuauagacaucauguuuacuacaauuccuucuuuaucucauuuuaguucauguagcacaagcuauugugcuauuuuaguuauuauaacuauaugacagauuuuuaaaauuaauuauguaacauauuugggaauuuuaauuacuuuuccucaaggcuugcuauuguuguggcuucccuggaggaaggguacuagacauccuucuaaggaagggucucuuuuucaugugauuuucuuccuagaaacuuauuuuuaugucagccacuugagaauuugcacagaauauuccuugauuuccguguauagaacuugcaaaacuaugugugaauuauguuaacaaaguugucucaagaguuuaagguuaaguauuuuucugaaacauuuguaguuguagccuuugcaacagucccaaguaaagaaagguuuaaugauauaaagcaagagaggagaaguugauucaauguggacccauugggaaguaaaacagaaaaauccggugacgugaccucacuacaaguccucuuuucccaguuaaaauuuaaagagugaaauagcuaagcaguccuuguccaggugugguccuucccaucauugacucuacccuaaucucucucauaagguugucuggcagguugcugaacuaugagaaauuucuuuuaaaagacaaacuuauuuucugucuggcagcaggauucaguauuuuccuucuggucaugagauuccaaauagaauucuagugucuuucuguccauuguuucaauaugcugauacugagcaaauggaagggggaacauaaguauuuauuuagaauauuuucauuccuugguagcacucaaguucauguucuuucuacgugucuuucuuagguagguggugucgcaaaaacaaaaaccaauccucaaaaaugaaaauuaauuaaugcaucaucuguagggcaugaaugggaggaggggaucagccaagagcuauaucagugcuuaagccagguccucauucgagucugcccuucucguuaucucaguagcccucugggaaaaauggaagcuaggaagagagaaauggagaaaggucgauuacgguuagaggauucucuggcauuguagacaccaagccauguagcuaucauuauuuauauuaguacauagugucuuuccucauauaucgaguaccaucuugguggugcauguaaccauagccuucuuuaguuguccaaauguugggugggcaacuucaguguacguaguccuaaugugaguaccuaagucuccagugagaacuagguuuccauguauucauaugcuugacuuggaucacgauggcuccuugcaagccuuccaguuuaaagauagucgccccuagauaguuguuuucccauuuaaagcaucguuucucccaggaagccacuaaccaacuucugcuucuuugcccugucucaaggcccaguaggagagggcaagagagaaggucagacauacccucagccucagucccagaaacccaaaagccaugaaggaaagucaagggaaaugcggaauguaguucuagucuaucuuguucccauaggcugucauucaggccuuuugggggagcuuugacaccauuugaaguauuccagaaaagagaaaggugaggguaaauguuagaauaaauagccauagauuuuacauucugggucuucuuccagccuuugcagccauuuauuagaguccacaguauaaccacagguuauuguaucuuuaaaaaggaaaaucacaccaggaacuaaugauuaaugauugaaauagagauacuuuacuaaggaaaagaaaaugugcauuggcuggcuaacugaagaagauaaaccuccaaagcuauaggccuucagagguuauuuauauagguccuuugcuuacauuuggauauuauagggcuuuccuaacauaugaccugauuuuucacuugcacuuagaccuaauggggauugucuuccauucuuucugcagcuaacuucuuuuauauuuuaauuuucaugccuuuuucucccacucaguuuuucugugacgacuaccuuguuuucuacuuuuguaaaugccauggauucuugaauccaaaaaucaauucaaugaaauucaacuaagcuuuuacugaacuaugaacuauguacuauguuagguaaagauaaugaaaauauuaauacaagagacuuguuaacuauguggguaguuuuacaguggacgauaaaaauaugaagugaugagguuaaaauaggauuggcuaauuuuuucuagaagaaaggaaguagcuaacaaaaaggccuugcuuuguguucccaugaucuaaucugauuguuugaagaugauuaaaaaaccacauuuuuucuaucucuuucagaauauaguuuugguaaauagguuaaaaaagcuaacauaaagauuugauauuaauaucacagauauuuaggaguauuuacaucuauuauugggugauauuuuuuuucugagucuuauguuuauuguauuuuccuguuuucuccccuaagaauugccugagguucuaagcauugacgaagaaguugaagaaacagagucuugggcaaagccucucauccaccuuuggcagacaaagucuccuaacuuuauggcugaacaggaguacaaugcaacuguugcaaaaauggagccaaacugugccaucugcacucugcucaugccguacuacaagguaauuuagaguuucacuaucauguaucuuucuacugcuguacuucuuugggggcuuuugguuggguuuguuuguuguuuauuuauuuuuaguguuuguuucuaucauugcauuuuagaaaccuguauuuuaacccaauucuuuuacuaaaagacacacaacuucuaacuuaaagccuagaaacaaaacauuucguauaaaaaagcaaacaccuaguaucuaacuaaaauugaaaguaguacuguccaguaauguaaauaucaaugcccauaccuuuccauguaaaacauacaaaaggcauguccaggacucauuacaaacuggguauccaguucacuauuuucagcuaacugugucugaugcuucuaucaucauuccauacaugucauucugacaggaucucaacucaggaaugaauguauucuucaauauacacauaagaaacauauuuaaugcuguguauaaaauugcauuaugagcuuuaagguacaauauauuagaagacccacuaauauaaacaucauuuucuuuuuuuuuuaauuagguauuuuccucauuuacauuuccaaugcuaucccaaaagucccccauacccuccuccccacuccccuacccacccacucccacuuuuuggcccuggcguuccccuacauauaaaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggggcccugugauccaaacaauagcugacugugagcauccacuuauaaacaucauuuucaaauugugauucuucugacauaauaaggaauacuuuauucaagaucauaagucucguaaauauuuauuuauuuauuuauuuauacuucauguaguuacauacaauugugaguuaccaugugggugcugggaauugaacucagguccucugaaagagcagcuaaugcucuuaaccacagagccaccucuccagcccuugaaaugaauuuuuuucaagugucagauuauagugauuuaauucuuauauuucagagcuggaaagaagaugaaauucuacauuuuuaacuuucuaauuaguagcuuacucacuuuugguuuuacuuucuucuagucauugaauauuugcuuuuauugauuuguauuuaagcauuuuuaucucccuguauauuuuccaauaauaaaaauacucccuuuaagggauacgauuuuagaaacugauuaauuuaagaucuagggaguaauaaagguaauuuauuaguuguaauuucuccaugacaaucaggucugacacauuauuuuuaucugaccacgucggcuaguucugucuucuguauuucaaacuuuugugggaggcauguacuucucguuggugcuacccuagaaaaccuaaggauuauauauauauauauauauucuuugagguauaaccacauaauauuuuucaguaagacaaagcagacauuacccuauuacauguggaucacagauguaugugagcaaaaguaguuguacauuccugagguauuuuggaagacugcaguuugaagagguucuugaacucuuguaugaacucucagagcuuacugauuuaacuuugaaugggagucuguaugggaacacuggugaaaugcuaccaauugaauuaaagaaaucaacaagaugaaguuguaaaaacaagaugagguuguaauguguuggcuaaauuggcauaaguggauuaauggauaaaagaaagucucuuuccagugucuuucacucacguggauaugauauauuuuucagccugauagcagcaaagaagaaaaugauucuagaugggagacagcaguaaaugaagugguucaaucuggaagaaagacuaagcccauuauuccagagauguguuuuauuuauagugaagaaaauguagacuauucccccccaaaugccuuccuugaagaagauggaacaagucuucugauuuccugugccaagugcuucgugcggguucaugcaaguaaauacgucagauuuuccagucucuagacuugcaguguuuuauauagcccuuacaaaucaccucagaguaaccugucaguuccuuugucgacauuguucuuuguacugggguucuucuagccaggagagcuccauuucuacucuuacaguugauauuauuaaugguuucauucaagaguaugaauagaaugucaucaucccuuugcaguuuuaugaaacacuagugaagagaaggccugggccuuugauuuggaaggaguccaguuguuaggaaucccauaaacauggcuggggcaucuucacuuguuuaaauuuuuauauucuaaugauuguggaaauuuaaccuaaaugucuaguauugacugaaaacuauuuuuaugacuuucuaagaaguggauguuauucuguagguucugaggguuaguguauugaauuaaauauuuuucuucauaaauauagggaaguuccuauuaauagucauuacaauaguuagguucuuuaucuuucaaaauuuuuuacuuuuauacagguagauaaguaucaaauauauuuauagguaauaaaauauuuuauauauauauauauauauacauauauauauauauauauauacacauacauacauacauauauauguguguguguguauguguguauguguauauauauagucuaauuuuaaaguauuucaauaguccugauuuucauuguuucuuucugucuuuuauuaguaggggccaaacaaggaccucauauaugcuaagauuauguuguaccacugagccacaucccaagccuuuaauacacauuguuuuuagacuuuuuauuuuuguuauauguauuuugcugguauguuuauauguauuccacaugagugacugaugccuagagaagucagagagggcuuucaguucucugaacuguaguaauggcugguugugaacuaccgugugaguguugagauuccgacccuuauccacugccggaagaacaaaaacuagugagccaucuuuucagccccucaaucccauuuuauucacuuauuucugucuuuuucuccaacauaguuucaaugguugcuaaugcaauuaauuucuaaauacaguauccuacuauguauagucaagagacaaaguaccagacaauaaauauggauuuagucuuguuuucuaaagucaccagcuauauacucuaaccguauuaaucccauaaacaugauugaauuuaacauuuuguuugauuugauuuucuuugauucuauuuauauucuguuauugucucuauuaucacucuuuguuaaaauugcucauuuauuucuuccaaacuccuuuuauuucaggaauuaaggauaaugugucucuuucugacucccaguuugcuuucugucccauuuauucuccucuugccuuucuguccuccuuugcuguucucuaaggaauuuucucuguaggcuaggcagaccuugaacauaccauauuuuccaucucaguaugucaaaugcagguguuacacauccuagauuguuaauuuuuugauuuauuugcuuauucauuuauuuugugcuaauauaaaacauauaucaccaagaucuugguaucaugcaauuuaccacacauauuuucaccaccucccauccucacauuuagucucagcauggaucuaucaaacauugaauugaagcaaacuuuaauuauuagucauggacuguauagcauuuaccccaucacugaaauuugagucacacuugauuaacauuccccaaccuguuuuaagaguuguaacuuauuaguaugacauuuuaggaauuuauuuuucuucuugcaaagauugucucugauaauauuaauauguguccucucaagcuuggcguggugcugcaccuccugaccucguucuccagaaacuauggcaaagaucucauucaaucuuuacuauauaagaaaaacucaucuggaagauuccaaauauguaggcuucuuagaugacccagucacaacauaaacuugcuuuugcaagccugacuucagaguuucaucaucauuaucugugacggagugagauuacuuaucgcacuaugaucucugauauccacaaacgugaauccacacuggcacacacacgcaucacauacacauauuaaucccaagaaagcaaagaagcaguaagaaaaucccaaaaagacaaaaaagauagaucuucauguuuugggaauugguagcaugauaguuacaaaauuaaccuuuaauuccagcauuugggaggcagaggcaggaaggucucugacuuugaggccagccugauuuacagugagaguucuaggauagcuagugguacacagggaaacaacaaaaaacguauuugucacaggcucauguagauggguaugcuaggcauugugcuguguaguaguaguaguaguaguaguuguuauuguuguuguuguuuuugaaauaugcauuuuugccuccuccccaccucgagaacuggauauuuuaccuaauucuuuuuuuaaugcuaggcuaucuaacacuaagcuauaacccaacccucuuuguaccuuuuauuuucgaauuaucucacuuaauuauacaggcuagcuuugagcuuacaaauagguuaugcaggaguugaacauaugaacaacaugccucugguagcuggaacugggauuucuuccaggguuguggacacuuuaaagaugcaagagacuuaaucuguacauccauuauguucuuuuauagguuguuauggugucccuucucaugaagucugugauggauggcugugugcccggugcaagagaaaugcauggacugcaguaaguagauuuaguauuaugucauuccucuucucuuugcaccuauuauugagauggcuaaaucuaauggaaagauaaauuucgguacauauuucuuauguacuuguagccccucucuucagaucguucuacauaauggcuuuguaaccacuguagaaaguucaggugacuuucuauguggcauucuacuucagauccuaugugcaccauagaucaucacguccauauuuacuuuuccagacuuauuuuuuuaauuucauuuucuaaaacauuuucaaauccuuacaaauaaauguucuaauaaaaaaaucaagggagguaucuugauguauccuuuaggaaacaauacaaucugucugcaguuuuccaacuaacaagaaaucuucccuuuauuuauucuuucguuuacucacaccuuaacaaaugugauuagaauaccuauucuaugaaguggaauucaucacugugaacuuuagacagaacguuugacaagaaaugauucuccauuuaaggaccagaauuauuguuuuauaaaauugcccuuggaacuuuacucuaaacccaucuuugauuuucauuccauuaaucuaccaugcuuuauacauuuucuauuuaaccaugcucugccaacuuuuuggacuguguucaucauuggugaucucacagcagauauugcccaguuuaugaucagcagucacuauuguuuaguagacagaacuuauacucugaguuaauauaggcccggauuuucaaauauuaauguuugcuaaacacuucauuaugaaucagugaauuuuguggcucauauguuuguggcgcaaaucuuuuauguugacuucuugaggaauugucuuccuacaguaaucuuuagauucaagagcaauggugcaacuccuuugacaaagagacucugaaggaguucacgggaauccaauaauucaccugaggucagauaauauaucagugcuggccuauguaugacaaagcuucauuuguaauuauuucuuaugauugcuuuuacuaucuuguguaaaaguaagauuuauguauuaggaacacagacuauuacuauagcauauuuagcuugguuuauacaaucauauaguaaauguaauuuuucuaauacuuuuuuauuguaacuaagcuuuuuacacuuuccuucccaauguuuacugagcucugaguagauuuagauauguucuuaggacugaacacacaaccucacuuauuguccacacucuaauagcuaugagcauuugcacugacuauuagccaauucacaaagaagcuucucagaccaagguugagaacuguaucagucaacggauaugaccauaaauauuuagaaauuuuugacaguauaucaauuuaaacaaaaccggagugguagguuucauuagaaggauuguaacucauuguccccaaccccuaggcauuagcauuuguccaggcuuacaaguacuagacauaaauugcuuuugguggaagaagucucaaaucaagucagaaaacaugccauuacuccaacagucacuacacuacugcacugagguguacauuuugaaugauaacaauauuuuuggauucagcauucaaggcugaguaaaucgguaaugacuuucucucugaguguucugcacaacaucucuuguacuaugaaaaguaguguggaacaaguuuucaaaucaguuucagauuaauaucuuuaugugcuauaaccaaaauguguuguguuuucaagagaagggucucauaaucuaguuguuguggccaacugagaauaagccauagccuauguuauuuugcgugccucuagggcuuuuccgaugauuaacucuuugaguaguacucauaccuaauacugagauuuuuguuuuauaauuccuaucuguuaguagauguaucaucuauacgaacagauugccuguuuucaaacucaaaagaaaaaucccacccauugcugaaaagugacauuaugaccaaggcaauuuauaaaaggaguuacguaauuuuggccuugcuuacauuuuuauuuauuuguuucccuuuuuucuuuuuuauuagguauuucccucauuuacauuucccaugcuaucccaaaagucccccauacccuccccccacuccccuacccacccauucccacuuuuuggcccuggcauuccccugaacuggggcauauaaaguuugcaaguccaaugggccucucuuuccagugauggccgacuaggccaucuuuugauacauaugcagcuagagucaagagcuccgggguacugguuaguucauaauguugauccaccuauaggguugcaguucccuuuagcuccuuggguucuuucucuagcuccuccauugggggcccugugauccauccauuaacugacugugagcauccacuuauguguuugcuaggccccgguguagucucguuagagacagcuauaucaggguccuaucagcaaaaucuugcuaguguaugcaauggugucagcauuuggaggcuaauuaugggauggaucucuggauauggcagucacuagaugguccaucuuuuugucucagcuacaaacuuugucucuguaacuccuuccaugguguuuuguucccaauucuaagaaggggcaaagaguccacacuugggucuuccuucuugaguuucauguguuuugcaaauuauaacuuauaucuuggguauucuggguuucugggcuaauauccacuuaucagugaguacuuaucauuugaguucuuuugugauuggguuaccgcacucaggauaauaaccuccagguccaaccauuugccuaggaauuucauaaauucauucuuuuuaauagcugaguaguacuccauuguguaaauguaccacauuuucuguauccauuccucuguugaggggcaucuagguucuuuccagcuucuggcuauuauaaauaaggcugcuaugaacauaguggagcauguuucuuucuuacuaguuggaacaucuucuggauauaugccaggagagguauugcuggauccuccgguaguaccauguccaauuuucugagaaaccgcaagacugauuuccagagugguuguacaagcuugcaaucccaccaacaguggaagaguguuccucuuucucuacauccucgccaucaucuacugucaccugaauuuuugaucuuagccauucugacuggugugagauggaaucucaggguuguuuugauuuucauuucccugaugauuaaggaugcugaacauuuuuucagguguuucucagccauucgguauuccucacgugagaauucuuugauuagcucugagccccauuuuugaaugggguuauuugauuuucuggaguccaccuucuugaguucuuuauauauauuggauauuaguccucuaucugauuuaggauagguacagauccuuucccaaucuguugguguccuuuuugucuuauuaaaggugucuuuugccuuacagaagcuuugcaguuucaugaggucccauuuaucgauucucgaucuuacagcacaagccauugcuguucuauucaggaauuuuuccccugugccaauaccuucgaggcuuuuccccauuuuuuccucuauaacuuucagugugucugguuuuauguggaucuccuugauccacuuagauuugaucuuaguaaaaggagcuaggaauggaucaauucucauucuucuacaugauaaccgccaguugugccagcaccauuuguugaaaaugcugucuuuuuuccacuggaugguuuuagcucccuuguugaagaucaagugaccauagguguguggguucauuucugggucuucaauucuauuccauuggucuacuugucuguuguuauaccaguaccauucaguuuuuauuacauacaauugaucuguaguaaagcuuuaggucaggcauggugauuccaccagagguucuuuuauccuugagaagaguuuuugcuauccuagguuuuuuguuauuccagaugaauuuggagauugcucuuucuaauucguugaagaauugaguuggaauuuugauggggauugcauugaaucuguagauugcuuuuggcaagauagccauuuuuacuauauugauccugucaaucaauccaugagcaugggagaucuuuccaucuucugagaucuucuuuaauuucuuucuucagagacuugaaguucuuaucauacagaucuuucacuuccuuaguuagagucauggcaagguauuuuauauuaauugugacuauugagaaggguguuguuucccuaauuucuuucucagccuguuuauucuuuguguagagaaaggccauugacuuguuugaguuaauuuuauauccagcuacuucaccgaagcuguuuaucaauuuuaugaguucuccuguggaauuuuuagggucacuuauauauacuaucauaucaucugcaaaaagugauauuuugacaucuucuuuuccaauuuguauccccuugaucuccuuuuguugucaaauuucucugacuaggacuucaaguacaauguugaauagguagggagaaaguggguagccuugucuagucccugauuuuagugggauugcuuccagcuucucaccauuugcuuacauuuuuagaggguugguccaugaccaccauggugggaaucagguaggcauugugcuggagcaguaacugagaguucacauaucaucuacaaguuagaggcagagagagcaagaucugggcuggcuuugucuuuugaaaccucaaaaccuaucccaaggggcauaccucuuccaacagaucacaacuacucaacaagacgacauauacuaggauuuccugaacacuucuaguaacugcagacaaauauuuaaacaugagccuauggggaucuuugucacucaaccuagcacagcucacagaauaguggguuuccauaggcuuuuuuguacauccauaccuuuaguuaagcauccccucuccugcccaugucuuccuuguuuaagccuuuaugccucccccuaauuucagaucccauguuuucuacuucccucuuucucuguuuuaaaucgucuuucccucucuucucucaugcacacuuucuagcuucuagaccucaauagacauuucagauuaaaacacaaauuuaaauauucaaagacagaauaugcacaagaaaggaagcauguucauuuguugugcuggguauggguuaccucauuuaguaugauauauauuuuuaaauuuuucuaaaaaagaucuacuuauuuauuuuaaguauaaguacacuguaacuauuuucagacgcaccagaagagggcaucagaucccauuacaaaugguugugagccugugguugcugggauuugaacucaggaccucuuaacugcugagccaucucuccagcccuuagcauauuucuaaguauaucacuuucaugaaaguuucauaauuucacuauucuuuauaacugaauaaaauuccauuggauauuuguacauuuuccucaucuguucaucaucugauugauauauuggcaucacauuugcuggccauuaugaauagaacagaauacaacacaguucugcauguaucucuagaaagauguggauuucuuuugauacugauuuauuuugaugauugaauagcaacuucuaugcugauuuuauuacuggcuucaccacucugcuuauauucccaccacuauaagauaaggcuuccucuuucuucacaucauuaccaacauuuguguaauuuuuuaaaaauuacccugcugaugaugggcaaguggaauuucagaguacacuuuuuuccaguuugaacauacuucuguguuuugaugaaaucauuguccguuuucuuuccuuguaauuccugcccuaugcaacuccacuuuucuccccaaacuuugugugcuucucccccuuuccaguuuuaucaguugucgccuuuuauuauuucagcuguaugagaguugaugucauaauuucaacucuggguaccauguauagugauggaaucaggauagguagcauuuucaugucauuauacauuugguuuucuucagugcuucuuaugaaaccuaaauguggauaucaaguguuuaucacuaagcucuaccuaaagcaccuaaauuuguguaugcuuauauuuuaauuuuuaaucauuuuaaauuaaaaaaaacaauugcaucuuucucucuuccuuuucuuuccuccagcuccucccagguaacuucccuucucauccucccauggucccucacucucagauugauagccuguuuuguuugaauauuggauugaauaucuacuggagguggauuaaggucaccuaaggucccuccuuuggguccugagagucacucaugucccaguucuauguuacuuucuuuaggguccccccccaacuuauacccccccuagguugccuguuugcauucuuucugcugucccucagggcuucagucuuguuuccccccaccccccaauaccuuacuauguuccauuuguccccucccuguccccucuuccacccagguuccuccuucccucagugugcuuucuauuaucauccauugccccaaacuggcaccauauauaaugggauggccccuccaguaacaauuauaaaucaagaagaugcuccacaggccaauuuuguguuugggugcagggaaggguucucaacugguucccucuucccaaauaacaauaacuugugucaacuugauauaaaauuagcuagcauacacgcacacaguauguuugauugauuucuaaguaccuaaugagugaauacauuuaaugcugccucuauauguaugguugugggacuauauccugaaacauuaguagccucucagggaccauguccaagaagaaaacaaacuuucccucucccagcagucaugaguugcaauagccugucaaccuagcaguggaacuucacgagccucuuuacuauccauacugagguuugggcugucucuaccuuguacaagucuguugcauacugggcugguaagauggcucagcagauaagaacacugacugcucuuucgaagguccugaguucaaaucccagcaaccacauggugggucacaaccaccuguaaugagaucugauacccucuucugguaacugucugaaggcagcuacaguguacuuauuuauaguaauaaauacauuuuaaaaaaagaaaaaaaugucuguugcauacaguuacagcuucuaugaauucauuugaacaacuaacuguacuauaaugucuggcaacuacuguuuuccugcaugagucuaguccuucugucuuacagcuggcauucauuauucuguccccauuuuugacacuguuaaugaugccagauauggauucuaucuguaggcuuuaaauucauagugucauucucacaacagucuucacauuugauuccaugcuucuccauacuacccgucugaucagacauugaauacacagaccugugcugcauuucugugcuaacauuaauaccuucaaauacaugaugaucuccuugacauaaaguacugggauuuauguguucuaugguucuuggccacuuuaacaagcaucaggugccccuuccaugaauggaccuuaaauccaauuaaauaaugguggauuauacucaaauuacugccacuauugcacuacuauaucauguaggcaagucacuguuguaggucccaagaauuguagcuacauacuauugaugauuaccuaucucuucugguagagugaaaaguacuguccagcaccauuagcacuagguauuauuagaggagaaacugcuauauagacaccaguuagauuuuucucuguucaaugacuaaguuacuguugucuuuaccuguaggaccuaccauaaguuguggagaguaagcaauaaucuuggcacuagccuaugacauuugcugguggggguguguuuuauagggccccuuugccaguaauucaacaagaugucacccauuccugugauuuuacuugguagccuaaggugucuaguuuccccuguuauuugaugacuccuuuuaaagucuuuuuuuauguaaaugcaugcuagcaagcuucaaugguaguacgcuuccauauagguuuuaaaaagccuuuaguauuagcuguuucucuguuuauuuccuccuugaucuugcccucccguucucauuuaauuuaauccucucuuauuuaugucucuauaacuuuauuuucuguuucucucuuuuugggagaugcucuggucucuuaugguaccugacgugguaccuaaccuaaccuaugccguuacuuggauuguaguauacaugucuaaggcauaacaauuaacacucacuuagcagagaaaacaguauuuguguuuugaggucuggguuaccucacucagcaugaauuuucuagcucuguuugccuuuggguuuuauaauuucacuuuucuuaacagcugaguaauauuucauuguguaaauguacuacauuuuucuuauccacucaucuguugauagaaaucaagacucuucccaguuucuggcucuuagagcagcaaugaacauggcuuaacaaguauuucuguuguaagguacaguucuuuuucacaacaucauuacugcacucaagagugaaagcaauauauggugauccuuucuaaggaccuaugcacucaaccguuuucaggcuuucuuuuuuuaucuggaacuugaaguaccuaucauuguguaauuucuuacacuuuuaguuuuaugauaaaugaaaaaugguauauacaaauuucuacaguaguuuauaugaagggcagugauauuuguuauguggguuuuauaacuauguuaauucccaucuccuccauaggaaugcugucucugcaauuugaggggaggugcucugaaacagacuaagaacaaucaguaaguaauauauuaauuauguucaauuucaucauuucuuuuccuacucuugaaguucugcaugauaguuggauuuacaguucuuccucggacauuaguucacauacuugcucucuggagcuaggguugaaauuuggcuucagagacaaaugccagaguauuucuuccucucugugcuuccuauguaaugacaguccucauuuuaugaacagguuucuccucugucuuaccucugauaucccuuuccuccucuccacuccucaccccuuccuucuucagcaguacuuccucccuguuaacugccuucccccugccccccucacuuccucucuuucuuuuuaaauaaacugguaggagaacuuggcuucaguggggcaagugaucuugcguggcccauacacuggaauaggaacuccuugugcauaaucuuuugaugucaguaccguauuuuuguacauauacaugagucucguugcuuggaaugaagacuaaaagcauuuaucauccuuaacauugauaaaagugcuauguaacagccaauacuuuugcuuggauuuguaucaucuuucauaaggucaucuaguaagauuggcauuauucuacauaggugucacuagauuuuagauguuauauauaggcucuggggauggcuuaagugcaucauguaaaaacauuuaucaugagaaauuaucuuaauagauuuacuauaagaugcuaauuuuauucaaguauugaagaaucuucuggugggguuaacaguuguccuuucuuccuaugguuuugggaugaaaccuggcauauuuacugguuaaaagaaauaaauaagcuauggcugagcagggccucgaagugcaguccuuuaaucccuguaucugaaaaggagaggcacuuguaucucugaguugaaggccagccugaucuaucuagaagcuccaagacauccuauaccugucuuugaaaaacaaacaaaaaccuucauuugaauauaaguugauaguuuaauaauacaaauccaaaugauguucugaaguccuauguuuacuuagagguauaacacuuaaagagauacugaauaauauuauuaacaaauugaugcggauuugggaugugaaaggaugcccuaauauuuuaaaaagaucacaaaacaagcuagauuucauuucucuuuaccuauagauucuuuuguuuauauuaaucuugcacugaggaaaaauauauaaagacuuaacuacuuuuaauuuuauagaaaauaccuauuuauuuauuuauuuauuuauuuauuuauuuauuuuuccgagacaggguuucucuguauagccguggugguccuggaacucauuuuguagaccaggcuggccucgaacucagaaaucugccugccucugccucccuagugcugggauuaaagguaugcgccaccacgcccggcccagaaaauauuuauauuuuaauuauuugccugagaaaauaauacauaucauaucauguauuauauuaaaaggugauuccuaguucacugaacuauugccauguaucacacugcugaaacauaauacacauguaguaucaagugaaaaugaaaaccuacauuuucaguauccuuaugguuuucaaauguauauauccguauuauagacuuaguccuuggccuuuauaugguucguuuuuuauauguguuuaugccuuagugugcaugcagcucauggaaggcagaaggaacaucgggucaucuaguauuggaauuuguuguaguugugagcugccauguaggugcugauaugccgugcagugccaagacccacugcaggaacugcugagccauuucuccagccccauuuaccuaguucucauuacagaacuuauguuaaguauauccaguugucauuagagaaguuuauaaucuagaacauacuugcacuggaauuacuuggauucauuucuucuaugugccagauugcuaccaccaaguugaagucaguaaguuuagggaauuuguuuauauuuaaugucuccuuuccuuaggugggcucaugucauaugugcuguugcaguuccagaagugcgauucacuaaugucccagaacggacacaaauagauguagacagaauaccuuuacagagguuaaaauuggugagugucaaaguuuuuuuuuacuuuauauauuaauguuaauuucaacuucugaauuuguuuuguuuccaaaucaguauaucagauaguuucauuuuauucuaccuauauuucccuguauccucuauauauuuuucuucacaaauucuuuauuaguauauuguaagucuccauaacaggccucauuuuuuuaaauaugggaaagggaucaauuuucuuuauugauaugaacuuguaaacauuaggcucucugauauuguucagcaauucccuaaccugucuuacagaaauugccugcuguuuuucuuucuuuacucuuguguuucuuuugguauaacaaauauguucaaccuuagcagccaucucuuugccaagaagaauuuugcuuugaaucgcagaagcuuuuuuuuuuuuuuauuacaagguuuuuuacucaaauguagacucuagauacuuaauauucccaucucaaacuuguuaccuucuaaucuauucaguagcauucauaaaaauuucuucacugauuuacuuuuuuaagagguuuuuuuuuuuuuuucauuuaaggacaagccugugaugaguguacuuuaacuaauuuuuuuauuccuguaccuuucuguaacauauaguauuaauuuaggccucuuuucuuguuuuuuguuuugauuuuuuuguuuguuuuuuuacuguaggguaucucugucuaucagaguccuggccauccuggaucuugcucuggagaccaggcuggccuugauuccuugcuucuaccuccccagugcugggauuaaaggcauguuccaccaccaccuagacuauuuuguuuauuuaauaaggcacuuuucuuagguuaaaaacauucauuuaguaugcuagugaacuucccuacaaguucuucaguuucugucauuaucauaacgcacaaucauuccucuacagaacauuucaagcauuaucauugaaacuguugcuugauucuaacaaccuucuucccacaaagaacccuguauuaggaauuuaucuucuauccuuuguucucagaaaggguaagugaacacuauuucucauuauaacacuaucaggcuuuuuuacuuuacgaagaaauaugugaucugcuguuacguaauuugaguaauguggucaagguguaaaaguaaggccuauaaagacagcgcaguauugaaagagcaagcgugucagccuccuccccacucuacaucuuccuaucauauggauguaauauuucuaaguguuagcuuauuucaucaaaacuauuaccuauuuugccaaauacuauauuuuuaaaauaaaccacaguucuuaaccuuuacaucuuuuagcaugauuucccagccuuagcacuugauuuaguauuuuaaguuaucuaugcuuauagaagcuaaauagcuugugaauacuaagaaguauaaaaugcccagguguugguggcgcacaccuuuaaucccagcacucgggaggcagaggcaggcggauuucugaguucaaggccagccuggucuacagagugaguuccaggacagccagggcuacacaaagaaacccugucucaaaagucccccccccccuccaaaaaaaaguaugaaaagauaugguauguaugauauauggcaaauuacuauucugccuuaaaauaauugucaccugaagagugagaucauacaauaacaaauaguuugagccuuucuugggauucuucuuuaauuucuaucuaccucugcacgccguacuaacguauggcacuauuauacucauuuucaucaugcaagagcuauguuuaugugguagucaugugccagucacuguauucacuuauucaaaaagagauuguuagggguccacaaucccucuaaaccaauacaggcaguuggcauguacugcuuauuguugccagccagaauuagaugauaaaaucguauuagucaagauacaacauguacuagugacagaacacagaaaaaaauaaguuggaacugaacagacucugauaauacuagaagaugcuauccgagaccaguggcaaguuccuguguugcuuugggagcucaguaucugaugugcguaaucgucagcagcaguuuuacucagccauggacuucagauccggaaaaauaaacccaccacuguaaugguguuucaggucggugaugcucucuaaauucuugacuuucaggagcugccaugaccuccacaagguggggacuguugagggaggcagaaagggauuuguaaggcccccguccucccuaaauaccauaaucagcugaugcaugguagacgagaagagacauuuaucuaacucaguuguguggccacagguaaaaguggcucgugcuucuugaccuuucauccauucuuuuguaagcaaccccaauacaaagcauuucaucugucugucugucugucugucugucuauuugaaaguaaagaacaaguaagccaguugaucauuucuuuuuucuuuuuuuaacuguguagcccuggcuguccuggaacucgcucuguagaccaggcuggccucaaacucagaaaucggccugccucugccucccaacgugcugggauuaaaggugugcgccaccacugccuggccagcugaucauuucguaugcagcacugagggcuaggcugagucucuccagcacccaccacaggguaaugcugcugguucgccugcaaaugcuucaucugagccuuaaucacaaguugucguguacagguguugcaaacuuguuugccuaacauaaaggauaguagcagaucacaaaaauuaaacaaaaacagaaaaauaguuugugaugcauugaaacacucaaaaucaugaagacaaacaaaaauguuuuuguucauuuugcaauguaaaaaacauuacuuuuucuugugaaaauuuagucuuucuauacaagucaugcuuaacaauuaguaacuacauaagguuuaaugaagaacugauaggcaagcaugaaccuauuuacuguuugucuacugacuuguuuuuuuggggggggggggaucugagacaggguuucucuguguagcccuggcuguccuggaacucacucuguagaccaggcuggccucgaacucagaaauccgccugccucugccucccaagcucugggauuaaaggcgugcgccaccaccgucuggcuuuaaauacuucuugauacuggauagauaugucuucuagcugugggaaauuuucuucuccuuuuuuuuuuuuuuuuaaauaaugugccuuuuauccagauuacaucuuuuauaccuguaauuuaaagguuugguauuuauggucuccuggauauccugcauuucuccucuuccuacuccucuuucucuucguucucuccgccuccuguuccucuuucuccugaucuuuuuucuuaauuauuuauucuugcuaacugauuuaguuccuccaucccaaucucuccacuuccugucugucauuaaguuccuccuuuuuguguggcuucccucugaacuuuuuauuagaauuacuaaauuuuauauuugaaguucuaguucaguuuuuccucagaauuucuguuucuuacuaaauucuauuuuuauguauugaauuauucuuuaauucauucaauaauuuguuucuauuuaaucuaguagucuucuuucuugcauuuuuuucauguccccuuugaguucucugaaugcauuaagaguuguuaucuugaguaucauccaaguuucuuuccuuaaaaagaaacuauugaaguacuaauuuuuagaguagcaaauuuguuguuuuuugguuuugcuguuuguuuugugauaguguuucuuuuaguauggauauuuugcccucccuuguucaguguuuuuauuuggaucuguuugcucuuauugguuuggaagguuuggaauuggcuaagugauauuucagacuuauuuuugugggcaugaaggucuaaugugugguugugguaucacagaugaucuuugcucugcuagggcaaguugcugcuucggaucucauaguaggugcuauguagaaucagaacguucucauugcaguuucucugagauugagguuggagggccagagagagaugugugaagguuaccauuugguucacagaugcucaacauuagcacagaauuaacacucccagauagaaggaaaaagggaguguacuacuuggaaugcagcaggguccugccucagguccucaacugauugugacuuugguauuuguagggagaguaaaggggugauuucuuuggaaagcaugugcaagucucacuuagaggugcuaauauuucaaugggugguggguaaaggaagcugagagugcugucuguggaacgugggcaugggccucagcacagaugucaagauggaggugacuaggucuuaugaggggagagggagguacuucucguguaugcagacuggcuuguugcagauccccagaugggaacccuugguagaagaggaaaaaaaccuacuugucuaccugugagauacauuuugagacuugguacugauccuuaccuggaaagagguuagggguggaggagggacuuccaaaaguauugguuuuauuuuuuuauuucagaagcaaagaaaaauugaugugaaacauuuuuauugaguagcagacuauuuucagucaaaagaauaaugacauucuggcauugguauaguaacauauauaucaaacuguucaaugcuuuucaaauuauaauggcuaguuuauugcauuuuagagcacuuaaggaguuuuuuagaauuaaauauuagucaacaaucacuaaacauaccaugugacacauauugaaauaaaucauaccaaauggcuggccuauaagcugcuauggaacuacaacaaauuuuaaaaaaagaaaaaugaaucaaacucucauaaguauuucacuacauauuacagcaaauuuugacccagucaauucaucauuuuaaccaucacaauccgugcucuggacagaaagcucauuggcauacuuaaguuauuccacccuucagcauuugucccuaucuucuuaggggauuucugcuaaaaugcuuauauuuaaaauuaauaacauuaugaucauuucacuuggagauuauuucauuuugccauuauuauaaauauuuuaaagaaaauaccagauuagggagccccccccccccuuaaauugggcugucagguuuuuacuaaaagguaauugcuccaagccucccucucguagagaggugagacucuggaaaagagaaacaggagccucagcaauaacuccucuacugaauucucugcugcuauacagcauauguuaauugacagagaauuauaaaguauguuuauaaaguaagaguuuaagaguuugcagaacuuauucaagcacagaguacuaucacguaacuuaagaagagagauaaagaguuaaguuucuucaguacuuaaugaaguacagaccaguacaaaagaguuaaguucuuagcacagaacaagaagaaaaaaaucaaguuuccuacaaggcuggagaccaucagucuuuuagccugugauuccccuaagaccaggcaggcuccuggcaugugaguauagcagaauaucauuagaauucauuuuauggcuauguuccuuuggccgaacaguaguuuuugguuuucuccuaggucccuggccuauguagucuuagguucuuagacaccugagcugugucaggaauggguucuaucucauggaguuagccuuaaauucaaucagauauugguugguuacuuccacaccaguagugaacuagcauaucuuguaagcagguaaccauuguaaaucaaaaguuuguagcugguuaccuuaggaagaaacauuauuucuaaaucuagguuugcacugcaguggcuuuauagugaugaguuauaaauuuuuauucugacuuaugaaucagaauuucuaacuguggagaaaaggggaacagaauuuuaaacaugauucccugauaaacauugauaguaguaaaacuaauucugcaaauguuugacucuccuauauuggauaguuucuguaucccagccuaauguuuuggcaggaucuaaugugauaaauuuagcauaaaauggaugagcaggagucagaaaaccagaaguccuuauugguauaacucaugagugacuuggaaagagccauguugaucccucacauuuggaggagaugcacucucuauagucccucuuugacugguuuaaccuauaacauggcauguuuaguuucuuucauuaagagauucuauuuauugacuacaauuuucuagccugucuuuaaaccaugauuugccuaggaccacucagacaauauugauuucaaaaucauuuagaaacagaacuuuuaggucagggaauagcaucgggaagggauauugucuuacuaagguccagcuuaauuuuuucuauagguuauuguuguugggguuuuuuuguuuguuuguuuguuugauugauugauuuuuguuuuuugguguuuugaggcuacacaggguuucucuguguagccguagcuguccuggagcucacucuguagaccaggcuggccuugaacucagaaaucugcuugcaucugccucccaagugcugggauuaaaggcgugcaccaccacugccuggccguaucauguucauauacauauauauguauauauguauauauguauauauguauaucuauaucuauaucuauaucuauaucuauaucuauaucuauaucuauaucuaucaaucuaucuaucuaucuaucuaucuaucuaucuaucuaucuaucuaccuaucuaucuaucuauauauauauauauauaucuugauguuauuuuauaguccagucacuauucccccuccuggucuggccucuguuccucaucgcauaucuccccccccaucuccaauagaauaugugugugugugugugugugugugugugugugugucccugccaaaccucccacucccuggggucucaagucucucaagggcuaggugcaucuucucucacuaaggccagaccagacagucaucugcuguuuauguuuugggggcuucauaugaacugguguaugcugagugguugguggcagacugagagaucucuggggggaccagguuaguugagacugcuagucuuccuauggggucuuucuccccucagcuucuuacagcuuuucucuaauuccagcacagggguccccagcuucuacccauuguuggggcguuaaguaucuguaucugacucacugagcuguuuguugggccugucagaggccagucaugcuaggcuccugucuauaagcacaccauagcaucaguaauaaugucaggccuuggagcuuguccuuaauaugaaucccaauuuuggccugucaccguaccuccuuucccucagucuguucugcauuuuugucccugcuguuuuagacagaacaguucugggucaguuucugacugugggauggcagcacaaucccuccacuugaugccuugucuuucuacuggagaugaacucuacaaguuccaucuccucacuguugggcauuucaucuagggugccucccuuuggauuuugagacucucucaccucccagguuucugguacauucuggagggucugcucccccucccguccccacuuuuaauacuugaucauguugcccuucuccccucacugaccccucuccuauccagguuccucccuccuucugccccccacccccaugacuguuuucuucucccucccaagagugauugaggcauccucacuggggccccuuggcuuuuguggauuguauccuggguauucuguacuuucuugauuaauauccacuuauuagugaguacauaccaugcauguccuuuuggguaugaauuaccucacucaggaugauauuuucuaguuccaugaguuugccugcaugaacucguucuuaauagcuaaguaguagucccuuguguaaaugaaccacguuuucuguauccauccuucugucgugggaugucuggguuguuucuagcuucuggccuucacagauaaggccacuaugaacauacuggaacacuugccacugcugcauuguguggcaucuauuggauuuaugccccagagugguguagcggguccacuuuagguagaucuauuucuaguuuucugaggaaccuccagauugauuuccacaguggucuuacuacuuugcaauaccaccagcaaugaaggaguguuccucuuucuccacauccucuccaacauguguugucaccugguuuugauuuuagccauucugauugguguaagguggaaucucaggguuguguuaauuugcauuucucugaucacuaaguguagccuuccacaagccugaagccaccugagccagaccuugacuuugcaauaccacuaaggagaucaccuaggguggagccugccucccuagaucacucuauuguucagccacuaccacugcugcuaccugcugggagucugccuagcuauucaguagccuacacguggucacuugcagcugggcuccaaggaugauuuggcaggaaugggccuccccucuccuuuauaaagcgugcccaccauuaaaaauuugagucuugaucagaauacuuucuuggcuccauuucucucucuacccuccuagauucccucuuuucuuucaguuccaagaugccucccagguuccaacccagacaugagagcugcagguccgccccaacaacuaaguacuuugaacauuucuuuaagugcuucuuagcccuuugagauuuuucuguugugaauucuuuauuuaguucuguacuccaguguuugauuguuuuaucuuuuuaucuuuuuuuuuuuuuaaaacagguuagcugcuugaguucuuuauauauuuuggauauucuguagcuuucuacagaaugugggguuagugaauauuuuuucccaaucuguagguuacagauuuguccuauugucuauauccuuuacaauacagaagcuuuucaguuucaugaguucucauuuaccaauuguugaucuuagagccugagccauuggaguucuauuuaggaaaucuccucuccuccuugcuuucaaaguuuccauugagaauguuucuuuuuucuuaagcagcuuuuaauacucuuuuuuuuucuguauggcuuauguuuuaagugucuuauccaguggagaauuucuuuuuuaucuuaucuauuugauauucuguuucuuauaucuguaucuaaaugucuuucuuuauuugggggacauuuucuucuaugauccuguuguuucaaagauuuaaucuuuucauuguaucugacaguuccugugucuuuccuuuuuaugcuuuauucaaauuuccauauucuuugcuucuacuaucugauccuugaguuuucugauuguguuuuccaauucuuucuuuauuccaccuugaguuuucuucaauguuuccaucuuuuuaucgaauuaccuugucaaaucuuacauugucuuugucauuuaauccagugcuauuuuuguauuaucuugggcaccauucagguauuaugcucuuaaauuucauucucuaagguuuuugagguuuuuuuuuuaaugucuucuuuaaacucuuuucuuugaagucuauaauuucucuuuuauaaaaaaaauucuucaugcuuagguuugcugugguaauucucuaugccaaauauuuccuucuguaugacuggauuuaagaugacacauccuauuuugacuauucacaauguguuuauuuuugugguuaaacuugggcauguggguuuauuuuguuaguuuucugucugauguagacauaguauacugugauaggaaacagauuaaacaggaagcuugauccugaagguugaauguaaugucaaaggacucucuccuggaagacaggaugugccuccuguccaaagccuguagauuguggguuauaagagcagagacuuggccuguucgcuggauuugaaaucuggauuauaucuagcacuugagaguggauguuccagaaaacuuaccaggauagcccugguguaagaugcaucagaucuggcuuagcugaaagguugcaugacauucaaaagggaugaugucagaugguaccuggggcucuaugcuaucauacauaaugucccucaguucagagcuuauauagguuguggccagugcaagcacagguuagacagacaguggaugggcaacuaggacuagauuuggggacuggguaugugaaagaaagggaagaggaggcagaucccucaggcugggcccuggagcaagauacacaguauuguccugcucugagauguuauauggaauaccaggaaacaguaauuuuauuuuuaaagauauuuaugccuguuuuagaauuaccuugauauuuacagaaggaaaaagaaugauuaaaaaacuggcaaaauaacuaucuaucuaucuaucuauaaaucauauaauauuauaauaauauaacaaaucauaaaauauguaaauaggaaaagacaagguguuuugaaccuccaacuacuucauagcucaucauuucuugauguccuuugccaagcuauaugcgcaaguaaaucauuacaagggcuuauuaccuccucagucuguuagugcccucaguggccugugccucagaaugaagugugagaauccaguuccccagcagaguacaguacucuguaagacauucuucugagcaucuucuucucuaggcauuggacagcagauggaguagcuuauacuuccuucauuccuuugaauuaaaaguaccucagaauuguugcugcuuuauauuuuguagccuucccacccaaagguucuuaaggaccgauauguggagcuccagccucaggaucacugagauuuaugucauaaaauauaaaugccgugguucuacccugaauguucagaguuuucaaugcucuuagaucuguuuauagacuuccuggucgcucugauucaugcuccagugucuuuuuguugaggcauguaaugugucuguugagauuuagaagaagcaggucaugaaacuugacuaaaguucauuugaaggaaucuguuuaauucaaugaaaaaaaugagcaguuccaggcuccuucccuggaaaaauguaaggaaugacgaaggugauaaucccaugguaucaguguccgcauuuucuacuuuuguuguuuucuggcagucagcauuuugguaaacuuauucuaaagcauccacaggggugcuucccucagaauccccauuuaacucucgaaucucuuguauuaguuguugcccagacauagccuucucauucuuucucaaggcaucacugauaccuuaaugaguggucugcaaaaauaauugccuugucuuucuauacuuucccgcucucaaaugccuauaaucuuauauccuuaaguucccuuuguaccugugucgcauaggguuaccacuuaagacucuagggagccaagccugguggcagagucuuguaauacaaacuauucuggcugaaauaggagagucucaauaucaaggucuuccuagccuacagaacaaauucagagcuaacccaggaaacuuaguacgacgauauaucaaacaaacaucacuguuagcuucccugaagacauugauucacuucccauccuugagcggauagcuuugcuuaaaggcagaaguucucuguaagucuuugucaggaaagagcagcaaauacggaagacaucucaacccuagccucuuccuaaugucagaauccuaaagccuggcuggucagaauuuguagugauuuuuuuuuuuaauuagguauuuuccucauuuacauuuucaaugcuaucccaaaggucccccauacccacccccccaauccccuauccacccacucccccuuuuuggcccuggcguuccccuguacugggacauauaaaguuugcaaguccaaugggccucucuuugcagugauggccgacuaggccaucuuuugauacauaugcagcuagagacaagagcuccgggguacugguuaguucauaauguuguuccaccuauaggguugcagaucccuuuagcuccuuggguaauuucucuagcuccuccauugggggccgugugacccauccaauagcugacugugagcauccacuucuguguuugcuaggccccggcauagucuuacaagagagagcuauaacuggguccuuucagcaaaaugcaauggugucagcguuuggaagcugauuaugggauggaucccugcauauggcagucacuagaugguccauccuuucgucacagcuccaaauuuugucucuguaacuccuucuauggguguuuuguucccauuucuaagaaaggguaaaguguccacacuuuggucuucguucuucuugaauuucaugcguuuggcaaguuguaucuuauauuuuggguacccuaaguuucugggcuauuauuaugcacuuaucagugaguacauauugugcgaguuccuuugugauuggguuacuucacucaggaugauacccuccagguccauccauuugccuaggaauuucauaaauucauuuuuuuuaauagcugaguaguauuccauuguguaaauguauccauuuucuguauccauuccucuguugaggggcaucuggguucuuuccagcuucuggcuauuauaaacaaggcugcuaugaacauaguggagcauguguucuucuuaccgguugggacaucuucuggauauaugcccaggagagguauugcgggauccuccgguaguacuauguccaauuuucugaggaaccgccagacugauuuccagagugguuguacaagcuugcaaucccaccaacaauggagaaguguuccccuuucuccacauccucgccugaguuuuugaucuuagccauucugacuggagugaaguggaaucucaguguuguuuugauuugcauuucccugaugauuaaggauguugaacauuuuuucagguguuucucugccauucgguauuucucaggugagaauucuuuguucagcucugagccccauuuuuuaaugggguuauuugauuuucuggaguccaccuucuugaguucuuuauauauauuggauauuaguccccuauccgauuugggauagguaaagauccuuucccaaucuguugguggccuuuuugucuuauugacagugucuuuugcuuugcagaagcuuugcaauuuuaugaggucccauuucaaaauuccaacucaauucuucaacgaacuagaaagggcaaucggcagauucaucuggaauaacaaaaaaccuaggauagcaaaaacucuucucaaggauaaaagaaccucugguggaaucaccaugccggaccuaaaacuguacuacagagcaauugugaucaaaacugcaugguacugguauagugacagacaaguagaccaauggaacagaauugaagacccagagaugaacccacacaccuauggucacuugaucuuugauaagggagcuaaaaccauccaguggaaaaaagacagcauuuucaacaaauggugcuggcacaacuggcgguuaucauguagaagaaugcgaauugauccauuucuaucuccuuguacuaaggucaaaucuaaguggauuaaggaacuccacauaaaaccagagacacugaaacauauagaggagaaaguagggaaaacccucgaagauauggguacagggggaaaauuccugaguagaacagcaauggcuugugcuguaagaucaagaaucgauaaaugggaccucauaaaauuguagugauuucuaacaguuccuuuucuuuuugugcuguuucaaaacagagagcggugauuuuuaaaaauaccaagguaaguuuuaaaguaaugcuuuaaaauuguaaggaccuuguuuuuguucuaugguaugcgcucucucccuauguucuugcugauaaggccccagaaucagaacuuguguuguucauauuauucuuugaugaaugaauguuauauucucuguuuuaauccuucagaaaugcaucuucuguagacaccggguuaaaaagguuucuggagccugcauccaguguucuuauggccgcugcccagcuucauuccauguuacgugugcccaugcugcuggagugcucauggagccugaugacuggccuuacgugguaaacaucacaugcuucagacauagagucaacucaaacgcgguaagaucugcucucccauuugcugacacuuuauuugaauucuuucugggaccugucacaggucucuaauaccuugugaguguugacauguccagacuguaguauaauuaagacucggaauugagaacuauuauuuaaacauaguugcucagaaccauucaguuucggcuaugcauuaaacacaguauuuauaguaaguugaaugagugaauguauacaaaaaugagucaaacucuuaggauccauucuuuuuuuggaucuguguacagauaucugaauaguuguauauagauugugcuguucauguguucagcaugucagaagauaauuucaaguagaacaacgugaaaagagcuccuaaaaucugcaaugcauucugugugcaaugauacacauuuauuuaaaucuuuccugaaagaaagaaauagcaacaacguuguaaaaggaaaauggccaggaacuuuugcuucuuucuaccuaacacaggauaagugagcucuaacaugaaggcccuggaagaucaguggaauaugacuaugaaaguguauaacuuuuaacgugaggagaauauauuagcauagauuauagaaaggaaaaauaguuugccccccuucauucauauuacuuaagacugaaauuccucuaagaaaauagaauuuguacgcagauaacuugaguuuaaacuguaauuugcuuaauuuuuccuugguuaaugaaaccauucccuugacuuaaaagcuuaaaaggauuagggcaauauagagauuuguauccuuacaagcucuuccugucucuauuaauauuaauaauauuuuucuccucuacucuuuuuuuuuuaaauuauuauauguaaguucauuguaguugucuucaaacacaccagaagagggcgucagaucucauuauggaugguugugagccaccaugugguugcugggauuugaacucaggaccucgggaauacaagucagugcucuuaacuccugagccaucucaccagcccuacucuuuuuuuuuuuuguuuguuuuuguuuuuguuuuaauggaaugacuucuauuauuugacaacuucacacauguaaaaaacauaucuuugucauauggacccacuaaugaucuuuuaugagcaggugccaaaauuguccacauugacuuguagaaauaucuuaccuacacagcaaccuuccagccuuuuguaaugauuccauuagugucuacuagugucuuuagaaauagcugacauuuguggcuagcgauuguguggaugugugagaauguucaaauggacaaacugcuguuaugagcuccuuauuuuaaaguuauuuuccauuaugugaaauuauagguugcauaggagacacccaugucuuuuucuuaguuaguugauguccuuuaaucaaaaagauuguauucaguaacaaccacacauuacuagacuaauaaauuaguaauaauauauacauuacuguggcacuugccacguacaucaagaagucaauaauguuaccccauucagugauucuggauguauucuguaguauaauaagauccugaccucuagagccauagugaucaguguucaugcuuagaaucugccaauaaaagcugauagcuaugaaaaagugaaaauguauacuaauuuuuuuuuacuucuacgauugcugguacugcaaucuuacacgaauaauguaaguauuuucuuguuuuaaaaauaauaaaccuaauuucagaggcacuuaauucuaugcacaaucuguuguaaucauaaaugacaggugacugacuguucaaccuauaugcucuauuacucguugaacccuuaacuccaaacuuaaauagagcuaacaguaugcuugggaccauagaucccauuuuaauacugcagugcccuguggcuauaggugauucuguugaaauuggacuuaagagcucuaggacucuggcuccgcuucacucugguguguggcuuaguuaggcuuaggcugcuaaccauuuacaaaagaugaugaaaaaggaaacaagacuugucagguaauuuagaaacuacuuuaugugcgguauguuuauaaaggaauauaucauauaccuuaaauauaaauaaaagaaguuguagguuuugaaauuaauugcucccgacccucugcagguaacucuagguuguugaaguauaguccugguagcuccuacuuagcuauucuucaauuagacuccaguacaauugcugcuuuaaucuuaucuugacauuacaucaacauagauaaggauauaaaagaaauaacaaguagcauuuguauagcuucuuacauaguauuguguauguucagacaugcacaggucuugaaaaaaguaccugcauccccauuuucugaaaucguaaagagccauucaccucugaaaugaaccauaaucgcuaauuacagagaagauguaaaacuuuuuaggacauauagcagagaacugcugauagauagauagauagauagauagauagauagauagauagauagauagauagauagaagauacauauauacauuuaaagauuauguugggcaaaugugagaugaugugagcagcaauuaauaaaauacaauaggacuuauauacaauuaggaauaagagauuaaucagcucaugcugacacguuugguagguagguagguaaguaaguagaugcaagagaacauaggagaugcccauaucaaauaccaagugauaucuaguaaauuuuuuaagaaugagauuuuuuuuauauaaucacagcuccagacaguaauccuucaagaagaugaacacugacacuuuaaucugccucguggacuuaacuugaucaaaugagcaggaugaucagcaugugccaccaucaucauaaagaauaagugagauucguuauuggauguuaaaucuaaccagacuuguauaaggauuaugauguuucuccauaguaagaaaacgucccauauauuauauauuaauauaagagaaaaauagagaaauugggucacucuuucauuuagaaucaaaaguaacauugagacacaugcagacaucaaguacccucagauggaaagaauccugaaaagaauauaguauaguacaguacuguuuauaaucauggggaaauauuauacagauaucuauugaaaagcagaaggagaaauuuuaucuuucuaaaauaucaguaccauuuuuuuuaaagaaggucuauagaaaugaauuuauaugagucuaaaaugaugggacagauaaacaaaacugaaguggagaauggauccuuuucuucagaguuuugggggagaggaaaggaaagcacuaaggucauuaugaggucaguugaauccaggugacagauuaaaaugucgugcuaguguucaccuucuucuaguugauuacuaucuagagcugugguuauauaacaggauaccucauucuuagaaaggaaacguugaaguauuuaggugaugaacaccaugaugugcauugcuucaaaguaguuuaagaaaaccauagagaauugaagaguugggcucagguaucaaagacaagccacagaggcagaauuauacacaaaugaaacauaauuucuauccucuuucacacugaaauaucagacaacaaagcacauccuaagacguuaguuauuauguguuaguaagcagcgacugacuaauagaugaauuuugauaccugucaaaggauagaugcucuacuuuuguacuaauuguagucuuuacauuugaaauuauucuuuaauacuaaguuuaaaauauuuaaaucuugacaaggucaguuuuugcuucccaaguaaauacuuuuuauuuucuguucuuuuuuucauauccgucucuuuuuuuuuuuccuuuuucuccaucucacagaaauccaaaacuugugagaaagccauuucugugggucagacagucaucacaaaacaucgaaacacucgguacuacagcugcagagugauagaugugacaucucaaaccuucuaugaggucauguuugaugauggcuccuucagcagagacacauuuccugaagauauugugguaaggaggauuccccuggaugucugauuccuuagaacaggaauuuacuuguuuaagcuguaaaaagguaaggcaguccaaaaguuaaguucugaccuuuuucucuggugaguaccuucuugcugaacucuuacaugggacaggacuuuguuuggaaccccaucucucacuugauguccuguaugucugcuggagguggcucuauaaguucccucucccugcuuucaggcauuucauauaggaucacucccuuugauccuggggugaaucucucaacucccaggucucuggugcauuggggggggggggggguccuaaccuccuauuuccugagguuaccuguuuacuuucuuucugcuggcuucagggcuuaguccagucuguuaacuuuugccuuuuuauaggugaguugagagcccauuaauauugagagauauuaaagagagaugauuguugguuccagauauguuuuuguuuguuuuuuguuuuguuuuguuuuguuuuauuuuuugguacguggcuugaugugcuuguggcucucugcuuuugacuuuguugugagauauccuuucuuuggugcagguaucuuccuuguguuguaguuuucuuuccaguauucuuuguagggcuggguuggauagauacuguuuggauuugguuuuauccuggaauauuuugguuucuccaucuauguugauugagaguuuugcuugauauaguagccugggcuggcauuuauguucucuuagagucugcaugaccucugaccaggcccuucugguuuucauagucuauguugagaaauaugguguaauuuugauaaguccaccuuuuuauguuacuuggccuuuuucccuuuaaucuuucuuugcucuguucauuuaguguuuugguaauuaucugacgagaggauuuucuuuucagguuccauuuauucggugguucuauaggcuucuuguaccuuuauguccaucucuuucuuuauguuggggaaguuuucuucuaugauuuuauugaagacauuuucagguccuuugagcugggaauuucauuuuccucuauuuccgcuauccuuagauuuggcuuuucauuguauccugauuuauucauuguauccuuagauuuagcuuuucauuguauccugaguuuccuugaugcuuuggguuaggaguuuuuuauguuuugaauugacagcuguuucaaucucuccuaccauaucuuuuauaccugagauucucucuucuuuuucuuguacucuguugguaauaauuacaucagcaauuccuuaccucuuuccuagguuuuccauuuccaggucugccuccauuugcauuuucuuuauuguuuuuauuuccacuuuuaggucuuggaucgcuuuauucaaucccuucaccuguuuaccuguacuuuccuguauagaaauacaggaaaauucagaauacagaaauucagugcauuauugauauccuccuuaaaggacucuauuaucuucaugagauaagauuuuaggacagauuccuaauuuuccuguguauucagggcuugcuguggggugaaaacuggcuucugaugauguccacauauuuuggcuucuguugccuauggucuugcucuugccuuucaccaucuggauaucccagaugauuguuggucugggugacuguauggagucugccucuuuugucccuggguugcuucaggucuccugguaggcuugcggcccuggcuguaucagaccaucuguggggccuuccuacugggggcucuucacaggggcagagaagcugcugaucuguugcccugacugcaguagaucuccugggaggccuucagacuguuggaucuucuguggaacagugaagcuguuguccagcugagugcagaggauccucaacugcucugagcgcagugggucuaacugcucuucaugcugcagguccucuaggauguaucaggauauggagucuucaugggagcaacuaggagccugccccagcagcaagggccauguggaagggcacaucucuguauucuuaacugggucagggauauuucucagccaguaaagguucuugcugccaaaccugauuaaacuaauucuguucccugggcccauaugaugaaggagacagccaguuccuacauguugucuucugacuuccacauucacaccaugggaugcacugacuucuccaccccaacacacucucacacaucuacacauauacauguacacaaaauaagcaaaacuaaaguauucacaagauuuaaaaugacauaaauggaaaccaaacuaauguuuaaaagauuuuaaauccaaugaauuuauacacauugaaaaucuuggaauuuuucccaaugaagacuaauggcuuauuggaguauaucugaagcugugugucuguacugcucucagagaucaccacagugaaccacacaaaccugccaagcagaaaaggaagugacacuugcuacugcucccacagguagagugaaacuuacaaacuuaaugucacaguucaagacuauuaugguuaauuuuauguccacuugacagugcacagauuuuuuuggucaaaccuuuucauuuuuuucuagaugaauuuuacauuuaaauucauugaauaaaauagauugcccucuauucuuugguuagcccuuauugguaguccucuagugguggaccuacacggaacaaucugacuucucccaaguuaaguagaaucguugcugucugcucuauguuccucugcagacgugggucuucugcauuuagaaagauuuuuuaaaucuugugaauacuuuaguuuugcuuauuuuguguacauguguauauguauaugugugagaguguguugggguggagaagucagugcaucccauggugugaauguggaagucagaagacaacauguaggaacuggcugucuccuucaucauaugggcccaucagcucgucagcuuuucuauaugucuagccugcucaccgcagaucugcaaacuuugcagcuucuagcaucuuggaagacugaguuacaauuuugcuuuuaaauaugaaaaucaaauuaggacaacaaauuuaaugaccauaaguuauuuaugugugacauaaauacaaccuauuuugaaggcugauacuucaguaaugaaagguauaguccccuauuuaaagauucaguguucagcucacuuuauuaauucauuagacaagaguucucuaaugcaaaaacucuauauuugaaaauaaauuuggcagucauaaagggauuggaauuuuguuucuagagaguauguauagcagcaggaaauuucacuaccuagguacuuaauucugugguagaaaaguguccaaaaaauucucacgaaacagagcaccuauacaaaguguguauuggccaacuuaaccucagaaugaaauguuuagcuguugaaggaaauaauaaaugauauauugcuacaugcuugcaucugucaguuucuuaaacauacucuugaugaauuuuuguuguacauuauuuuaacagaaauuaaaaaugcccaucuaaaagaaauguauagcguggggcuccuuggccccuuuagcauaugccaaagccugggauccucgugaugccugccuuggcuccagagugagauucacuugcuucuuuccucacuuggaguucauuucaagggaugaaggggccuaagagucacugcaucuucuuggauaggcacaugauauacaccaugcaccacaaagggaaaauugacugccuagaaauuugaucacaggagcccaucagugaaacaggaguuguuaaaaacaauuauauuuaaauuaaauuaaauauuacaugcuguauuagauaaauagacagaguaaugucacuuagagugguuauguuccuucugugaguaauagacuagcuaccaaacuccagcuucagucaugggaaaccuuacaucuagucuuuguucagagaaguugaagaaauucccaaaauauaaaagcuauugcccuuguucuugauuuucauuuagaacuugaagagucuauuguauagacaccaugcaugcuuugagcaugagacagaggaaucgagcugaaacugaucaggaugccugcucucugaaaacuagcucucguaguuucaggaggugcuuugcaagcugccaaggaauaccaucaaguuguaccaagggugcaguaaugacaguuagggccacucaaugggagggaauucgugccuuguacuggacucagccaacuacuuacggcugguaaggucauaacuccuagaggagacccuauuauucucacuuuccaaaaccaguauaauuccuaauuuauucuaaagacuuauccagacauuaguguaacucuuaccuuuuaucaaaaaacuccuuuuugcagcauauagagaccauuauaaaaacucacagcuuguauauguauaguguggugucaguuauguauaaauagguaaaggaaaggcccucaaaggaaauacaccaaaauauuacuuuuaucugaagauuguuaucagucauaggugauuaugacuuucauuuuaugguuuccauaugaauguuuucuguuuauaagcagauaaaagauuauauauuuuauucuuuacuuuuuccucaguuuuuccuaccuggaucauuucagauuacuuuaucaaauauuuuauuuuggagccaucaucuauugauguuuccuuuguauuccuaauuaaguuucagucauauaauuuuuuuuaauauauacaucuaguaaugcccuuucguauccucuuuucauuccugcuauaacuuuuuucuuccagucucuuucuauuucugugccuucucgugagugagugugagugugcaugugcgugugugugugugugugugugugugugugugugagagagagagagagagagagagagagagagagagagagagagaggaaagugacagaggccuauugaguuucauuagauuuuguuuccuaugauacaugugagguaacuuacuggagcuggagcaugucuuaacuuaaaacaaaaaaggacuccuccuccauaguuuaucuuagcugcaaauaucuucuuagagaguguguggucucaugaaucccuccccaauccaugggauguugacagguucaauuuaguacagcucuuguggagguuaccuaagcaucucugauuucaugacuacaccagcaacagccuuuccaggaaacaucauuuuccaauuuuagugcauucucucucccucucccucucccucucccucucccucucccucucccucucccuauguguguguguguuuguuuguguguguguguguguuuacacccuuuauucuauaauguuaccugagccuagggugcgguuauguagauaucccauguagcacugacuaucccuuauuaaacucauuuacuuauucucaaccuuuucaccaguuacaagugucugcauugauugcacucauguuaagaagccuuucuaagcagcugauaguacuaaucugugaguauaaauauuuggaagaagauuuguuucuuucaauacauuuuaucaaaacaccaguauuguucuccuuuccuuuccuuuuuuuuuuuuuaagauuuauuuauuuauuuauuuauuuauuuauuauauguaaguacacuguagcugucuucagacauuccagaagagggagucagaucucauuauggaugguugugagccaccaugugguuacugggauuugaacuccggaccuucggaagagcagucgggugcucuuacccacugagccaucucaccagcacuguucuccuuuccuuagucaaugacuuaccuagcuaugggcuuuugcauauuuacaguuacaggcaugaauucucucccacaaaauaggccuuaaauccuaucagaauguaauuguuuaccuccauaucagucacgccacuguagcaucauugggcacaauguccugguagggugauauuguuacacacuggcaaauaacugguuaagacuauggcugacuuuuuuccucugaacccugcauagcaucuuucagguaccaugaaagcuaguugaacaucaagaaagcauccagcucagcuauaguuucauuucuucauguccugcagcuaaagaauagcucagcaauagacuuuucccauuaaguucuagugggcaaguaagaggaaugagauauccuguguuguuugagggaucuccaggggccucuuugaccaacaacuuuuagaaauguauccuaugcuuuguauagggauuuucauuuaacaaacuuauggcuucuaggagagggauuauccauccauacagcuuuuaucauuguauuuuuaacuacuuuacaaauagaaguuguucauaugccuuuuucauauuuuuaaaaucugauuaccuaccuccaacucuacaugccccaacacucaucccuucuuacccuauuucaaauaaaacauuuucccucuguacuuucauauuacuuuuguuauauucucuccauucucuguuaaguucauacacaaauucacacucccucuucacugcaugcauauuaaaauuguaauaccuucuuaauguucucugaucaguauaaagugacauuuuuagucccuucuaacuaguuuuaauuuaaagccuauuuugucagguauuagacuggccauauuuguuauuuccuaguccauuuuuuuucuuuucuuuuuguuuuguuuuguuuuuuuuuuuuuuuuuuuuagaauagccuuuucuaucguuuuaccuuaaugugguaucuuccucugaugaggaaguauguuucuuugaagcaggaaaaagaagagugcuguuuucuaauucaguuugccauucucaucuuuugauugaauaauuaagaccauuuacauucagggcuuuuuuuuuuuuuuaaugguauguuauaaguccugucauuuuuguuuauuuucuaauguuuuguguuuucuuaguccacauuugccuaacugguuuagcauuguuugccccuacccgaacuuccugaauauuuucauugagaaaucagcuguucugauguacucucuuauauaauagauuuagucuuucugucuugcaaucuuuaauauguuuucuuuguuccauaaucuuugugcuugaaauuaaacugggaguuucuuuucugccccaguauauuugauaaucuguguaccuuuguacaugguuguaguuauauuauagaaggcugagucauggauagugaguucccaguccccauccaucacugugauugcauauuuccuuaugcuaugugcauucugauguauguuugaguaccaaacuagaucugaaucccuuuagcgaaagaauuaggaaaaaguugggugguuuuuuguuguuguuguugguguuguugucuuaaaccuguuuaccuaauggucagugccaggcccugaggauauauuuaguauguuauuguaaaacccaaugaucacccuuuccagagaguuuugacuuucccucccaccaauauuggaacuugacagacagagaaggaagguaaucugucucagagaaggcaauucuguuuccuccauacucucaagcucaaaagaugcagagaguuuccccaguacugcagagggcaacccccagaccaaccucacuguaccugcugcugccuggcccuauucccacagccccuuaaaacaggcugguuccccaguaccagucuugugggggguuuuguuuguuuguuuuguuuuguuuuuuaaaagauuuauuuauuauuacauguaaguacauuguaguugucuucagacacuccagaagagggcaucagaucucaucucauuacgggugguugugagccaccaugugguugcugggauuugaacucaggacuuuugggagagcagccagugcucuuuaaccacugagccaucucuccaggccccccacucuuguuuuuaguuauuggcuuuucugcuuuuuucaugguaucuaacuuuagaggaaccaagaagaaaacuuccuaaagaaacauuuacuuaugcauucaaagcucccagaugucaaggcccauuaauucugauaccauaaagauugccuucucucauaaacagaccucaugcuaaugcugaaauacguuuuaaaauaauaaucuccauaucaggauuuucuguucuuuucucagcccuguguauacucuugacauauggcugaaggagaagugcaaaccaacaaaccacuuggccuugaggaauucuccaaauaaguacuaaugcuguuguuacauagaagaugauuuguguuugugugucagggccuggcaauaggaugugucuaauagccaagaauuugguuuaaugaagaaacaaggugggcuuugaaguaacauaacaaugacaaccacaguauuguggggguauaggaagagguguauucacacaugcauaugcauuuauuugcuuuucaaugggggaaaaaaacuauuuaaaaaaaaaaaagauaggaaauuagacuucuuacuuuuaagaguugaauccuuuaacccugaaccuacauuggcaaugauccuguauguaacacaaaacauguauaggcagauaacucuggguaagagccuuucagauuuucuuuuuagcauauuaaaugccucucaauguaauauaaaguuguuucucuuuucauacauaaacauagccuuacauuaucacagucuuaacauguaucuauuuuacauuauuacaaauauguuugcagcuacugggcuguacaauuaauaugggggaauggcaaaucuuuuuuuaaaaacauuuucuuuuauuggguuauucaauauuuugaagaaaauaucgaauaaaauauaaaauaauuggauauuuacauuuuaaauauuauccccuuuccugguuuacuccuccuagaacuccccccucuucccauccccucccccuacuucuguguggguguuccccuuucuaagaaggacugaagcaccugcaccacguuggugcugguucaacuggaggucagcauauagaagaaugcauaucgauccauucuuaucuccuugaacaaaguuuaagucuaaguggaucaaggaccuccacauaaaaccagauaugcugaaucuaacagaagagaaaguggggaaaagucucgaacacaugggcacaggagaaaauuuccuaaacagaacaccaauggcuuaugcucuaagaucaauaaucaaccaauggguccucauaaaacugaaaagcuucuguaaggcaaaguacccuauauucauuuaacauuuuggcaucuggucuagcuugaaguugcacuagucuugugcauacugucauauuauugugaguggauauaugaaauuaccauacuguauuuugaagacacugucuucuuguuccagugggcaugccuugccagaucaguuguuauuguaguucacaggguucacugcuauguaagauuaaugaaagcuagccagcaggcaaugaagcuuccaugucaguaucaacuugguuucucauuuuuuuaugagucaaguauaugguauuuucaguaauagggucuuacuaucaauuauaucuaaauuauaccuaguagaauuggcauauucuaauaaauuauaucuaauagaauuggcauuacuaucaauuauaucuaaauuauaccuaguagaauuggcauauucuaauaaauuauaucuaauagaauuggcauauaucuaaguguuggcauauucuguaaaguucuuuugguuaauuuggcuauauaucuggcuguauaacuuuuuuucuuguuuuauuauuuguauguucuuuuguugauagcagaucacuuuguaaucuuggcuguccuggaacucaguauauagaccagacuggccucaaagucagagaaauaugccuaucuuugccucuguauuagaauuaagcauacauaccaccaagccuggcuugcuaaacuuuaaaaaaaaaaaaaaacuagcucuuuuuuuucauugcuucuuuguaucauuuuuuuuuauuucuaugcaaugaauuuuagcccugaucuugaaaaaaauauuaauuuuuuuauauuguuuguucuguuuuucuucugcaggcuuuuguugcaucacuaaauuguuaguuugagaucucuaaaacauuuuuuuauauagauagacgcuucuauaaacuucccuguuaggccugccuucauuuguccuauugauuuugguauuaauuuucguccaauuuuaggaggcuuuuaaauuuucuuucuugauuuuuuuuucugugaccuaauuaucauucaguaguguguugcuuagcuuccaugaguuuguguacuuucuauaauuccuauuucuguugauacccaguuuuaucccacuguggacuaauagaacacuggaugccauuucaguguuccuauuuuuauuaagacuugcuuugucuucuaucauggaguuaauuuuggagaacauuuuaugagcuacauaguguuuggauggaaugcucuguaggcauuauuuagaaccauuugaaugaugucauugaauagcagcauuucuuuuuucauuuuuuugccugugaaucugugagagugagauauuaaagucuuccacuguugcgggaaauaauaaaaaaugauccugccaacucuccugccccagagggguuccagcucuagcacuggugggccacaacacuguguccuggcaggguaccgcucacaaggucucugagagacucucucccagcuagcccccgcuguguuuguuccaucaccacuaguucuucuucauccauaaaucuauauaguuggagaucacauauuccaguaacuacaugggaccgccaaccucgcgguuacaucucacaacccaauaccccaguagaaucaagacucuguaguuaaccaacuagauuuauauaucaauaaaaucucaauuuacaaaaugccaauaaagaauuucagagccaguugguaaugauaaaacuuuaccccaauauuucuaaacuuaugaaaucauagcuacuuguggcuaguaauugccacaggaguucacagucugcggucuugguucuucucccuacccucugggauacucccucucugcaauucuuagcucaaccccacuuugcccuguccauucacagaccucugcacuaauguaauuggacagggaacauccugcaacauuccacagucacucuguuggggucaaucugugguuuuuagaucuaauguuuucuuuaugaaaugugaugcccuguguuuugguguauauagaccuagaguuguaauauucuguugguggguuucucuuuuacuaaaaaugaacugauaguccuuaugucuucuuccuaguuuuuguuugaagucuguggucuugaauauuagaauagcaaugcugcugguucuuagucccacuucuuuggaauuccuuuguccaugcuuuuacucuaagguguucucugucauuacuggugaagugugguuuuggaggaagcaaaaguauggauguuguuaucuaauucagucugauagucagugugguuuuguugaagaauugaaauaguauuuaguuauuauugaaaggagugucugcuccugucauuuuuguugguguuguguuuucuuggaccucuuuauucuguguccugcuauucauuuuuuuccuaugacuucuugugugucuuuacccuuuucaguugaaggauuccuuuuaggaucuuuuguagagcuuguuuaguagucaaaacuuacuuuaaucucuuuuuaacauaaaaaguuuucuuuuuccuucaguuuccaacuagaacaauuaaacaucugugccuuucauacuuaguccucaccuggcaauaaaaugaccacuucuuuuuagggcagaaauuuauuaauagaaagaaauaucugacaugucccuaguuguaaacaaccaaauauguccuguguuucuuucauuuaaacauaaucuuuucaggcagcauuuauagcuucauuugucaaaaauauauuucuuucagccagauuaauaaccucucugagcauauuuuauuauuugacacauauauccucuuggcagaaguuagcuuucugaaugaacuccccuggggaguuuugcuaaucuuagaggagagagacaugaaaccaaacaccagaagacagaaaacuuuggauaguuucugugggaccacuaguacaccuguauaccguaaccagcacacuuaauggauacaggagcauucauguucaggcaacugaaggaagacacaucccaccuccuccaaauaccauguguugcggccgccagcagcucgcaacgugaaugguucgacugauauggcuacucgagcuguaagagaggaaucuagauggggcgaaagaagaaacggagcuaagacaaauucauucugaucaaagcucaaauuuuauuguugcgacacuaguuaugaaggaagggggaggggacccgauucccaccgaauaaucucugguccaguagaaaggugagcaugaguguggcuccgaacagcaaagcggcagguuccagcaguaggcguggcagaacgaaugagcaggaagcuccaccccugagcaggcagguuucaggcuggggaaggggagacuacaccaugucccuuccaucccuugucuuuuccuugcagccugaaucaauucucucagcucugacuuugaggccccucauccccauuauuuucagagcuugacugacugacauucagcgucauuuaugguagagguguuccuuggaugcucaguauuguugccaguaaaauaaauaucauaauuugccacuucauaugaucucaacguggguuggggguaguagucuuauaggccuaccccagcucaguaucuaauggcauugaauagcugcugugacaggauaguuuucuucaaugguuugaccccuguaccaucaacuccagugcagccuucacauccaacacaaauuaggcaacacaauuuugacuuuauggguguuaaaaagagagagaacucuaauuuuggguaaaucagaaggugggauguauccaggaaaauuugggaaggaggauaaaugugauauaaaaaauacauuguaucaaauucucaaagaauacacgaaaauauguaaaaauucugucuacuuuaaagaguaauuagaaagaucaagaucauagcuaugccaaagacacuuucuuaauugcacauugcuacagaaaugucagguauaaugaaucccuuugucucaggcaaaguacuuuguauuuauuauuugaguuucugucuugacaguuccuugucaagcagcaaauguaaaguacugauucguuguuuuuguugcuguuuuguuuguuuuguuuucaugcuugucuacagggcuccugcaacuuaauaguauagacuaaaucuuuaaguucuccuacaccucuuaucucuucccugaacacccagucaugauaauaaucuguaaaacccuaggauaauuauuucuuuuaauucccaagaguucaucauuugcuaaguuccaaauguauucacuuaggcacuugucuuaaaaugcuucuccauuaauuccacagagccgaaacugugugaagcugggcccuccugcggagggagaagucauccaagucaaauggccugaugguaaacucuauggggcaaaguaucuuggaucaaauguugccuauauguaucaggugggugcuacucucucugugcuguuuguugagaaagacaggauauaccagagggagauaacaugaguaugcuauggaucaaaaagccacuugaauuuuguucuuucccuuaaauuuugugaaagaggcaaaaugucauugucuagcagccuggguuucaacuuacaguuuagcaacuuauaguuuaguugccggauuggacacugagaaccccuaacaauugguaaaugguuaguucacuauaugguucaacugcuagauaguaggcucuuuccccuguguuuucauuaugagaguugguuuaucucaccuuaagccagaacauggagcuuggguuauuauagcucagcaguagaacacuugcuuugcauauacaaggcacagaacuacaggaaucagauagauagauagauagauagauagauagauagauagauaggaaucagauagauagauagaaagaaaggaaucagauagauagaaagaaagaaaggaaucagauagauagaaagaaaggaaucggauagauagauagauagauagauagauagauagauagauggauggauggauggauggauggauggaaggaacauucauuugccaaguugauacagugcuauauauuacuuuugugguaacuuuguauggcuguucaacaagcagccccugacuugauuuacuuggguggaggcaucucagauaaaacugagucagguaaggagcauugacauagguucuaaggaacuuacaguugucaucuacucaaguuuaaagaaauagucguuuaucaaguguauguucuggucacuaggguauucuacauguuaauaacuaaacuggaauuuuauauuucuacccgaaaugaagaagaguugaacucacaaaagggaaacaacauaggcagcacauguguauuccuauuccuuggggaacuuuacaacugaagcaaugaauuucaauaacaccaugucauaaauuaacauucuaguguaaaugguauaguaaaaauggggaaaaccaagaugauucaagugcaaaacagguuaauaauaauaagacacuaguuugcauaaaguaaguuagcaaacugaucagggcuuaaaagguagaguacauuacaaaguacggcaccagaaacuagaacgaaauauaauuaaaagaugcucaaagaaguuuagaaaacaugagaguacacuuuuucauggucuagaaaaucccgcuugaguugguauacuggcaaguuuuuucucauguugacaagaaccagaguuaucugggaagaagauccucaauucagaaaauguuucuaugggacuugccuguaguguagguaagccauggcacagcuuaauuagugguugauggaugggugggggccuggcacaucuugugugugccauuccucugcagagaguccugaguuauauaagaaaacaggcugaggaaaccaguaaguagugagcuuccaauucuccauggucccuguuucaauucuugccuugagauucugcccugacuucaguaauggacugugauguggaagugaaauaaaaucucaccuuuccaaguuguuuuggauacuguguuuuuauugcagcuuagaaaacuaaaaguuaacaagugaaggacaugggcauacuguuggucauuuucaaucuuucccauguguagauuaggauuauguauggugggauaagugcuacagcaucguuguagcagauuguguacaaugaaguaaaccucacaagggggcuguauaauacagaguauuucuagaggaaguuuuaauauagcuuucaaaaacaaagugucacauuuaauaagagcaauggugaagcgauguaacaaagcucauugcuacauaaaaguaucacauguuaaaaugcaggcuaauuaguaaucacuguguuagccuagcagcauaaaauugcagccauaaauauagaaucaaugaaaguuaaagcugguauuaaaaguaucucuuuaauuacaaguaguauaaaauuccucauuaaacaaagugguccuuugagacugcuuuguucuuucugucuuucaguuucaccacagaguaaaccagauauucauuaaagugcauagagauaaauaucaggcucacaguacauauaugcuaaaucuguguauauuuguuguuucugugaauguaugggucuguguguauauuugcagguguguguuuuuaucuguauguguauaaauuuggcccuguuuguauauuuguacuuacguguuuauguguauugauguagcucuuuaugugcauauuugugugaaugucuauauguguauguauguggcuguauuuaucuguguguauauuuguguauguaaauuuggguccaugcgcaucuuuguauaugugugucuguguguguauguauguauguauguauguacuuaugucuguuuaugugauuguauguguauguuugugugauuguaugugucugugaguguaugucuauauguguguguguauuuuugcuucuuacaauaguccugcaaaauaggguuuauaaauucuuauuguacaacuaagggaaggagacagcucagugaacaaauuuuaacuauuuucaggaggagaacauauuuuuuucauaguucguaagagcauacagcugauaaaaaauaagagccagaaaguuacucuuuucucuguccuaaugagaggaagcagcuguccaugcugguaguaaaguuuugccucuguauaccugagacuuagaaaaauuaggacagccagcauugcuuuaggaaaauugucuucuuuuaauuaaaguuuucaaaugacucaaaacaaaagaaaguagucacagauaaguaaguuaaagcuaugcuaucaaaugucuaaaugagaagacaucuugccuacuuuaaugcuaaaggagccauuuuguuaguagaaaaggccaggaugaacccaguuuuuauucucagccuucuaggcaguagcaacaaaguauuuuugugaccacagccugauuccaccuuguuguaaagcuucaucuuauguuaguaguauaugaauguaaaugaaaacaaaaacauguuuaacacgugcuuccaucucuguuucauugaugacuuugaaccacuacauaauuugacuuaucuuuugacuuuuaaaguaccacucagccgggcgugguggcccacgccuuuaaucccagcacuagggaggcagaggcaggcagauuucugaguuugaggccagccuggucuacaaaguaaguuccaggacagccagggcuaaacagagaaacccugucucgaaaaaccaaccaaccaaccaacgaaacaaaugaaguaccacucuauuaaaagugaaaaauacagaaaaucaaaauagcuggaaguucuaaauccuaggagacuuaagaguuguaauauaucaaaugucuacuuaucccaccuauauauauauauauauauauauauauauauauauauguguguguguguguguguguguguauuuuuuuuuuuuuuacaaauauuguuguuggaaauuccuaagcacccacuauccaggccucagcuaggccagcaucauagacuuuucucuaagucuccuaagaucuaaaaaaauauuucagaauuaguugcugucauuuuacaaggaguugaaaauguuugucuuuuaaaagacacuguuuucacacacuggugccauuuacaugcuaugaacuagaggccuauuugaauuuggaaaaguaauaauaguuaugaaagcuucuuaauguguauugaagaugugccaaaagauaugcuggcccugggaaguaugacugaaguucugcaccaggauccugucacucugauucucuacugauacccuggagugacuagacuggaguauauauaagauguauaaucacugccuagaugagcagucacuggagaacccaagaacccagcucuccuucagguaaauguagucucagacaacaacacuacugggaaaaaggaaaauggcuaggauuugcuaggaacacaaaguagcaaauuaucuuaguaccguauaggacacaaguaaaguacauaauugucuuugacugcaagggauugcuaauaauuccuauucuuuuccuguuaacuagagucaggcuccucccaaguaguagagaggaauauaagcccaaacaaauauagcucaccaugaagacguacaugaaacaaacagaaagaaggaaagaaaggggaaauaaagacagacuagacauucaucccagcagaugcaagaaaugcaacaauaucaaaaugagccauucugacaucucaacaauacauuaacauuaaaaaccacuuacaacacaucaauaugaaagcccauagauaauggcauagcugaaaugcuagaaaagauuucugggucuucuacaaaggcucaagggccaaguagagaacuuaagaaaagcaauuugggaccuaggaaagaaacuuaauaaaguccaaaaaggucaacaguuggggaaaaagcucaugcaagaacugagugagcagaucuuugcucccuccuccucuuuucuccuaggaggcugcuggccaccagcaugacaguacaaaggaagcagaggccaagagcaggguucagaaggcagugaauaugguaaaaugaccuccagagaccauagcaaaguuuaguuuauuauuucagggauagccaaccgcaguuggcauguaccagauuaaguaggaagaauugcagacccuaacugggaugacugccuuacaaagacagagaucuucagggugaacugcaacagcaccuaccugcagauggagacugaaaaucucaaaggccaagguacaauccuggaggcugcaugagcagcguggggagauggccauuaagaaucuagcugcauauguaucaaaagauggccuaguaggccaucacuggaaagagaggcccacuggacaggcaaacuuuauaugccccaguacaggggaaugccagggccaaaaagugggaauggguggguaggggagugggggggggaggggcaugggagacuuuugggauagcauuggaaauguaauugaggaaaauacguaauaaaaaaaaauaaggaaaaaaaaaaagaaagaaaguuagaagaaacaauuuaccgugaagaaaauaaaaagaaaacuauuaaucucucauuuaaaaaaaaaaaaaaaaaaaagaaugccaagcuggguaagcuagaggcugcccucuaaugggcccagaaguguauagccaggcagcuucaagaguaccaggaaauguugaacaguaagccgggcgggcccuugacaucaagaucaccacuuaacaacaagcugcugaaguccgaagagagcagccuagagucugagaggcagaacuugaguauccauaugaagaucaccagcagcuacucaggaguacugaacucagcuuauggagcacucacuaguccugguuuuagcuauagaaugagcuccuuccagccaagcuccagcucugucaggggcuacagcauguuuuuucacaccaaggcuguggucaugaauaagauugaaacucauguuuggaagcuggugucugagucuucugauaucccucccaaaugaauggccacuuaaguuccugccagucuguguaccuacagcuacucagggauuacagggggggcagcuguaucgcagaguacagggaacaagagacccaccugaucaaggaucaacacuaacccucaggccaaccuugggaagaauguccuaucugggauaguccucccuugccuuccacuaaaacccaacucaguuguauuuuccaaaaaaggcuucagcugguucuuaaaaaaauccuauccagcuauaacccugugcuuuacaaccacaaccucccagcaaaauacugaugauaauggcacaaacguuaggggaguaaccaaacacuuuucaguuggauuuacggccugcuccaugagcuagaacccauaucagaaaucugagacuagauaggucaugagccuacgggaaaugacuucugcuaccauacagcuguacccaucaaacagagcaugaaucauccucaucagagaaacaacuucuugagguauaugacaacacagagacacacaacuggaaaauguacagaacgugugcaauuguagagugcucagggagagugucucaacucuaaggaaaaaauggugccuuuuguucauauguaguaaucuuuccugauaauguuaaguuuucauagagcauuaacucuuuuaacuuucuguuuuuaaauuacuuuuuaaagugagcacacaaguaauggauuucugccauucauggaaauaggccaauucacuuuguucuuacauuuuucucaucccugucuuucauguuuguguucuuuucuuauccuccagauaccacucuucugguuuuacauugcuauguguuccauugccauuucucccauauucucuuaacaucaucuuuaccuucaagguucccugugaacuuaucaacacacacauacacacacaccccagauagaaauaaauuuaaaucuagauucuucauaagaaagaaaauauguaauaugugucuuugggggucugagcuccuuugcuuaauacaauaauguccaguuucauccauucuuuggcaaaugacauuauuuuauuuauaaugaauaaauuucuuuuuauguuugccucaguuucuugguguuuguuuguuuguuuguuuguuuguuuguuuguuuguuuuucaagacaggguuucucuguguagcccuggcuguccuggaacccacucuguagaccaggcuggccucaaacucagaaauccgccugccuuugccucccaaguacugggauuaaaggcgugugccaccacugcccuuugccucauuuucuuuguucacugguagauauauacugugguuccauuuccuugcuauuuugaauaccuacagaaauaaacauggaugugcaaauaucccuguuguauguugacuuaguccuucagagaugcaccaggaaaugguauacacagauuauaucauaguucuguuucuauuuuuguaaggagccuuuauacugaguucuauagugucuguacuagugcacaauucuaccaguaguguccugcuuuucccacauccuucuaacauuuguugcuauuugcuugcuugauaauagccauucuaacuagagcaggaaucucagacugguuuuaauuugcauuuuccggauagcucagaauauugaacaauuuuucaaguauuuauugagcauuuguauuuuuucugaggguagucuauucauuucacuaacucauuuaauaaugacuuugggcuuaaaaaaaaacuugguuugauaucuguuugcucuauuuuucauuuuuuuuaguucuuuaaguauucuggauauuuucacccgauguauaguucucaaauaacuuuucucauuuuuguaggcuguuuuuuucuuucuucuaauaguuucuguuaauaagacaugaugcuagcaagcccagcccaucuuaaugcaggacuugccacuuuucagagaaauuaucugaucagcccucauuuuucuuaguugguuuugagauauuaaaaauuucauaguucauauuuuaagucuauccucuacaacagucuugacuauuucucaacuugcuuuguucuuaguuggguaagaaaaugcucuucuagugucccugacuuugggucauucuauauuuucucaguuagagcccuuuacuucccuaccucccaauacucauaauuaauuggaacucuugaaaaauggccaggauuucuuugguuuuacuacauaucacauuggcuuuuguaucuuuagguugaauuugaagauggaucgcagauugcaaugaagagagaagacauauacacuuuagaugaagaguuacccaagagaguaaaggcucguuuuguaagugcaagggacaaauccuacuuagguuaaguccucauucucuguguuaucccaagccuaaaacaaccuugggcuuuugguuaauuuugaagaaagcuaaaguaacuuuucccuuguuguaaccugaugaaugcaaguguccacuuagaaaugggaaaaccagugcaugcagaguuuacuucuaaugagaucaaauggcaggacuuuguguuaaaauuuauugacacauaauaauaguuccuaaauuugucauuuauacaaagcucuggguguaaacaaauacaauauuaagguauuuacucuuuguuaguggaaguuacauuaaaagaaaguguucaaaauagauaaagagguagcauuagagaagagucuguaguaaucuuaucauguaacgguaaaguucuacguaacacacucacugauguuucuuuccaaacucucacuuucauaaaggcauaacaaaaccagaauauuaauagugggaguacuaaaagaguuauaauaagugcccauguauauguauaugcauauauauauauuuuuugccaaguccaauuuaagccacuaaaugauaaguaaauauggguggccuaaucuuaaauuauuuuuaaauguaauucauaauaauguagguuucacacuauuauaaaguauuuaacagaguauaaaauuuaaguuugguuuauucauuuggagucauaucuauagcaucucucugaaaauaaauuuuuaauagagaaguuaauuuucugaauaaauuugacuuuuucauacgcaaucacugauuauguccuccugcagaggcagaguugugauaccaaccaagggcuucuuuaaguugugaacaguuccucuguugucaagugagauccuuaggcagggaacccacaauggaugugcacuucccucucagcuguaccuucagaggaaggacauuaaaguaagaagaggacacgacucagugucagugcugcuguucacccagugaaaugcgggguuuucaggacagcugcacguacucugagaacauucuaguuuaaaaaaaaaaagaacagauuauaauaccugugagcaaagagaaaauuaaguguuccaauuauggagacaaauauuccugaagccuggguaacuugucagcauuguaagaucuugaaacccggggcuagagcauggcacuacuguuccaucccaaucuuggagaggaccugggucuggguuucuguauccacacccacaugguagcuacaacuauggauaacuucaggguucgguguauccaacauccucuuugguccucuacgggcauuggaaacacuucaaggaaaaacacuccaagggaaaacauucauacacauaagauaaaaauaaauauuucauaaagcauacugaagucuuucaagaaaaucugaaaucaguagagaugguuuuauauccauaucuccccuuggcucaccucuacucucccuguuuuguuuugcuauuuuguaacuucuauugaccccuaaauauuuggguagggaauagaguaggaagcccucugaaagucucuugguuuuuuuguuguguauaucaggugugcauacuaaauugauucuuagagauuucauguucauguuucuuaugaguucacuucucuaaacagauaaaaucuuuuuauuccauaguagauauggucuugauucuaugaugcuaccuucaguuuuuugguuuuuuuuaaaaacaaaugucuugaguaucauuuugugguguguauucucaauacaucccccuucucucugcccccugguuuuuuguuucuguuuugaaacagguccauaugugagcuaggcuaggcuuuaauucacuaagaggccaaggauuucuuugaguucuuggucugccucgugucccaugcuacaugucaggaugaugaguguuugugaccuguccaacuucucugagaacacuguaauuaacuuuaacaaaacaaugaaugcaguccugugugcccagcagcuaagcccaguaggaaauaguguccuggagcuacagcucuugccacuuuuguuacuagaucaaaaacuuuauacccuucaguuagaagguauaccugccuucagguagguugucucauacucuuccagcuggggagucaaaucuaauuuaauauucuuugauagauauuuuaugcuuacagaauauuugguuugaggaagauugauaagcaucgcuuaucacugaaccuuuauguuuuagugacuuugccucccucagauucuucucacuugggggaaaauguuuuaagagagccaucggacugcguaaugacugugcugggcucuuuuuuacucuuuucagaaacagccccauuaccuuuuauugucucauagaguaaccauggcaaccacugcauaauuaacuagagcuccugguaaauugacuuuacuauuguguuuaagaggcugacuucugcuguuucugcagaguagcaacacuuucauagauguuuuauuuccuccuuugguaacuuuagcacuuaauaaaggugaaauauaaguuaguggaggugcuuucuuuuuuuuaauucaauuuuuuauuauauauuuucuucauuuacauuucaaaugguaucccaaaaguccccuauacuucuccgccccgcccugcuccccuacccacccauucccacuucuuggcccuggcauuccccuguacuggggcauauaaucuuugcgagaccaagggguuucccagugauggccuacuaggccaucuucugcuacauaugcagcuagagacacgagcucuggggguacugguuaguucacauuguuguuccacuuauaggguugcaggccccuucagcuccuuggguacuuucucuagcuccuccauugggggcccuguguuccauccaauagaugucugugagcauccacuucuguguuugccaggcacuggcauagccucacaagagacagcuauaucaggguccuuuccccaaaaucuugcuggcauaugcaauagugucuguguuugguggcugauuaugggauggauuccuggguggggcagucucuggauaaaaucauccuuucaucucagcagugggggugcuuucuaagaguuacugaaacaaaauguuucuuucugaugacgaagauccaaccaauucacaauucuaaguuuccuccccaaaugauauauggcacucucuagggaacccguagauuagccucaugagcggcucagcagaaaauauaugcaucugccaacuugaaacauuuccaaauucuaggcuuccuucugucugaucccuucccucucuacuacacaaugaaccauguauuuuuaacaccugaaagaauaacagucuacuuuguuaucaaccucauauauucuauuuguucaugucauuagaagucauaccccuaacuuaaaccaguggagaccguauucuagauugaaacuagacuaaggaaucaggaaugaaguuugguauuuuauuguagacucuagguuuggucuugaguaucucaacucaaugaucacuuacugaagaguugcugaguuccacgcuuuaguguuccaacauuaguuuauacaacauuuaguuuauaguucuuaauauccuuuagcuuaagaaaugcccaaugggaugaacauugauuauuccugcauucauguucagggcucacaggaauucccagcuuuucugugguagagacucuuccauggaagaaaaacuaucucagacagaaaacuuaaggcucucauauguggcucauaauguaaaauuuacucuuccgaaagaaggaaguaggaugugcuagguuguaaaagucugcccuugggaaugugcaguuauucuugagggcagguagaagauaagguuacagacagguacauguagcacucuuuaauuaguuaauuaguauguuucuggagagcuuuguuuucuaggaguuaaaugggagauagacugggacuacugcauuuguucuagugguucaaaaggagaagggagugacccugcaucaggaucauggcuauuucaaguauauggagggcuccuggcagaaugggaauccacaguaccauuaaaucuuugacaaaugauuguacagaaaagcaugguauugacauucaggaaauuuaagaagggcagucauggagcaagucuuuaguuccauuuuauacaaaauacuuuggagagggucugaagcacacagucuaagguaccuauugagcaggguauuguaagucugagugugagagauccaaccuagagugagauuccaucaucagccuuggagucugcauaggcaucaaugccaagaauauggguuacaggccccagaguugaacagauagcuaagacagugaagucugaaaugucaaaaaugagcaaacagguagccaguaaaguaguuaagcaacaaagaacugccauaggacuuaggaacuagggauuuaaccacauuagcuucaaggaaguggagaaaggcuaaaggaacaaagaauaggauucggcaugaacuaggaaugacugaugacuacccacccccaccccccaaaagacaaaccuguuggcgcagaagccaaguggagauggugacugagcaaguguuaauguaaaaugggcagcuccuauucuaaagucacauggcuaugacucaagaacauagauuuaagacaacuaaaauuucauauuccaacauggaagcugcuucaugaaguguuauaguuuuguaggaccaaaaaaaaaaaaucuaaauaccucagcgaguuuaaaauacauuaguggguacaucagagagguugcuauagcaagaagggggaagguuugcuauaggcccaagauucugucugaugacauuguuagcuuuggggcuggagggaacuagugaucugcuaaguuaaugggcuccaaaaaguuuuuuaucuguaagucacaagauguuaacuugcaacacagaaauaggaaagcauggguggcucuucugaggggcuagagcuagugaugagcuauuagaccuggaucauuuuaaucucaccacaauacuuucucaaaaucuaauuagucaaucaauuucuauagacauagcuucuuuuuaggaguuuucauuuacagcagacucaauaugagaagacuuuaauuuugcuuuuguuuggggaagcuuccucaggcaggauaaagaaauugggaccaaauagagccacauaucucugccaugugguauaggugagaccuaccugaugaugaagacacuguaagacacugugguagguuccuucgacccugugauagauccuagccucuguucccuagaucuguauguaguguuucaguaauauauuucucauuuauacacucaauaauguauuucugcguuuaguccacagccuccgacaugcgauuugaagacacauuuuauggagcagauguaauccaaggggagaggaagaggcaaagagugcuaagcuccaggcucaagaaugaguauguggaugacccuguguaucguacuuuccugaagaguucuuuccagaagaagugucagaagagacaguaguugauaaugugcagcagccacagugcagcucagaccagaagagggaagacaaagggacagccuugggguacacauugggacagguggcugggugcuucuuugguauugguaauaaaccaggcuucuggaguuugauuaccaagcaaccaagaagagacauauuaguugcuucuguaaucugaucaccccucagucauuuguuugaccccaaagaauauuccuaaauuaaaggaaacagcagugaauggcccacuagauaaaacaacugcuaaagaagcgggguucccucucuggcucaggucccuuccucagggaacacauuuggaggcuccuuucccaccuccuucaguggcagccucaucacccaacagccgguggguguauuuauauauauuuuccacagccagggaaagagucucacucacauuuguuuucaguggcaguuuuuauaaaacauuuuuaaaacacaaauggcauguaugguaauaggauuuaccuguaugcuaucuucccuuguacagaacuuuuccauuuuuuauauuauuacuuuugauugugucugaaaacugaguuggccuuuauaagaggaaauuuuuugcucuugaagaggaauucauaugaaguauaugggaauuuuauauauuuacagaggaaaaaucuuggccugauauuuugaacacuucauaauuccuguucugaaaugauauuuauaaaauauauauuucuuucauuauguguuuguaaaaauuagaguuuaaagaaauauacuuaaugcauaguuuuaaacuaauguaacaugauuuuucuuugcaaaacagccuggagauguauuaauauuuaaaaauuaaaaucuguuuucuccug

SEQ ID NO: 12089 - RNA, 153915 nt, Mus musculus
caggagaaaacagauuuuaauuuuuaaauauuaauacaucuccaggcuguuuugcaaagaaaaaucauguuacauuaguuuaaaacuaugcauuaaguauauuucuuuaaacucuaauuuuuacaaacacauaaugaaagaaauauauauuuuauaaauaucauuucagaacaggaauuaugaaguguucaaaauaucaggccaagauuuuuccucuguaaauauauaaaauucccauauacuucauaugaauuccucuucaagagcaaaaaauuuccucuuauaaaggccaacucaguuuucagacacaaucaaaaguaauaauauaaaaaauggaaaaguucuguacaagggaagauagcauacagguaaauccuauuaccauacaugccauuuguguuuuaaaaauguuuuauaaaaacugccacugaaaacaaaugugagugagacucuuucccuggcuguggaaaauauauauaaauacacccaccggcuguugggugaugaggcugccacugaaggaggugggaaaggagccuccaaauguguucccugaggaagggaccugagccagagagggaaccccgcuucuuuagcaguuguuuuaucuagugggccauucacugcuguuuccuuuaauuuaggaauauucuuuggggucaaacaaaugacugaggggugaucagauuacagaagcaacuaauaugucucuucuugguugcuugguaaucaaacuccagaagccugguuuauuaccaauaccaaagaagcacccagccaccugucccaauguguaccccaaggcugucccuuugucuucccucuucuggucugagcugcacuguggcugcugcacauuaucaacuacugucucuucugacacuucuucuggaaagaacucuucaggaaaguacgauacacagggucauccacauacucauucuugagccuggagcuuagcacucuuugccucuuccucuccccuuggauuacaucugcuccauaaaaugugucuucaaaucgcaugucggaggcuguggacuaaacgcagaaauacauuauugaguguauaaaugagaaauauauuacugaaacacuacauacagaucuagggaacagaggcuaggaucuaucacagggucgaaggaaccuaccacagugucuuacagugucuucaucaucagguaggucucaccuauaccacauggcagagauauguggcucuauuuggucccaauuucuuuauccugccugaggaagcuuccccaaacaaaagcaaaauuaaagucuucucauauugagucugcuguaaaugaaaacuccuaaaaagaagcuaugucuauagaaauugauugacuaauuagauuuugagaaaguauuguggugagauuaaaaugauccaggucuaauagcucaucacuagcucuagccccucagaagagccacccaugcuuuccuauuucuguguugcaaguuaacaucuugugacuuacagauaaaaaacuuuuuggagcccauuaacuuagcagaucacuaguucccuccagccccaaagcuaacaaugucaucagacagaaucuugggccuauagcaaaccuucccccuucuugcuauagcaaccucucugauguacccacuaauguauuuuaaacucgcugagguauuuagauuuuuuuuuuuugguccuacaaaacuauaacacuucaugaagcagcuuccauguuggaauaugaaauuuuaguugucuuaaaucuauguucuugagucauagccaugugacuuuagaauaggagcugcccauuuuacauuaacacuugcucagucaccaucuccacuuggcuucugcgccaacagguuugucuuuugggggguggggguggguagucaucagucauuccuaguucaugccgaauccuauucuuuguuccuuuagccuuucuccacuuccuugaagcuaaugugguuaaaucccuaguuccuaaguccuauggcaguucuuuguugcuuaacuacuuuacuggcuaccuguuugcucauuuuugacauuucagacuucacugucuuagcuaucuguucaacucuggggccuguaacccauauucuuggcauugaugccuaugcagacuccaaggcugaugauggaaucucacucuagguuggaucucucacacucagacuuacaauacccugcucaauagguaccuuagacugugugcuucagacccucuccaaaguauuuuguauaaaauggaacuaaagacuugcuccaugacugcccuucuuaaauuuccugaaugucaauaccaugcuuuucuguacaaucauuugucaaagauuuaaugguacuguggauucccauucugccaggagcccuccauauacuugaaauagccaugauccugaugcagggucacucccuucuccuuuugaaccacuagaacaaaugcaguagucccagucuaucucccauuuaacuccuagaaaacaaagcucuccagaaacauacuaauuaacuaauuaaagagugcuacauguaccugucuguaaccuuaucuucuaccugcccucaagaauaacugcacauucccaagggcagacuuuuacaaccuagcacauccuacuuccuucuuucggaagaguaaauuuuacauuaugagccacauaugagagccuuaaguuuucugucugagauaguuuuucuuccauggaagagucucuaccacagaaaagcugggaauuccugugagcccugaacaugaaugcaggaauaaucaauguucaucccauugggcauuucuuaagcuaaaggauauuaagaacuauaaacuaaauguuguauaaacuaauguuggaacacuaaagcguggaacucagcaacucuucaguaagugaucauugaguugagauacucaagaccaaaccuagagucuacaauaaaauaccaaacuucauuccugauuccuuagucuaguuucaaucuagaauacggucuccacugguuuaaguuagggguaugacuucuaaugacaugaacaaauagaauauaugagguugauaacaaaguagacuguuauucuuucagguguuaaaaauacaugguucauuguguaguagagagggaagggaucagacagaaggaagccuagaauuuggaaauguuucaaguuggcagaugcauauauuuucugcugagccgcucaugaggcuaaucuacggguucccuagagagugccauauaucauuuggggaggaaacuuagaauugugaauugguuggaucuucgucaucagaaagaaacauuuuguuucaguaacucuuagaaagcacccccacugcugagaugaaaggaugauuuuauccagagacugccccacccaggaauccaucccauaaucagccaccaaacacagacacuauugcauaugccagcaagauuuuggggaaaggacccugauauagcugucucuugugaggcuaugccagugccuggcaaacacagaaguggaugcucacagacaucuauuggauggaacacagggcccccaauggaggagcuagagaaaguacccaaggagcugaaggggccugcaacccuauaaguggaacaacaaugugaacuaaccaguacccccagagcucgugucucuagcugcauauguagcagaagauggccuaguaggccaucacugggaaaccccuuggucucgcaaagauuauaugccccaguacaggggaaugccagggccaagaagugggaauggguggguaggggagcagggcggggcggagaaguauaggggacuuuugggauaccauuugaaauguaaaugaagaaaauauauaauaaaaaauugaauuaaaaaaaagaaagcaccuccacuaacuuauauuucaccuuuauuaagugcuaaaguuaccaaaggaggaaauaaaacaucuaugaaaguguugcuacucugcagaaacagcagaagucagccucuuaaacacaauaguaaagucaauuuaccaggagcucuaguuaauuaugcagugguugccaugguuacucuaugagacaauaaaagguaauggggcuguuucugaaaagaguaaaaaagagcccagcacagucauuacgcaguccgauggcucucuuaaaacauuuucccccaagugagaagaaucugagggaggcaaagucacuaaaacauaaagguucagugauaagcgaugcuuaucaaucuuccucaaaccaaauauucuguaagcauaaaauaucuaucaaagaauauuaaauuagauuugacuccccagcuggaagaguaugagacaaccuaccugaaggcagguauaccuucuaacugaaggguauaaaguuuuugaucuaguaacaaaaguggcaagagcuguagcuccaggacacuauuuccuacugggcuuagcugcugggcacacaggacugcauucauuguuuuguuaaaguuaauuacaguguucucagagaaguuggacaggucacaaacacucaucauccugacauguagcaugggacacgaggcagaccaagaacucaaagaaauccuuggccucuuagugaauuaaagccuagccuagcucacauauggaccuguuucaaaacagaaacaaaaaaccagggggcagagagaagggggauguauugagaauacacaccacaaaaugauacucaagacauuuguuuuuaaaaaaaaccaaaaaacugaagguagcaucauagaaucaagaccauaucuacuauggaauaaaaagauuuuaucuguuuagagaagugaacucauaagaaacaugaacaugaaaucucuaagaaucaauuuaguaugcacaccugauauacacaacaaaaaaaccaagagacuuucagagggcuuccuacucuauucccuacccaaauauuuaggggucaauagaaguuacaaaauagcaaaacaaaacagggagaguagaggugagccaaggggagauauggauauaaaaccaucucuacugauuucagauuuucuugaaagacuucaguaugcuuuaugaaauauuuauuuuuaucuuauguguaugaauguuuucccuuggaguguuuuuccuugaaguguuuccaaugcccguagaggaccaaagaggauguuggauacaccgaacccugaaguuauccauaguuguagcuaccauguggguguggauacagaaacccagacccagguccucuccaagauugggauggaacaguagugccaugcucuagccccggguuucaagaucuuacaaugcugacaaguuacccaggcuucaggaauauuugucuccauaauuggaacacuuaauuuucucuuugcucacagguauuauaaucuguucuuuuuuuuuuuaaacuagaauguucucagaguacgugcagcuguccugaaaaccccgcauuucacugggugaacagcagcacugacacugagucguguccucuucuuacuuuaauguccuuccucugaagguacagcugagagggaagugcacauccauuguggguucccugccuaaggaucucacuugacaacagaggaacuguucacaacuuaaagaagcccuugguugguaucacaacucugccucugcaggaggacauaaucagugauugcguaugaaaaagucaaauuuauucagaaaauuaacuucucuauuaaaaauuuauuuucagagagaugcuauagauaugacuccaaaugaauaaaccaaacuuaaauuuuauacucuguuaaauacuuuauaauagugugaaaccuacauuauuaugaauuacauuuaaaaauaauuuaagauuaggccacccauauuuacuuaucauuuaguggcuuaaauuggacuuggcaaaaaauauauauauaugcauauacauauacaugggcacuuauuauaacucuuuuaguacucccacuauuaauauucugguuuuguuaugccuuuaugaaagugagaguuuggaaagaaacaucagugaguguguuacguagaacuuuaccguuacaugauaagauuacuacagacucuucucuaaugcuaccucuuuaucuauuuugaacacuuucuuuuaauguaacuuccacuaacaaagaguaaauaccuuaauauuguauuuguuuacacccagagcuuuguauaaaugacaaauuuaggaacuauuauuaugugucaauaaauuuuaacacaaaguccugccauuugaucucauuagaaguaaacucugcaugcacugguuuucccauuucuaaguggacacuugcauucaucagguuacaacaagggaaaaguuacuuuagcuuucuucaaaauuaaccaaaagcccaagguuguuuuaggcuugggauaacacagagaaugaggacuuaaccuaaguaggauuugucccuugcacuuacaaaacgagccuuuacucucuuggguaacucuucaucuaaaguguauaugucuucucucuucauugcaaucugcgauccaucuucaaauucaaccuaaagauacaaaagccaaugugauauguaguaaaaccaaagaaauccuggccauuuuucaagaguuccaauuaauuaugaguauugggagguagggaaguaaagggcucuaacugagaaaauauagaaugacccaaagucagggacacuagaagagcauuuucuuacccaacuaagaacaaagcaaguugagaaauagucaagacuguuguagaggauagacuuaaaauaugaacuaugaaauuuuuaauaucucaaaaccaacuaagaaaaaugagggcugaucagauaauuucucugaaaaguggcaaguccugcauuaagaugggcugggcuugcuagcaucaugucuuauuaacagaaacuauuagaagaaagaaaaaaacagccuacaaaaaugagaaaaguuauuugagaacuauacaucgggugaaaauauccagaauacuuaaagaacuaaaaaaaaugaaaaauagagcaaacagauaucaaaccaaguuuuuuuuuaagcccaaagucauuauuaaaugaguuagugaaaugaauagacuacccucagaaaaaauacaaaugcucaauaaauacuugaaaaauuguucaauauucugagcuauccggaaaaugcaaauuaaaaccagucugagauuccugcucuaguuagaauggcuauuaucaagcaagcaaauagcaacaaauguuagaaggaugugggaaaagcaggacacuacugguagaauugugcacuaguacagacacuauagaacucaguauaaaggcuccuuacaaaaauagaaacagaacuaugauauaaucuguguauaccauuuccuggugcaucucugaaggacuaagucaacauacaacagggauauuugcacauccauguuuauuucuguagguauucaaaauagcaaggaaauggaaccacaguauauaucuaccagugaacaaagaaaaugaggcaaagggcagugguggcacacgccuuuaaucccaguacuugggaggcaaaggcaggcggauuucugaguuugaggccagccuggucuacagaguggguuccaggacagccagggcuacacagagaaacccugucuugaaaaacaaacaaacaaacaaacaaacaaacaaacaaacaaacaccaagaaacugaggcaaacauaaaaagaaauuuauucauuauaaauaaaauaaugucauuugccaaagaauggaugaaacuggacauuauuguauuaagcaaaggagcucagacccccaaagacacauauuacauauuuucuuucuuaugaagaaucuagauuuaaauuuauuucuaucugggguguguguguauguguguguugauaaguucacagggaaccuugaagguaaagaugauguuaagagaauaugggagaaauggcaauggaacacauagcaauguaaaaccagaagagugguaucuggaggauaagaaaagaacacaaacaugaaagacagggaugagaaaaauguaagaacaaagugaauuggccuauuuccaugaauggcagaaauccauuacuugugugcucacuuuaaaaaguaauuuaaaaacagaaaguuaaaagaguuaaugcucuaugaaaacuuaacauuaucaggaaagauuacuacauaugaacaaaaggcaccauuuuuuccuuagaguugagacacucucccugagcacucuacaauugcacacguucuguacauuuuccaguugugugucucuguguugucauauaccucaagaaguuguuucucugaugaggaugauucaugcucuguuugauggguacagcuguaugguagcagaagucauuucccguaggcucaugaccuaucuagucucagauuucugauauggguucuagcucauggagcaggccguaaauccaacugaaaaguguuugguuacuccccuaacguuugugccauuaucaucaguauuuugcugggagguugugguuguaaagcacaggguuauagcuggauaggauuuuuuuaagaaccagcugaagccuuuuuuggaaaauacaacugaguuggguuuuaguggaaggcaagggaggacuaucccagauaggacauucuucccaagguuggccugaggguuaguguugauccuugaucaggugggucucuuguucccuguacucugcgauacagcugcccccccuguaaucccugaguagcuguagguacacagacuggcaggaacuuaaguggccauucauuugggagggauaucagaagacucagacaccagcuuccaaacaugaguuucaaucuuauucaugaccacagccuuggugugaaaaaacaugcuguagccccugacagagcuggagcuuggcuggaaggagcucauucuauagcuaaaaccaggacuagugagugcuccauaagcugaguucaguacuccugaguagcugcuggugaucuucauauggauacucaaguucugccucucagacucuaggcugcucucuucggacuucagcagcuuguuguuaaguggugaucuugaugucaagggcccgcccggcuuacuguucaacauuuccugguacucuugaagcugccuggcuauacacuucugggcccauuagagggcagccucuagcuuacccagcuuggcauucuuuuuuuuuuuuuuuuuuuuaaaugagagauuaauaguuuucuuuuuauuuucuucacgguaaauuguuucuucuaacuuucuuucuuuuuuuuuuuccuuauuuuuuuuuauuacguauuuuccucaauuacauuuccaaugcuaucccaaaagucucccaugccccucccccccccacuccccuacccacccauucccacuuuuuggcccuggcauuccccuguacuggggcauauaaaguuugccuguccagugggccucucuuuccagugauggccuacuaggccaucuuuugauacauaugcagcuagauucuuaauggccaucuccccacgcugcucaugcagccuccaggauuguaccuuggccuuugagauuuucagucuccaucugcagguaggugcuguugcaguucacccugaagaucucugucuuuguaaggcagucaucccaguuagggucugcaauucuuccuacuuaaucugguacaugccaacugcgguuggcuaucccugaaauaauaaacuaaacuuugcuauggucucuggaggucauuuuaccauauucacugccuucugaacccugcucuuggccucugcuuccuuuguacugucaugcugguggccagcagccuccuaggagaaaagaggaggagggagcaaagaucugcucacucaguucuugcaugagcuuuuuccccaacuguugaccuuuuuggacuuuauuaaguuucuuuccuaggucccaaauugcuuuucuuaaguucucuacuuggcccuugagccuuuguagaagacccagaaaucuuuucuagcauuucagcuaugccauuaucuaugggcuuucauauugauguguuguaagugguuuuuaauguuaauguauuguugagaugucagaauggcucauuuugauauuguugcauuucuugcaucugcugggaugaaugucuagucugucuuuauuuccccuuucuuuccuucuuucuguuuguuucauguacgucuucauggugagcuauauuuguuugggcuuauauuccucucuacuacuugggaggagccugacucuaguuaacaggaaaagaauaggaauuauuagcaaucccuugcagucaaagacaauuauguacuuuacuuguguccuauacgguacuaagauaauuugcuacuuuguguuccuagcaaauccuagccauuuuccuuuuucccaguaguguuguugucugagacuacauuuaccugaaggagagcuggguucuuggguucuccagugacugcucaucuaggcagugauuauacaucuuauauauacuccagucuagucacuccaggguaucaguagagaaucagagugacaggauccuggugcagaacuucagucauacuucccagggccagcauaucuuuuggcacaucuucaauacacauuaagaagcuuucauaacuauuauuacuuuuccaaauucaaauaggccucuaguucauagcauguaaauggcaccagugugugaaaacagugucuuuuaaaagacaaacauuuucaacuccuuguaaaaugacagcaacuaauucugaaauauuuuuuuagaucuuaggagacuuagagaaaagucuaugaugcuggccuagcugaggccuggauagugggugcuuaggaauuuccaacaacaauauuuguaaaaaaaaaaaaaauacacacacacacacacacacacacauauauauauauauauauauauauauauauauauauaggugggauaaguagacauuugauauauuacaacucuuaagucuccuaggauuuagaacuuccagcuauuuugauuuucuguauuuuucacuuuuaauagagugguacuucauuuguuucguugguugguugguugguuuuucgagacaggguuucucuguuuagcccuggcuguccuggaacuuacuuuguagaccaggcuggccucaaacucagaaaucugccugccucugccucccuagugcugggauuaaaggcgugggccaccacgcccggcugagugguacuuuaaaagucaaaagauaagucaaauuauguagugguucaaagucaucaaugaaacagagauggaagcacguguuaaacauguuuuuguuuucauuuacauucauauacuacuaacauaagaugaagcuuuacaacaagguggaaucaggcuguggucacaaaaauacuuuguugcuacugccuagaaggcugagaauaaaaacuggguucauccuggccuuuucuacuaacaaaauggcuccuuuagcauuaaaguaggcaagaugucuucucauuuagacauuugauagcauagcuuuaacuuacuuaucugugacuacuuucuuuuguuuugagucauuugaaaacuuuaauuaaaagaagacaauuuuccuaaagcaaugcuggcuguccuaauuuuucuaagucucagguauacagaggcaaaacuuuacuaccagcauggacagcugcuuccucucauuaggacagagaaaagaguaacuuucuggcucuuauuuuuuaucagcuguaugcucuuacgaacuaugaaaaaaauauguucuccuccugaaaauaguuaaaauuuguucacugagcugucuccuucccuuaguuguacaauaagaauuuauaaacccuauuuugcaggacuauuguaagaagcaaaaauacacacacacauauagacauacacucacagacacauacaaucacacaaacauacacauacaaucacauaaacagacauaaguacauacauacauacauacauacacacacagacacacauauacaaagaugcgcauggacccaaauuuacauacacaaauauacacacagauaaauacagccacauacauacacauauagacauucacacaaauaugcacauaaagagcuacaucaauacacauaaacacguaaguacaaauauacaaacagggccaaauuuauacacauacagauaaaaacacacaccugcaaauauacacacagacccauacauucacagaaacaacaaauauacacagauuuagcauauauguacugugagccugauauuuaucucuaugcacuuuaaugaauaucugguuuacucuguggugaaacugaaagacagaaagaacaaagcagucucaaaggaccacuuuguuuaaugaggaauuuuauacuacuuguaauuaaagagauacuuuuaauaccagcuuuaacuuucauugauucuauauuuauggcugcaauuuuaugcugcuaggcuaacacagugauuacuaauuagccugcauuuuaacaugugauacuuuuauguagcaaugagcuuuguuacaucgcuucaccauugcucuuauuaaaugugacacuuuguuuuugaaagcuauauuaaaacuuccucuagaaauacucuguauuauacagcccccuugugagguuuacuucauuguacacaaucugcuacaacgaugcuguagcacuuaucccaccauacauaauccuaaucuacacaugggaaagauugaaaaugaccaacaguaugcccauguccuucacuuguuaacuuuuaguuuucuaagcugcaauaaaaacacaguauccaaaacaacuuggaaaggugagauuuuauuucacuuccacaucacaguccauuacugaagucagggcagaaucucaaggcaagaauugaaacagggaccauggagaauuggaagcucacuacuuacugguuuccucagccuguuuucuuauauaacucaggacucucugcagaggaauggcacacacaagaugugccaggcccccacccauccaucaaccacuaauuaagcugugccauggcuuaccuacacuacaggcaagucccauagaaacauuuucugaauugaggaucuucuucccagauaacucugguucuugucaacaugagaaaaaacuugccaguauaccaacucaagcgggauuuucuagaccaugaaaaaguguacucucauguuuucuaaacuucuuugagcaucuuuuaauuauauuucguucuaguuucuggugccguacuuuguaauguacucuaccuuuuaagcccugaucaguuugcuaacuuacuuuaugcaaacuagugucuuauuauuauuaaccuguuuugcacuugaaucaucuugguuuuccccauuuuuacuauaccauuuacacuagaauguuaauuuaugacaugguguuauugaaauucauugcuucaguuguaaaguuccccaaggaauaggaauacacaugugcugccuauguuguuucccuuuugugaguucaacucuucuucauuucggguagaaauauaaaauuccaguuuaguuauuaacauguagaauacccuagugaccagaacauacacuugauaaacgacuauuucuuuaaacuugaguagaugacaacuguaaguuccuuagaaccuaugucaaugcuccuuaccugacucaguuuuaucugagaugccuccacccaaguaaaucaagucaggggcugcuuguugaacagccauacaaaguuaccacaaaaguaauauauagcacuguaucaacuuggcaaaugaauguuccuuccauccauccauccauccauccauccaucuaucuaucuaucuaucuaucuaucuaucuaucuauccgauuccuuucuuucuaucuaucugauuccuuucuuucuuucuaucuaucugauuccuuucuuucuaucuaucuaucugauuccuaucuaucuaucuaucuaucuaucuaucuaucuaucuaucugauuccuguaguucugugccuuguauaugcaaagcaaguguucuacugcugagcuauaauaacccaagcuccauguucuggcuuaaggugagauaaaccaacucucauaaugaaaacacaggggaaagagccuacuaucuagcaguugaaccauauagugaacuaaccauuuaccaauuguuagggguucucaguguccaauccggcaacuaaacuauaaguugcuaaacuguaaguugaaacccaggcugcuagacaaugacauuuugccucuuucacaaaauuuaagggaaagaacaaaauucaaguggcuuuuugauccauagcauacucauguuaucucccucugguauauccugucuuucucaacaaacagcacagagagaguagcacccaccugauacauauaggcaacauuugauccaagauacuuugccccauagaguuuaccaucaggccauuugacuuggaugacuucucccuccgcaggagggcccagcuucacacaguuucggcucuguggaauuaauggagaagcauuuuaagacaagugccuaagugaauacauuuggaacuuagcaaaugaugaacucuugggaauuaaaagaaauaauuauccuaggguuuuacagauuauuaucaugacuggguguucagggaagagauaagagguguaggagaacuuaaagauuuagucuauacuauuaaguugcaggagcccuguagacaagcaugaaaacaaaacaaacaaaacagcaacaaaaacaacgaaucaguacuuuacauuugcugcuugacaaggaacugucaagacagaaacucaaauaauaaauacaaaguacuuugccugagacaaagggauucauuauaccugacauuucuguagcaaugugcaauuaagaaagugucuuuggcauagcuaugaucuugaucuuucuaauuacucuuuaaaguagacagaauuuuuacauauuuucguguauucuuugagaauuugauacaauguauuuuuuauaucacauuuauccuccuucccaaauuuuccuggauacaucccaccuucugauuuacccaaaauuagaguucucucucuuuuuaacacccauaaagucaaaauuguguugccuaauuuguguuggaugugaaggcugcacuggaguugaugguacaggggucaaaccauugaagaaaacuauccugucacagcagcuauucaaugccauuagauacugagcugggguaggccuauaagacuacuacccccaacccacguugagaucauaugaaguggcaaauuaugauauuuauuuuacuggcaacaauacugagcauccaaggaacaccucuaccauaaaugacgcugaaugucagucagucaagcucugaaaauaauggggaugaggggccucaaagucagagcugagagaauugauucaggcugcaaggaaaagacaagggauggaagggacaugguguagucuccccuuccccagccugaaaccugccugcucagggguggagcuuccugcucauucguucugccacgccuacugcuggaaccugccgcuuugcuguucggagccacacucaugcucaccuuucuacuggaccagagauuauucggugggaaucggguccccucccccuuccuucauaacuagugucgcaacaauaaaauuugagcuuugaucagaaugaauuugucuuagcuccguuucuucuuucgccccaucuagauuccucucuuacagcucgaguagccauaucagucgaaccauucacguugcgagcugcuggcggccgcaacacaugguauuuggaggaggugggaugugucuuccuucaguugccugaacaugaaugcuccuguauccauuaagugugcugguuacgguauacagguguacuaguggucccacagaaacuauccaaaguuuucugucuucugguguuugguuucaugucucucuccucuaagauuagcaaaacuccccaggggaguucauucagaaagcuaacuucugccaagaggauauaugugucaaauaauaaaauaugcucagagagguuauuaaucuggcugaaagaaauauauuuuugacaaaugaagcuauaaaugcugccugaaaagauuauguuuaaaugaaagaaacacaggacauauuugguuguuuacaacuagggacaugucagauauuucuuucuauuaauaaauuucugcccuaaaaagaaguggucauuuuauugccaggugaggacuaaguaugaaaggcacagauguuuaauuguucuaguuggaaacugaaggaaaaagaaaacuuuuuauguuaaaaagagauuaaaguaaguuuugacuacuaaacaagcucuacaaaagauccuaaaaggaauccuucaacugaaaaggguaaagacacacaagaagucauaggaaaaaaaugaauagcaggacacagaauaaagagguccaagaaaacacaacaccaacaaaaaugacaggagcagacacuccuuucaauaauaacuaaauacuauuucaauucuucaacaaaaccacacugacuaucagacugaauuagauaacaacauccauacuuuugcuuccuccaaaaccacacuucaccaguaaugacagagaacaccuuagaguaaaagcauggacaaaggaauuccaaagaagugggacuaagaaccagcagcauugcuauucuaauauucaagaccacagacuucaaacaaaaacuaggaagaagacauaaggacuaucaguucauuuuuaguaaaagagaaacccaccaacagaauauuacaacucuaggucuauauacaccaaaacacagggcaucacauuucauaaagaaaacauuagaucuaaaaaccacagauugaccccaacagagugacuguggaauguugcaggauguucccuguccaauuacauuagugcagaggucugugaauggacagggcaaagugggguugagcuaagaauugcagagagggaguaucccagaggguagggagaagaaccaagaccgcagacugugaacuccuguggcaauuacuagccacaaguagcuaugauuucauaaguuuagaaauauugggguaaaguuuuaucauuaccaacuggcucugaaauucuuuauuggcauuuuguaaauugagauuuuauugauauauaaaucuaguugguuaacuacagagucuugauucuacugggguauuggguugugagauguaaccgcgagguuggcggucccauguaguuacuggaauaugugaucuccaacuauauagauuuauggaugaagaagaacuaguggugauggaacaaacacagcgggggcuagcugggagagagucucucagagaccuugugagcgguacccugccaggacacaguguuguggcccaccagugcuagagcuggaaccccucuggggcaggagaguuggcaggaucauuuuuuauuauuucccgcaacaguggaagacuuuaauaucucacucucacagauucacaggcaaaaaaaugaaaaaagaaaugcugcuauucaaugacaucauucaaaugguucuaaauaaugccuacagagcauuccauccaaacacuauguagcucauaaaauguucuccaaaauuaacuccaugauagaagacaaagcaagucuuaauaaaaauaggaacacugaaauggcauccaguguucuauuaguccacagugggauaaaacuggguaucaacagaaauaggaauuauagaaaguacacaaacucauggaagcuaagcaacacacuacugaaugauaauuaggucacagaaaaaaaaaucaagaaagaaaauuuaaaagccuccuaaaauuggacgaaaauuaauaccaaaaucaauaggacaaaugaaggcaggccuaacagggaaguuuauagaagcgucuaucuauauaaaaaaauguuuuagagaucucaaacuaacaauuuagugaugcaacaaaagccugcagaagaaaaacagaacaaacaauauaaaaaaauuaauauuuuuuucaagaucagggcuaaaauucauugcauagaaauaaaaaaaaaugauacaaagaagcaaugaaaaaaaagagcuaguuuuuuuuuuuuuuuaaaguuuagcaagccaggcuuggugguauguaugcuuaauucuaauacagaggcaaagauaggcauauuucucugacuuugaggccagucuggucuauauacugaguuccaggacagccaagauuacaaagugaucugcuaucaacaaaagaacauacaaauaauaaaacaagaaaaaaaguuauacagccagauauauagccaaauuaaccaaaagaacuuuacagaauaugccaacacuuagauauaugccaauucuauuagauauaauuuauuagaauaugccaauucuacuagguauaauuuagauauaauugauaguaaugccaauucuauuagauauaauuuauuagaauaugccaauucuacuagguauaauuuagauauaauugauaguaagacccuauuacugaaaauaccauauacuugacucauaaaaaaaugagaaaccaaguugauacugacauggaagcuucauugccugcuggcuagcuuucauuaaucuuacauagcagugaacccugugaacuacaauaacaacugaucuggcaaggcaugcccacuggaacaagaagacagugucuucaaaauacaguaugguaauuucauauauccacucacaauaauaugacaguaugcacaagacuagugcaacuucaagcuagaccagaugccaaaauguuaaaugaauauaggguacuuugccuuacagaagcuuuucaguuuuaugaggacccauugguugauuauugaucuuagagcauaagccauugguguucuguuuaggaaauuuucuccugugcccauguguucgagacuuuuccccacuuucucuucuguuagauucagcauaucugguuuuauguggagguccuugauccacuuagacuuaaacuuuguucaaggagauaagaauggaucgauaugcauucuucuauaugcugaccuccaguugaaccagcaccaacguggugcaggugcuucaguccuucuuagaaaggggaacacccacacagaaguagggggaggggaugggaagaggggggaguucuaggaggaguaaaccaggaaaggggauaauauuuaaaauguaaauauccaauuauuuuauauuuuauucgauauuuucuucaaaauauugaauaacccaauaaaagaaaauguuuuuaaaaaaagauuugccauucccccauauuaauuguacagcccaguagcugcaaacauauuuguaauaauguaaaauagauacauguuaagacugugauaauguaaggcuauguuuauguaugaaaagagaaacaacuuuauauuacauugagaggcauuuaauaugcuaaaaagaaaaucugaaaggcucuuacccagaguuaucugccuauacauguuuuguguuacauacaggaucauugccaauguagguucaggguuaaaggauucaacucuuaaaaguaagaagucuaauuuccuaucuuuuuuuuuuuuaaauaguuuuuuucccccauugaaaagcaaauaaaugcauaugcaugugugaauacaccucuuccuauacccccacaauacugugguugucauuguuauguuacuucaaagcccaccuuguuucuucauuaaaccaaauucuuggcuauuagacacauccuauugccaggcccugacacacaaacacaaaucaucuucuauguaacaacagcauuaguacuuauuuggagaauuccucaaggccaagugguuuguugguuugcacuucuccuucagccauaugucaagaguauacacagggcugagaaaagaacagaaaauccugauauggagauuauuauuuuaaaacguauuucagcauuagcaugaggucuguuuaugagagaaggcaaucuuuaugguaucagaauuaaugggccuugacaucugggagcuuugaaugcauaaguaaauguuucuuuaggaaguuuucuucuugguuccucuaaaguuagauaccaugaaaaaagcagaaaagccaauaacuaaaaacaagaguggggggccuggagagauggcucagugguuaaagagcacuggcugcucucccaaaaguccugaguucaaaucccagcaaccacaugguggcucacaaccacccguaaugagaugagaucugaugcccucuucuggagugucugaagacaacuacaauguacuuacauguaauaauaaauaaaucuuuuaaaaaacaaaacaaaacaaacaaacaaaaccccccacaagacugguacuggggaaccagccuguuuuaaggggcugugggaauagggccaggcagcagcagguacagugagguuggucuggggguugcccucugcaguacuggggaaacucucugcaucuuuugagcuugagaguauggaggaaacagaauugccuucucugagacagauuaccuuccuucucugucugucaaguuccaauauuggugggagggaaagucaaaacucucuggaaagggugaucauuggguuuuacaauaacauacuaaauauauccucagggccuggcacugaccauuagguaaacagguuuaagacaacaacaccaacaacaacaacaaaaaaccacccaacuuuuuccuaauucuuucgcuaaagggauucagaucuaguuugguacucaaacauacaucagaaugcacauagcauaaggaaauaugcaaucacagugauggauggggacugggaacucacuauccaugacucagccuucuauaauauaacuacaaccauguacaaagguacacagauuaucaaauauacuggggcagaaaagaaacucccaguuuaauuucaagcacaaagauuauggaacaaagaaaacauauuaaagauugcaagacagaaagacuaaaucuauuauauaagagaguacaucagaacagcugauuucucaaugaaaauauucaggaaguucggguaggggcaaacaaugcuaaaccaguuaggcaaauguggacuaagaaaacacaaaacauuagaaaauaaacaaaaaugacaggacuuauaacauaccauuaaaaaaaaaaaaaagcccugaauguaaauggucuuaauuauucaaucaaaagaugagaauggcaaacugaauuagaaaacagcacucuucuuuuuccugcuucaaagaaacauacuuccucaucagaggaagauaccacauuaagguaaaacgauagaaaaggcuauucuaaaaaaaaaaaaaaaaaaaacaaaacaaaacaaaaagaaaagaaaaaaaauggacuaggaaauaacaaauauggccagucuaauaccugacaaaauaggcuuuaaauuaaaacuaguuagaagggacuaaaaaugucacuuuauacugaucagagaacauuaagaagguauuacaauuuuaauaugcaugcagugaagagggagugugaauuuguguaugaacuuaacagagaauggagagaauauaacaaaaguaauaugaaaguacagagggaaaauguuuuauuugaaauaggguaagaagggaugaguguuggggcauguagaguuggagguagguaaucagauuuuaaaaauaugaaaaaggcauaugaacaacuucuauuuguaaaguaguuaaaaauacaaugauaaaagcuguauggauggauaaucccucuccuagaagccauaaguuuguuaaaugaaaaucccuauacaaagcauaggauacauuucuaaaaguuguuggucaaagaggccccuggagaucccucaaacaacacaggauaucucauuccucuuacuugcccacuagaacuuaaugggaaaagucuauugcugagcuauucuuuagcugcaggacaugaagaaaugaaacuauagcugagcuggaugcuuucuugauguucaacuagcuuucaugguaccugaaagaugcuaugcaggguucagaggaaaaaagucagccauagucuuaaccaguuauuugccaguguguaacaauaucacccuaccaggacauugugcccaaugaugcuacaguggcgugacugauauggagguaaacaauuacauucugauaggauuuaaggccuauuuugugggagagaauucaugccuguaacuguaaauaugcaaaagcccauagcuagguaagucauugacuaaggaaaggagaacagugcuggugagauggcucaguggguaagagcacccgacugcucuuccgaagguccggaguucaaaucccaguaaccacaugguggcucacaaccauccauaaugagaucugacucccucuucuggaaugucugaagacagcuacaguguacuuacauauaauaaauaaauaaauaaauaaauaaauaaaucuuaaaaaaaaaaaaaggaaaggaaaggagaacaauacugguguuuugauaaaauguauugaaagaaacaaaucuucuuccaaauauuuauacucacagauuaguacuaucagcugcuuagaaaggcuucuuaacaugagugcaaucaaugcagacacuuguaacuggugaaaagguugagaauaaguaaaugaguuuaauaagggauagucagugcuacaugggauaucuacauaaccgcacccuaggcucagguaacauuauagaauaaaggguguaaacacacacacacacacaaacaaacacacacacacauagggagagggagagggagagggagagggagagggagagggagagggagagagaaugcacuaaaauuggaaaaugauguuuccuggaaaggcuguugcugguguagucaugaaaucagagaugcuuagguaaccuccacaagagcuguacuaaauugaaccugucaacaucccauggauuggggagggauucaugagaccacacacucucuaagaagauauuugcagcuaagauaaacuauggaggaggaguccuuuuuuguuuuaaguuaagacaugcuccagcuccaguaaguuaccucacauguaucauaggaaacaaaaucuaaugaaacucaauaggccucugucacuuuccucucucucucucucucucucucucucucucucucucucucucucacacacacacacacacacacacacacacacacgcacaugcacacucacacucacucacgagaaggcacagaaauagaaagagacuggaagaaaaaaguuauagcaggaaugaaaagaggauacgaaagggcauuacuagauguauauauuaaaaaaaauuauaugacugaaacuuaauuaggaauacaaaggaaacaucaauagaugauggcuccaaaauaaaauauuugauaaaguaaucugaaaugauccagguaggaaaaacugaggaaaaaguaaagaauaaaauauauaaucuuuuaucugcuuauaaacagaaaacauucauauggaaaccauaaaaugaaagucauaaucaccuaugacugauaacaaucuucagauaaaaguaauauuuugguguauuuccuuugagggccuuuccuuuaccuauuuauacauaacugacaccacacuauacauauacaagcugugaguuuuuauaauggucucuauaugcugcaaaaaggaguuuuuugauaaaagguaagaguuacacuaaugucuggauaagucuuuagaauaaauuaggaauuauacugguuuuggaaagugagaauaauagggucuccucuaggaguuaugaccuuaccagccguaaguaguuggcugaguccaguacaaggcacgaauucccucccauugaguggcccuaacugucauuacugcacccuugguacaacuugaugguauuccuuggcagcuugcaaagcaccuccugaaacuacgagagcuaguuuucagagagcaggcauccugaucaguuucagcucgauuccucugucucaugcucaaagcaugcauggugucuauacaauagacucuucaaguucuaaaugaaaaucaagaacaagggcaauagcuuuuauauuuugggaauuucuucaacuucucugaacaaagacuagauguaagguuucccaugacugaagcuggaguuugguagcuagucuauuacucacagaaggaacauaaccacucuaagugacauuacucugucuauuuaucuaauacagcauguaauauuuaauuuaauuuaaauauaauuguuuuuaacaacuccuguuucacugaugggcuccugugaucaaauuucuaggcagucaauuuucccuuuguggugcaugguguauaucaugugccuauccaagaagaugcagugacucuuaggccccuucaucccuugaaaugaacuccaagugaggaaagaagcaagugaaucucacucuggagccaaggcaggcaucacgaggaucccaggcuuuggcauaugcuaaaggggccaaggagccccacgcuauacauuucuuuuagaugggcauuuuuaauuucuguuaaaauaauguacaacaaaaauucaucaagaguauguuuaagaaacugacagaugcaagcauguagcaauauaucauuuauuauuuccuucaacagcuaaacauuucauucugagguuaaguuggccaauacacacuuuguauaggugcucuguuucgugagaauuuuuuggacacuuuucuaccacagaauuaaguaccuagguagugaaauuuccugcugcuauacauacucucuagaaacaaaauuccaaucccuuuaugacugccaaauuuauuuucaaauauagaguuuuugcauuagagaacucuugucuaaugaauuaauaaagugagcugaacacugaaucuuuaaauaggggacuauaccuuucauuacugaaguaucagccuucaaaauagguuguauuuaugucacacauaaauaacuuauggucauuaaauuuguuguccuaauuugauuuucauauuuaaaagcaaaauuguaacucagucuuccaagaugcuagaagcugcaaaguuugcagaucugcggugagcaggcuagacauauagaaaagcugacgagcugaugggcccauaugaugaaggagacagccaguuccuacauguugucuucugacuuccacauucacaccaugggaugcacugacuucuccaccccaacacacucucacacauauacauauacacauguacacaaaauaagcaaaacuaaaguauucacaagauuuaaaaaaucuuucuaaaugcagaagacccacgucugcagaggaacauagagcagacagcaacgauucuacuuaacuugggagaagucagauuguuccguguagguccaccacuagaggacuaccaauaagggcuaaccaaagaauagagggcaaucuauuuuauucaaugaauuuaaauguaaaauucaucuagaaaaaaaugaaaagguuugaccaaaaaaaucugugcacugucaaguggacauaaaauuaaccauaauagucuugaacugugacauuaaguuuguaaguuucacucuaccugugggagcaguagcaagugucacuuccuuuucugcuuggcagguuugugugguucacuguggugaucucugagagcaguacagacacacagcuucagauauacuccaauaagccauuagucuucauugggaaaaauuccaagauuuucaauguguauaaauucauuggauuuaaaaucuuuuaaacauuaguuugguuuccauuuaugucauuuuaaaucuugugaauacuuuaguuuugcuuauuuuguguacauguauauguguagaugugugagaguguguugggguggagaagucagugcaucccauggugugaauguggaagucagaagacaacauguaggaacuggcugucuccuucaucauaugggcccagggaacagaauuaguuuaaucagguuuggcagcaagaaccuuuacuggcugagaaauaucccugacccaguuaagaauacagagaugugcccuuccacauggcccuugcugcuggggcaggcuccuaguugcucccaugaagacuccauauccugauacauccuagaggaccugcagcaugaagagcaguuagacccacugcgcucagagcaguugaggauccucugcacucagcuggacaacagcuucacuguuccacagaagauccaacagucugaaggccucccaggagaucuacugcagucagggcaacagaucagcagcuucucugccccugugaagagcccccaguaggaaggccccacagauggucugauacagccagggccgcaagccuaccaggagaccugaagcaacccagggacaaaagaggcagacuccauacagucacccagaccaacaaucaucugggauauccagauggugaaaggcaagagcaagaccauaggcaacagaagccaaaauauguggacaucaucagaagccaguuuucaccccacagcaagcccugaauacacaggaaaauuaggaaucuguccuaaaaucuuaucucaugaagauaauagaguccuuuaaggaggauaucaauaaugcacugaauuucuguauucugaauuuuccuguauuucuauacaggaaaguacagguaaacaggugaagggauugaauaaagcgauccaagaccuaaaaguggaaauaaaaacaauaaagaaaaugcaaauggaggcagaccuggaaauggaaaaccuaggaaagagguaaggaauugcugauguaauuauuaccaacagaguacaagaaaaagaagagagaaucucagguauaaaagauaugguaggagagauugaaacagcugucaauucaaaacauaaaaaacuccuaacccaaagcaucaaggaaacucaggauacaaugaaaagcuaaaucuaaggauacaaugaauaaaucaggauacaaugaaaagccaaaucuaaggauagcggaaauagaggaaaaugaaauucccagcucaaaggaccugaaaaugucuucaauaaaaucauagaagaaaacuuccccaacauaaagaaagagauggacauaaagguacaagaagccuauagaaccaccgaauaaauggaaccugaaaagaaaauccucucgucagauaauuaccaaaacacuaaaugaacagagcaaagaaagauuaaagggaaaaaggccaaguaacauaaaaagguggacuuaucaaaauuacaccauauuucucaacauagacuaugaaaaccagaagggccuggucagaggucaugcagacucuaagagaacauaaaugccagcccaggcuacuauaucaagcaaaacucucaaucaacauagauggagaaaccaaaauauuccaggauaaaaccaaauccaaacaguaucuauccaacccagcccuacaaagaauacuggaaagaaaacuacaacacaaggaagauaccugcaccaaagaaaggauaucucacaacaaagucaaaagcagagagccacaagcacaucaagccacguaccaaaaaauaaaacaaaacaaaacaaaacaaaaaacaaacaaaaacauaucuggaaccaacaaucaucucucuuuaauaucucucaauauuaaugggcucucaacucaccuauaaaaaggcaaaaguuaacagacuggacuaagcccugaagccagcagaaagaaaguaaacagguaaccucaggaaauaggagguuaggacccccccccccccccaaugcaccagagaccugggaguugagagauucaccccaggaucaaagggagugauccuauaugaaaugccugaaagcagggagagggaacuuauagagccaccuccagcagacauacaggacaucaagugagagaugggguuccaaacaaaguccugucccauguaagaguucagcaagaagguacucaccagagaaaaaggucagaacuuaacuuuuggacugccuuaccuuuuuacagcuuaaacaaguaaauuccuguucuaaggaaucagacauccaggggaauccuccuuaccacaauaucuucaggaaaugugucucugcugaaggagccaucaucaaacaugaccucauagaagguuugagaugucacaucuaucacucugcagcuguaguaccgaguguuucgauguuuugugaugacugucugacccacagaaauggcuuucucacaaguuuuggauuucugugagauggagaaaaaggaaaaaaaaaaagagacggauaugaaaaaaagaacagaaaauaaaaaguauuuacuugggaagcaaaaacugaccuugucaagauuuaaauauuuuaaacuuaguauuaaagaauaauuucaaauguaaagacuacaauuaguacaaaaguagagcaucuauccuuugacagguaucaaaauucaucuauuagucagucgcugcuuacuaacacauaauaacuaacgucuuaggaugugcuuuguugucugauauuucagugugaaagaggauagaaauuauguuucauuuguguauaauucugccucuguggcuugucuuugauaccugagcccaacucuucaauucucuaugguuuucuuaaacuacuuugaagcaaugcacaucaugguguucaucaccuaaauacuucaacguuuccuuucuaagaaugagguauccuguuauauaaccacagcucuagauaguaaucaacuagaagaaggugaacacuagcacgacauuuuaaucugucaccuggauucaacugaccucauaaugaccuuagugcuuuccuuuccucucccccaaaacucugaagaaaaggauccauucuccacuucaguuuuguuuaucugucccaucauuuuagacucauauaaauucauuucuauagaccuucuuuaaaaaaaaugguacugauauuuuagaaagauaaaauuucuccuucugcuuuucaauagauaucuguauaauauuuccccaugauuauaaacaguacuguacuauacuauauucuuuucaggauucuuuccaucugaggguacuugaugucugcaugugucucaauguuacuuuugauucuaaaugaaagagugacccaauuucucuauuuuucucuuauauuaauauauaauauaugggacguuuucuuacuauggagaaacaucauaauccuuauacaagucugguuagauuuaacauccaauaacgaaucucacuuauucuuuaugaugaugguggcacaugcugaucauccugcucauuugaucaaguuaaguccacgaggcagauuaaagugucaguguucaucuucuugaaggauuacugucuggagcugugauuauauaaaaaaaaucucauucuuaaaaaauuuacuagauaucacuugguauuugauaugggcaucuccuauguucucuugcaucuacuuacuuaccuaccuaccuaccaaacgugucagcaugagcugauuaaucucuuauuccuaauuguauauaaguccuauuguauuuuauuaauugcugcucacaucaucucacauuugcccaacauaaucuuuaaauguauauauguaucuucuaucuaucuaucuaucuaucuaucuaucuaucuaucuaucuaucuaucuaucuaucagcaguucucugcuauauguccuaaaaaguuuuacaucuucucuguaauuagcgauuaugguucauuucagaggugaauggcucuuuacgauuucagaaaauggggaugcagguacuuuuuucaagaccugugcaugucugaacauacacaauacuauguaagaagcuauacaaaugcuacuuguuauuucuuuuauauccuuaucuauguugauguaaugucaagauaagauuaaagcagcaauuguacuggagucuaauugaagaauagcuaaguaggagcuaccaggacuauacuucaacaaccuagaguuaccugcagagggucgggagcaauuaauuucaaaaccuacaacuucuuuuauuuauauuuaagguauaugauauauuccuuuauaaacauaccgcacauaaaguaguuucuaaauuaccugacaagucuuguuuccuuuuucaucaucuuuuguaaaugguuagcagccuaagccuaacuaagccacacaccagagugaagcggagccagaguccuagagcucuuaaguccaauuucaacagaaucaccuauagccacagggcacugcaguauuaaaaugggaucuauggucccaagcauacuguuagcucuauuuaaguuuggaguuaaggguucaacgaguaauagagcauauagguugaacagucagucaccugucauuuaugauuacaacagauugugcauagaauuaagugccucugaaauuagguuuauuauuuuuaaaacaagaaaauacuuacauuauucguguaagauugcaguaccagcaaucguagaaguaaaaaaaaauuaguauacauuuucacuuuuucauagcuaucagcuuuuauuggcagauucuaagcaugaacacugaucacuauggcucuagaggucaggaucuuauuauacuacagaauacauccagaaucacugaaugggguaacauuauugacuucuugauguacguggcaagugccacaguaauguauauauuauuacuaauuuauuagucuaguaaugugugguuguuacugaauacaaucuuuuugauuaaaggacaucaacuaacuaagaaaaagacaugggugucuccuaugcaaccuauaauuucacauaauggaaaauaacuuuaaaauaaggagcucauaacagcaguuuguccauuugaacauucucacacauccacacaaucgcuagccacaaaugucagcuauuucuaaagacacuaguagacacuaauggaaucauuacaaaaggcuggaagguugcuguguagguaagauauuucuacaagucaauguggacaauuuuggcaccugcucauaaaagaucauuaguggguccauaugacaaagauauguuuuuuacaugugugaaguugucaaauaauagaagucauuccauuaaaacaaaaacaaaaacaaacaaaaaaaaaaaagaguagggcuggugagauggcucaggaguuaagagcacugacuuguauucccgagguccugaguucaaaucccagcaaccacaugguggcucacaaccauccauaaugagaucugacgcccucuucugguguguuugaagacaacuacaaugaacuuacauauaauaauuuaaaaaaaaaagaguagaggagaaaaauauuauuaauauuaauagagacaggaagagcuuguaaggauacaaaucucuauauugcccuaauccuuuuaagcuuuuaagucaagggaaugguuucauuaaccaaggaaaaauuaagcaaauuacaguuuaaacucaaguuaucugcguacaaauucuauuuucuuagaggaauuucagucuuaaguaauaugaaugaaggggggcaaacuauuuuuccuuucuauaaucuaugcuaauauauucuccucacguuaaaaguuauacacuuucauagucauauuccacugaucuuccagggccuucauguuagagcucacuuauccuguguuagguagaaagaagcaaaaguuccuggccauuuuccuuuuacaacguuguugcuauuucuuucuuucaggaaagauuuaaauaaauguguaucauugcacacagaaugcauugcagauuuuaggagcucuuuucacguuguucuacuugaaauuaucuucugacaugcugaacacaugaacagcacaaucuauauacaacuauucagauaucuguacacagauccaaaaaaagaauggauccuaagaguuugacucauuuuuguauacauucacucauucaacuuacuauaaauacuguguuuaaugcauagccgaaacugaaugguucugagcaacuauguuuaaauaauaguucucaauuccgagucuuaauuauacuacagucuggacaugucaacacucacaagguauuagagaccugugacaggucccagaaagaauucaaauaaagugucagcaaaugggagagcagaucuuaccgcguuugaguugacucuaugucugaagcaugugauguuuaccacguaaggccagucaucaggcuccaugagcacuccagcagcaugggcacacguaacauggaaugaagcugggcagcggccauaagaacacuggaugcaggcuccagaaaccuuuuuaacccggugucuacagaagaugcauuucugaaggauuaaaacagagaauauaacauucauucaucaaagaauaauaugaacaacacaaguucugauucuggggccuuaucagcaagaacauagggagagagcgcauaccauagaacaaaaacaagguccuuacaauuuuaaagcauuacuuuaaaacuuaccuugguauuuuuaaaaaucaccgcucucuguuuugaaacagcacaaaaagaaaaggaacuguuagaaaucacuacaauuuuaugaggucccauuuaucgauucuugaucuuacagcacaagccauugcuguucuacucaggaauuuucccccuguacccauaucuucgaggguuuucccuacuuucuccucuauauguuucagugucucugguuuuauguggaguuccuuaauccacuuagauuugaccuuaguacaaggagauagaaauggaucaauucgcauucuucuacaugauaaccgccaguugugccagcaccauuuguugaaaaugcugucuuuuuuccacuggaugguuuuagcucccuuaucaaagaucaagugaccauagguguguggguucaucucugggucuucaauucuguuccauuggucuacuugucugucacuauaccaguaccaugcaguuuugaucacaauugcucuguaguacaguuuuagguccggcauggugauuccaccagagguucuuuuauccuugagaagaguuuuugcuauccuagguuuuuuguuauuccagaugaaucugccgauugcccuuucuaguucguugaagaauugaguuggaauuuugaaaugggaccucauaaaauugcaaagcuucugcaaagcaaaagacacugucaauaagacaaaaaggccaccaacagauugggaaaggaucuuuaccuaucccaaaucggauaggggacuaauauccaauauauauaaagaacucaagaagguggacuccagaaaaucaaauaaccccauuaaaaaauggggcucagagcugaacaaagaauucucaccugagaaauaccgaauggcagagaaacaccugaaaaaauguucaacauccuuaaucaucagggaaaugcaaaucaaaacaacacugagauuccacuucacuccagucagaauggcuaagaucaaaaacucaggcgaggauguggagaaaggggaacacuucuccauuguuggugggauugcaagcuuguacaaccacucuggaaaucagucuggcgguuccucagaaaauuggacauaguacuaccggaggaucccgcaauaccucuccugggcauauauccagaagaugucccaaccgguaagaagaacacaugcuccacuauguucauagcagccuuguuuauaauagccagaagcuggaaagaacccagaugccccucaacagaggaauggauacagaaaauggauacauuuacacaauggaauacuacucagcuauuaaaaaaaaugaauuuaugaaauuccuaggcaaauggauggaccuggaggguaucauccugagugaaguaacccaaucacaaaggaacucgcacaauauguacucacugauaagugcauaauaauagcccagaaacuuaggguacccaaaauauaagauacaacuugccaaacgcaugaaauucaagaagaacgaagaccaaaguguggacacuuuacccuuucuuagaaaugggaacaaaacacccauagaaggaguuacagagacaaaauuuggagcugugacgaaaggauggaccaucuagugacugccauaugcagggauccaucccauaaucagcuuccaaacgcugacaccauugcauuuugcugaaaggacccaguuauagcucucucuuguaagacuaugccggggccuagcaaacacagaaguggaugcucacagucagcuauuggaugggucacacggcccccaauggaggagcuagagaaauuacccaaggagcuaaagggaucugcaacccuauagguggaacaacauuaugaacuaaccaguaccccggagcucuugucucuagcugcauauguaucaaaagauggccuagucggccaucacugcaaagagaggcccauuggacuugcaaacuuuauaugucccaguacaggggaacgccagggccaaaaagggggaguggguggauaggggauuggggggguggguaugggggaccuuugggauagcauugaaaauguaaaugaggaaaauaccuaauuaaaaaaaaaaaucacuacaaauucugaccagccaggcuuuaggauucugacauuaggaagaggcuaggguugagaugucuuccguauuugcugcucuuuccugacaaagacuuacagagaacuucugccuuuaagcaaagcuauccgcucaaggaugggaagugaaucaaugucuucagggaagcuaacagugauguuuguuugauauaucgucguacuaaguuuccuggguuagcucugaauuuguucuguaggcuaggaagaccuugauauugagacucuccuauuucagccagaauaguuuguauuacaagacucugccaccaggcuuggcucccuagagucuuaagugguaacccuaugcgacacagguacaaagggaacuuaaggauauaagauuauaggcauuugagagcgggaaaguauagaaagacaaggcaauuauuuuugcagaccacucauuaagguaucagugaugccuugagaaagaaugagaaggcuaugucugggcaacaacuaauacaagagauucgagaguuaaauggggauucugagggaagcaccccuguggaugcuuuagaauaaguuuaccaaaaugcugacugccagaaaacaacaaaaguagaaaaugcggacacugauaccaugggauuaucaccuucgucauuccuuacauuuuuccagggaaggagccuggaacugcucauuuuuuucauugaauuaaacagauuccuucaaaugaacuuuagucaaguuucaugaccugcuucuucuaaaucucaacagacacauuacaugccucaacaaaaagacacuggagcaugaaucagagcgaccaggaagucuauaaacagaucuaagagcauugaaaacucugaacauucaggguagaaccacggcauuuauauuuuaugacauaaaucucagugauccugaggcuggagcuccacauaucgguccuuaagaaccuuugggugggaaggcuacaaaauauaaagcagcaacaauucugagguacuuuuaauucaaaggaaugaaggaaguauaagcuacuccaucugcuguccaaugccuagagaagaagaugcucagaagaaugucuuacagaguacuguacucugcuggggaacuggauucucacacuucauucugaggcacaggccacugagggcacuaacagacugaggagguaauaagcccuuguaaugauuuacuugcgcauauagcuuggcaaaggacaucaagaaaugaugagcuaugaaguaguuggagguucaaaacaccuugucuuuuccuauuuacauauuuuaugauuuguuauauuauuauaauauuauaugauuuauagauagauagauagauaguuauuuugccaguuuuuuaaucauucuuuuuccuucuguaaauaucaagguaauucuaaaacaggcauaaauaucuuuaaaaauaaaauuacuguuuccugguauuccauauaacaucucagagcaggacaauacuguguaucuugcuccagggcccagccugagggaucugccuccucuucccuuucuuucacauacccaguccccaaaucuaguccuaguugcccauccacugucugucuaaccugugcuugcacuggccacaaccuauauaagcucugaacugagggacauuauguaugauagcauagagccccagguaccaucugacaucaucccuuuugaaugucaugcaaccuuucagcuaagccagaucugaugcaucuuacaccagggcuauccugguaaguuuucuggaacauccacucucaagugcuagauauaauccagauuucaaauccagcgaacaggccaagucucugcucuuauaacccacaaucuacaggcuuuggacaggaggcacauccugucuuccaggagagaguccuuugacauuacauucaaccuucaggaucaagcuuccuguuuaaucuguuuccuaucacaguauacuaugucuacaucagacagaaaacuaacaaaauaaacccacaugcccaaguuuaaccacaaaaauaaacacauugugaauagucaaaauaggaugugucaucuuaaauccagucauacagaaggaaauauuuggcauagagaauuaccacagcaaaccuaagcaugaagaauuuuuuuuauaaaagagaaauuauagacuucaaagaaaagaguuuaaagaagacauuaaaaaaaaaaccucaaaaaccuuagagaaugaaauuuaagagcauaauaccugaauggugcccaagauaauacaaaaauagcacuggauuaaaugacaaagacaauguaagauuugacaagguaauucgauaaaaagauggaaacauugaagaaaacucaagguggaauaaagaaagaauuggaaaacacaaucagaaaacucaaggaucagauaguagaagcaaagaauauggaaauuugaauaaagcauaaaaaggaaagacacaggaacugucagauacaaugaaaagauuaaaucuuugaaacaacaggaucauagaagaaaaugucccccaaauaaagaaagacauuuagauacagauauaagaaacagaauaucaaauagauaagauaaaaaagaaauucuccacuggauaagacacuuaaaacauaagccauacagaaaaaaaaagaguauuaaaagcugcuuaagaaaaaagaaacauucucaauggaaacuuugaaagcaaggaggagaggagauuuccuaaauagaacuccaauggcucaggcucuaagaucaacaauugguaaaugagaacucaugaaacugaaaagcuucuguauuguaaaggauauagacaauaggacaaaucuguaaccuacagauugggaaaaaauauucacuaaccccacauucuguagaaagcuacagaauauccaaaauauauaaagaacucaagcagcuaaccuguuuuaaaaaaaaaaaaagauaaaaagauaaaacaaucaaacacuggaguacagaacuaaauaaagaauucacaacagaaaaaucucaaagggcuaagaagcacuuaaagaaauguucaaaguacuuaguuguuggggcggaccugcagcucucaugucuggguuggaaccugggaggcaucuuggaacugaaagaaaagagggaaucuaggaggguagagagagaaauggagccaagaaaguauucugaucaagacucaaauuuuuaauggugggcacgcuuuauaaaggagaggggaggcccauuccugccaaaucauccuuggagcccagcugcaagugaccacguguaggcuacugaauagcuaggcagacucccagcagguagcagcagugguaguggcugaacaauagagugaucuagggaggcaggcuccacccuaggugaucuccuuagugguauugcaaagucaaggucuggcucagguggcuucaggcuuguggaaggcuacacuuagugaucagagaaaugcaaauuaacacaacccugagauuccaccuuacaccaaucagaauggcuaaaaucaaaaccaggugacaacacauguuggagaggauguggagaaagaggaacacuccuucauugcuggugguauugcaaaguaguaagaccacuguggaaaucaaucuggagguuccucagaaaacuagaaauagaucuaccuaaaguggacccgcuacaccacucuggggcauaaauccaauagaugccacacaaugcagcaguggcaaguguuccaguauguucauaguggccuuaucugugaaggccagaagcuagaaacaacccagacaucccacgacagaaggauggauacagaaaacgugguucauuuacacaagggacuacuacuuagcuauuaagaacgaguucaugcaggcaaacucauggaacuagaaaauaucauccugagugagguaauucauacccaaaaggacaugcaugguauguacucacuaauaaguggauauuaaucaagaaaguacagaauacccaggauacaauccacaaaagccaaggggccccagugaggaugccucaaucacucuugggagggagaagaaaacagucauggggguggggggcagaaggagggaggaaccuggauaggagaggggucagugaggggagaagggcaacaugaucaaguauuaaaaguggggacgggagggggagcagacccuccagaauguaccagaaaccugggaggugagagagucucaaaauccaaagggaggcacccuagaugaaaugcccaacagugaggagauggaacuuguagaguucaucuccaguagaaagacaaggcaucaaguggagggauugugcugccaucccacagucagaaacugacccagaacuguucugucuaaaacagcagggacaaaaaugcagaacagacugagggaaaggagguacggugacaggccaaaauugggauucauauuaaggacaagcuccaaggccugacauuauuacugaugcuauggugugcuuauagacaggagccuagcaugacuggccucugacaggcccaacaaacagcucagugagucagauacagauacuuaacgccccaacaauggguagaagcuggggaccccugugcuggaauuagagaaaagcuguaagaagcugaggggagaaagaccccauaggaagacuagcagucucaacuaaccugguccccccagagaucucucagucugccaccaaccacucagcauacaccaguucauaugaagcccccaaaacauaaacagcagaugacugucuggucuggccuuagugagagaagaugcaccuagcccuugagagacuugagaccccagggagugggagguuuggcagggacacacacacacacacacacacacacacacacacauauucuauuggagauggggggggagauaugcgaugaggaacagaggccagaccaggagggggaauagugacuggacuauaaaauaacaucaagauauauauauauauauauagauagauagauagguagauagauagauagauagauagauagauagauagauagauagauugauagauauagauauagauauagauauagauauagauauagauauagauauagauauacauauauacauauauacauauauacauauauauguauaugaacaugauacggccaggcagugguggugcacgccuuuaaucccagcacuugggaggcagaugcaagcagauuucugaguucaaggccagccuggucuacagagugagcuccaggacagcuacggcuacacagagaaacccuguguagccucaaaacaccaaaaaacaaaaaucaaucaaucaaacaaacaaacaaacaaaaaaaccccaacaacaauaaccuauagaaaaaauuaagcuggaccuuaguaagacaauaucccuucccgaugcuauucccugaccuaaaaguucuguuucuaaaugauuuugaaaucaauauugucugagugguccuaggcaaaucaugguuuaaagacaggcuagaaaauuguagucaauaaauagaaucucuuaaugaaagaaacuaaacaugccauguuauagguuaaaccagucaaagagggacuauagagagugcaucuccuccaaaugugagggaucaacauggcucuuuccaagucacucaugaguuauaccaauaaggacuucugguuuucugacuccugcucauccauuuuaugcuaaauuuaucacauuagauccugccaaaacauuaggcugggauacagaaacuauccaauauaggagagucaaacauuugcagaauuaguuuuacuacuaucaauguuuaucagggaaucauguuuaaaauucuguuccccuuuucuccacaguuagaaauucugauucauaagucagaauaaaaauuuauaacucaucacuauaaagccacugcagugcaaaccuagauuuagaaauaauguuucuuccuaagguaaccagcuacaaacuuuugauuuacaaugguuaccugcuuacaagauaugcuaguucacuacugguguggaaguaaccaaccaauaucugauugaauuuaaggcuaacuccaugagauagaacccauuccugacacagcucaggugucuaagaaccuaagacuacauaggccagggaccuaggagaaaaccaaaaacuacuguucggccaaaggaacauagccauaaaaugaauucuaaugauauucugcuauacucacaugccaggagccugccuggucuuaggggaaucacaggcuaaaagacugauggucuccagccuuguaggaaacuugauuuuuuucuucuuguucugugcuaagaacuuaacucuuuuguacuggucuguacuucauuaaguacugaagaaacuuaacucuuuaucucucuucuuaaguuacgugauaguacucugugcuugaauaaguucugcaaacucuuaaacucuuacuuuauaaacauacuuuauaauucucugucaauuaacauaugcuguauagcagcagagaauucaguagaggaguuauugcugaggcuccuguuucucuuuuccagagucucaccucucuacgagagggaggcuuggagcaauuaccuuuuaguaaaaaccugacagcccaauuuaaggggggggggggcucccuaaucugguauuuucuuuaaaauauuuauaauaauggcaaaaugaaauaaucuccaagugaaaugaucauaauguuauuaauuuuaaauauaagcauuuuagcagaaauccccuaagaagauagggacaaaugcugaaggguggaauaacuuaaguaugccaaugagcuuucuguccagagcacggauugugaugguuaaaaugaugaauugacugggucaaaauuugcuguaauauguagugaaauacuuaugagaguuugauucauuuuucuuuuuuuaaaauuuguuguaguuccauagcagcuuauaggccagccauuugguaugauuuauuucaauaugugucacaugguauguuuagugauuguugacuaauauuuaauucuaaaaaacuccuuaagugcucuaaaaugcaauaaacuagccauuauaauuugaaaagcauugaacaguuugauauauauguuacuauaccaaugccagaaugucauuauucuuuugacugaaaauagucugcuacucaauaaaaauguuucacaucaauuuuucuuugcuucugaaauaaaaaaauaaaaccaauacuuuuggaagucccuccuccaccccuaaccucuuuccagguaaggaucaguaccaagucucaaaauguaucucacagguagacaaguagguuuuuuuccucuucuaccaaggguucccaucuggggaucugcaacaagccagucugcauacacgagaaguaccucccucuccccucauaagaccuagucaccuccaucuugacaucugugcugaggcccaugcccacguuccacagacagcacucucagcuuccuuuacccaccacccauugaaauauuagcaccucuaagugagacuugcacaugcuuuccaaagaaaucaccccuuuacucucccuacaaauaccaaagucacaaucaguugaggaccugaggcaggacccugcugcauuccaaguaguacacucccuuuuuccuucuaucugggaguguuaauucugugcuaauguugagcaucugugaaccaaaugguaaccuucacacaucucucucuggcccuccaaccucaaucucagagaaacugcaaugagaacguucugauucuacauagcaccuacuaugagauccgaagcagcaacuugcccuagcagagcaaagaucaucugugauaccacaaccacacauuagaccuucaugcccacaaaaauaagucugaaauaucacuuagccaauuccaaaccuuccaaaccaauaagagcaaacagauccaaauaaaaacacugaacaagggagggcaaaauauccauacuaaaagaaacacuaucacaaaacaaacagcaaaaccaaaaaacaacaaauuugcuacucuaaaaauuaguacuucaauaguuucuuuuuaaggaaagaaacuuggaugauacucaagauaacaacucuuaaugcauucagagaacucaaaggggacaugaaaaaaaugcaagaaagaagacuacuagauuaaauagaaacaaauuauugaaugaauuaaagaauaauucaauacauaaaaauagaauuuaguaagaaacagaaauucugaggaaaaacugaacuagaacuucaaauauaaaauuuaguaauucuaauaaaaaguucagagggaagccacacaaaaaggaggaacuuaaugacagacaggaaguggagagauugggauggaggaacuaaaucaguuagcaagaauaaauaauuaagaaaaaagaucaggagaaagaggaacaggaggcggagagaacgaagagaaagaggaguaggaagaggagaaaugcaggauauccaggagaccauaaauaccaaaccuuuaaauuacagguauaaaagauguaaucuggauaaaaggcacauuauuuaaaaaaaaaaaaaaaaggagaagaaaauuucccacagcuagaagacauaucuauccaguaucaagaaguauuuaaagccagacggugguggcgcacgccuuuaaucccagagcuugggaggcagaggcaggcggauuucugaguucgaggccagccuggucuacagagugaguuccaggacagccagggcuacacagagaaacccugucucagauccccccccccccaaaaaaacaagucaguagacaaacaguaaauagguucaugcuugccuaucaguucuucauuaaaccuuauguaguuacuaauuguuaagcaugacuuguauagaaagacuaaauuuucacaagaaaaaguaauguuuuuuacauugcaaaaugaacaaaaacauuuuuguuugucuucaugauuuugaguguuucaaugcaucacaaacuauuuuucuguuuuuguuuaauuuuugugaucugcuacuauccuuuauguuaggcaaacaaguuugcaacaccuguacacgacaacuugugauuaaggcucagaugaagcauuugcaggcgaaccagcagcauuacccuguggugggugcuggagagacucagccuagcccucagugcugcauacgaaaugaucagcuggccaggcagugguggcgcacaccuuuaaucccagcacguugggaggcagaggcaggccgauuucugaguuugaggccagccuggucuacagagcgaguuccaggacagccagggcuacacaguuaaaaaaagaaaaaagaaaugaucaacuggcuuacuuguucuuuacuuucaaauagacagacagacagacagacagacagaugaaaugcuuuguauugggguugcuuacaaaagaauggaugaaaggucaagaagcacgagccacuuuuaccuguggccacacaacugaguuagauaaaugucucuucucgucuaccaugcaucagcugauuaugguauuuagggaggacgggggccuuacaaaucccuuucugccucccucaacaguccccaccuuguggaggucauggcagcuccugaaagucaagaauuuagagagcaucaccgaccugaaacaccauuacagugguggguuuauuuuuccggaucugaaguccauggcugaguaaaacugcugcugacgauuacgcacaucagauacugagcucccaaagcaacacaggaacuugccacuggucucggauagcaucuucuaguauuaucagagucuguucaguuccaacuuauuuuuuucuguguucugucacuaguacauguuguaucuugacuaauacgauuuuaucaucuaauucuggcuggcaacaauaagcaguacaugccaacugccuguauugguuuagagggauuguggaccccuaacaaucucuuuuugaauaagugaauacagugacuggcacaugacuaccacauaaacauagcucuugcaugaugaaaaugaguauaauagugccauacguuaguacggcgugcagagguagauagaaauuaaagaagaaucccaagaaaggcucaaacuauuuguuauuguaugaucucacucuucaggugacaauuauuuuaaggcagaauaguaauuugccauauaucauacauaccauaucuuuucauacuuuuuuuuggagggggggggggacuuuugagacaggguuucuuuguguagcccuggcuguccuggaacucacucuguagaccaggcuggccuugaacucagaaauccgccugccucugccucccgagugcugggauuaaaggugugcgccaccaacaccugggcauuuuauacuucuuaguauucacaagcuauuuagcuucuauaagcauagauaacuuaaaauacuaaaucaagugcuaaggcugggaaaucaugcuaaaagauguaaagguuaagaacugugguuuauuuuaaaaauauaguauuuggcaaaauagguaauaguuuugaugaaauaagcuaacacuuagaaauauuacauccauaugauaggaagauguagaguggggaggaggcugacacgcuugcucuuucaauacugcgcugucuuuauaggccuuacuuuuacaccuugaccacauuacucaaauuacguaacagcagaucacauauuucuucguaaaguaaaaaagccugauaguguuauaaugagaaauaguguucacuuacccuuucugagaacaaaggauagaagauaaauuccuaauacaggguucuuugugggaagaagguuguuagaaucaagcaacaguuucaaugauaaugcuugaaauguucuguagaggaaugauugugcguuaugauaaugacagaaacugaagaacuuguagggaaguucacuagcauacuaaaugaauguuuuuaaccuaagaaaagugccuuauuaaauaaacaaaauagucuagguggugguggaacaugccuuuaaucccagcacuggggagguagaagcaaggaaucaaggccagccuggucuccagagcaagauccaggauggccaggacucugauagacagagauacccuacaguaaaaaaacaaacaaaaaaaucaaaacaaaaaacaagaaaagaggccuaaauuaauacuauauguuacagaaagguacaggaauaaaaaaauuaguuaaaguacacucaucacaggcuuguccuuaaaugaaaaaaaaaaaaaaaccucuuaaaaaaguaaaucagugaagaaauuuuuaugaaugcuacugaauagauuagaagguaacaaguuugagaugggaauauuaaguaucuagagucuacauuugaguaaaaaaccuuguaauaaaaaaaaaaaaaagcuucugcgauucaaagcaaaauucuucuuggcaaagagauggcugcuaagguugaacauauuuguuauaccaaaagaaacacaagaguaaagaaagaaaaacagcaggcaauuucuguaagacagguuagggaauugcugaacaauaucagagagccuaauguuuacaaguucauaucaauaaagaaaauugaucccuuucccauauuuaaaaaaaugaggccuguuauggagacuuacaauauacuaauaaagaauuugugaagaaaaauauauagaggauacagggaaauauagguagaauaaaaugaaacuaucugauauacugauuuggaaacaaaacaaauucagaaguugaaauuaacauuaauauauaaaguaaaaaaaaacuuugacacucaccaauuuuaaccucuguaaagguauucugucuacaucuauuuguguccguucugggacauuagugaaucgcacuucuggaacugcaacagcacauaugacaugagcccaccuaaggaaaggagacauuaaauauaaacaaauucccuaaacuuacugacuucaacuuggugguagcaaucuggcacauagaagaaaugaauccaaguaauuccagugcaaguauguucuagauuauaaacuucucuaaugacaacuggauauacuuaacauaaguucuguaaugagaacuagguaaauggggcuggagaaauggcucagcaguuccugcagugggucuuggcacugcacggcauaucagcaccuacauggcagcucacaacuacaacaaauuccaauacuagaugacccgauguuccuucugccuuccaugagcugcaugcacacuaaggcauaaacacauauaaaaaacgaaccauauaaaggccaaggacuaagucuauaauacggauauauacauuugaaaaccauaaggauacugaaaauguagguuuucauuuucacuugauacuacauguguauuauguuucagcagugugauacauggcaauaguucagugaacuaggaaucaccuuuuaauauaauacaugauaugauauguauuauuuucucaggcaaauaauuaaaauauaaauauuuucugggccgggcgugguggcgcauaccuuuaaucccagcacuagggaggcagaggcaggcagauuucugaguucgaggccagccuggucuacaaaaugaguuccaggaccaccacggcuauacagagaaacccugucucggaaaaauaaauaaauaaauaaauaaauaaauaaauaaauagguauuuucuauaaaauuaaaaguaguuaagucuuuauauauuuuuccucagugcaagauuaauauaaacaaaagaaucuauagguaaagagaaaugaaaucuagcuuguuuugugaucuuuuuaaaauauuagggcauccuuucacaucccaaauccgcaucaauuuguuaauaauauuauucaguaucucuuuaaguguuauaccucuaaguaaacauaggacuucagaacaucauuuggauuuguauuauuaaacuaucaacuuauauucaaaugaagguuuuuguuuguuuuucaaagacagguauaggaugucuuggagcuucuagauagaucaggcuggccuucaacucagagauacaagugccucuccuuuucagauacagggauuaaaggacugcacuucgaggcccugcucagccauagcuuauuuauuucuuuuaaccaguaaauaugccagguuucaucccaaaaccauaggaagaaaggacaacuguuaaccccaccagaagauucuucaauacuugaauaaaauuagcaucuuauaguaaaucuauuaagauaauuucucaugauaaauguuuuuacaugaugcacuuaagccauccccagagccuauauauaacaucuaaaaucuagugacaccuauguagaauaaugccaaucuuacuagaugaccuuaugaaagaugauacaaauccaagcaaaaguauuggcuguuacauagcacuuuuaucaauguuaaggaugauaaaugcuuuuagucuucauuccaagcaacgagacucauguauauguacaaaaauacgguacugacaucaaaagauuaugcacaaggaguuccuauuccaguguaugggccacgcaagaucacuugccccacugaagccaaguucuccuaccaguuuauuuaaaaagaaagagaggaagugaggggggcagggggaaggcaguuaacagggaggaaguacugcugaagaaggaaggggugaggaguggagaggaggaaagggauaucagagguaagacagaggagaaaccuguucauaaaaugaggacugucauuacauaggaagcacagagaggaagaaauacucuggcauuugucucugaagccaaauuucaacccuagcuccagagagcaaguaugugaacuaauguccgaggaagaacuguaaauccaacuaucaugcagaacuucaagaguaggaaaagaaaugaugaaauugaacauaauuaauauauuacuuacugauuguucuuagucuguuucagagcaccuccccucaaauugcagagacagcauuccuauggaggagaugggaauuaacauaguuauaaaacccacauaacaaauaucacugcccuucauauaaacuacuguagaaauuuguauauaccauuuuucauuuaucauaaaacuaaaaguguaagaaauuacacaaugauagguacuucaaguuccagauaaaaaaagaaagccugaaaacgguugagugcauagguccuuagaaaggaucaccauauauugcuuucacucuugagugcaguaaugauguugugaaaaagaacuguaccuuacaacagaaauacuuguuaagccauguucauugcugcucuaagagccagaaacugggaagagucuugauuucuaucaacagaugaguggauaagaaaaauguaguacauuuacacaaugaaauauuacucagcuguuaagaaaagugaaauuauaaaacccaaaggcaaacagagcuagaaaauucaugcugagugagguaacccagaccucaaaacacaaauacuguuuucucugcuaagugaguguuaauuguuaugccuuagacauguauacuacaauccaaguaacggcauagguuagguuagguaccacgucagguaccauaagagaccagagcaucucccaaaaagagagaaacagaaaauaaaguuauagagacauaaauaagagaggauuaaauuaaaugagaacgggagggcaagaucaaggaggaaauaaacagagaaacagcuaauacuaaaggcuuuuuaaaaccuauauggaagcguacuaccauugaagcuugcuagcaugcauuuacauaaaaaaagacuuuaaaaggagucaucaaauaacaggggaaacuagacaccuuaggcuaccaaguaaaaucacaggaaugggugacaucuuguugaauuacuggcaaaggggcccuauaaaacacacccccaccagcaaaugucauaggcuagugccaagauuauugcuuacucuccacaacuuaugguagguccuacagguaaagacaacaguaacuuagucauugaacagagaaaaaucuaacuggugucuauauagcaguuucuccucuaauaauaccuagugcuaauggugcuggacaguacuuuucacucuaccagaagagauagguaaucaucaauaguauguagcuacaauucuugggaccuacaacagugacuugccuacaugauauaguagugcaauaguggcaguaauuugaguauaauccaccauuauuuaauuggauuuaagguccauucauggaaggggcaccugaugcuuguuaaaguggccaagaaccauagaacacauaaaucccaguacuuuaugucaaggagaucaucauguauuugaagguauuaauguuagcacagaaaugcagcacaggucuguguauucaaugucugaucagacggguaguauggagaagcauggaaucaaaugugaagacuguugugagaaugacacuaugaauuuaaagccuacagauagaauccauaucuggcaucauuaacagugucaaaaauggggacagaauaaugaaugccagcuguaagacagaaggacuagacucaugcaggaaaacaguaguugccagacauuauaguacaguuaguuguucaaaugaauucauagaagcuguaacuguaugcaacagacauuuuuuucuuuuuuuaaaauguauuuauuacuauaaauaaguacacuguagcugccuucagacaguuaccagaagaggguaucagaucucauuacaggugguugugacccaccaugugguugcugggauuugaacucaggaccuucgaaagagcagucaguguucuuaucugcugagccaucuuaccagcccaguaugcaacagacuuguacaagguagagacagcccaaaccucaguauggauaguaaagaggcucgugaaguuccacugcuagguugacaggcuauugcaacucaugacugcugggagagggaaaguuuguuuucuucuuggacauggucccugagaggcuacuaauguuucaggauauagucccacaaccauacauauagaggcagcauuaaauguauucacucauuagguacuuagaaaucaaucaaacauacugugugcguguaugcuagcuaauuuuauaucaaguugacacaaguuauuguuauuugggaagagggaaccaguugagaacccuucccugcacccaaacacaaaauuggccuguggagcaucuucuugauuuauaauuguuacuggaggggccaucccauuauauauggugccaguuuggggcaauggaugauaauagaaagcacacugagggaaggaggaaccuggguggaagaggggacagggaggggacaaauggaacauaguaagguauugggggguggggggaaacaagacugaagcccugagggacagcagaaagaaugcaaacaggcaaccuaggggggguauaaguuggggggggacccuaaagaaaguaacauagaacugggacaugagugacucucaggacccaaaggagggaccuuaggugaccuuaauccaccuccaguagauauucaauccaauauucaaacaaaacaggcuaucaaucugagagugagggaccaugggaggaugagaagggaaguuaccugggaggagcuggaggaaagaaaaggaagagagaaagaugcaauuguuuuuuuuaauuuaaaaugauuaaaaauuaaaauauaagcauacacaaauuuaggugcuuuagguagagcuuagugauaaacacuugauauccacauuuagguuucauaagaagcacugaagaaaaccaaauguauaaugacaugaaaaugcuaccuauccugauuccaucacuauacaugguacccagaguugaaauuaugacaucaacucucauacagcugaaauaauaaaaggcgacaacugauaaaacuggaaagggggagaagcacacaaaguuuggggagaaaaguggaguugcauagggcaggaauuacaaggaaagaaaacggacaaugauuucaucaaaacacagaaguauguucaaacuggaaaaaaguguacucugaaauuccacuugcccaucaucagcaggguaauuuuuaaaaaauuacacaaauguugguaaugaugugaagaaagaggaagccuuaucuuauaguggugggaauauaagcagaguggugaagccaguaauaaaaucagcauagaaguugcuauucaaucaucaaaauaaaucaguaucaaaagaaauccacaucuuucuagagauacaugcagaacuguguuguauucuguucuauucauaauggccagcaaaugugaugccaauauaucaaucagaugaugaacagaugaggaaaauguacaaauauccaauggaauuuuauucaguuauaaagaauagugaaauuaugaaacuuucaugaaagugauauacuuagaaauaugcuaagggcuggagagauggcucagcaguuaagagguccugaguucaaaucccagcaaccacaggcucacaaccauuuguaaugggaucugaugcccucuucuggugcgucugaaaauaguuacaguguacuuauacuuaaaauaaauaaguagaucuuuuuuagaaaaauuuaaaaauauauaucauacuaaaugagguaacccauacccagcacaacaaaugaacaugcuuccuuucuugugcauauucugucuuugaauauuuaaauuuguguuuuaaucugaaaugucuauugaggucuagaagcuagaaagugugcaugagagaagagagggaaagacgauuuaaaacagagaaagagggaaguagaaaacaugggaucugaaauuagggggaggcauaaaggcuuaaacaaggaagacaugggcaggagaggggaugcuuaacuaaagguauggauguacaaaaaagccuauggaaacccacuauucugugagcugugcuagguugagugacaaagauccccauaggcucauguuuaaauauuugucugcaguuacuagaaguguucaggaaauccuaguauaugucgucuuguugaguaguugugaucuguuggaagagguaugccccuugggauagguuuugagguuucaaaagacaaagccagcccagaucuugcucucucugccucuaacuuguagaugauaugugaacucucaguuacugcuccagcacaaugccuaccugauucccaccaugguggucauggaccaacccucuaaaaauguaagcaaauggugagaagcuggaagcaaucccacuaaaaucagggacuagacaaggcuacccacuuucucccuaccuauucaacauuguacuugaaguccuagucagagaaauuugacaacaaaaggagaucaaggggauacaaauuggaaaagaagaugucaaaauaucacuuuuugcagaugauaugauaguauauauaagugacccuaaaaauuccacaggagaacucauaaaauugauaaacagcuucggugaaguagcuggauauaaaauuaacucaaacaagucaauggccuuucucuacacaaagaauaaacaggcugagaaagaaauuagggaaacaacacccuucucaauagucacaauuaauauaaaauaccuugccaugacucuaacuaaggaagugaaagaucuguaugauaagaacuucaagucucugaagaaagaaauuaaagaagaucucagaagauggaaagaucucccaugcucauggauugauugacaggaucaauauaguaaaaauggcuaucuugccaaaagcaaucuacagauucaaugcaauccccaucaaaauuccaacucaauucuucaacgaauuagaaagagcaaucuccaaauucaucuggaauaacaaaaaaccuaggauagcaaaaacucuucucaaggauaaaagaaccucugguggaaucaccaugccugaccuaaagcuuuacuacagaucaauuguauguaauaaaaacugaaugguacugguauaacaacagacaaguagaccaauggaauagaauugaagacccagaaaugaacccacacaccuauggucacuugaucuucaacaagggagcuaaaaccauccaguggaaaaaagacagcauuuucaacaaauggugcuggcacaacuggcgguuaucauguagaagaaugagaauugauccauuccuagcuccuuuuacuaagaucaaaucuaaguggaucaaggagauccacauaaaaccagacacacugaaaguuauagaggaaaaaauggggaaaagccucgaagguauuggcacaggggaaaaauuccugaauagaacagcaauggcuugugcuguaagaucgagaaucgauaaaugggaccucaugaaacugcaaagcuucuguaaggcaaaagacaccuuuaauaagacaaaaaggacaccaacagauugggaaaggaucuguaccuauccuaaaucagauagaggacuaauauccaauauauauaaagaacucaagaagguggacuccagaaaaucaaauaaccccauucaaaaauggggcucagagcuaaucaaagaauucucacgugaggaauaccgaauggcugagaaacaccugaaaaaauguucagcauccuuaaucaucagggaaaugaaaaucaaaacaacccugagauuccaucucacaccagucagaauggcuaagaucaaaaauucaggugacaguagaugauggcgaggauguagagaaagaggaacacucuuccacuguuggugggauugcaagcuuguacaaccacucuggaaaucagucuugcgguuucucagaaaauuggacaugguacuaccggaggauccagcaauaccucuccuggcauauauccagaagauguuccaacuaguaagaaagaaacaugcuccacuauguucauagcagccuuauuuauaauagccagaagcuggaaagaaccuagaugccccucaacagaggaauggauacagaaaaugugguacauuuacacaauggaguacuacucagcuauuaaaaagaaugaauuuaugaaauuccuaggcaaaugguuggaccuggagguuauuauccugagugcgguaacccaaucacaaaagaacucaaaugauaaguacucacugauaaguggauauuagcccagaaacccagaauacccaagauauaaguuauaauuugcaaaacacaugaaacucaagaaggaagacccaaguguggacucuuugccccuucuuagaauugggaacaaaacaccauggaaggaguuacagagacaaaguuuguagcugagacaaaaagauggaccaucuagugacugccauauccagagauccaucccauaauuagccuccaaaugcugacaccauugcauacacuagcaagauuuugcugauaggacccugauauagcugucucuaacgagacuacaccggggccuagcaaacacauaaguggaugcucacagucaguuaauggauggaucacagggcccccaauggaggagcuagagaaagaacccaaggagcuaaagggaacugcaacccuauagguggaucaacauuaugaacuaaccaguaccccggagcucuugacucuagcugcauauguaucaaaagauggccuagucggccaucacuggaaagagaggcccauuggacuugcaaacuuuauaugccccaguucaggggaaugccagggccaaaaagugggaauggguggguaggggaguggggggaggguaugggggacuuuugggauagcaugggaaauguaaaugagggaaauaccuaauaaaaaagaaaaaagggaaacaaauaaauaaaaauguaagcaaggccaaaauuacguaacuccuuuuauaaauugccuuggucauaaugucacuuuucagcaaugggugggauuuuucuuuugaguuugaaaacaggcaaucuguucguauagaugauacaucuacuaacagauaggaauuauaaaacaaaaaucucaguauuagguaugaguacuacucaaagaguuaaucaucggaaaagcccuagaggcacgcaaaauaacauaggcuauggcuuauucucaguuggccacaacaacuagauuaugagacccuucucuugaaaacacaacacauuuugguuauagcacauaaagauauuaaucugaaacugauuugaaaacuuguuccacacuacuuuucauaguacaagagauguugugcagaacacucagagagaaagucauuaccgauuuacucagccuugaaugcugaauccaaaaauauuguuaucauucaaaauguacaccucagugcaguaguguagugacuguuggaguaauggcauguuuucugacuugauuugagacuucuuccaccaaaagcaauuuaugucuaguacuuguaagccuggacaaaugcuaaugccuagggguuggggacaaugaguuacaauccuucuaaugaaaccuaccacuccgguuuuguuuaaauugauauacugucaaaaauuucuaaauauuuauggucauauccguugacugauacaguucucaaccuuggucugagaagcuucuuugugaauuggcuaauagucagugcaaaugcucauagcuauuagaguguggacaauaagugagguuguguguucaguccuaagaacauaucuaaaucuacucagagcucaguaaacauugggaaggaaaguguaaaaagcuuaguuacaauaaaaaaguauuagaaaaauuacauuuacuauaugauuguauaaaccaagcuaaauaugcuauaguaauagucuguguuccuaauacauaaaucuuacuuuuacacaagauaguaaaagcaaucauaagaaauaauuacaaaugaagcuuugucauacauaggccagcacugauauauuaucugaccucaggugaauuauuggauucccgugaacuccuucagagucucuuugucaaaggaguugcaccauugcucuugaaucuaaagauuacuguaggaagacaauuccucaagaagucaacauaaaagauuugcgccacaaacauaugagccacaaaauucacugauucauaaugaaguguuuagcaaacauuaauauuugaaaauccgggccuauauuaacucagaguauaaguucugucuacuaaacaauagugacugcugaucauaaacugggcaauaucugcugugagaucaccaaugaugaacacaguccaaaaaguuggcagagcaugguuaaauagaaaauguauaaagcaugguagauuaauggaaugaaaaucaaagauggguuuagaguaaaguuccaagggcaauuuuauaaaacaauaauucugguccuuaaauggagaaucauuucuugucaaacguucugucuaaaguucacagugaugaauuccacuucauagaauagguauucuaaucacauuuguuaaggugugaguaaacgaaagaauaaauaaagggaagauuucuuguuaguuggaaaacugcagacagauuguauuguuuccuaaaggauacaucaagauaccucccuugauuuuuuuauuagaacauuuauuuguaaggauuugaaaauguuuuagaaaaugaaauuaaaaaaauaagucuggaaaaguaaauauggacgugaugaucuauggugcacauaggaucugaaguagaaugccacauagaaagucaccugaacuuucuacagugguuacaaagccauuauguagaacgaucugaagagaggggcuacaaguacauaagaaauauguaccgaaauuuaucuuuccauuagauuuagccaucucaauaauaggugcaaagagaagaggaaugacauaauacuaaaucuacuuacugcaguccaugcauuucucuugcaccgggcacacagccauccaucacagacuucaugagaagggacaccauaacaaccuauaaaagaacauaauggauguacagauuaagucucuugcaucuuuaaaguguccacaacccuggaagaaaucccaguuccagcuaccagaggcauguuguucauauguucaacuccugcauaaccuauuuguaagcucaaagcuagccuguauaauuaagugagauaauucgaaaauaaaagguacaaagaggguuggguuauagcuuaguguuagauagccuagcauuaaaaaaagaauuagguaaaauauccaguucucgagguggggaggaggcaaaaaugcauauuucaaaaacaacaacaacaauaacaacuacuacuacuacuacuacuacacagcacaaugccuagcauacccaucuacaugagccugugacaaauacguuuuuuguuguuucccuguguaccacuagcuauccuagaacucucacuguaaaucaggcuggccucaaagucagagaccuuccugccucugccucccaaaugcuggaauuaaagguuaauuuuguaacuaucaugcuaccaauucccaaaacaugaagaucuaucuuuuuugucuuuuugggauuuucuuacugcuucuuugcuuucuugggauuaauauguguaugugaugcgugugugugccaguguggauucacguuuguggauaucagagaucauagugcgauaaguaaucucacuccgucacagauaaugaugaugaaacucugaagucaggcuugcaaaagcaaguuuauguugugacugggucaucuaagaagccuacauauuuggaaucuuccagaugaguuuuucuuauauaguaaagauugaaugagaucuuugccauaguuucuggagaacgaggucaggaggugcagcaccacgccaagcuugagaggacacauauuaauauuaucagagacaaucuuugcaagaagaaaaauaaauuccuaaaaugucauacuaauaaguuacaacucuuaaaacagguuggggaauguuaaucaagugugacucaaauuucagugaugggguaaaugcuauacaguccaugacuaauaauuaaaguuugcuucaauucaauguuugauagauccaugcugagacuaaaugugaggaugggagguggugaaaauaugugugguaaauugcaugauaccaagaucuuggugauauauguuuuauauuagcacaaaauaaaugaauaagcaaauaaaucaaaaaauuaacaaucuaggauguguaacaccugcauuugacauacugagauggaaaauaugguauguucaaggucugccuagccuacagagaaaauuccuuagagaacagcaaaggaggacagaaaggcaagaggagaauaaaugggacagaaagcaaacugggagucagaaagagacacauuauccuuaauuccugaaauaaaaggaguuuggaagaaauaaaugagcaauuuuaacaaagagugauaauagagacaauaacagaauauaaauagaaucaaagaaaaucaaaucaaacaaaauguuaaauucaaucauguuuaugggauuaauacgguuagaguauauagcuggugacuuuagaaaacaagacuaaauccauauuuauugucugguacuuugucucuugacuauacauaguaggauacuguauuuagaaauuaauugcauuagcaaccauugaaacuauguuggagaaaaagacagaaauaagugaauaaaaugggauugaggggcugaaaagauggcucacuaguuuuuguucuuccggcaguggauaagggucggaaucucaacacucacacgguaguucacaaccagccauuacuacaguucagagaacugaaagcccucucugacuucucuaggcaucagucacucauguggaauacauauaaacauaccagcaaaauacauauaacaaaaauaaaaagucuaaaaacaauguguauuaaaggcuugggauguggcucagugguacaacauaaucuuagcauauaugagguccuuguuuggccccuacuaauaaaagacagaaagaaacaaugaaaaucaggacuauugaaauacuuuaaaauuagacuauauauauacacauacacacauacacacacacacauauauauguauguauguauguguauauauauauauauauauauguauauauauauauauauauaaaauauuuuauuaccuauaaauauauuugauacuuaucuaccuguauaaaaguaaaaaauuuugaaagauaaagaaccuaacuauuguaaugacuauuaauaggaacuucccuauauuuaugaagaaaaauauuuaauucaauacacuaacccucagaaccuacagaauaacauccacuucuuagaaagucauaaaaauaguuuucagucaauacuagacauuuagguuaaauuuccacaaucauuagaauauaaaaauuuaaacaagugaagaugccccagccauguuuaugggauuccuaacaacuggacuccuuccaaaucaaaggcccaggccuucucuucacuaguguuucauaaaacugcaaagggaugaugacauucuauucauacucuugaaugaaaccauuaauaauaucaacuguaagaguagaaauggagcucuccuggcuagaagaaccccaguacaaagaacaaugucgacaaaggaacugacagguuacucugaggugauuuguaagggcuauauaaaacacugcaagucuagagacuggaaaaucugacguauuuacuugcaugaacccgcacgaagcacuuggcacaggaaaucagaagacuuguuccaucuucuucaaggaaggcauuugggggggaauagucuacauuuucuucacuauaaauaaaacacaucucuggaauaaugggcuuagucuuucuuccagauugaaccacuucauuuacugcugucucccaucuagaaucauuuucuucuuugcugcuaucaggcugaaaaauauaucauauccacgugagugaaagacacuggaaagagacuuucuuuuauccauuaauccacuuaugccaauuuagccaacacauuacaaccucaucuuguuuuuacaacuucaucuuguugauuucuuuaauucaauugguagcauuucaccaguguucccauacagacucccauucaaaguuaaaucaguaagcucugagaguucauacaagaguucaagaaccucuucaaacugcagucuuccaaaauaccucaggaauguacaacuacuuuugcucacauacaucugugauccacauguaauaggguaaugucugcuuugucuuacugaaaaauauuaugugguuauaccucaaagaauauauauauauauauauaauccuuagguuuucuaggguagcaccaacgagaaguacaugccucccacaaaaguuugaaauacagaagacagaacuagccgacguggucagauaaaaauaaugugucagaccugauugucauggagaaauuacaacuaauaaauuaccuuuauuacucccuagaucuuaaauuaaucaguuucuaaaaucguaucccuuaaagggaguauuuuuauuauuggaaaauauacagggagauaaaaaugcuuaaauacaaaucaauaaaagcaaauauucaaugacuagaagaaaguaaaaccaaaagugaguaagcuacuaauuagaaaguuaaaaauguagaauuucaucuucuuuccagcucugaaauauaagaauuaaaucacuauaaucugacacuugaaaaaaauucauuucaagggcuggagagguggcucugugguuaagagcauuagcugcucuuucagaggaccugaguucaauucccagcacccacaugguaacucacaauuguauguaacuacaugaaguauaaauaaauaaauaaauaaauauuuacgagacuuaugaucuugaauaaaguauuccuuauuaugucagaagaaucacaauuugaaaaugauguuuauaaguggaugcucacagucagcuauuguuuggaucacagggcccccaauggaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuauauguaggggaacgccagggccaaaaagugggaguggguggguaggggaguggggaggaggguaugggggacuuuugggauagcauuggaaauguaaaugaggaaaauaccuaauuaaaaaaaaaagaaaaugauguuuauauuagugggucuucuaauauauuguaccuuaaagcucauaaugcaauuuuauacacagcauuaaauauguuucuuauguguauauugaagaauacauucauuccugaguugagauccugucagaaugacauguauggaaugaugauagaagcaucagacacaguuagcugaaaauagugaacuggauacccaguuuguaaugaguccuggacaugccuuuuguauguuuuacauggaaagguaugggcauugauauuuacauuacuggacaguacuacuuucaauuuuaguuagauacuagguguuugcuuuuuuauacgaaauguuuuguuucuaggcuuuaaguuagaaguugugugucuuuuaguaaaagaauuggguuaaaauacagguuucuaaaaugcaaugauagaaacaaacacuaaaaauaaauaaacaacaaacaaacccaaccaaaagcccccaaagaaguacagcaguagaaagauacaugauagugaaacucuaaauuaccuuguaguacggcaugagcagagugcagauggcacaguuuggcuccauuuuugcaacaguugcauuguacuccuguucagccauaaaguuaggagacuuugucugccaaagguggaugagaggcuuugcccaagacucuguuucuucaacuucuucgucaaugcuuagaaccucaggcaauucuuaggggagaaaacaggaaaauacaauaaacauaagacucagaaaaaaaauaucacccaauaauagauguaaauacuccuaaauaucugugauauuaauaucaaaucuuuauguuagcuuuuuuaaccuauuuaccaaaacuauauucugaaagagauagaaaaaaugugguuuuuuaaucaucuucaaacaaucagauuagaucaugggaacacaaagcaaggccuuuuuguuagcuacuuccuuucuucuagaaaaaauuagccaauccuauuuuaaccucaucacuucauauuuuuaucguccacuguaaaacuacccacauaguuaacaagucucuuguauuaauauuuucauuaucuuuaccuaacauaguacauaguucauaguucaguaaaagcuuaguugaauuucauugaauugauuuuuggauucaagaauccauggcauuuacaaaaguagaaaacaagguagucgucacagaaaaacugagugggagaaaaaggcaugaaaauuaaaauauaaaagaaguuagcugcagaaagaauggaagacaauccccauuaggucuaagugcaagugaaaaaucaggucauauguuaggaaagcccuauaauauccaaauguaagcaaaggaccuauauaaauaaccucugaaggccuauagcuuuggagguuuaucuucuucaguuagccagccaaugcacauuuucuuuuccuuaguaaaguaucucuauuucaaucauuaaucauuaguuccuggugugauuuuccuuuuuaaagauacaauaaccugugguuauacuguggacucuaauaaauggcugcaaaggcuggaagaagacccagaauguaaaaucuauggcuauuuauucuaacauuuacccucaccuuucucuuuucuggaauacuucaaauggugucaaagcucccccaaaaggccugaaugacagccuaugggaacaagauagacuagaacuacauuccgcauuucccuugacuuuccuucauggcuuuuggguuucugggacugaggcugaggguaugucugaccuucucucuugcccucuccuacugggccuugagacagggcaaagaagcagaaguugguuaguggcuuccugggagaaacgaugcuuuaaaugggaaaacaacuaucuaggggcgacuaucuuuaaacuggaaggcuugcaaggagccaucgugauccaagucaagcauaugaauacauggaaaccuaguucucacuggagacuuagguacucacauuaggacuacguacacugaaguugcccacccaacauuuggacaacuaaagaaggcuaugguuacaugcaccaccaagaugguacucgauauaugaggaaagacacuauguacuaauauaaauaaugauagcuacauggcuuggugucuacaaugccagagaauccucuaaccguaaucgaccuuucuccauuucucucuuccuagcuuccauuuuucccagagggcuacugagauaacgagaagggcagacucgaaugaggaccuggcuuaagcacugauauagcucuuggcugauccccuccucccauucaugcccuacagaugaugcauuaauuaauuuucauuuuugaggauugguuuuuguuuuugcgacaccaccuaccuaagaaagacacguagaaagaacaugaacuugagugcuaccaaggaaugaaaauauucuaaauaaauacuuauguucccccuuccauuugcucaguaucagcauauugaaacaauggacagaaagacacuagaauucuauuuggaaucucaugaccagaaggaaaauacugaauccugcugccagacagaaaauaaguuugucuuuuaaaagaaauuucucauaguucagcaaccugccagacaaccuuaugagagagauuaggguagagucaaugaugggaaggaccacaccuggacaaggacugcuuagcuauuucacucuuuaaauuuuaacugggaaaagaggacuuguagugaggucacgucaccggauuuuucuguuuuacuucccaauggguccacauugaaucaacuucuccucucuugcuuuauaucauuaaaccuuucuuuacuugggacuguugcaaaggcuacaacuacaaauguuucagaaaaauacuuaaccuuaaacucuugagacaacuuuguuaacauaauucacacauaguuuugcaaguucuauacacggaaaucaaggaauauucugugcaaauucucaaguggcugacauaaaaauaaguuucuaggaagaaaaucacaugaaaaagagacccuuccuuagaaggaugucuaguacccuuccuccagggaagccacaacaauagcaagccuugaggaaaaguaauuaaaauucccaaauauguuacauaauuaauuuuaaaaaucugucauauaguuauaauaacuaaaauagcacaauagcuugugcuacaugaacuaaaaugagauaaagaaggaauuguaguaaacaugaugucuauaauccuagcaauuggaaggauguaugcaggugaucaagucucggcacugccuagacuuuaacuuuaacuuauaucuaggaaacaaaaacuagaacuaauucauacagaaauaacaucuaauauuucucuuuauuucaauuauucaacuaaaaugcuacuguacacuauagaaaguacuaccacuguguucuauuuuccuacauaagcaugugucacaaaauaaauguaguaaauggggccugagagaugcucugacucugguuacucucuugccccugucucuugcacucuugcuccccuucucuccacuuucccuuccccccucucuccaccuucccuucccucucuccacauggccauggccaaccucuacuucucgacucuucucccacucucugccuuucuuugccuacccucuuagcuccccuuccugccauaacaauaaacacuuuaaaaccaugaacugccacuucucaucgggauccaccaugcugaagcaauggagcaggucuuccccuagccucucgucuaauuucacaugggaggccucucuauguucucagccauggucuccaccaagccaagcagcccacugagcaagccaagaacucgccuccacuugggacccagcuggagcucuccuccugcccacuccauucucagcucuuccgcagcauucagccaugacuguggugcccaagagcuagaaucugucgucccuggccuccaugcaggccugggaaccccgagcaaauuucugcaguucugcagggaccccagacuacgccuucccaaccccaggagauagguccugcugcuucucacagcccggcggugugggauccgugucucagucaaaacuuccucaguguuccgccuggcccaguggcacaagcugugggccggacaggaccccacuuuuaauccacaucugaugaccaacuuggggcagaaccagcuaaaacauacccucagcuggggacccacacauagagagagacccacaucagaacuccagguagcccaagaccaugaguaagcugaccuaguucgaaagacuaggccguccucugaucacccccccaaacccccaccaccccacccccggccaucaccccacauccauguguuccaggccaccuucuucccuagguggggacuagccuccacucucugccccucccccagcccuguagcaagggcuccuuucagaaggcagcucuugcucugaacucucugcuuccucugucugcaagucaacacaccauucccugaguaugacauauucuauucggccagaggucuaugcuuauucuuuugagcuuuucuucaagguuggccuuucaucuccugcuuuccaagaaaacacaaauggggaaaacaggaaccuguuugauagagcacacagcuaccucauagcagaguaggccccuccccccuccaucuaagccccccaaagaaaaaccacaccugagagagacccuuuuugggguuuguuuaaaugcuugcucuuccuaacggggacaccugaaacaguuuucaggcuuuucaaccuaaaauuuucuugcuucuuuauuuaaagguuugcuuugcucccuaauauucgcgauguauguucaaaauuguucaacuuguuuaagauuucuuuuaagguuuaaaagucaccuaaucuacuuccaaaggucaaaucaacuauacugauuaccauuauucaauccuuaauuaacaaccaauuuccuuuuacagacaaaugguuacugcauauccaggaugcauaauuaacaugauauuuuguuccucagccauccaaagcagauuuaaaugaugccuuccagaacuaaauuccucaaaaacccuugcuuuucuaggaccauaacagcagacagugauaugcucccaagcaaaccacugcaggcuuaacauaaauuauccacccuaugcagacaucccccuguugggguucugcaccucuguuaugauuacucuacagguuuauucccacaaaagaaaaggccagugccugcugcacagauccugcugagacagugccaucuccugagaccugccugggacaacaaagcugccuuccuccagacaccucaucugacagaagacuccugagacacaugcugagauucagagacaugcacugagucccacagaggacagacuugggaccucccagcuacagaugaacucucuugccaaagucaaauggcugcugaacuugggggaaguuacaggauaguaaggaaaacaugauguuuaucuagauuaaucaauugcuguuuaaaacugaugcuauugcccucaaacuguacuagccauggaacaauagauucaauaaucccuugccuucccaacaccuacacuuaacccuccuuaccacacuggcuuaguuguguuaccccuccgaccuguauuguguuuucuuuugauacugcuuccccacccaaaauguuuacuucaaaugauagauccauuccagugaccccucccuuugaaaaaaguaaaagggggaguuaugggaccaugaaaggaagccuguuuucuggucgagcuagguuuaaucccuggagacacagcagauuaaucugcaagggacaaaaggaaguuugccacaugcucccagacacuaaguuccggacaagaggccccagcuccauaauuccguggccaucagucacacaggcugugacuccaaccccaguuaccuggcaaccucuacuucuauacucuucuuccucucugccuuucuuucucugccuacccucuuagcuccacuucccgccaugauaauaaacaccuuaaaaaaaaacaaacaaacuaagaaaaaaacaaaaacagaacugacuguucuuccacagguccugagcucaagccucagcacccagauggcagcucaggacuuucuguagcuccaggggaccaagcaucuucacagaacacaaguaggcaaauccccaacacagauaaaauaaaauaaaaaugaagagauguauguggaaaauaaugcugacacauauugugaguguuauuuuauauaaacaagaaccacuauccuguuuuaccuggacuacaucaucaaagacaggggacuuuagucaauauccaucagaaaaggagauucucaaauaagaacucaaaaaacaaacaaaaaaccuacaaaacaacaacaaaacccuuagaaauguaggaaaguaguaaguaaauuuaaacacuacacagacagagagaaagaggaacaagcuaaacaagaaaaguaaauacuauauugggauacgugaccuauaaaagaaaucauuuuacaucaagccucaucagaguagucuaucaaagaaugacagagauuuaccacacacugcuauggagguauauaagagcugguuucugacuguaagguauuuaaaucaauuuaaaugauucagguuaaaagugcaaacugugcagagggcagugguggcauaugccuuuaaucccagcacccuggaggcagagaccagccuggucuauagagugaguucccggacauccagggcuacaugaagaaauccugucuuuaaaaaaacacaaaaguacuaacaauucauauaugccaugacuugaagugauucuuccggaaaauuuucaggcuaugucaggaaugacuuacuuauggcaugaaacaaaauauuuguacuaguauuauuauuaaaguauaugaagcaugacauuacuucuaaacuucaauugcuuuuaccuauaaacuauuuacuacuuauagucucccaaugauuugcuccagaguaaaaguuuccucucuaacugaaaaaucguauuacaguuaauugcauaagccaucuauuacaaaagacuauacacucaccuucaucacucgcuaccugcugcuucacaagugucauuggggaucuggccggaggcuuaccaaguggauggcgccaacucuuaguaguuuuuggcuguccuucaauuaucuggauauagaaaaaaaaaaaaaaaaaaagaaguagaaauauccaugaacaagguuugguucuuuugguuuuacuuuguuuggucuaugccuguauauaugcaggagcuuacauucuacuagcucacugcuuuacauuuugaagcagggucucaauaaaccuggagaucacuucuuugacuagcuuggguaaccaggaagcuccaaggauccuucuguuucugccucccagacuagugcagccaugucuaacuuuucuucaugauugcauagcaagcacauuauucacugagcuauuucuucagacucaauaaauauuuguuucagggaaaaauauauacuuccaaaugauaacauggcuuacaaguuauaucuuauacuuauuuaagaaaugagcacuuuaagaaacuuagacuuacaagcuaagguacagcucagugguagaacacuuaccuagcaugcacaaagcccugaguuuucauccagaguacuaccagggugacauagggagaaaggcugagggcagggggaaagaaggagaaagugagagaggaagagugggagagaaaggggagguaaaggaagaagguagcauuuuucuaagaagucaauuaauucuccuucaacaaauauuguuucauagaagacaauuaagguuucaaagaucauuuaaaacuaucccacauccagcauuauauacuguuaaaaugaugaaaaacuguuaaguuguaucaccuuucauauaugaauacuuggcaagugauccagcuuuaauccucucagagaagaaaauuuagccaagugguaaagaggaccuuuccuuccauagaguaaugagccaugaguucaauaggaaaauauuauuuuuaaauaaaacauucuguuauuuggaaaccauuaaauugugagauauuuuuaagccccuaugagauacuuuaccuuuuaacuuuuaauacuuuugagauaauauguuacauauuucuguagaauauacaaugauauaaaaaaaugauuaagugcauugaucaaauuauugaauuauauuuaauauacuuuaagaugacuaagaaauaaccucuuuaaaauuacucuuuuuauaacgugcuuuguuacuaaaggauaugaaaagacucauaguagguuuaguaaaaugggaucaagcaagauuguuacucaggucagcagacagcucagcugccauuucaaaugagagagaagcuccuuaaguccccggugagggacucagaaugguagcacagcauuagcucgcccgaauguucaguauguaagcauauaauuauaacacuaaacaagaacaaaggagaaauacagagaggaggcuguagccauaaaaccagcaugggaaacuuaacuuuucugagaggcaaaagguuuguggaaauaaacgugaccauaaguauaucucuaauauucugaguaagaagagucaaaggaaacacugaucauguagccaugauguuaagaccaagacuauaugaaacugacucaaauacuuucuacugucaguagggcagugcccaagagacaccugagcucagccuggauaacgcugcuuguuauggggacguuuugcaccaugacugccugaaugucaacaugacuaagauuucaaaauacaguucaucaaguacuaguauuugugaagagcaguuaaugaguaucaauuaacucucuguguacuguuggcacugaagccugcauuauuuacaaauacagauguugcuuauuuuaaaguauaaaguggaaaaaaaucagacuuuaacaguagccaaaaggguuuguauuaaugaauuaaaauguaagccagaauaguauuucuaugccaaaaucauauuccacugaugaaauacaauuaaaauucaaaaauguaaauacuauugauuuuugcccuaaagcaagauuucaggaguuaauaaacuauacucauagagcaucauuauaccauacaggccacaauucaaugaacacagcagaauuacaaaaugacauguaccuuaggaauguugagcccauuucucucuucacuaagagcuucugggauuuccccaggcucaagguuacuuccauggcccucuucaucauuuucuucucccucugucaauacuuuauuacuuucuggcaggggggaagguaucuugggagauucaagcuuuagaaucuuaaguagaugugacucuuugccugcuugauggccaugagaaagugguaugcagucagcgcccuccuucagcugagauggugaaauuacagcacuggcucuguugucuucugguggaauuucagcuguuacugaugaacuuaugcaaccuuuuccuaagaagcaaacaaaaaacucauaguaaguauugcacugcauuacuacugaguacaaugauugaacaauuacaaaguaauuacugauuuuauauuuuauuuuaauuuuaauugagccccaccauguguuuucuuugauuggugauuuagucccagggagcucuggggguacugguuaguucauauuguuguuccuccuauggggcugcaaaccccuucagcuccuucgguacuuucucuagcugcuccauugggggcccugcgcuccauccaauggauggcugugagcauccacauuugccaggcacuggcagagccucucaagaaacagcuauaucgggcuccugccuuaaaaugaagucugaaacaagguaucugaacagaauugucuguaacuuaguuucuuuucguacauuauaagcugaauuucacuaaaacuuucugcucuuagaucucuucauguuuaauuaaaccacaaguauucuauuggacauuuauuuuagaauucuauuacacauaagagcuguuuaccuuauuguguagcauucacuuuccucacagguaaaucaucuguaaguuucuauacucauugacaagcugcguagucagugagauagcuuggugagucagauuacggagcucccuagucacaugugacagacaaccagcuauuuucuuacccgagagcuuggugucguucaguaagcuuugauccacuuguauccugguauccaaagcuucuuuugcugaagauucuucuaauuuccccagcuuuaaugcuuuuucuggcuuuucagugacuuugaggugccuagggcccauggcaggguuugcacccucuuccccacuaaauucagcaaauuccucaucuucuucagguuuaggccuuuuacaaaguggcuuauugcccuguaagcuauuaaaagcaggaugcuggucagagcaaaaaaguucaaaacaaauaauauacagcaaugcaaaugcuacuauuauguacuuauauaaaaaaaaacuucuuuaauuuuuacaauuaauaaagucugaaguuaaaaccauaauggcuuuaugucagcuuucaaucaacuucauaacaacugaauuugcauacuauaaguuuaugaugauagcugaguaguacuccauuguguaaauauaccacauuuucuguauucauuccucuguugauggacaucuggauuguuuacagcuucugacuauguuauauguggaagcauauucuggguauaugcccaggagugguauagcuggguccucagguaguacuaucuucaauuuucugaggaaauguucugaggacuaaaaggucaucagcaaucacuuuaagccaccaacuaaaaaaaccaaauauacuccugaauauuagcauuuauaagaaaugagaaaccuacucugauaaaaacacuggcaaucugaguaucacagauacacauguuguuggcauuccuucuaugcuauguccagcaguuaccuagccacaggcagguagguauggcuugguguaaaagggaauguuugcccccucccuuccuccuccuccccuucccccucucucugcccaugcucucccucucuucccucccuccucccccuuucucuccaaguguuccuggccagccucuucucuuuaucccccgccucccucaccuauccucuuuaaauguccucaaaauaaagucuauucuauacuacaccuguccuauggcuggcaccucagggagagggaugccucagacuuucaagacuuuagcagcuaccucagcucaugaacauuuagacuggugugucuccugaaugacucuagagguguugauuucuuaaauaaucaaucucuaaaugcauuuagucaaucaguuacacauuuugagacaacacuuauauacaugcaaauacacaaaccaugacaaccauuucccucacauaaaacacuauuguagcuuucagauccuauagaaugggaguuauagaugguuguuagcuguggcacauaugcugagaacuugaguuauuuagaagaucauucagugguuuuaagauagcucucccgcuccauuguaagacuuuuaaauucauauugucuguuaaaacacugcauuugaucauucaaauuuuuacaaacacuauuuugaaauuccuugcucuauacuacaaccgaaauauuauuauuauuagauuagcuaaggacuaguccuguuuuguguguguguguguacacgacagaacuaaucaauagauaauaaauacaauauauaauacuuauuauauaauacauauauaugaauauaguuaauacacacauuauauaauauauacaauacauauauuauacuauacauuuuauaacuuuuauauauguauuacauucauucuuucauuuauuuauguauuuauuuauucaugggagacauuuucccaacaucaggaaagcagaagcacagguagaucucucugaguuacagguucuaggauaaccauaaugaguucaaggauaaccacaacauaaugaaaacccuaucuuuaaaaaaacaaacaaaaaaugaggggugggguggcaaaaugaaacuauguacuauuccauguuuggaaauuucuccugcucacaaccagucuaaacaacaaaaaauaaauucaagugguagggggaacaaauugaacauuauacucugagcaaaauuuuaaaauuauaguauuauuacagaauaaacagaagugccauagaucuaaauguaagauauuaaauacauguagauauuaaaaauugugcuauagaaaauaauuugauuauauaaaaaucauucacuuaccuggacaaucaauuguuaauaaagcauagacucauuuugaacgagguacaugcuauuuuuauaauauacauaauaaauacauauguaagaauauacauaaaaucuuaaaauggaugcucuuuggauaacuagguuaugagugauuuggauucacuggauauuuuuuccugaauuuauaaaauuuuagcaauucucaaauauuacuuuuauaaaccaaaggaauaacaagcaauauuaaaaagaaaguuggaauaaaaauuccaaauuacgagcuauuacauuagccuaaggaccugagccauagacaagauauauucaaaggauuuuaaaaaggauuuuugacaaagucaagaaagcuugugacaaagaucacaaaaguggaccagagguaaaguuuaagaagaccacaauggacagaauuaacacauucuccuuugagucuuagaaaagaauuaacacaaacugaauaaaaugccacagcauaagcauccaugugaaaaaaaaaugaaggaaauuauuaugaaaaugucuuaaaauaguagcacauaaaauuuggaaaucaaguaucugaaguuguuugaaauauggugaauaaugucaacaacaaauacauguuuaagauaaauuaaugagaaaacucuaaaauguuccaugcuguucuacuuacuguguauaucaauuucaggaguacucugcauaucugacuaccgauuccuaaauucuaaaacaccgacucaaaaguuaaacacacaaaauuucaguaauauacuauguaaagguaugacuaauaggaacaagaauaaaggaagaggccuagagaacauuugguuccauuucauacaagaacaugcuacagcaggaugugaugggcuucuuaccucuugggaggcuuucuuaauuuuuucuuccucuguagccauguuuuuacuucuggaguagauucuggagugggcuuuguauggucaauaguauauauauccuuuccuuguuuccaaaucugguaucuaucuggcugaaauuucuucacaaauauauccauugauaucuucaccaugucauuccgacaagugcacugaaacgcaauaaacagaauaaaacugacaaugaaauauuuugugaauuauauaacauagguagaauaugaauguuuaaugaaaauauaaaugagaauaauauuuacaucuacaaaaaaacucaaaggaaacuuaaaaaugagaaauacuuuuaaauauagucuguacauucauaugaaccacuuaagaauaaguuauagagaaguaugaauauuucuucaaagguuguccagcaaacgaaacauuauucuacuaucacagauauccaucaacaucuguaguagagcaaguaguguuuguaugaaaugauuacuaucucagauaugcaacaaaauuccaaaguaccaauacuauauagaauguuugugccaauuuagguauguucugaacaucaccaaagauccacuguaauuagacguucgguacaaauggaaagaauauugauagaugaggccuaauagaugguuuuuaauucacuggaugcaggaaauaguucuuauaguaguuugcuauaugugaacauuuguaacuuuuguuuuuuugcuuuuuuuauuuaagucagaaugagauuuauuucauaguaucagaaguuugcauccauggguguuuggucccacuguuugggaaggcugagacagaacacagcuuuccccccacagcagccaggaaacagagagaggggacaaguucagagcuccaguguucuucaagggcaagaccucaauggccugcuucuuccauuuuggccccaccuuccuaccuuuacagcuugucccaaugccagcaucugcuggagguauaacuuuuuuuuaaauaagauauuuucuuuauuuacguuucaaauguuauccccuuuccuccuuuccccucagaaaacccccgaucccauccccucucucccugcucaccaaugcaccugcuucccugaccugucauuccccuauacuagggcacagagccuucacaggaccaagggccuuuccucccacugauguccguccgacaaggccaucgucugcuacauaugcagcuggagccaugaggcccucaauguguacucuuugguuggugguuuagucccugggagcucugguaauauacuguuauuccuccuaugaggcugcaaacccugucagcuccuuggauucuuucucuagcuccuccauuggggacccugugcucagccuaaugguuggcugagagcauccaccucuguauucuuacuuguucauaugcaaagccuccuaucuccuugcauucuucaaaaccuaaauauguucaguuauuaguucaauauauuccagauuucccuuuaggagaagaaagcguaucauucaugucugagauggcuuuucuucauucuuuucuuuuuuuucuuucguguuauaguuggagagaccaagaguggaaacacuugauaguaagcagcgucugaauuccuucugguaaaguccugguaccaguuuuaccacgucugguuuuuguaaaggauuacuauucaggccuucgugaaagaaaguguuguacuuuguuuuaacaugggguucuauuaagugaguuaugcauggcuuuggaucuucucuugucaaggaacuaguuagagccucuugaaugaguucuuagguagggagagguuuuagucugcacauguuucaauauguucaauaugagcaaaccagccaggcgugguggcgcacgccuuuaaucccagcacuggggaggcagaggcaggcggauuucugaguucgaggccagccugguucacagagugaguuccaggacagccagggcuauacagggaaacccugucucagauaucccccccccccaaaaaaaaagaaguuugccacaacauuugguuuacugaagcucuugaacaagaauugcaaaauuuacaacuaucacuggccaacaagagggacacccaggcagaacccugaggaguccuccaaaaaugacacugggcucccugaagcuuugaaagccuugaagaggcucacacccucuucuggguaccaaagcagagauggcaugucacaggauuucugacucccuaguacaagcuccuuuuguugggggagcagguguuggauuuuuauaucuauugaucguacacuaauaauaaagccugcuauucauaaaauaaaauuuaaaaaaaggaccaaacauacauagaaaaagauaaaaggcuaaaaggauugagaauuucagacgaaguuauuuuggacuuaguagaagacuauuucucaugaauacacagugaucagucauaccuuauaagcuuucuauaaaaacuucacccaauuuaauuagguugaauccaacagucuuugcagcaagcaaugguauaguaacaggcucaaugauuuagcugcgauaacuuaauaauuccuuacauagcuagucacagaacaugugauuuuaaaauuguugguacaauuaucacaugcauauaaauuaauuccaaguuuaauuuccacuggcgaauuuccccuaauagagcuauacauuuuuguuuuguauuuuuagaagcaggcuauauagacaaguaacccacuauaagcagaaacuccgaaucuuggaaagcccugucccuaaggagcuguuacuaugauagaugugaguuacuauauguggcuaguuuuaauauuaauagaaauaaacgauauuucauaacauuuaugucagauuaagccaacuucauaaacuacauauaggaauuugacagcuaugaauaauacuaaguugcuucauaauuucauacccuugcaacuccccaagccuuacacacugaauaugacaugaucugcuguuaaaccugccaguaaaguauccacugcauccguuacuucucgcaacauugcuccaguuucaaacagacccuggauuuuggcaaaauaaauauaaagaacuucucuaacuauaccauuucuaaacaaucuacugucacaaaaguuacuuuaacuucucucaaauaggaucuuaaauuuucagcacuguuuuaacuuuagaauaaacugugguucuucaugucuaacacucagcaguuccaauauaugaugccaacaaugacacugucauauuuccuugucauagagaucaaugugccuaacugucuucaauacaagucacugagcauaucaauaauaguaucugcagucagaagaaaacaaaugaaaggacuagaaagcaauugagaaagaaacacuguaacuuaagggaaagucuauauucaucuccucugaauugaugcacugcuuccugaaagagagagagagagagagagagagagagagagagagagagagagagagagaaguugcuaagacacaagaaguaagcaaacuuacaaggcucagaaaauuaucauaaggcucauccaaaaaguuacaaaagcaguaaccaaguaaccaaggagaggaacugcuccuacugacccaguuucuaacaacuuacacaagaagccuuaaggaagaagccuucaggggcugcauccccaacgcugggauaaguuggcugguaaguugccuaugagucagccauacuccuguagauaguccaaagaaaaucacuuguucacuauacuggccuuggaugaaaucauuuccuugcucuguccuaguaccaggacuggcaccucauaccuguaauucccucacucacgggguaaaaacugaagccuggggaucacaagauaaagaucaaccucaacuacacagguagugcaaggacagccuggacuauacaagaccaugggccuaaagaaacaaauaaauacucaacuucauaaaaacaaguagaggugcauuucaauaguagcaggauucuaagucuucacuaaauacauucucaggucagaaauacaaaccccauucagaaaauggacaaguucuuauacagucucauuacccucaaauuccuucauguagagcucugucagaaauucuaggaaaaaauaauugauguguuugaauucucaacauuaaccuucuugaagcuuggacagaaaacaaguauugaucuagucuuaccaugaauauucagcagagaucuucuauaguucaauucuuaguauuaucacuggcauuauacauaaaugaccaauuuucauucuaauucucaaagaauuaaguuaaauaugucaaaauaauuuacuaagaucgaacaguuuuagaaucuugagcaguaaaugacacagaauuaguuaggcacuuacaguagauaaauacaaugaacaggcccagguaugggagaugccaaauaucuccauaagcuacugaaaggagggaaggugaagcaguggggagaggcgagaaugcacuugcuuugaaaaauccauacucucuguuaccuacuguaaagucagggaaguuuucaauuuuuaugucauguuauucugugaauauuuugaucuaauaugcacuuacuauauaauauuauguacugacuucugaaacauaagacuuaaaaauaacacuuuaaaacauauuaagucaaaagcagcagagauggagugaucaagggaggacagaagcagagacagcauuaauaaacagaaaagaaagcaaaauuuaaaaagauagauuucaaguaacaaaauuacuaucgugugugucuguguguguguauaaauaaaagaguuuuauagaccuguuaagucucagaagauaaagaugcuggucacacaaacccaaacauacaaucacauacauaugcauucauauauauauauacacacacacacacacacacacacacacacaagcauacuuauuuacaucacauacauauacauaugaacauacaaguaaauauacauacaaacacaaaagcguguacacacacacacauacacaaaaucuuauacacacauauauauacaucccaaaaacacuauauuuuaagaaauuaaaacaaaauuaugcuuugugccugggcguggugguggugcacgccuuuaaucccagugcucgggaggcagaggcagguggguuucugaguucgaugccagccugaucuacaaagugaguuacaggacauccagggcuaaacagagaaacccugucucaaaaaaaccaaaaaaacaaaaacaaaaacaaaaacaaaaaacccacccccccccaaaauauauauauguuuuguaacuauguuuagaaagaauauuuauucuuuuuuuguaaauuuugaauugcuuauuggcuuuugcuaggauauguauuaagcgcuuauuacccauuuauauucaaaacuguauuagauuuuguaaauugggcuggagagauggcucagugguuaagaacacugacugcucuuccagagauccugaguucaauucccagcaaccacaugguggcucacaaccaccugaaaugcuguaauaggauccaaugaugccuucucuugguguaucugaagagagcaaugauguacucauauacauaaaauaaauaaguaaaucuuuaaaaaaaaacauuuuguaaauuacaucaagaugaugggaauuauauauuauaauauuucacuauuuuuguuuucaaacucaugauuccacaguagugugaaucacuacuacauagcaucucuuucuaguccucuggaacuaugguucuccuccuacuucuuuuccuaaucuaacacucucuugggggauauuauuggccuuauuugguuaugcuaaaaagaugauucuaaauuauguaaaaaauauucauguuaucauuuauauuuccuauaauuuuauuuauuaaaugaaaauuucauuugcuacuuaccaaguguuugcaucaucaaauugaacuguuaucuuuugugaacuggcuauaauuuauuuacagaucucucgcaaucuguucaaggcucugauccuuacgagcggagcacuguaugaaaacagcauauacagacacagacaauaaaauaaaaccguguacuggggagggcuuacaagacgacagcgccagagcaugcacuccugccccagcucucauuccccacagcucgggaagcugcugcuucauuuugaagggcuuccgcagagggacuagcuagauaguuaugcccacuuugccccauuucuuuaugauaaagacucagugagacuagauguggcaucaacuuugaagugagaaugauguuuugaguucuuaaauaggaaagugaggagucuggcggggguuaugaaguagguuuaguggucaagugguaaaccugccuuggcuuaaaugcugacauugucuuaaauucugugagguguauuuuccacuuaucuuuguaaauaacugcauuaguuacuuaguuauuaaauaugaacuucacaagcuacaacugcauaacacaaaauauggaauacuuuaagacaaauagaucuggaggcuggugauguaacauaauaguagaccucuaaucuguccaagguaauggguuugagcccaacacagggaagaagagaaacaaggaggaaagaacuguuaaaugaacaaaugcgaggcagucuggauuuucuuuccuuuacauacaguaagaacagauaaacauuaaacuaacauuuuaugacacaauaaaaagucaaugccaaacaucuguaaaaacuaguuacuccugggucuacaauucacaaauucugaguuguaguucauaaugccuauucgguacccacacuaaguucaguauuagcugguaaacccccaggagcaaaacaauggccaagcugccuaaggagauuuuaacuguaccagcuagaaaacgaagcaaauaaaauuaaaagcuagaaauucacuuuaaaaaugauacuugagucuuugaacaaagacugcccgagacugaagacuuugcuggaagaauguuuuaacugacuuaauuuauuuucauuuaaaaaaagacugaaauauaaaauagaaugaauccauacccuggcauuaauucuaggaaauuuucacauuugaaauaaauuccaaauuaauuuuaaauauuacuaccauaucuauucagauuuauucaaaugccuaaggauucaaauguuaaaauaacuuuaaauuaguaaccuaaugauucugaaucuugucagaaaauauuuucagaucuguaguucaauuuucaagauucagacacacacuaugcaauaguuacuuuuaauaagaucaccucaaaauaaaaugucacugacuacugcacccucuccuaagacaacaauguccaucauguccuggcgagucucucacucugcacacugaaauaaguaccguuucuaaagauacagggaagacaugauugucucugaaaacaaucaguauaguuaaaaacuguuucucuuuaagauaaucacaauguuuacaacugccauauuagcaacacaaaagacuuucacaaauguuuucaaacacucaaggccaaauacaagacaaagcuuuauuuaacagcugccagguuuuauuuaaugugaagaucaucaucauccuauauaugacacuucauccuacccaaugaaagaaugaaaucaaaaccuauaaguuagcucuuugauuuagccuagacaugaugcagcaccacuauagauacaaagaaauauucauaggcuccauuuuuccacaaaggaaugcuauaaaauuuaaugcaguuauuugaaauaugcagcaauguuuggcuucaauugauacauugucugucacauauuuucaaaucuuuaccaggguuauaacaacauuauauucuaaauuacucuucuuuuaaagcaaugaagauuacuaaauuaagucaacaaacacuauauucuacagauauuaaagcuuugcgcaugcaauuacuaaaggccuuucaggaaggcucccuaaagacaaggaaauuuguauuuucucuguaacauaaaagagaaaaggcaaauucuuaguggccuuuacgaaagagaggcucucauauauucccaagacuuuaggucuuccuguuaguaucuaagaguagucuacucuacucuaaaugauucugauucauccucguaacccugaauagggccauucucuuuacauacugagcagcagagccgacauggcaaugacaaguaaugaggagcuugucuucuucuaaggcagaaaauaguuuugcugucccugcugacgcagagcagugcagaaugucauucauacauacgugagggaagagggugcugccugccuucaacaucucacugcuucuaaugaauggucuuagaccuggucaucacaauucacauacacauacauuauucugagucagggacaugcaugcacacaaaagcaaaauaaagauuacaccauggaauccccaaaagcacaagacgucagcaagcuaaguaugcuuuucuucaagggcagauaauucugaauauuaaguacauaguacauaaaaagagugaguauauaguuauaaauaaucugaaagcacauuauuagcuugguuacaguugacugaauguuagauuuguaagagcaagaucugaacagcauuucucagaaaauccuuucccauauauuccuacacauaaaugcagcccaguacuuuugccagagcagacucugagcacuuaccagucaaagauggcuuagcuggcagggaaaagccuacaaggaacuaugcauauuuuaugaaaaucauaccuuacauuaagaauaucaugaaaaacuacauaaacaccuuguugaguaggauaacccuguuaaauauaagguucuguugcucgggagcacuauguuuuauuuuacaagcucuguugguugaauaacuaagacugggauugugguauugcugugauaguccugaccaugcuuauauuuggaggaauguggauuuggggacuuuaagaaagcaguggagaacuaaccaauacccccagagcucgugucucuagcugcauauguagcagaagauggccuagucggccaucauugggaagagaggccccuuggucuugcaaacuuuauaugccucaguacaggggaaugccagggccaagaagugggagugggugggaaggggagcagggcgggggaggguauaggggacuuucagaauagcauuugaaauguaaaugaagaaaauaucuaauaaaaaaauugaaaaaaaaacgaaagcaguagaaugcuuuaagaagagcuuagugggucauacucauagaaugaaguauggaacacaguggugcugagggugauuuaaaaugugggggccuggaucaagagguuucagaggagaauuuuagcaugaugccuagagauuguucuucugauauuuuggugaagaauguggcuaauuuuugccuuugucuaaagucuucugccuuaggcuaaaauaaagagauuuagagaucuagaaacaacuuagcauuaacugcccugugguucauucuuauggagcaaauugaaaaaggaaaacuacaaaauguaugaucaaaggaguacaaggaaguggaauggggccucuguuucagaauaauaaacaaaguuaagggaaugcuggacacagggaaagauaccacucaccuaaccuuacuauuuauaucauugcaguuaaacaaguuaggcauuguuaugaccugguuauugcucucauuugaacauaagaaaauacuauugugugucaaaucgacaagggauggauugugaugguuauucucaguugucaaccugcaugaaauguauggaaugaacuguaauuuggaaauauagggcacaccugugauucagaucuuauggcauaggggauuaaaggauuuaaagaacaacuuauguccauguguaguacaugccuuuauucccaggagacaugggcaagcaguucaaggccaggcugauauugaguaaguuccaaguaaagaaaagcuuauguccaggcaugguaguacaugccuuuaaucccagcauucagaagacgaaugcagaucucugaguucaaggucagucuauagaccaagauccaagauaaccaaguuuagguaguaaaauaaaucaucaaaaacaggaaaccugugaagaacaagagggccaaguucccacuccagcaagcugcagaacuuagaaccuucaaccaaagccagacauuaagaaugaaguuuucuucacuacauaccuacaggucacuaauaauuucaguggaaaccaauaaaauaucaucagaaaucacuacaacagcagaaggggcaagaaggaguauuggacccaggcaguacccucuacucucaccucuggucuccagaccggcaacaacauaaaucaagcacagucucaguaaauguagcuuuucucucuuucaacaagccauauauaguagugacagauuucucuaccaagcaaacuugauagcuuauaaucaagaaucuccaaagaaaaugguuaggugcuuuucauuaaaaauagccuuuuguaagaauuccuuucucagacaucaaauuagaaauuuggaauaaugugagguuacauguuuuagaguguaugaaugaaugauuuauauaaauguuauauauuauaaagaagauucagaacacucauguuauguacacucauccauuauuguucuauguccagagacuuuuaucacacacuuacauuauacucaagccauaaggaggagccaaguccuuguauagcuauaaggaagcagcagucuguuuaaaaaguaacaaaaagcuuuacucaaaagcaccuacaagucaugaguucuaccauuuagaaaaaauucaaaggaacaaauaauaagacuaacaaagcuaaaagccuguugacuucaauccauaacuaacacauacauuguaucaguaaugaacaaaacagguaaacuugugccuaaaacacaauuucaaauggcuaaaagcuauauauaauauuaaaaauuagugaggugaucuaccuuagauauaucaaaaauauagagacaaaaaacaaagucuaaaagaaacucacaucacauuuuaguacaagaaaaauaauugacuaagaauagaaaucauaauacuaaggugauaaacuaaugaaacuuuaaaaacugucuauuaaaaggguaaguuccuguuuuuaagcagacaccaguuacuuaggcaaaguagauuuucaguuauuacucaucauuugcuaauuuguacucauuugugggcaaaugauuagguuagcaucuacgaugcagucauccaaaucucuaaaaccuguguacuaccuuauaugaaaaaaauguaugcugacaggagccugauauagcuauccccaagagacucuuccagugccugacaauugcagaaguagaugcucacagccaaacacuggacugagcaugggguccccaauggaagaguuagagaaaggacuaaaggagcugaagggguuugcaacuccauaaggaagaacaacaauaucaaccaaccagacuccccagagcucccugggacuaaaccaccaaccgaggaguauacaugaagggacccauggcuccagccuauguaacagaagacaaccuuuucaggcaucaacaggagaagacucuccugguccugugaaggcucaauaccccaguguaagggaauguaagggcagagagguaggagugaaugggugcgggguggggaacacccucauagaagcaaggggaggggggauggaauaggaagggguuuuuuuuuggggggggggggaaccaggaaaggggggauaacauuugaaacguaaauaaagaaaauauccaauuuuuuaaaaaaugaaaaagacaaacaagcaaacaagcaaaaaaaaaaaauauauauauauauauauuugaacauuguuuguccugaauuaacuauauacuggauggagccugucaauuagcuaggaaaagacccuacucuuacaacucuacagaaguaaauuuagcgagcagugguucauucauauuugaaugcuugguccccacuugguacaaucauuuaagaaugacuaagagguaugucacuggcuuugagguuuuaaagcccaccucuauaccaccuacaagcuuuugcuaccacucaaagcaaaugcucaaagcaaagccaugucaccuggccuauaggaagaguagagugaggggaaauaccuauauaggauauguggaacauuuuaaauuagcuagccuaauauauauguaucaauagucaugugcccaacaaacuaaacaaaaaaaaguguucaaaaccaaauaaagaaguaauauaaugagugauuucacgugcauaugauuucucccaccacagcaaaucuuuaaagaggacuuucuaauuuuguugaaaaauaaguuacuuuccugaauauacauaucauaccuagcaagaauagaaaaauugggcuuagauccacuucuguaacaccucaggcagcuaagguucuaagguauaccaacauccacaauucuucacugguggcuguccacuccuacuauaaaaauauagaaaaaugaucucauugccaaugacuauaaacaagaaaugucuuauuuuggugaauuccacccaauaguuuugaagccuguaauaaacaagcacuaggccauuuuucugauuauccaaauaucuaaaauagcuuacuuauucugccaaauuuaaagaugcaaaaaacaacaucacaguacaacugcauguuuauggcaagauuucaacacagaagaaagcauuucauuucaaugcaagcacuaaacagauauuucuagacagauaacaaauaccuaaauuaagucaggauaagauaaaccaucuaaacagucccauuaccccuaaagaaauagaagcagucaucaaaagucucccaaccaaaaaaagcccaggaccagauggauuuagugaagaauucuaucagaccuucaaagaagaccuaauuccaauacuccucaaacuauuccacaaaauagaaacagaaggaacacuacccaaaacugugaagccacaauuagacugcauauucucccuuggagauggaacaguuucugucuaaucaggaaucugucacaauuuccuuucauaaagaacuuaauaugagauuuuuuucuacuucuaucauguuuaauguuccaaacagauucuaaaaacugauugaguauauacauauuauuuuuagcaucagaagauaucauguauauuuaagaggcauuuaacuauuauagauuauuuugaugacuuaaaaaaugucaauacuggggcuggagagauggcucagcaguuaagagcacugacuacucuuccagagguccugaguucaauucccagcaaccacaugguggcucagaaccaucugaugagaucugaugcccucuucaggugugucugaagacagcgacaguguacucaaauacaugaaauaaauaaauaaaucauuuuuuaaaaaugucaauacugaguuguauauuuuaaaauaaauuguauuaauuaaaaaaauggcugaccucaaugcaagcauugauguuacaggccaacaaauacaugcugaauguccuauuucucauuagacaaagaaugaugcuguuuaguaggagcuaguucaguuuuaugccuucguaagcagccccucagaaauaggcacuaaucauuuucuucacuugugguguagucgugcaaacuugucugugcuugacuguauaaccgcaaacauucucaacaauucuaauuaccauguagcuaacaaacuagacaagaccauaacagaaauauagaaaaucagaugggaaccauuugagaaaaagacaggauucaguaggagugagaagaagauguaaagagguucugaaggcuaaaugaccaauuuacgaucacacaaguauaugcaggauccugucaaagaaccaaaacaaaccuuuaacaagaauucauucugaguugccaaagaguagaacuuuuuauguauuuuaauguauacaaucuucuauuacaccuguaacuaacuuacgagugauuuucccuacguucaugaaauggucccacauacaaucuuacucagaguaggaugaacagucacguguaccaugacauagcuaggaaaaggcuauaagggucauuuaucauuuuucacccugacuaugucaacuucauauacuuugaaauaguuucauuaagaccaagcccucucccaguuugcuucucccuaaaagccauaggaaagggucauaucaucaauuguuuugaagaugucucuguuuuaaugccucaaggugaaagcaauucaauucaagaaaaacuguugcagaugaaaauacacaguacaugaaauaaaaguguuuuuaaaacuaaaacuauaaacaaaacuuuauauaaguuuaauguuauuguuuauaugaacuaaaacaaauacagaguuuuaaaacuaaaacugcaaacgaaucuuuauaccaaguuuaucauuaagauauaaaauguguuuuagacuguuaccacuaagaaguauaauuuuacauuaaggaagccuuaauuucuuuuuacuauacuuucucaauaaccaacaguucucaauuuaacuaauaacuuccuucuauaaccugcuguuuucuaaacaacugacucaacuuuaaugugaaguccaaaucucauuuuacacacagccaagaaaaaugcugcaggagcugggugugguggcgcacgccuuuaaucccagcacuugggaggcagaggcaggcagauuucugaguucaaggccagccuggucuacaaagugaguuccaggacagucagggcuauacagaaaaacccugccucgaaaaaccaaaaacaaacaaacaaacaaacaaaaaaaaaaaacgcugcaggaaauccaaauggcagcuuugagagugaaaguaagcacggacagaaaaaaaucccagcagaauaaaacguccuauaacaaucucaaaacagacaaauucaguaaugaguggccauucgucguaugaaaaguaaauguagcuaaccuggcaaaagcuaaaguagugagaggcacagugugaauggggaacacgacugccgcacaugcuccuuaggugcauacuaugugugcuucacuugucaggagagacuuaccaacuuagcaaccuugccguagucaauccaucugacuguagcaaaauuuguagacucagcacaauugaaaccaugauuaaaaccagcaugauauccauaaggaaaagugaucauaaacucuccagccuccugggugaucuguggaguuugaggagacagaauguucaauaacuuuccaaauaauuuaauaauuaauauacauuuacauuuucuuuuuuaaaccaaaaaaaaaacugucaaaauaucacaaguguuuucaaauaacagaaguucuagauguuguuucauuucagugguuaauagugccugauaacuugaguucaaucuauggaccacaaugcaaacauauuguguauuuucagcaaucacagaauugaaugugaacaucucaucugcagauacaacacagaaaaaggauucacuauugccaucuguguucugcaagucuuaugaccccaaaccucucccauuugugauacuguauuuaucauuacugcuccuuccauauauucuauauauucuuaaugguaagucuacuaauaaugguaagcauauacuuauggauaaaaaaauuaccauuagaacaaacauaaaauaucuacagugauuuccaguccugaacagcaacuauaguuggcaaaagaaugacuaaauaaacaacgugaaaugagaaccaagagaauaauagugagggacaagauugucaauccuagaaaagacaccaacuauuauuuaguauguuaacaaauaagaaagcgaagaauuucaccauccaguucucacugcccaaagauuccucucaaacauuugaaacaaagcccaaguaauguuguguuugaaguuacugacgaaagggaaauaauucucuugauauuccaguucuaaaauuuugggaaguaaaugaaucacguagagauuuguauucaaauauuuugcagucaaaguauauaaauauagaaguauagacugcaaucaaacggccaucucggccuuguuaguuguugauuaugaaauguccugcaacuacauuacuggcccaauuuaaagaaagccacauuaucacaucaagcugaaugaaaaauccuauuuugaacaaagcuuugccccuaaaagaagauaacacugggaccuuuguuaugcuggguuguaguuccuucuuauuucaaagaagcaaguucuccuccuacccagccugugggaccccuccuugagauacuucauguaccuucccuuucccaugccacaaggcccacccagcucucugaggcuccccacaaacacaacuuaggcccacuccuucucacuucaaagguucuucgugaacgucacaucauuccuuccuaucucauaggauuaaaagaacucucauguucauggauugcuaaauuuaucaaaaguaaccucuagauucaaugcaacuccuaucaaaauuucaugcaauucuucacauaaauugaagaaaagaaucacaaaauucauacagagucacgaaagaccuaggauaaccaaaauaacauuaaacaauaaaagcacugcuagaaguuuuaccaucauugaauucaaacuauacuauagaguuaugguaauaaaaacaguacaauaagccgggcgugguggcgcacgccuuuaaucccagcacuggggaggcagaggcaggcggauuucugaguucaaggccagccugcuacaaagugaguagcaggacagccagggcuauacagagaaacccugucucgaaaaaccaaaaagcaguacaacaauggcauaaacacauugaucaauggaauaaaauugagagccagauaugagcccacauuacuacagcuauuaacaaagaggucagaagcaaauuggagaaaagacagcaucuucaacagauaguaccagucaaacuugauauauacacuuagaagaaugaaauuauauauuaauuucgaccauacacaaaaacagccauacauggaaaaacuucaaaauaagacuagacaccaugauuuaauagaaaauguacuuuaauuuauagggacaugaaagagcuuucugagucaggcagugguggcugacgccuuuaaucccagcaauuaggaggcagaggcagacagaccucugaauucaagaccagccuggucuacagagugaauuccaggacagccaaggcuacacagagaaacacugucucgaaaauacacacacacacacacacacacacacacacacacacacacacaaaacaacaacaacaaaaacccuuuuugaacaauacccaguagcacaggcauucagacuaacugaaacuaucaaaugggaccuaguaaaacuaaaaaaaacuucuauaaaguaaaggacaugauaauucauguaaucuguagaaaggggggggugguauuaaacaaugauauaucuggaagaaaguaguuaucuaaaagauagaaaaacuugaaaaaccaagaaagcaaacagaacaaaaaacaaaaacuggcacgugaaaguaaacagaguucucaaaaaaaaaaaaaaguaaaaaugacugugaaauauuuuauuuuuuaaaagucuaacauccuuacccaucaaagaaaugaaaacugaaacuaguuugaaacucaucuuaccuccauuaaugacaacaaaucugccaugcugugaggaaagaaauaucuuuaugcacuuuggaaaaaguauaagcugguagaagcgaauaugaaaaucaguaaggaaguaacucaaaaagcuagaaauagauauaugacacaacccaguuacagcauaucugguauauccucaauggaaucuauagcuuacuacagaaauauuuguuccucccuguuccuugcugugguauucauaaugccuagggaaaaaaagcagccuagauacccaccaaccuaaaaauguguauagaaaaugugcuauaaauaaaaugcuacucuuucagaggaccugagucaaguucuuagcaccaugcugcgggacccacaaccaccuguuaacucuauguggggaaucugauggccucuucuggcuuccagggacaccaucacugacuuguacugacuugacugagucagcucagaguauccauaccauauccccuccccgcaaagcuugagaaucauuauggaagagaggacagaaagagccagagauagcagauaucucgagaaaaaccuaucugccauucaugacaauaccauuucauacaugagcucagagcagcuguaauuauauauacaaaaacuguacaagaucauucaagccaccaaaucaguauggauggaaaaggagaucaugaaguucuaccauaagagcuacuggcaacugaugucugcuguuuuguuuuguuuuuaguuuuuugguuuuuuauuuuaacugugggcccccaagaauguauucauccucugauacaugguucuacagccaugcacauguaaguauuacuaaauagacacugugaguuuagaaagaaagaaagaaaggaaggaaggaaggaaggaaggaaggaaggaaggaaggaaggaagagagagagagagagaaagagagagagagagagaggaaugaaggaaggaaggaagaaggaaggaagggcauuauucuguuuggagaaaaaagugaccaugggguagggaaaaaucuggaugggaagaauagugggugcauauuauauuuauguaugaaauacuccaacaaaaauuaaacauauauaaaccugaguaaaacauuuuaaaauauuuaauuacgauuuaaauuaauuauugauguuauaggaguuuaaauuucucuucacccgucauaaguauuauuuaauaauccaagaccacguuuugccauuuugaacuuuucuuaaauacaaauccuaugauaugagcaauggacuuguaaagucggagagccgcuaaccuugucgaagggaaugccauacuucuucagcacugagggggaaaugagggucaucuugugccggagaaaugcaucacagccuugggagcuacuggggaagaagccuaaggagcagcagaaaugcagucagcuaaaacaacauuucauaugguuggaaaacacacuucaauucuaauguccuuagaacaaugacuaaaaaucagcccaaguacuaauccuuaaaagguaauauauauaugucaaaaagguugaucuuuucaaaacuauuuacccagaauuacauuuguacauacaaaaucacuuaauuuuaagaauuucaauuuggcacguaauugaaauacaguugccaaauauacagcaaguaacuguucaaacuuccuguucaagucgaaagugagauuaagaacacccguacuagccaaucccucaguggagacucugagaacuaacuauucugaaagcaccaguuccaaaagccugagacacuauaugcaccaaacacuuucuuaucuuccugcguauuucacacuaacaacgacuaacuuacaauauccuacaauaacuauguuuggcaacaauuaacuaaauuauuucaaagucacagacagaauuuuaugguuuuuuuuuuuuuuagauuuuacuuauuuuauguauaugaguacacuguagcugucuucagacacaggagaagagagcaucaacucccauuacaguugguugugaaccaccuugugguugcugggaauugaacucaggaccuuaggaagaagagucagugcucuuauccacugagccauuucuccagccccaacacagacaggauuuuaauaugucuaacaugaaaaaagugauguagcucuuaaaugauagauuuccccuuccaagcaugguauaagcauuugaaaauaucauacuauaccauaaaaacauucauaauuacuacauaucaauuugaaauaauacuucagaggcugcagagagggauaaacuguuaagugcacuugcuguucuugcagaggaccaagguuuguuucccagccccaacacgguggcucacaaccaccuagaacucauguuccaaaggaucugaugccaucuucugaccuccacagcaccaagaauacacauggugcacauucauacauauaugcaagcaaacauucauacacauaaauaaaauaaucuaaauuuaaaaaaaaaaucccaucugaguaaaccuagcacacaugauuggaaacuugccuuacaagccuauuuugggagcuuuuaagagaggacgcuaaacauuaaggaaaucuuugauuccucaauguauuaaauguucacucagcaguguauugugcuuuaguucauggucgauuuucuccaucacugcuuucaaucuagcugaggcauguuaucaucaccuuggugauacagggagaggaaaaugaaaacuggcauauuugauguuuuauucagcccuuucuccuucaaaggaugagaaaucucagagaguggaaaacaagucacaaugaaaaggacaaagagaagauagaggaacaugaaagaggaaacaagaagacuccaggaaugauggaguguggacuccaggaaugugguagaaguagagguacuaugugaccucauaucuaaaaugaagagaaggcuugccuagugcucuacacacaacucggaguaggguaccuuaaugaaaaacucauuagaacucaauuaauuagaaaaaaaaaguauguuugaguuagauugauuucagauauccuuauccacacaaggccucuggacagcaagguagauauaaaugauuaaucacgaaucaucauaaugguguagaauaaauucacagaaacuuuuagauaauugaaaugguuguuuaugcuacagugcucaggagagagagagagagagagagagagagagagagagaagugcacgagcacacaauagcuaguaugcagacaaaggaauuuaaggaacagcuugguagaaaaaaguauuguacucuaaaugguuggcucagcaguuaaaagccuaguguucuuucaagacgugagcccaguucuuagcaccauccuaggaggcccacagccaccuguaacuuuagcuacuaggacucugauggucuuuuccaguuuccagagguaccuucacugacucauacaugucauagacagacagacacaugauucauuuuuaaaaaauaaaguuuuuuucuuaaguacauucuggguaagcaucuucaccuguuuaaaaauagaaaagggacagagggggaguuugcaaaaucaguucucuauggagacauuaggaauacuaccacucuuuacaagacuaacacaaauaaaaauguaacuuugcccuguggggucauuuucauagcaaucuaaggaugauuaauaaucauaaaauauaaacacuaaaugaaacuuuaauggauaggaagugaaaguuguacgguauaaagauuaaauguguacaauuaaaugcccuaagccuucucaaaggagacaggaaggcacccagcugcagcuaccuggucaucaaauucagaacccagccaacaauguuaauaacaaaaucugaauacaucugggaagcuuuccaaaucuguaacuuugugcagcacuauauuuugaacuaaauuuuauguuaaaauuacugaagaaaaaaguguccauuaauuugcaucugagguggauuuguaaucaggacaugaacaauaggaaaacauaauuuaacuuaaauuagaaaacuacuaaaggaugguaaaguucuauaccuauauacaccuacauacacacacaaauuuuaaaaaaugaaaaagcaacugaaaggcaaauucaaauuccugguuuuguuaaauacaagccugauaucuuucagauaaaauauucauaaguaucaaauacaggccuuagaguucugagauaaaauauucauaaaugccacaaucaagcaagauuucauuggaaaucaaaagcgaaugcaccugugcauaaaagguggcugcaaugguuacacuguaaaggcaagauaagggaaaauaucucaaccuguuuuucauuucauguuuccuacacugcuuugauguagauacaguguacagucuaucauauguacugcacuauuuuaucauuguaauuaucuggcugguaucugcacaacagauacaaaucuuucacugucuuauaggacuuuuucguuuguuuccuuucucaaaauacuguaagcaguuuuaccucucuguugauuaaaaccuugguccuccuuuaccucccugggaugucaucuaucauaguucacaggauaaacuucaguguuugagccugcgccacaaagcugaccuuacuuccucuuaacguucuuuagugaugagguuaauuuaaauguuguaggacuuauuacagaaaagaauagcuaguuuuaacacauuuaguuuuaacacagaguacacuaccuucacauucugaauauauaauaaucauaacauucuacucuaaucuauuacccuaaacaguauucaauuacuucaguauucuugaaaauaauccuuaaauucacacucacaauugaacuacucuuauuacuguaauauaauaaacacuguccugccaaaauuauagcacugugucuuauaaaggugauccuaugaccacuuuuaauaauuuccuauaauugggggaaggggaaaaaucguagaugccauuaauaauuucuggucaaacuuucaggccaaugagguuuaucaaugcccucauuucauuuuauuuauuuauuuauuuuauuuauaugaguacacuguugcugucuucagacacaccaaaagcgggcauaggaucccauuacagauaguggugagccaccaugugguugaugagaacuaaacucaggaccuuugaaagcgcagucacugcucuuaaucgcugagaaaucucuccaaaccuaaugauuuauuuguuaauguacuguauguguguguguguguguguguguguguguguguguguguguguguguguguacacauguauauacacacacacaucccccaccccucucuuucagguucaucugcaugcuaaaagaaaguaucagaccacaugggacuaggauuauagaaguugugugaucuaccauguggguacagggaauugaacuuaggaacucuggaagaauagccagugcucuuaaucagccagcccucacacuucauuuuuuaagugaauauauaugguacauagaaggaaaacuuucuucaucauuuuaauaaaccauaacauaacauauaccaaugcaugagcagaaguguucuacucauucaauagugaguucugauaaagcaagaugcuugcuaccaguuaucacucaaauucaacucuaauuguuauuacaaauaguuccuguccagcugacaucuuuagaggaaggguggccagcaaacaagauaaauuucagcaguguuuaagaaagaaaagaaaguuaagaauagguacaauauauugaaaugccaacugcccagugaaauauuaagagucagcuaaacucauuaugaagacuauacaacagaagaaacauuaccuacuaaugugaaaauaaauaauauuguucaauuagguuaacauuuaaaagcuagcaguuugaagaagauauaaauaaauaaauaaauaaauaagcaagcugcugaacuaccucaaaacacaaagccuacgauguaagaaauugaaagcaaguauuaccuugggcuagucuuucaagucgcuuuccaugcuccggagguauagcauaccuaaaauguuaagaauaaaaaaaaaaaauuauguuuauaauauuuuagcuagcuuaugaagaguauuuaaauaucuucauuuacaaaaacugaacugcacuuaaaugaacuaggaaacaagaauauuaaaagccugucccuggcuggagagauggcucagugguuaagagcacugacugcucuuccaaagguccugaguucaaaucccagcaaccacauggcacaugguggcucauaaccaucuguaaugggaucugaugcccucuucuggugugucugacagcuacaguguacucauauaaaauaaaaaaaaaaaaaaaaaaaaacuuaaaaaaaaaaaaaaagccugucccuuagacauagaaaugaagaaaaaugagcauaaacuuccuacuuaaaugucacaaaucaccuauaauuuaaagcuuacagaacagauguucaagacuacugaacccuuccuugucuaagccuggagacuacccacuaaccacaacauuccuauguaguguagcuauuucuggacauagguauucuuauuuguuuagaagcuggugaguuuggguauuauuucguagaaaauauugguuacuaucuauuuguacaucuuuaucauauguauuguggaugcauauguauauaugugcaugcauguauguguauguguauguguauggcaugcauguguauuaugaaggucacaggauacaguaaggguugauucucuccuucuacugaguuaguuucuggggaucaagcuuagcuuuucagacuuaguggcaagcaucuauccagucagccaucucaugaaccuaguuguugucucuuaaauguagcuugcuucuauuuauuuauuuuguggguauaugacuuuuaaaauccugauuauagauuuguuugcccuaaagaaaagaaauauucauuuaaaguuccaagugcagugacucucagccuuccuaacacugugacucuaauaguucuucauugcuguggugaccgguccccccgacgauaaaaucaugugcagugcuacuucacaacuguaauuuugcuacuguuacgaauuguaauguaaguauugcucaagauagagguuuaccaaaugugucacaacaaacaaguugagaaacacuauaguagugcuuucaaacaugaaguaaaugaauuauuugcugaauuuugaacugaaaauuuuaguacaaaacuaaaucuuaaagguccuucaauaaaaacuuuagauauugucuuaguuggguuuuuuuuuuuuuauuacuaugacaaaacauuaugaccaaaaaagcaaguuggggaaaaaagcauuuauucagcuuacauuuucucguugcuguucaucaccaaagaagucuggauaggaacauaaacacugcaggaaccuggagacaggagcuuaugcagaggccacagggacaugcugcuuacuggcuugcuucccuucccccucacccccaccccccacuuucucagcuugcuugcuugcuuuuccuucucuuuuuuuuuuuuuuuuuuuuuuuuuuuuuuuuuuuuggguuuuuggguuuuugacacaggguuucucuguguagcccuggcuguccuggaacucacucuguagaccaggcuggccucaaacucagaaauccaccugccucugccucccuagugcugagauuaaaggugugcgccaccacugcccggccucagcuugcuuuaauauagaacucggaacaucacugcaggaauggugcuacccaccuugaucuggacacuccucuauugacuauuaauugagaaaaugccuuagagcuggaggccucuuccuuucuaaugacucuaguuuguaucaaguugacacacaaaaaccaaacaguacauauauuacaagcauaucuaauaaucauugaaugaguuaggugagaugauauacugcuuuuaaacaugaagacuuccugcuuacuagcacaguauauuauaaauacaaauuccuuuuugcugauacaauuuucuaagcauaccuaguagcacauuugguuguauuuaauagcaucuguacucaaaauguauuugauuuugauguaacuaagcaauucucugaaugaaaguucaaccauauguucugucccuuaaaauacugcuauuuaaauucuaccaacugaauuggggagagauaaaauuuuagcauaaggaaaugaaaauaaucaacguuuaagguaaguucuugucguauuuuucuuauugguuuauaccaggaauacacucagaaaagaaaaaauuguggguguaucccauucaaggugauucccucuucauaacaucacaaaugugcauacacacagacaaagacacagaaacagacacacacacacacacacaccaucuggcugcacaaaaugagcuggaugugaagagauaguuauauacccauauuacucuaagcaacuggcaagguuaaauucccuccauuuuaaauguaaucaucaguucacagaaaaagcaagugcauucauuuguuaagaaaauagaaaguuaacauuguucuaucccacaucugauccucaauuuacuucuaguauauaaaucacucucauuagauauucuucugccacauuaccugugugaccuuacuagcccaaacuucuaaauaaugcaguauaguggacagauuaucuauuuaauugggucugcuuuucuuuuuauguuuagaauaauguuuuggucuauuucugaacuuuccagaaaacccaauucauauaauuacaaaucgacucaaauaaauguccuaugguuaauccaacauauucaauauucucugaaaucauuaaaggguaaaaaauuccuuaacacuauugcccagaaagaaaaaugaaauaguucccaguaaagcuaauucuucauauugauagcaauucuaugauaacagucagcaaaguacaagguaaaaaugaauucugaaagacaauuucauuguccugcuguaaagacuacuggcaagaucugugcuuacaugaacaaaaugugucucccuaaugagggaagcacacucauuagauauuacagguacaauuccuuuaaagguagcaaugauuagauacuaaauaguacauuuucauuuuaauccaauaucuuuguuuuaaauuuuucuuauuuucaaggucaagaaaacacaauccuuuguaaguauaucucugagugauuuguuccaaaaaauauguauauaugaaaauuuuagucaauacuuuaaggauuuuccccauuuucaacgauguuugcugaguuuguuguauacugccuuuauguugagagauguucccuacaucccuguuuucucagaacuuuuaucauagagauaauguauucugaggacuuuucugcauuuagcaagaugaucauguaguuucuaucauuuaaucuauuuauguuguaaauuacaauuacuauuuuacauauguugaaccaacccuaaaucucuaggaugaagguaacuuuaucacaguaguauuuuuugauguguucaugaauucaguuuguaaguauuuuauugacaaguuuuacaucugugcucaucaacgaaaauggcccacaguuuuauucuuauuuuuuauuagauauuugugagguuuugauaggauaauggcuuugggaaaaaauuggaaauguuacuucuuuuacuauuuacuguaauaguuucaaaaauauuaaugguuaaugguccuuuaauggauaggaagaauucuauacuugaguucauuuuuuuuccuuuuccacuuauuagcuuacuuuggaucauaauacuugucacuaccucacauuacagaacauucuaucuuuugagauuuuauuguuuuauucuucucucauacaaaacauccuugccacagugucccucacucugucugcugccuccuauuccucucagugccacuccaucacaaccucuuccccagacccacuguuccuccauuuccacucagaaaagcgcagaugccccagcgauaacaacauugguauaucauuuaccaagaaauuuauccauuucuucuuccuuaggacugucugaguuuccaugguaucugcuauaauguuuccucuuuaacuuauaauuuuauuuaacuagauugaauuucuucaguuaauuugaauaaaagauugucaaucuucaucuuaucaaagaaccaacucaaaaauuacauuuuuguuuugcuacuguuuguuucuauuucauuacuuaauugugauuagcacuucucaucuacuuuuaggagguguuaugauucuuguucuucccuggccuuuuggugcauguuaaguuauuaauuugagaccuuugacuauucuuaauauagggacauaguuuuacaaaauuucaucuggugacuguuuucauuuguauuuccuucagagauuuugaaauguuauguuuucauuuucagucaauacuaggaauuuaacaccauuugcacgcaccccaggcacaguacuuccaguguuagcuaacacacuaggucaagugaaggagguagagaagauacaaaugagaaagaaagaaauccaaguauccuuauaugcagaugacaugagucugcacauagugugaaagaugaaagagacuguaagagugagaagaaaccaguguugucugcacauugcaggauagcuacacauacaaauucgcagugcuucuaacagccccaaaucaaaccccuccguggaaaggggaguugggcugagaagcuauuggcaacucugagcugcugggaaagaaaagauuaauuuucuaugauaacuccauguuucaguaaaugaccacucauccaaaaauagcucagcagcacaaauugaccuggagggaguaggguaggggacuccaaguuggggaaugaauggaaggaauauaucugguaagaucuagggaaggaagagugcauauagucaaaacacacuguacaaaacaaaacgcuaaaaaacuaauguuuauuaaaaaaaaaaaagcuagacucacugagaguacugguggugcacaucuuuuaucccaacaccugggagacagaggcaggcagaucugugugagaucaaugccagccuggucuacauagagacuuucugggcugucaauguagaaaucugucucaaaaaacaaaacaaaacaaaacaaaacaaaacaaaacaaaacaaaaaaacaagggacuuaaaaucuuaucaaccaaauaagcuggaaaacagaaacaaaauuuacaguuuuaacugaacgguauuagacugccauugcaaguucuuggcagaaaaagcuaaauuuuccaaaacauacuauauaacuccacccgcugcuggcuccaauuuucugugaaguguccuucuuaugcguccuuaaaagcuaccuucagaccacuugcuuguuaacuaguccugcucauucaauggcuucuuugcuucagguuaguccuucgguaucuccuuaguguuguuaauuguccuagaacucucaauaauuuacuuagaaacacucuuucccuauccagaacucugucacugcuaccacuggcagucaccacugcucucucauacucauaagcacugcugguauuucuaucagggacagcuucuacccacauguagugucaaaggccacaaagaaccccuuccagguuaauaaagaccuaaaacaggaagaggugcugugaugguuuguauauccuuggaccagggaguggcaccaucugaagguguggccuuguuggaauaggugugaccugguuggaaugggugugucacuguggguguggguauaagauccucacccuaguugccuggaagucagucuuccacuagcagccuuuggaugaagacauagaacucccagcuccuccugcgccaugccugccuggauacuuacugccuuggugauaauggacugaaccucugaaucuguaagccagccccaauuaaauguuuuuuuuuaauaaaacuugccuuggucauggugucuguucacagcaauaaaacccuaacuaauacaggugcccucucuucuucucccuagcuccuuuauuuauaguucugcuaagugauauuuuacucauagucauagccuauaaaucaaaccaaagauuuuauggucaauuuguaguaguucauccuaccaugacguucuccacuuuuacaaccacaaacuuguauguaugacuuaugcucuacaguucagaaacggcugaaaggcacaagagucgaccaauuaaauaggauugcagucuaccacagcuaacauuuauucaguauuuacaacacaacagcaugugcugacacaguaauauguuuucuauugucugcauguuauaaaugagaaaguccaggcacagggucaucacuucagaugaaacacaaaggaugaaauagcugguucccuacacaaaucugucugagagccauucccagcuucauguuccacuacuauaucccaaggaucacugugaaggagacaauaggaaagaugugaccagguuaaggaaccuguaacucuuucaaggacacauucaccuuuaaauuaaucaaagaacaacaaagaaagccaucaaucuacuuccuaaagggagcauuaauuugaaagaauugguguuucuuauuucucaucacaaaaacaugagucaaaaaguaaaauacuuaauacuacuuuuuauaagauuuaaguauauuucauuuauaauauaauaauuauagcauaucccuaauaaauuauaucaaaagcaaaacugaacaacuauacauuccauagaugugauuguuauaguuucaaauuuauuuuuauuauaugaguagucuauaguuaucugaagacacaccagaggagggcaccaggccccacuauagauaauugugagccaccaugugguuucugggaauugaauucaggaccucuggaagagcagucaguacucuuaaccacugagccaucuuuccaacccccaaacgauguucucuuacaagcuccucacuucacaucacugagauccaagcucacauuccgucuaaaauaauauaauacagucccugaggaaggaugagccccaugugcaaugugugggacaacuugaguauaaaggccagaucccauugucucauccuaagccauucugaagaauuuuggcagcuucacaucugucuauagaaucuucccaggacuccaacacugcuuaaugcuuaugacuagugcaaccuuccuuucuucucagagguaucacuccugggagacuacccugaaacuauagggcacacaaaacucaaaacaaucuuuccuaccaucugagcuguaauaauaacaaugaacauaacaucuuugcaggaaauagcagaccugaaaaugaaauggcuagacaucuauaaauauggcaaggaauaagguacuuaagcugagccugaaaguauaauacaugacaaguccugaggaaaaacccaacauggccucaccaauaucccuauacaaccucugaguuuaaaaaauuccaacaguaagaugcauaagcagacaggcacagugaagaaaauuaaucaccaaaaauauauucuguucaauccaggauucuaaauaagguucaguagccacuucuaugaaaauuuauauccugggcaaucaaacacauaaaaaugcuugugucugaaaucauuaauauaaaagcuagugacauaauaaauacacaaaauuuaucuucaagaaauuagaucucacacuucucagccuuuuuaauacuuucuauauaucuaacaauacuuuuucaugaaagggucauuaugaaguauuaguugacauuuuuuuuuaauuuaaugaaaaccuuuccuuccuaauaucaacuccaaaauacucaacagauaaaauaaacuaaauuuucagguguuagauauccagauaaccuucccacucccuaaugcaggcuuacugucaacaacacuauucauagauaaucagcagcagacacugccacaucugacccaacuuccaaauaugaccagaaaugaauaauucuuuuuuuguuuuguuuuuuuucucucuguagcccuggcuguccuggaccuuacucuguaguccaggcuggccuccaacucagaaaucuuccugcuucugccuccccacaugcuagaauuaaaggcaugugccaccacuacacggcauaaauaguuauucuuaaaaauauauuaaauugcagaggcaggaaagaauaauuauaagauuacaacccaaaacuuccuuacacucacucuauaaaagaaguaaauucucaucaauaaugaacaacaaucaaugauucucaacucuaaugggugugaauauuaaacaagugacuugccaagacuugggcuccccaaaguggagauaauuaauacuguagagauccauguccuccgugugccacgcaaauguuguuuuccacauuccaaaauagagauaagggguauuuacccccucaauagaaauaccacacucuucuucaaccacauccaagacuguauuuaggcgagcuauauuccauucauccacacccuagagacaagacagggagagaaaaagcaaaagcagguguuaggaaauaaaaaauaguacuuacuaaucaaauagcuauuuaucaaauacuacuauacuguguauuuuaucauuuaauaauggaaaauauagaacauauucaaaaguuacauuaaauuauuauuaaaauuauucuaaaauuacuaucaacauauuuuuauauauaauuauaaagguaaaauuauauccaacaacugcaugauucucagugaaauuaagaaauaguaauaauccuaguuuaaugcagauaaucugaaauaugauacugauaauuggcauguauuuacauucaggggcugaaauuuuuaguuuguuucauguuugcccaauaguuucgaggcccuguucaacaugaaacauaaucuuaggaaaucaacagcaaaaaacaccuccuucucccuuggucguguccauuuuacuguagcaugugauccacuguguccuacaaauuucgugcuacuggaaaaaaaaauucaaguuuuccaaaucauagacccugcgcuaagacuaguccucaaaaagcaauaauagcauauauuauagcauauauugauaaaauauacauaacgucagcauuuaacaacucaucuaaacucuggcaaaauuacuggaauagcccauagagcuggugauaaagaaaagaaauaauuagaaugacugucaguaaaacuaagggggaguuuguuguuguuguuuguugguuuucauuaaagguagcuggaaugguaguaaauguguauaauuucaaaacuuuggaaacugcagccaggaggacgaguucaacuaagcuacauagcaaauuuaaggccagccuuagcuacauaauguguugucucauaaagacaaaacaauacuaaaaacauuuuaaaauagggaaauauucugaguuuaagagaauuuaccaaucaguaacuaauuuacuguaauacacaacuauguagaauguuuuagcaaacuauauugucaacccccaauacuuuacucauagucaaagucuaauauccaacauugggcgcauauaugucaguuuacaagacaacuauaaaauccauuucaauccgcacacaguccuuuaacaaagagaauaaaauauucucuaugaccuaaaagggcccccuaauaacuauaguacuaaaacagccuuacaaauggucacucuuaccaauuucucuuuuacacuaaaacccucuaggcuuguucuguuuucauuuuacucuuuaaauaauucuuugcuuaauaagcuaaucccauuuccuagcacuauuguguaagaaaaaauagugaugaaguaguuaaaaaaagaagaagaagaagaaaguauuuaaacauuuuaguucccuaaauaacuguucuaucuacaacugaaggccuaugcugggaacuuuaaaaaugcagauuuaauuuuaggagaccucauaaaaguucaauaaaauuacauagauuuuucucuuguauuuauaguauccuauuucuuaacuuaaguccaacuuaacuucaguccauacacuuuaguaagaaaccuauuugaaaaucuuuacagggggcuggagagauggcugagcggguaagagcacugacugcacuuccaaagauccugaguucaaaucccagcaaccacauaguggcucacaaccaucuguaaugaaaucugacacccucuucuggugcgucugaagucagcuacacuguacuuauguauaauaauaaauaaaucuuuuaaaaaaaucuuuacagauauaacuaaucuaaauuaauaaacgagcaucauaauuaugagaaccauuuuaaucugaaagaccauaggaauaagaaacaaacucuuucacugaaauucuuaggugacaacaagucaccucaggauccuuaguccaacugcacucuacgcacagaaacauuacuucacgauccaucuccagcuccuaauggugcaaugaugcaccaagcaucuuagugcauacccaagaucggcccauucuucugaaagccccauucauucuucccuucuagccgaccuucagcucuuuuuuacugugcugccccacaugaaucucucuaccagggacccacagcugccagacuaggcugaaacucaugugagggaauuagauucuccuucauguucuccaugccagucuagccaaacuuccuuagugcugcugcagccugcuagccugagcaccaccucccaaaccaccuacaccccgcuaggcauacaccaaaagaugcuccacaauaccacaaggacaccuggagcuagaaaaugucauccucaaugagguaacccagacccaaaaggacaugcauaguaaucacuuagauauggauacuaggcuuaaagcacuggacacccaaaaagaguguguaugugaaugaaugaugggaggggggcgggagagaaagagagaaagagaggaagagagagagagagagagagagagagagagagagagagagagagagaaugagcaagcaugggguggugcucaaguucaaucagcaugcaauucaggcuaacugaaagugaugggauuccaauagaaaggcagccuacaaaaagcacaucagcgagcacuauuucuauguccugauugcuggcugcaugggcaguguagaauauucaucauuguauauaaauauuaaaauauauugcccacaaagaguuugugcuuuuaaaaguuuauuuaaaagcagaaaaguaagauuggagagacggcucagcauuuaugagcaguaaaugcucguccccaggaccuggguucaauuccuagcacucacauggugauucacaacaaucuguuaacuccaguuucaggggaauugaaugcccuuucuggucuccauggucaccaggcaccaggcauacauguaguucauggacauauaugugagcaaaacacucauacacgagaaauaaaauaaguuauaaaaaaucauaagacuaucuacugaguuccauuacaugucaaacuuuccaucuaggcaacucacagaacaagaucuuauugaauacaagacagugaaauaguuccuaaaaauaauacaugcauuuuccuaagcaaugacugcuaaucaagcacuucucauggcuuggucaaacuuugacagacagaagaaaaauuauaaacagcuagauguuaggcaggacuucuauuuacaaggacaacuauaaaauaaauuuucuguuaucagauuacacuacagacuaucauuaaagcccauggauuucuacauugcccuucuguacuauuaucacaaguggugaugaauuuugucaagugaauaagacagaacauacaauauuacaauuuuuuaaucaugucaucucauucucuccuaauaaaguggcauguguccucaaaagccauuucaucugaaagcacuguaagaaaggcaucacuugcucaggaucccaaaguucaugccuaaaaagcuagggauuauccaaguaaaguuaaaaucucuaaccaggccgggcaguggccuuugaucccagcacuugggaggcggaggcagaggcaggcggguggaucucugaauuggaggccagccugguuuacagagugaguuccaggauagccagggcuacacagagaaacccugucucaaaagaaaaaaaaacaccucuaaccagggcuggcucuguuucuuaaguaauguggccaagcaaaagccagaaagucaacucugauccauguauaauuuacacuuuuuuuaaaaaguaaaggaaaauucuuuccaauacuuugaaauucaguaauguaauacuuugggucucuggguuuucuugguguuucauuuuguuuuauauuguauuaaaagaauggugcaucaaaauuuagaaauagcuaaauccaaaaagaacauucauggacacacucacaaacaugcagucuacuucuuuuuaaaguaacaauaaaagaaaauaauaaauuauuuaaaaacaauagugaguguccccaagugucaggaccuguccccgagaagcaaaugcuagaaaggaagaacuagcuccugcacccugucuucaacacacccagugccaugcacaugucucacacacacacacacacacacacacacacacacacacacauacaccaaaagaaaaaaugcuauuuuaaaccucaaagaaauaaucgcuauaggguuuugcuguuugauucguugacugguuugauuuuuuugguugcuguuuucaagacagaguaucauuauguguagcacuggcuaucuuuguagcuauguagcuagccuagaacucaccagagaucugccugcuuccuugugugucagcauaccuagcuaacuuuuauacaucuacauauagaccuuguagaucuuuaaaauaacauaugcaucacaggacuuuacuuucuuuuggggaaauuaagaacuagcucaccucuucuugagguacugaagcagaaaguaaucauuuaaaacagauaaauacugucaaauaagccauuaauacaagcaucccauucccauuccugcucacucaacacuggcauuugagaaaacaaaagcaagagaccauuuaaaaagagcuuuugauacaguggugccguugcagccugagaaccucucggaaucagagucucaggacucugagaccaaggguuaugggacuacauaggaaacuuuacagacaauacugcaaaacuacagggggauaggggguggacaaacugagccagaucugaacagcauuuaacaaaucaguaaucgauaaucuggccaaaaccaaaguauacaagagcaacauucacccagauggcaaucaucuugcagaauacugccuaaggcugcauagggauguggagaacauuggcaaugcgaugccuagaaagaaauucagacauuugacuauauaugaaacuccaucuacaaaguaauacacauacaucaggauaugaguaaucugaauucccaaaguuagauccaauaugaacaaucacaaagacaucacagaccacucccagcagauaggaaaaauacaagaauccugagaccacaaaucagucuagucugggguuggggguuuagcucagugguagagugcuugccuauagcaagcgaaaggcccuggguucaguccucaguucugggguggggggcgggggggaccagcuaaugcuccuaacaaaucaggcuagucaguuuccuuaaacuucaacucuucuaggcuuucuuucucucuuucucuagcaccuauuuaauauccgaauauuacuucaucaagccaccucagccuuauucuguucuugcucuguauugcuucuucuuucuucucuuuucuuuuuugauuucuacaucccucccuccuuguucguucauuccuuuuauuucuuuacgcucccaagaaacuagugguggggcuccugaaaaaugcaacugccccauacuaucagucagcauagcuuuacuucucuccagucugcuagucaagcaucucucaucccaugacauuugcugcaaucccuuauccuauuuaugucuuccucuccuguuuggucucuaucaugacaaagcgaaucacuauccuaccaguguuggcuuccuucuuucuauuuucuuuugauuccauucaaacacacaauaacuaauauaguaauagacacagaacuaccaauaucccuuuaguccaaggagcgauuagugcuuaggugaugacuuuguguaauugacuaagacucuauuucauugugaaucuacuguuguugcacagaacggcugggaacagaccauuauggccugaauacaagucuaacaaaagaaaacaauaccaaaaagccacuacgacuuaauuccuaugaagcauuacagaugcuguaauaugggggugggagggucaaaaaaacuaacuucuaagguacaaaucccaauacaaaacagaacacaaaauaccuuaugacuucucuaaagucuacuaauuccaaaauaauguccccugccugauaagagaagaucaguaaagauccuggacaaauaacucaaaagaaugaaaaguauguuuaagaaaugaaggauggggggcuggagagacagcucagugucuaagagcacaaacugcucuuccagagguccugaguucaauucucagcaaccacauggugacucacaaccaucuguaaugggauccaaugccuucuucuggugugucucaagucagcuacaguguacucgcauacauuaaauaagcaaacaaauaagucuuuaaaaaaagaaaaaaagaaaugaaaggugauaugaauaaacuacaagggaaaaaagacaacugaauaaaaaaaggaggucaauacaggauauaagaauggaauucaauaaagacaaauauugaagaaacaccaaaugaaaugaugguaaaaauaaaaauuucaauaaagucaagugaaaauguuuuaggaagagguagaggaauugguacacugaaagaaaauaauaaaauuuuuauaacaugacagaacaggaaacucuuguaggcaucaugcaaacaccuggagaugaggugcaguguagcacauuugccuagcaugugugaaguccuagguccaacccucagaagucugaaguagaaaaauggacaagggcaaaacucaaaggaugaagggcaugacucuaagaaguuaauuuauuccaaaaggauagagcauuuuaagauaauuguaacaaucaauaaauaaauaaauaaauaaauaaauaaaaccucaaaccuaagaaacaagggcucauccacauauaaaagguauuuuaaaaagcaacuggaacaagaaaccaaaacccacaugacauauccauaguuaaaacacuaaauauauugaacaagggauguguauaagagcuacaauagaaaaccaucaaaucacauacaaaggcaggaccaucagaauaacaaauaaccccucaacuaaaauuuaaaagccagaaggucauaugcauugaacauucuagaauaccacaagugccaacccagacuacaauauguagcaauucugucuaucaugacugagggagaaauuaaaauaguucauuauaaaaacuaauguacaucacgccagcucuacagaggauacuauaaggaauucuucauauucaaaagaaugauaaagacaucuaauagcuacaugagggagaaaaguaacauauuugugaaacaaagaagcauuagagaaacagcaaacacuacaaaaacaacaaaauaaaaggaauauaccuuucaauaauucugaguauuaauuagcuuuaaucaaaagauauagaguagcuuuuaaaacuaacaaggaaguaaggaagaagagaagagaagagaagagaagagaagagaagagaagagaagagaagagaagagaagaggggaggggaggggaggggaggggagggggaagggggaaggaaagggaagagaagggaagagaagggaagagaaaagaaagacaggcagacaaacaaacagcauccauccauuuaucacuggagaaccagaaaugacagacaugacccuaacagugagaggauagaaaaggucauucuuagaaugcaaauagauagaacuaaggaauaagcaggugucucuauuuaaaugccugacaaaauuagacuuacacuuaaaacuggcccagaaagauacgagaauuuacuucauauuuauuacagaaacaaucuauugaggacauaauaauccuaaacauaaaauacaacuaaauauaaagauuaauccuaacacaguaauacuucaugguuucacuaucaaaaugcucuaucaauaaacaugccauucuaacaaaaaccagagaaguauuggaauuuuuuuuuaaagaucuguuuauuuauuuuaugaguacacuguagcugucuucaugcauaccagaugaggguaucagaugucauuacagaugguugugagccaccgugugguuguugggaauugaauucagugccucuggaagaucaaucaaugcuccuaaccacugagccaucucuccagcccuaaagucguggaauucaauggcaucacagauccaauguauuuaacaaacaucuaugaaacauggcaaucaaacacuccagaaaaacauccucucaagauccuguggaauuuucuuuaaaauagaucauacaauagaauacaagcaagucucaacaaauaagaaaaaaauuaaaauaauuucuuauauucugaauauaauggaauauagcuagaaaucaauuccaagaaaaaacacagaaaauucacaaagucauggauaguaaacaucacauuacucaguaaugaaauggagccacuaagaaaaucaagaaaacuaaaaacaaacaacaauauaccuagaauuagaugaaagugaagaacauaccaaaauaucucuaaauacgugcaucauucccuagacauuauaaaaauguaaaacaauacuacuuuaagacuucauuuuaggaggcuggagagauggcucagcgguuaagaacacuaacugcucuuccagagguccugaguucaauuuccagcaaccacauaguggcucacaaccaucuguaauaagaucugaugcccucuucuggugugucugagagagcuacaguguacucacauaaauaaauuaaauuaaaauaaauaaauaaauaaauaaauaaauaagacuucauuguagaccauucagaauggcaaugaucaguggaacaacagacaacaaauguuaaagagugaggaagagggaccccauucacuacggguggaauugcaaacugguauugucucuauggaaauuguuauuaaaaaaaauucuccaaaaagcucaaaaucuuacuauauggcccacauauuagcuuacauccaaaggacucaacaucauacugcacagauacuuguucagccauguucaaaggcgaauguuauguuuaauaacaccuaggacgaggaaacagccuaaguguucuauaaauaauaaauagauaaugaaaaugugguuccuauacacuaugggauacuauuuagcagcaaagaaaaacagaaucauaaaaacugcaggcaaauggauagaacuagaaaagaucauauugaggaaggaauccagacccaaaagacaaaugugguauguguucucuuacugaagguuuucagcuccaaaucuucuaaugugaguacauacccuauaguaacuacagaaaccaggaaaguaaaaugggaccacuaucaagauacuguaucugagggacaauagagaaggaaauagcacauuauaagaaaucugguaaggaaaaugggaaaaucgaggguucguuggggaauaagagguagguaaauacaaaagaaggugagacggggcaaaaggggaacggcaugcaugauacaagugacuggauaaggaaaaugggaaagauggaacaucacuuuaagaaaaggggauagagauaaguacagaaggaagaagguagguaaauaacaauaugguugagaaaaaucacaagauaucauacuauuaauuacuuaccuagaaaaaaaaucacuuaaugcauguaauucaauguauaaauauacauaauauagauauauaauauuaaugagcuuuucucuuuugagcugauaauauucccuucaaaggucaaaacuaccugagaaaaaccccaaugccaaacaugagaagccuucuuuuguguuguugaccagggcugucuaagagacucccaaaacauacacacucuuacuuuagcccuugguugccaaauagagauagaagguaaguaccuacugcugaagacaucauacacuucagaaacauggccagaggcccugagcuacaaugaaccugaacauccugaccccucucuaaggacaagcuuucauaguaccagaagaagggaaauuuccaaaggagggaaguagaaacaguccuacccaucucugucaccuaugaacuacaucaauuaccagcauaccagacauaguaguagaacacauacuugguaguaaccaacugcucucucauuauauuuaagacccauucaacaagagagagagaccaugcuugaaacuggaaaccacuacucaguacuaaugaaaaucauggaaacugggguagaaucuacaaucaauaauuuauuaaaucaacauaaucccuaacuauaaucuauaaacauauguguucaugcccacagauaaguguuaccuuuaacagucauuaaggaaacuuaucuuugcaacaaauggaaacaccauacaaaaccacaaccaccaaaaugcagauuugugcagaccagucccaguugguuucgucuacaaaacaguauaacaaauaaggcucagaaaacauugcugaagagggggcagaaggacuauaaaaaucaaaaggucagagucucuauugugaaauccgaagccauaaauucucaccgauaugacugcacaaacaugaaagacacaccacaugcauacuaagcuggagaaggaaaagcaaaaauuccaaugccccacagaaugagaaaaauauuguuaaaauuuguauggcuauauaaaaaagcucagagagccauagccauccugaucaaacagaauaaugccacaguugucaguauaucugaccucagguuauauugcacaacaaaaguaauaaaaacagcagaaauaugcuaucgcaaaaguaggcuacuaaaucaacguaauuaagugauuguaccagacaaaaacccaaacaaguaacagcuauaugauuuuugacaaagacaugaaaacuaaacucaggaguaaagacagcaucuaggguggagcaauggugcaguggaucaaagugauugcuguuuucccagagggugggcucaggcuugguuuccagcacccauaaugaaugguuacaacugccugcaacuccagcugcaggagaucugauccacuucggggcucuucaaccaucugaauucacaugcucauauguacucaccucagacagacagacagacagacagacagacagacaggagagagagagagacaggcagagagagagacagacagagacagagagaauagaauuaaguaaaggaaugacagccucuuuucacaaagggcaucaggaaagcuggauacaaacaugcagaaaucggaaacuacagcuuuucucgauccacaaauaaacaaaaaagcagcuccaaauagaucaaaacccauaacauaagacuugaaccucgggcuggugagauugcucaguggguaagagcacccgacuguucuuccgaagguccagaguucaaaucccagcaaccacaugguggcucacagccaucuguaacaagaucugacucccucuucuggagugucugaagauagcuuacuauauguacuuacauauaauaaauaaauaaaucuuuaaaaaaaaaaaaaaaagacuugaaccucuauaguuccuagagcagugauucucagccugugggucuggaacccuuuaggggucaaacaacccuuucagagggccacauaacaaauaucuacauuaugauucauaacaguagcaaauuuacaguuaugauguagcaacaacaacaaaaauaaaaauaauuuaugguugguggucaccacaacaugaggaauuguauuauagaaucacagcauuaggaagauugagaaccacuguucuagaaaaauaauauuuugaaauacagacauagcugaggacauucugaguaggauucuaguggcuuaggaaauagguuaaaaaaaaucaacaaauaaaaauucaaaggauagauacugcaacagaaaguguuaauagaguaaagaggcuuuccaaaacgaugagaaaguauuuaggagccauauauucuggcauaggauuaacaggagcaugcacacaugagugcacauauauacccacacacaaagauaacaauccaaauaaugggcuauagaacugaaaagcucucaagauaugcaaauguauauauauuuugaaagaguuccaccucuuuagucaucaagaaauuacuuugagguuaacuucaucucacucagaaugguuaucaucaagaaaccaaaugucaacaaauacaggcaaguggaggaagagagaaugcugauuucucuuagugucuguguaaacuguuuuaucaacuauaaaaaucaguguggaguuuacucaaaaagguaucaauaaagaaugacugcaugacccaacuauaccauuccuaggcauaccccccaagauuuugaauucuacugcagagcuacccacacaaacauguguggcaggauagucccuguccaauuacuauuagugcagcaggagacuugugauuagacagggaaaagagaggcggagcuaagugcugcagagagagagagagagagagagacagacagacaggcagacagacagacucaggagagaggagaaggaagcaagauggagggcaacaagcaagaugauucauaauccgcaugguuuuaaauagccauagguagauuuauaucauauagggauagaauaauuaggguagccccaguacaggggaacgccagggccaaaaaaaugggaauggguggauaggggaguggggcggggggagggugugggggacuuuugggauagcauuggaaauguaauugaagaaaauauguaauaauuaaaaaaaaaagaauaauuaggguaacuugucuaaucuaggugggcaucuuguaccaauaucaacugacucugaauuuauugugagggcauccugugaaaugagaauuuauuguuauauaaaucugacugauuaauuauuaacuucuagaguuuuguuucuaccggguuacuggguguuguggcagcugacggcugggagggcgguccuugcauggggcugacaugagaaugaccggccaagggaaacauuucagcagcucccggccagagauugaguggagaccacccagcuaaagcuauguggucugccagugcccggcguagcacaggauacaaauagucuuuuuaauauucccacaucaaacauguucauugauguuuuauucacaauagcuguguggauaagaaaaauauggcucacauauacaauagagauuuucuuaagcuauaaagaaaacuggaauuauaaaauuuucaggaaaauuuauggaauuggaaaauauauuaagugagguaaccuaggcccagaaaggcagaaacuuaaauguuuccucuuauacacagccacuauuuucauuuugauuugucuauuuaaguugaagaagcaagaggcuagcacauggucacugggaguaguagauguuagacuagacauuuagagaugagaaauaguagaaugcaugugauaugaaaguacaaggauagagcgugcaccgguauaagcaggaaauggggggggggggggaggacgacugggaaguaaacggagaggagaauuaacuaaaacuaaggauucaaacacgcuaauuuuuuuaaagauuuauuuauuuuauguaugugaguacacuaucacugucuucagacacaccagaagaggacauugaaacccauuacagaugguugugagccaucaugugguugcugggaacugaacucaggaguucuggaagagcaauccgugcucuuaaccucugagccaucucuccagcccacaaguuaauuuuuucaacuuuauuuuuuauuuuacgugacuucauguuucaucugcagguauuuuugugugaaaguaucagauccccuggaacuagaauugcagacagcugugaucugucauauggguauucacagaacaauccuacugaccacugaaaaauauauuaggauaagcaacuauuccuuucuuuuugaccaauuuuggcuuuguggcauucaaaguuaagcugagagaacuucauucaccauauagugcucuuggacaaccauugaucuaagacugggaauucacugccucagccuuacaagugcuggaauuauaagcaugaagguagaacuuccaugaguuugaugacagacuuggcuucauagugauccauucuggccugccucaguuauaguaauccugcguccaaaaaauaaaaaaauaaaaaaggguaaacaaagccaaaaguaggcaugauagcacaugccuauaaccccaccccuggugaagcagaugcaggaggauaaccagaggcuugaggccaggcugaaaugaaauacacaccaaguucuaggucaugcagggcuucagaguaagauucugucuuaauuuaaaaggaggggggugguggggcuguguagaggggugguucugaugaucuuauggggaaucuguuuacuaacucugaagguccuugcucccaacugguuuuugaucuaucaguaaagaugccaguggccaauggcuggguggaaagaaagaggagggacuuacagguucccacaagcuggaaggagagaggaggggggagggguaggggaaagggggggaggggaggggaagggaaggggaaacaaggaacagacuggagagggaagaaaagaauggaaaacaggagagaaggagaaacaaaagaguaagaaagaguaaaagaggagagggagaaaagagaggagaggagaugggaguggaaaacaaacauauuucacaacgacuugagggaggcagauaauauaaugcaauuuuaaaacacaagcuaaccaggcauaguagcacacauuuaaucacaaaaccuguacauucaaggccagcuugaucuacagcucgagguuguuuguuacacagaagaaucccugucucaagaggaaaacaaaacaaaacaaaacacacaagauacuacaccuaaaaaaauagcuaaaaucuacagaaggcuaaggaagaacaaaaauucaaacguuguuccaagaaggauaacuauaaacugcaauguuuucuucuaaagccagucagguuuuuuuuuauuuauuuuuuuuuuuuuuugguauuuuugagacaggguuucucuguguagcccuggcuguccuggaacucacuccguagaccaggcuggccucgaacucagaaauccgccugccucugccucccaagugcugggauuaaaggcgugcgccaccacgcccgcagguuuuuuuuuuaaagauuuauuuauuuaauguauaugacuacacuguagcuguacagaugguugugagccaucaugugguugcuggaaauugaauucaggaccucugcuugcuccagcccaaagauuuauuuauuauuauauguaaguacucuauagcugucuucagacacaccagaagaaggcaucagaucucauuacagaugguugugagccaccaugugguagcugggauuugaacucaggaccuucgggagagcaguuagugcucuuaaccccugagccaucucuccaacacugccagucauguauaucuacaucuauaccaacaggaaaguauauuucuaugccuuaggaaacauuuccagaagauucauagaagccucgaucauaaaaacuaaaauuaaaagcaacccaaauaacgaauaacaaaaagacaaacuauaacuuauucuuauaucacauagagucguuaaaacuaaugaacuacagcuaauaauucaaaaaauuacuuggaaauaaaaaaagguugucugauacaauacaguuauaaucccagaacugaggaugaagagaugaaagggcagagggacaagauuucaagaucaaccuggcuacauggcaagaaacuguccaaaaguaggaaugaaggguaagaggaaggaaaagaaaggaagaacauacaccacaugaucuaaacuacauaaaguucauaaacaggccacaaugaauuauguugucauaaaaaaagagaguuacuauaagugagaacaauuauuaucacuggagaaagcuggagccuauaacagguaaugcaugcuuagagggaaaaggaugcugauaaaauucuuucuugaggucagaaauaacacaaaaauuuccauauacaagaagucaugauguucugaaucugugcuuuguguacugugcuggcuagucugugccaacuugacacaagcuagaauuaccugaaaguaggaagcucaacuggcaaaaugccccaaaaagauccaucuguaaugaauuucuuaucuagugauugagggacagggccccguccaauuuggguggugucauuccugggguaguggugcugguccuggguacuguaagaaagcaagcugagcaagacauggaaaagaggccccacucuuccauggccucuucaucagccucugccuccacguuccuacccuguuuaaauuuauguucugacuuccuucaacaaaaugaacaacaauauggaggguaagccaaauaaccucuuuccuccccaacuugcuuuuaggucaugauguuuuguuguugcaauagaaacccuaagaccugcacuuuucaacuugucuuacuuuuaaaaaaaaguguaauaaggaaacuaagguaaggguuagcaaugggugucaaugcauaaaguacaaggaagauuguuggggaacaaaauauuuucuacaaaaauacccuacaauauucuacuauuuacucccuuauuaacuacacagugaaauuuauuauucuucuauuuaucuauuucccagcuugcuugcuuguuuuugcagcccaaggacuugaacccagaacugcaaaaugugaugucacacaugacaagcaaguucucagucacugaccugcaucucuagcccuaaaggaguaauucaucacuauaggagaggaguuacuauaaguaauguuagagaaauuauggcaaccucaauauauccuauauauuaauugacaucugucacaguuguagcaugucaacccggaguagaggcaaaaugaucagaaguucaaggucaugcucaguuaagcagcaaguuuuaaacuggccugaacuaucuaagacacuggcucaaagacagcaaaggagauggggagggcuggagaaaaaaacagcucagugauuaauagugaaugcugaucuucuagaggaccugaaauugguuccuaguaugcauaucaaagaacucacaaccaccuguaacaaauucuaagggauacaaugccucuaaccuccacaagcuucuauacaaacauacauagccuuacccacagauacacacaugcacauaauuuaagauaaacaacaacaauacaaauaaauaaauaaauaaacaaacaaacagaaaaagugagccauaggcagagaauggaggaaagaagaaggaaagaauccuccugguucuuucucucauauuuaaaaaguauagauaccaaaaaaaaaaguaaauagaauacaauaaauaagauauaauugaguacuucuaagcuaucuaaaaauagaaaacaaaaacaacaucaccaaaaacuuuuaaaaaccacaacauaaguguaaauauaccucaucauaaaugcucccauuuauaucugcuccauaaauaggugccacaaaaguuaaguuuuuccaguauuugcguuccaaaucuucauaauccaaguaucuuggaguacaguaucuauaaaaaauuaaaaaguaaaaaccacaaagcaguaaggcaauuuuaagguuuucuacccaucuaauuuaauuuacuuucuaaauaaaaauauuguacacucaugugguaucagaguuaaugaguaauauauaaaugauuucauauuaaaagcucuauagaauuucuuauguuccuuaucaguagggcuuccaaaacacacuaauaaaggcaucauucgcuagcuuucaaaauauuucuaaaauauguaaucaauuauauaagaacauuaugcacauuuauguagaaaaacacaucuauagaaaacugagaagaaaacuuuauaaaauucuaagacaacaaaacuaaaauaagauacucuguaguuauuagauuggugcugccuaauauacuaaugacagaaaaaaaggaaaaaaaacuuauguaguuagaguggaagaauaagcuagcacaaucuuuccagagcauaauuucucaucgcauaucuuaucaaaauuuuacacacccucgaucugaauuuauaaauuccucuugccagcacagaaaugcagacaaugacaaaugaggaagugcacagcagcauaacuagaaacacaauggguaagaggcacuuuccuguagcugugaucaaacucugacaaaagcaggguucgcuuuagcaaugaagcuugaggugacugaucugcauacaauugcacucagaaagcaaagaaagauuaaugcuaauuuucaguacagcucuccuucuauuccaauauaggaucacagcccauacaauggcacuguccagguaagguaaguauuuccaucucaauuaaucuaauauaaauaaacccucauaggcaugcucagagacuugucuuaagugauccuagauccugucacuuucacaaugaauauuaacuaucagacugaauagccagcaauuaacuauuaaaacauaaaauaagguaagucuucuauguaaugacauuaaaauauuuccaugcugacuacaccaguuuagagauuacuguguauauauaauguaaucacauugcauuuuuuuguuguuguuaaguuaaauuaaaaaccaaacucuggagguaggaacccagcuccuugguaaccugcuugucuaucagacaggaugccagaguuaacaaauacccugauuaccuaaauaugucaugguaacacaucccuauaaacucagcacuugaaagauagaaggaaaaucauaaauuauagauagaaaagguaccucagcuacaucaagaguuaaugccaacuuggacuagaaagauacccuaauuuuaaaaaagaaauguuaaaauuaacaauuaacuucuugagcaugaugguacauguauauaauuucaauauucaggaugcagaggcauuaggaucaagcaagaauucugggccaguuuuggcuacaccguaaauucaaauccugccugaaaauacauacauaaaauccuauguauaggggaaauguauagagagcucgguggguaagaacacucuugcaaaggacccaaguuugccuucuaguacccacaacaggccauuuacugccuguaguuuggcuccagggaauccaacaacucuggccccccugaguacauauagccacauaugaacaugcauauaauccaaauuaaaagauaaauccagauuaaaagaucucucagacauuaaagguacuagcuuuuuuugcaaaggccuagggucugauucccacuacccauauggcagcucacaacaaacuauaacuccaaucccagaggauccaacacccucuucuggucucugcagccauuuaauacaagucaugcagagaccugcaugcaggcaaaacaugcauucacauaaaagaaaaaauuaaaaugucuuuaaaaaaguuuucucucacaaaauaauuaaagaaauauacuucucugaauuauuuuguauuuauuuuaagcaaucauauugauaugaaagauauaaugaaguucaaccugacaggauacagaaucacugaaaacauaaauuucaaagcaugucuauaagagauuaccuaaaauaaauuaagugggaagaccuucccuaaauguggaaagcuccacccuguacugaauaaaaagaugaaagcaagaugagcaccagccuucacuacaggucuuugcucugacucuggucgaccauggcucucucagccccuauaggcuguauccucugaaacuuuaaaccaaacaccucuucaaacacaucuuuaauuuaacuggguauuuugucacagcaacaagaaaagaaguuaagacagauaccuuuuuuuuuuuuucaugaagaaaauaagcaaagguccguccuaacaugcugccagaccaucacaguuguucaaaccccaauuuacucaaaacugacuccauaauacauucucagaaccauuuacucacugagcacaguucuaaaagagaggcucaugaccaggcuccuucugccuuagcaacccuacaauucuaacuacgauuaagagccaccacaaacaucaagguuugacauguaaaaacuaaaauaucucuggggugagugcugaauuucucagaagcuuauuauugcucuauaaaauacagaugauagggacauguggcucuaacuauauauguagcugaggauggccuaguuggucaucaaugggaggagaggcccuugguccugugaagguucuauaccccaguauaggggaaggacagaacugggaaugggaguggguggguuggggagcaggagaaggggguagaggauaggggguuuucagaaggggaaacuaggaaaggggauaacauuugaaacguaaauaaaaaguaucuaauaaaaaaaauuuuuuaauuaaaaaaauacagaugaugucagccccacuugcuacuagggaccauguagccaccacggcagacccagguagacaaccugugugcugccucuccuccuccuccacuccaguugcuuauggcaaauccaaucuacagccccuguucugguccccaacccuguacucagguccaccguggugaacucccugaaccauugcauaccuuuccagcccccaaaauuagucuggccaguccugccugugggguuuccaacccccaaguuuggcaguagucucauauccucuaugcuugcccauucugaucaguugcugcuagugccuuuccaagcuucaggcuuggcacuggucccacccccuguguaccaugugcacuagucuaguccagugaguuccaccagaaccuagcaggcuguaccauauccagccuacaggcauaaaccagaucagacaucuaugcaaagauacagccuggugaaugcaagagaccucaucuuccugugccauccuggucccucacaccuugccccagccacacagccuaaacacaggccuaaccugaggcaguguagauccgcacaucggcuacacaacuagcaaagaaguccauaugccugggauauaugauaaaaucacaauacaaaaauccaaggcaacauaucuuuccccaaauccaccaguccuauauauauguucuccaauaaaaauuuccuacauaaaccacagacacagaaccuaaauuucgcugugaaauuuuaaaaggucauagacagaccaaagauaaagagaauagcuagcacuaaauaccugaagcuaaagaaacaaacauaaaucugaauaaaacuaaaauaauucagaauuugaaaguaaaauaaaaauagugaagagaaucucaauaaaugaaugaauuaaugaaugaaugaaagacaaaauuacaaaacucaauaacucaaucggaaagcucagguaaaagucuuaaaaguugauugaauuaaguagaacaaauaucuggacuuaaagaaaaucaucagaucuucaacaagaucaaagaaaagacuuuccuaaaccaaguaaaaucauacauauacauacauaugcagaaagcacacaggacaccaauaagcaagaccaaaaaaguccaacgauauagcauacguaaaacacaaauauagaguauuugaaaacugaaaacaaaacaaaacaaaacaaaaaaaaaaaacacagacaacauaugaaggaaaacauuuagcuuauuucuagaugaaaauuuuaagagggaaaaaaccugaaguagugcauucuaaaacaccacagaugccggccuagacuacuguauccagcacaacagucuaccacaaaggaagaagagaaaguuuuucuaauaucaagagauuaaaaggauuaguaucagccagccauagugguacacaucuuuaauuccacuaccacucagaacacugaggcacgcauaccuaaucucuaugaauucaaggccauucuggucaagauccagaacagcaaaggcuacaugagauauugacucaaaauaauuauuguuaagcugggcgugguggcgcacgccuuuaaucccagcacucaggaggcagaggcagguagauuucugaguucaaggccagccuggucuacaaagugaguuccaggacagcccgggcuacacagagaaacccugucucgagaaaaacaaaaaaacaaaaaacaaaaacaaaauaaauaauuauuguuaucacauuauuauuauuacuauuauuauuauuauuacuauauuucaucucuaccaaacaaaccuugcagagaauacuagaagcaauacuuaugacugaauagaggaauaaacaagccaaagcuaaaaagaaaauaaaugaaguuauaauuauugaaauacaaaauacaaauacaagaccacaaacaauaaaaauacuacaaucaaccuguaccuuucaauaguaccuuuaaauacgaauagcuuuacuucaccaaucucaaaaggcacaggcuauaugaauggaguaagaaagaaaacgcaucuuuccauugucuacaagaaacuaauuuuagcuuuaaaagauaggcaauacuuuaaaauggaaggauggaaaaauguauuccacgcaagagaccauauucuggagcaaaaacuauaccuuaaaacuuuauaaaaacugaaauaauuucauaugucuuaucugaccacaauauaaucaaaguuaaaauugauagaaaucucuaguaaauacacauacuuguggaaauuaaacaguuuguuacuuaaugauaaauaggucauaugagaaauaagaguaauuuaaaaaaauuuagaucugaaaacaaaauaauaucccugggaaacauuaaaaguauuccuauaacaggaauccuaagaccaugcauuaaaauacauauaucugcugugcagugguguugcacaccuuuaaucccagcacuugggagacagaggcaggcagauuugaguucaaggccagccuggucuauagauugaguuccaggacagccagggcuacacagagaaauacugucucgaaaaauaauaauaauaauaauacauauaucuaaacauacacacacaaaaaaauuacuaauacuauugaagaauuuacaaaaauaagaacaagcugggcgugguggcgcaugcuuuuaaucccagcacucaggaggcagaggcaggcagauuucugaguucgaggccagccuggucuacaaagugaguuccaggacagccagggcuacacagagaaacccuguuuugaaaaaaacaaaacaaaacaaaaaacaaaaaaaacaaacaaacaaacaaaaaaagaacaaauaaaauuuaaaucuaguauguggauacaauaauaaaagucaaagcagaaauaaauaaaauagaaacaaugaaaacaauacaaagaaugagucugauagcuuauuuuugagaaaauaaguaagaauaacagacccauagacaaacucagcaaaaaaaaaaaaaaaaaaaaaaagaccuaaguuaacagaaucagaaaugaacaaggaaacauuaugacagacaccaaggaaauucagaacuuuauaaggaaauauuuuuaaaaccuauauuccauaaaaaucuaaaagaaauggaugaauuucuagauucauccaaaccagcaaagucaaagcaagaagagaucaacaaucuaaacuaagaaggcacaaggugaguaacacugaaugcauuugccauucuaaauuacgagauaucuuacugagcuauauuaauacaaaauagucacaguaacaaaacagcaugggacaggcacaaaaacugacauuuuuaccaauggaacaaacagaagacaacaugagguucagguaacaaaagccaucucaaaauguauucaacauccuuagcaacucagaaaauguaaaucacuacuaguuugguaacuggaagugauggugcacgcuuuuuaucccagcacucaggaggcagaggcuggcagauuucuaugaguucaaagccuauauccuacagugagagagacacagacagagacacagacacagacaaauacuuugaguuuuauauuaccauaaucagaacgacuacaaucaugaaagcaaaugacaacauaugcuggggguaauguaguagaggugcaaauuaguguugcacuacaaaaaaucauguaaaaaacucucaaaaugcuaaaaauaaaucuaccauguaacacagccauacaacuacuuggcauaaauucuccaaccuacuccacagauacuugcauagccauguugacagcugcucuauucccaauaguagagaauuuggcuagcaaucaaaaggcccugaguacaauccucagcagaaaaauaacaacaacaacaacagcagcagaaaaauuauguggccaguaagaugccucaauggauaaaaguaguugccucagaagccuaaagaucugagaucaauuccuagaaucaauuccacaaaguuguuccaagaccaccacacaaaaguuauauggaacaugaaugcucacacaaacacaucauacuuauauacacacacauacauauacacauacacacaugcacacacacguacaugugcuaauaaaguuucuuaauaguauaaaugaugaggugcucaaucuauaacuaaaguccuauucucaauaagauccaaaagaaugggaucuaauaguauauuuuuuaauucaaaauuuaauuuuuacacuaaacuagaaauaacaagaaagacucuucaucauuuguauacuauaucaaauaaugcacucauacacgcaaguuacuuuuaugccguaucagcuaaguucauccaaagauuugcuuccauucacaaccauacaagaaauuuaaacauuuuuggcauguuuuuuaaaauacuuggagauuuuauuauuguucuaagguggaacuuuuuucugagauuuuacaggaaaaggagagaaaagcaggaguugggcacagucaguuuuagggggauuuucagaugacuuugagcuuuuaaugauccuuuugccucucccucuagagucaggugcauauaccaucaagccagguuuauuaguacuggugauuaaacacaggccucaugcaugcuaggcaaacaaacaaacaaaaaaaaaacaacaccuaagcugaauccccaguuucagauuaagauuuuuauauugggcauccaauaccacauaaaaaacacaagguuuaaaaauauauucgugcugggcgugguggcacaugccuuuaaucccagcacucaggaggcagagacaggcggauuucugaguucaaggucagccuugucuacaaagugaguuccaggacagucagggcuauacagagaaacccugucucgaaaaaacaaaacaaaaaacaaaaacaaaacaaaacaacaauauauuuauacacacacacacacacacacacacacacacacacauauauuuuuuuuccguaaauucuuuaauagucuucccuucaagaaagaaaauuuugcuagguaugguggcauauaccuacagacccagaacuugagagacugagacagaaggaccacaaauucauugucagccuaagcuuuauaguggccagcuaucucccugccucaaaaacaaaguaagacuucauucuucuccccauucaguauaugauauaccuacucaauuucucuggaagaagacaacggccacuauaugaagauucgggcaacacagacaaagaggaaacagaaagaaugcaggaucagaaggauagagaaguaacagagauaugccaucuacuagacaggacacagacauuuuaauuaugaacucgcugacgcuguggcugucuacuaugggugugaacaauauuggacugucaacuguaaguaaaggaagggggaaccuacuggcuagugauggauuuagaaaagaagauguccaggggcuggagagauggcucagugguuaaaagcacugacugcucuuccgaagguccugaguucaaaucccagcaaccacaugguggcucacaacuauuccuaaugagaucugaugcccucuucuuggguguccgaagacaacuuguacuuacauauaauaaauaaauuuuuaaaaaugaugaugaugaugaugaugucauuaucuucaguuguauacccacuggugagccuaccuggcuccauucaauauaagcccauaaucacucaaaaaccccuuauuaaacacaguaggucauauaacaaaagaaaacaugggaaugggaccuauuaggagagggaacugacaggggaguuggggaaaaagaauggguaguggguaaaguaccagaauauguuaaauacauaugaaauugacaaagaacaaaauaauaauaaaaaaaaaaaaaagauagaaagaaagaaagcaaaucuugaacuccaaaguuacauacacaugcacaaguccacaaugucugcaauuuacucaaaugugcuuuuuaaagaugugugagugcauagcaggacugguauaggaaaaaggaaacaguaauauguccauguuucuacacauuugcaaagcuccacuuacaggacgagcagcaugaacuuuagccucauacaaggaccccuccuagacaaaucuuccagcuaaguucucaagcagccgcccucccagucaaagccuuagcaguaaacguggcagacauccuaagcuuaaucauucaucuacaugacuccuagcuuccugacuuuuauaauuaugagcuggcuuaagggacuaacuuuaagaauuuguuauaugccauauaacugauauaauagauguuucccuauucauucaacguuguuuuuaaauugcuacugcucauuuuagucuuaaacaaaauuaucaauaaaauuuucccuaacaaagcuaaaaagaacuaaaaaccucugacaacuaaaaagaacagaaaaaaaaaaacacaaaagaaccacuucuagauuuuauaaacaggauuauaaaauauggaucaauuucuuuagaaauaaucaaauaugaguaagccgucauuugaagaacagaaaccagggaugaagacaagagaugacaaaggagguuccugcuuuuccggcugcucuguccacguggcuucuuaccucacagaccccuuuggaagaauuacaaacauaacucaacugacucacuugcugcuguuagccagcugccugaacuccuucacagucauggcuuucuucuggauguuguauugcgugaacagucccgacugcccugugaccaucugcugaauuggugcugggaugagcaaauuaucaauaucaucauagcacugucuuggcuuccacuccuuaggaggaaucaccuggaagcaaaacaaaauauuaacuuggcacuccaaacuaaguauuacauaccuuuuauuuuucagaagaacacauuuucucaauaccucuguaacaaaaguacuguaaacacucacuaauacuuugcaguaaggauaugauucuuaauaacaaaauucacugacacccauaacuacauuuguauugacuuguuuuuaaugccacucauaacacuugcuuuuauuuuuuuaugauuuuuuuauguauacagaaugacuaagaguaagagcuaaugauaagacaggcugggauauuuauuagguguuuauaagacaggcugagcugggcaugguggcgcauaccuuccagcacccgggaggcagaggcugguggauuucugaguucgaggccagccugguuuacgugaguuccaggacagccagagcuauacagagaacccugucucgagaaaaaaaaaaaaaggcaggcugagauguuagaugaaacaccaaugacaccagaacaaacaauucaccacguguuaccucucaacuguugauggacucuuccucacagaacacaagcaaguucaccuuuacugaauuuuaucuacaugucucuucuuaagcaacccagacuguccuugaauuuguuacgucucuaggaaugcccaggaauaccuccugcuccucccaaauucugggacugcaugaaugcgccagaauaccuaagaaauuucuuaaaauauuuuaagauugagagggcuggagagauggcucagugguuaggagcacagacugcucuuccagagguccugaguucaauucccaagcaagcgcaugguggcucacaaccaucugaaaagggauccgaugcccucuucuggugugucugaaaaguuacagugcacucauaugcauaaaauaaaucuuaaaaaaaauuaacauugaaagauuuauuuacagaaaaugaaaaugaauuauuagaaaccaaagcacagaggacccacuugggcaaguauaagaagcagaauacuauuaccccucccaaguccuccacacacucuuuucaaaauaggucuauccugcucaaguggcaacaacuaccauauuuauugguaauaaaugcauguggcuaugcuucacuaaauauuaaguuuuugucuggggcuggagagauggcucagugguuacgagcacugacugcucuuccagagguccugaauucaauucucagcaaccucaugguggcucacaaccaucuguaaugggaugugaugcccucuucuggugugucugaagacagugauaguguacucacauacauaaaacaaauguaucuuuaaaaaaaaaaaaaaaguuuuguuuuguguauguaacaugucugacauuuuuguguuuguauauaugcauuaggauacacauguauguauuuuauuauauuuuauuuggaaacagagucugucauggagccgaguccucucuucaccuucccagcacuagcauuauggagaugcauaaugaccccuggcuuuuuuuuuaacaugcguauuagaaaucugaacucaggaccuccugacuguacagcagguacucaacaccuccagucuacaucaauacuacuauuugaaagguacacuauauaaaaguggaaggcuugagcaaaggcucagagggugccagcacucuagcuccaggagggguacccgcaugcacaucaacgugcucacacagaaaaccguuaaaaaggaaucuuuaagacacuauacuauaaucuugguaacugaaaggaaaucagaguguuuaaguauuagaaagaucaacugugagugcaaaagcgauaguucaacaguugagagcacuuguugcucuucucuuccaaaggucuugaaauugguacccaauacccacaucaggaagcucacaaaugccuaugacuccacaagaucugacacucucuucugcccucugcagacaccugcaaagacacagcagauacucacaucaacacacaaagggaaauaaaaauaaaucuuaaaagaacaaaaauaucaagcauacagccagguaagcaugccguacuccuuuaauugggaggcaaaagaaggcagaucuccacaaguucaaggucagcuggucuucagagcuacuucaggacaggcaaggcuacacagagaaaacugucucagaauaaauaagacgaggagaaggaggaagaggggagagaggaagaaaggaaagggaaaaggaaggaaaagagagauaucuagcauguacaaagucuggaguucucccuccagaaccaccuaagcuuggcaugguaguacaaggcuguacaucuagacaguagaaauguucuuagcuacauagcaaggucagggccagccugagacaacagauccugucucaaaaauaaaacauaaaauuaguggcuuaagaaauaucucaguggaaaaaagcacuuaaugcuuuuacagaagacucccaucacccaaauggcaauucacaacuuccuauaacucaguucccggggaaucaauguccaccucugaccucuugagauccccuacacaagugguucauauacacucaagccaccaccagaguguagucccuagaauucuuggugggaagaaaaaaaaaaaaaaaaaacuuccaaaggucucugaauauacccauacucacaucacacacgcacaaacaaauaauuuuuaaaaauuaauuuuaaaaauaaaaagaauaaaagaaguaaacugguuucccaggaauauuuuuuguuuuguuuuguuuuguuuuguuuuguuuuguuuuguuuuguuuuguugguuuuucaagacaggguuucucuauguagaccuagguguccuguaauucaguuuguagaccaggcuggccuugaacucagaaauccgcuugccucugccucccgagugcuggguuuaaaggcgugcgccaacacacccggcuaggaauauuuuauucuuuuugaauuuuuauuuuauguguaaguauguugccuacauguaccacaugauugucuggcauccuuggaguuauagaugacuguauacuaccauguagguacugggaacuaaacccagauccucugcaauaacaucaagugguuuuaaucauuaaaccuaaccucuccagcccaccaggaauauuuuuaaguaacuuuuaaugccagagaauaaagcauaaaauaaauuaaaguuauuacaaaguuaagccuaucaguucuaaguuugaggccagucaguauaugcagugaauucuaggccagacagguauacacagaaagaccccaugucaaagaggaaggaaggaaggcaggcaggcauguugauccaagccuauaccaacuauuuucuuuugaauucauuuuagauuuuauuuuauucuccuacgugcaugagugauggaaguggcaugcaaguggagaucagaggacaacuuucaggaguugguucucucuuucccacgggauccagaacucaacagucagcagcagguaagucaagugcuuuaccuacagucauacuuucaguuccauuuuaagucuuuaaauaucaaaucaccucacacaguucgaaaccaaguacaacauauuugcucauuaaacaauuuaauaguaacaccuucauauuuaaugaguuaaaguagaggaaaccuauucugcuucauuucuaucaacuauauugacuacuuccugaguaugucaagacagaauacauacuuuaugucacuguuuucccaaacccaggcauugccagcuaaaauaugcaugcccacuagauauguugaagccagaugcuaucuacaaaguagcaaaagaagaacgauguuaucuucauguuguaggcauagguacauaucuucacucucuuguauuuuaugaagcacauacauauaugcacacauauauauguacauauguauauguuuauguguauguauauaaauaauuagagaaaaaacaaaauugggcuacucugaaauuaaacucacuauuauugaaguacucaaaaauugauuauuguaaguuaaagaaauuauuauaaguuaagacaaguccacgaaaugucaauaauacauuaagaaaggaaccacaggggaccuuuauucccccacgaaaagaaaaacauccacaucuauauagucuggauuuucaaccaaguaacuugguuuguugaagcucuauacacuuaaguuacuucaccauccagaguaagaaugaaacuagguuaaacauaauuuaugugacaauaagaauacagcaaaauacuauuagaagaaacaagcaguucagcuucauccuaggagagcaaaccuaauauuauuagagaacgcugucuuugucaaagaguguuccauugagggugagguacacuggacucacucagguguauuuguaauucucauauuaauuuuauucugauucuaauuuauaccugucauggguguacucagugugccuacagcuccucuucucguuacuuaacaagucaucucaccacuagacagcauacuaauuacagaggaccaggagauguguucaagaaacaaaaaaggagacaaaaaaagguuuucaaaaaaggucaaauaaugaacacaguauaguaacacacaugccaacaacccagcauucaaagauggaggcagaacaaccaugaaauucaggguuccaggcuauucugggauauaugagaaaucuguuucaaaaaaaaaaaauagauagcuagacagacagacagacagacagcuagaaaacuagagaggagaaggugaucuccagcuucucucugggcuaauaaagcccaguuccuagauaauacaugacauagcauuucauacucaugccaaaugacggaaaaauaacaccuucuguucaacugaagaaagauucccccaugucuaccucaaauuauaaucugcaaguugagaccaaaacugaaaaagcaaauucuaaacaacuuuuacauuuacuuauucuguguaugaggaggggggacauggaggcauggggaguacauagcacaaauguagaagucagagcauaacuacugacaacagccaccuaacaaaaggaaugaccucuggauacaaaaugccacaaacaguaaaaaacuggauuacagucucuaguaugaaucaagauaucucguccucguacuccaaaccuauauuucugaaguucucuguucagcuaacagucauuauccacaccauuugaccuucauaacagauaugcaaaguccagggaaaaaccuuucccagugaacguaucacuagcaacagccucugccagugccaugcaccuauaugaugaaauuacagucuuugggaccucaugaacucuccuacgaccuuaagcacaccauuuaccauuauuuuuuaaaacacauaauuucguaucuuuaagaacaagaauagaugaaccuacucaaaacuggcuucucuuuuuaaguguucaaagcuaccgagagcuguucaguagaucagcacacuaucccugguaagacuucccguggacacuugucuuuacaaccaaacucauuuuuuacauagaugccaguguaguuuuuuuucaagcaaugucucagcauagcaaaagaacaggacaaggaaacaucuacuacuacaucuuccuucccaauuuuaauaguuaauauugauugucaacuugauagaagucaccuaggggacagaucuagauuguauuacagagacgugaagacccacccuaagugugggcuaagauucugaacuguauuaaaaaguagaaaacaaguugaacaacaguauuuaucucuuccuccuuccacaguguagauguaauaugaccaucuagcugccucaugucccuaccaccauaauguauucuaaaacagccaacauaaaucauuccuuccugaaauuguuuugucagacuaaucuauucaauucaagacuacccucacuucuuacugcagguggaauaaacccccuaaugcauuaccucaguaauccuagcacuuagcaaaaaaaaaaaaaaaaaaaaaaaaaacucugucuuaaaaaaauaaaauaauaauaauaauaauaauaauaauaauagagugagcuccaaaagugauucagcagcugugagcccuuacugcucaaucacgggaaccagaauucaaauccgaguaaccauacuggguggauggcaauaccaguaaaucuaguucuaaaugauucaaagcccuuuuauauacuucauaagcaaucgcacacgugugcguguacacacacacacacacacacacacacacaccacaucuauuaguggaggggcagggaggacaaccuagaauguuuuuccuuaacuccuaccuccuacucuuuuggcacaggucucuguggugaucugaauaggaauggcuccccagacucauguuugaaaguuuggcccauucgguguggguguguccauguuagaauagguuggucuuaauggaggaagugugucacugugggggcgugcauuaagaugcucaauuccaggcucaauggcucacaguuuucugccugccucuugcugaagaagauguagaacucucaccuccuccagcaccauuucugccuacucaccaugcuucuagccaugaagauaaugaacuaaaccucagaaacuguaagccagccccaauuaaauguuuuccuuuauaagaguugucauggccaggugugguggcgcaugccuuuaaucccagcacuugggaggcagaggcagguggauuucugaguuugaggccagccuggucuaacagaguacuuucaggauagccagggcuaaauauagagaaacccugucucaaaaaaccaaagaaaaaaaaaaguagucauggucaugguuucucuucacagcaauaaauccuaacuaagacagucucuuuaccaccuucugugacaggcuggccaugagucuucauuugccacugacacuggagggcugggauuacaaaauauaugcuauuggccgcaguuuuuacaugauuucuggagacuguaagucuucacaguuugguagcaaauauuuuaccuacugaaccaugucuccaaccuggauucuuucacccuaauuaucuguuugguugguugguugguugguugguugguugguuugguuuuuuuggaaacaagauuucuguguagccuugccuguccuggaacucacucugaagacaaggcuguccucaaacucaagagauccgccugccucuaccucgcaagugcuagaauuauagacucugccugcaugcccuccaucaucacugcuacacagcagacacuucacacuugaagaaagaaaguaggcuaggaucugguaaaagagcucggugguaaacaugcuuguuacagccugguaugacaauucauaccuuuacucccagaacucaggaagcagaggccagccuggucaacagaaaaaguuccaggauagccagagcuacauaggaaacccagucuugaaaaaacaaaacaaaaacaaaacaaaacaaaacaaaauaagaacaaagaaauacugauaaacaauauuguccccuggaaccacaucaagguaaaaacagaaaaccaacucuaaaguuguccucuggccucaacagaugaguuguggcaauauauacaucuccacaugucauacauaggcaccacccauaaauaauauacaaauuuuuuuuucaaaaauagguaaaaaggcaaauugauagagaaugcagacugugauugccuagggcaacagugauaccaggaaauuggaaaugaccauuuaaaauauauaguuucucuuugugauauccacauauaauuugauaguaguaacagcuauaaaacuauuugaauaaacaaacaccacugaauuagaaacuguagauugaggauauuguaucuuguuguuuuaacacgagacaagcauaguugcuagagccuauaaucccagcauucaggaaguugaagagagaagauggcuaugauucaagacagugaaagaaccuaucucaaaaccaaaaaaaagaaagagagaggggaggagggagggaggaaagaagggagggaggaaggaagagaaauucuagaacauagucuaguauaaauaauccaaacaaaagaaaauuaagcauuccagcuagauagcagacacugaaagaaccaaaaacuaacaauguaauucccgaagucaaaggauacuuuuuaggacaagucugaauauaaucaccuuggcaagaccugcucgaugggcuccuuuggauuccauguaugcgagguauuuguugaacucccgaaacuccuccauggaaggucugaaggucauuaucuuacagcugggauuuaggggacucuccaccuccaccaccuccaugauggccacagauguuucugcaaagaaaagguggccaucaauaauggacuccucaaaaaggacgccucagggcuuccuaacaugcuccuauucuggauacagaaucacugaccugacuguaaaacugaccuccaugaaaccuuuccaaguaaaacugaauuuucuagaaguacagucuaccacagagauaaguuauuucuccacuggugaaaaugagccaguucaagccaaauuugauuaucuuaaaggcauguuuauugggaagcuguucuuaggcaaguucacuggccccaagaggaaagaaagguggagagagagcccacaaagagaguggagagaaagagagggaaaagaacagagagagagacagacagacagacagacaaacagagaaacauagagacagacaccaaggagaagccucugaaggagaaaagcagcguagcugcugggcuguaaaguucaggguuggggacaagguaugcugaggagggacugcugggaaaaccuggaggucagguguuaaugguccucaaauaaacacacagauguacugguccacuaucucacauaugcacauauauauauaaaggccuagcauauauaugcugaaggauguucaauaucacuagcacagagcugaagugucuuccaguuuuuuauaagaugguuuucuauaauaauuaaaaaccaaucacaugacaaaaccaccagaaacuaaacuaaucuacugaagacagaaaacaguaccagaggagcucugauaagagcugugcaaaacugaaguucugaauucaaacuccagcauccauguaaaaagccuagccaagcauggccauguuuuguaacccuagcauugugggaggaggcagggacagaagcaucacugggauuugcugcccuccagccuacuccagguucaagaaagagaguaagauugaacauaucauagcucauagucaaagaagucaguauacaaacucaaauagggcaggaaccagaggcaagagcugaugcagaggccauagaggaaugcugcugacuggcuugaccaucaaggcucauucagccugcuguaaagaacccagggcaaccagcucagggaccgcaacaugcacaaagggcugggucauccaccaccagucauuaauuaagaaaauguccaacaggcucgguaacagucauggaagcauucucuuaauugagguucccaccucucgagugaccuuagcuuguguuaaguugacauaaaggcauccagcacagggaauuauuuuuuauguuuuacaugccaaguuuuccucuugagacuucugauauagccaugacuggccuugaacuuguuauguaguugagggugaccuugaauuucugauccauaugccuguaucuccuucauaggagguuuguaguacuggaaaucaaacucaaacccucuagguaacuacucuuaccagcuaagcuacauccuuaaccagaugcaauuuuuuguaagcccuuggucgauucaauucaucaauacaaaaaaacucaaauauagaaagccaacuguacuucacccaguuucucaaacaaguuaaguaaucugugacuucacauauuccuucccuugaagcagccucugcacacuuccuagcugugaguucccaacugucugugcaauacagaacucaacgagccauccugugcucugucuccuugucuacacccauacuauagacagcaagggguuccucccaaugcuggcacagcccacuagccauugaguuaucaagcacugaaaagaaagacagauuggcacguagucuuccucacaucugcuauaauaauauuauauacaauaaucauuacaauaauauaugaguaauaauaaagaaguauuggccaggaaugcauaucuuuaaucccagcacuuaggaggcagguggauuucuaugaguuugcagacagccuggucuacagaucaaguuccaagacggcaaaaaaaaaccccuggaaggaaggaaggaaggaaggaaggaaggaaggaagggagggggagagagggggggaucaagaaaaguaaagaaaagaguaucaaggggcuagaagcaaggaacagagguuaagagcauuuguuguucuuacauaggacccugccuggcucaauuuccagaaucaacauggugacuaacauacagacuaugcauauacauauaauauuacacauaaaauauuaaaaagacauuacauagaaugucacauucgggaaaaggaauaaacuuguccuaaacaaaaguuauucagaaagcagauuagccuagcaugaaaaacacaucuauaaucuugguacuugagagaaagaggcaagaggauuuucacaagucagaagucagcauggucuacauaccaaacucugggugaggcagcuagaguccuaccucaaaaacaaaaaacaaaacaauaaacaaaucuaauuuguuucacuagcaaaaaaaaaaaaaaaaaaccacagcaggaaacuaagaaaacuacaaacuaucugugugaaacacaccagcuauaugaaaugaaacauuccuuuucuucuggccaaaauacaagucaccuugguauuugucugagcagagucagcagccacugaaggaacuggaaaugcagcuagcaauucaacagugauugaauuccuaacuuuaguuccacagacauugaaaggacaaaacaguccuggcacuaacaaugacacauaaaauacaguaaguaaaugguaucaaugcgaaauuaaaaaaaaaaaaaaaagcaguuuuuuguuuuguuuuuguuuuuuaagggaauaugaaauaaauuuuucuggagcauuuuaacaugacuguugcacagggaauacagauuuagaucacuccaaacuccauauuccaacauggaagcaguuucaugaguuucaguuacacuaugagaacagaacauguugcagaacaaagagaaauauaagucaaggcaaauuuaaaacacacagaauaucaaagggggcagucacagcaagacagggaaagcuuuucuaugcuaugcuauaugcuaggcuacagaagggucucugaugacauucuuagcauuugguugguggaagcugguggucuaccauguuaauagaguccaagaagaaaugaccuacuacucacaagacugccaggaaaaaagaaaggcuacugcgugcagaagaggaaaaccagcccaagauaagguaaaacuaccuccugggccugcaacauuccaaccucuccacaguauugaaauucuaaucagucaggcaagcucuggagacaaagcugcuuuucaagaguucugauuuacaauaguaacuacuaaaaaaugcagggccaacugaggggguuccgguuucaaagcaggcaaucgaaggugguucagagaaauaaaauccaggagaagccuaaaggaagagauaucucuuagguucaguucugcucuauucuucaagagaucuccaagaaggcagauauggcugaaaacaagacagagaagguugagagagagagaguagaaaaaagaaguuuggcguuuaucugaguaugccagcaaguaauuuuggaccuuuaccccuuaacauauccaguuccugaacucagucauuuucgucacaccauucaaagaacuaagcucccuaaguauaccucuucugaggaaacugaagcaaaaaaggaaucuugcucauauuuucauuucuuguugcugugaagaaagagaguaaggaagacaaggaggggagaaggaggaaggggggaugaaaagggggaaacaccaaggaagagauuuauccaaagaaaauuuagccagacaaaacagaagugaauguauauagugugcagugagauccaauuaguauuugguauguucugaagaaaauuucacaacagaaaugaaaaaggaagaaaagucaagauuucuaaacugaggcuggagauguguagcucaauuguacaugcuugcuuugcaugcacuaggauggaguucaaacacaagagugggggugggggcaaggggaaggaggggguagccccaaauccucacacuugagaagcugaggcaggaagcacagcuggagauguagaccaaaaccacgccugaaaauaaggaaaagggagggguccaagugugguggggcacucaggagacugaggcaggaaagucacaaaugcuagaucaaccugagcuauguagaauucagaaccaguauggauaauaggacccugucuuugaaaaaaauagagacaaagagcccagccugcaagugcagcuacccuggacacuuggucaaggaggaucacuguacuuaaaggcugggcuacauuaugaguucaguagccugguaacaguaagauaagaccgauccuaaauugcuugcuuccauguuggaacauagaauuugaggucacauaagucuguguucccaggccaugguuacucaaaauggcuggagaaucucuuauucccuucuaagaugaaagcugcaguuuuagcauugccuuccucccauaucuagcaaguacuuagcacguuguacauguuacuguuuucuuuaaauguauguagaugcaaaaacaagcagagcaacuaaugggucacuauucaaaaacuuaauaaacaauucaccaaaagaagaggaggaggagucuggguuacaggccagacgugcacgaaggcacuggacuccagcugagcuuucagaaagguggcuggggcggugaaacuaaauaaacaguaaaguacaaaucagaagggaggaagaacaaaggaucagccccacucugagagguaagcgaacagaggaaaggagugggaaaugaugggcugaacaaagccucacaaacacagggucaacugcaggcugcuaccccaaaugaagagcugcuggaaguggagcaaggaggcuaaccuucuuaaagggauuauucugacugcguggguggauuaagcuaccacggaauaugaaauauuuucaguguaucacuuaauuccaagagacagagagggaaguguguagggaagcuuuggguguguguguggggggggggggugaaaaguaaaaugagcugcaauauguaaauggaaaauguaaaaguaaaaacugagucuguuucacucuaauuaaaccucacaccugaaguaaauuaugaauucugucagcucccugucaagacuuacuguuaaugguaucuuguuucauuuaccacuaauuuuuuaaauuuguacuuucggauucacaacacuauaguuauaaagacaaaaauacacauugcauguauacauauggcuucuauuuccagaacucuaguuucuauccccagaacugcaaaaauaaauaaauaaauaaauaaauaaauaagacaaggggcuggagagauggcucagcgauuaagagcacguaugggggagggaggaggcagguuaaaaaaaaaaaaagagcacugcucuucugaagguccugaguucaaaucccagcaaccacauggcacaugguggcucacaaccaucuguaaugagaucugaugcccucuucuggggugucugaagacagcuacaguguauuuacauauaauaaauaaauaaaucuuaaaaaaaaaaaaagaugacaguauacuauacuucccaagaaguucaaaugagacucaauagugaagaaaaaggaaugguagcccacaccauuaaccccugaauucugggggcagauuuaggaacugcaggccagccugcuauacacagugaguuccaagccagccagaacugcaaagugagacccauuuuccccaaaaaauaaacaaacagcugaaucuugagguagauugauucccagcuucaggagggaccuccacacuaaauucuagacugccccuaccaguuugcacccccaccauaaugaagaauccuuuccccaccacagacugcugucguuuauuuuauugaucguggcuauucugaguuaagaugaaauaucaaauucuaauuugcauuucccugaugacuaaagauauugaacauuuaagcauuucaaucuuuguugaguuuuaauucuuuguuuguuuguuuugugaguuuguuuuuuuuuuuuuuuauaauucucagccuaguucugcaccccauuuuuaauugaguuguuuccuggaucccaguucucuuucuucuuugugcauucaagauacuauagccugccacuuugcccaaauuauggugcccuuuuccauauaaaagcuuuucaguuucaugaagucccauuuauuaauuguugaucauagugccuauccuaucaacauucuguucagaaaacccuuuccugugacagugaguucaaggcuauuccuaauucauuucuaucguauucaggguauaugguaggacauugaggacucugauccauuuagaguugaguuuuguacagaaaaauagauauggauguauuuucauuccucuacaugcagcuauccagucuaacuacaucauguuaaagaugcuuucuuuucucccugguguaauucuggcuccaucaucaaaauucagguuuccaaagguguguggaauuaugucugcaucaucaacuuuauucuauuuagcaagacaacuuuuuauggcaaugccaugcuguuauuauuacuauagcucuguaauacaaguugaaaucagggauggugcuaccucuuugcauucauauucaaagaaaucuacaucuuacuaaagugauacuuguacauccaugcucauuacuuuucuauacauuauagccagaaaaacagccuaggugcuaaucaacuauuagaacaagucaugaaaaugugauacauuuacacaauggaauauuauuugguuguuaaccaaaaugaaauuugccaguaaauggaaaacagcuagaaaccaucaucccggacaacccagacccaaggcgacaaauacugcaugguaucucuucuauguggaugucaguuuuuacucuuuagauaugugagcuaugauuugaauagucacagaaguuuaaguaccuaguuggggguggggagaccauaucccaaggaagggaaaauagaauauaguuauggagagacaaauggaaagacauaauaggaagaucaaauggagaaggaaauggaagggcagagcagaagaaaaaauauggggagguacacuaaaggcccuuuggaaaaccauauggaaaccuacuacuuuacacguuccuaaaacauauaaucuauggaaguaaucuaaauggaaucaucacauacugagggaggcaauaccacagcuagauaccugacacaaacccccaaugaugggaauggguuacaucuuuuugagucauuggccaaauggcucccauaggcaugucugcaaaauguaauaagcuauuguuuacuugccacaaccagaugauaaggcccuaaugcugacguauaucaccuauuuauaucaucaaacaugaagaaauggagcugguauccgaauagaaacuuuaacagugcuggaaggcacuuuauaccauaccagagaaggugguuaaucaucaguaucacccagcuacaaacccuauaaccuacaacagugaccugccugcaagggauacugguauuuacugcaguaaaaaaccacuuuuuuauugaacuuaccaugagacagaauccaugacacugauuaaguggcuaugggucuaggaaaaacaucuccuguuacuuugcuaaggacacugcaauaaaugacugcccuuagcaugcugcuauacccacagaucagagccucacucagccagcaucacagaaucuugcaguagacaguaauuaaaacagagaccaucagcuacaccauaugcagaguaugagagacuuuggagcacucaggucuaaaugggauaucuucaucaaauuucuccagucccaaacgggcgugguggugcacgccuuuaaucccagcacuugaaaggcagagacaggcggauuucugaguuugaggccagccugaucuacagagugaguuccaggacagccagggcuacagagagaaacccugucucgaaaaaaccaaaaaaaaaaaaaaaaaaauuuuuuucuccagucccagaucaagggacugaagaccaagaagguggaaagacuacaaggccauagcaauggaggacuccagagaaagagggcaucuuccagacacaacaauaaugcacauaugaacucauugagccuguggcagcauaaaaaaagauauguacagcuucaagcuagauaaggucucagcuaagagggauacguguaccuguagucccaccacuaaccaagaagcuauuuguaauugauaccaccugcaaaagucaguucuauccagggcaggcccuggugcccagaauuaguugaccaagacgaaagauauucauauucuauccccccuucucuuucucuuccucucccccccacucccuuugccugggccugugucuguguguauauauacacuuuuuguucuguuuaauugugaaacugauuuuuguguguguguguuuugaguuuuaguugguugguugaguuuuguggggaguuugagagagaaaaugaaguauguaaagagguagagagaggaucugacaggaguauguggagggaaaacaucaggaucaaaaucuauuguuugaaacaaguauaaauaaacaaaaaaugguauuuacaggaccaugaaauauuaacauacaaaaaaaggagacaauuuuuucuauuccaucgccuuaaacacucagccagaacuacugcuucaaagagaauuuuuuuaaaaaaccugcauuacauauugaacuuaaugacaguacagaauguacuuguuuuaucauuuaauaucuaguaaauaauaacggguaucaaggguauagcaguaagaauccuugcuacagaauguaggacuggaaauguagcuugguauagaguuugccuaccaugcgccaaagccuugaauucaguccccaggucugagucaaacaaaguaauuccaacacucaagaaguagagacaaagaucaccaauucaccaaucuaugugggcuacaagagacagucucaagacaaaaggaaaggaaagagaguggggugggggagggaggaauuaaguaaguuuuuuaguaccauaaagcaagccuuagcguugaauuuuauuguauuaccaauuucguggagaacuguaaacauuauguguaaacucuaaacacuaaaaugggaagguagaaacccugucucgaaaaaccaaauaaauaaauaaauaaauaaauaaaugaauaaauaaaauaaaauaaaaugggaaggagguccuaaaacuacuuaacuaggcagugcauuccaaaacaaagcaugauagguuaccaggccagcaagcuuuaagaaaacauuagugaacaugcucaauaguaaaaaaaaauuuuuaaauuuuaaaaacgaacuuuuuuuuccuuuuucuuuuuuuuucuuuuucaaucuuagagaccgaacuuaagguguucagauacuaagcauuggcccuaccacuugagcuauauauuccaggcggugggaacggaccguaaauuuuagagaacaaauaaccaguagcagugcagaaauaugaccagcaggaaucccugcacuggugaugcagaggcagguggauuuccuggagcaccagguuagcuaccauacagaguucuaaguugggcaggacuacauauaagacccugacucaaaaaacaaccaaaaauaccaaaaguuuuaaccaucacacuuuuaaauuagaauacuaauaacuuuucccauagaaagaguuaggcuccacucccuuccgcccuuuuuaaacgcaaaacucaagugggugaaauacagcaaagauuggugcuaaccuaagcuuaccgagccuaucaaaagcgucucccggguuccgaauugcuucauuucuaacguaagcuuucuaagcaguacuagguaaaucaccaagugugagugaccguacugaguccaagauuuaaaaaaaaaaaaaaaaaaaaaaguuggucaagucuuccaagucuucucucagagcaccugacugacuacgugcgagcuugcgggcucagccacaccggcggcugccuucuggguccccaagaaaauccucagaacugaguccagcugcuuucacugcugagcagagaacaccaacuuccagcccgagcuagaccgccugccuucuuggcauucccaucgcacaacacgcccucucucccuggcaguucacaugccgcaacgaagucgcaucuauuaagcgcccacugucuaccccgcaucauggcuccccccaggaaccgcacaaagaaauggccucaagacggaggaaagaaaaagggaaagaucaucugcuagggccaagaacgaacccgagugagggucgggcuaccugcuaccucgcggauccggacaucccgacccaagggaggcucggaggacgcacaggcccggccuuccuggagucggccgcagaggggucggucggcgccccagaccacacaggcguggcaguccggagcaacagcaccuccgaucggcucccgggaggcaggcgagcgagcucccgaaucccgagggccagaauggacugucagggccgccuccucccucccagcugacugcuuugcaccgcggagcgcccaggcccgugcugcccugcgaagaccggaccgaggccgccacccuucccgcuccgucccgaccaagaagagguuaccugcgccgcuggcggagguccagacgccacccgaaugaaagggaugaaaagugcggccuccccugaggguuuugggaaucuuuggaagacuuguuccgcacugggugacagcuguucgcugcgcacgcgcacggggcgcc

SEQ ID NO: 12090 - RNA, 36880 nt, Mus musculus
ccgagcuggagacggcgggagcugucgccgucaaguugagguuacugcagacacguucuccuggagcugugcggaagggaggccggaaucaugaccggcgagguggguucugaggugaguuuaggcucugguccgggcuguggaggccuuucgcugagggccgagugggacagucaacccagcagggccagagcgccgagccgggaggacuacaauucccggcgugcaccgcuccgagaccacuggacugagucugggggccucuggagggucuccaucuggcuucccgcgcucaguccccacagcuucugguucggcggcgcgcgcuguuguccgcccagccggguccucagcuugucacugcagcccgccuugcucuuuggcgcguuuccugccgcgcaagcucccuuuacagcauccccacaaaaaaaaaaaaaaaaaaaaaaaaaaaaaaggccuuggccagccuggccuggaaguuguggggugggagucucuguaagcacagggugagggguauaagcaguuggaacucugguucuggaaggaacuuguaagggugucgcgcgugggcccacagucuuugccuacaguggccuggcucacagcguccuuccaguagcuggugacucacuaguggaauuuggccauagaaaaccuuuuccgugaucuguguucuuuucuggagccaggacuagggccaaauaguugccuuaagaacagauuuaauggggguaccagaaaaaccuaaucaccaaaggaaagccuuuuuguuguuguuguuguuguuguuguuuuuuuuuuuuuuuuuuuuuugagacaggguuucucuguguagcccuggccgcccuggaacucacucuguagaccaggcuggucucgaacucagaaauccuccugccucugccgagugcugggauuaaaggcgugcgcccccacgccuggcuaugaaagccuuauuuugacaugaaguuuucacgauuagauauugaacaaaauaacagacuuuaaucaagaucucguugugcaccaaccugucuuuuugccucacuaggauuuuuuuaaaaagccuuaauuuaaauaacauuauuuucaaaagguggcugacuucauaagccacacuuuugcugacucuuacuagaaagagagaaagaaagaaagaaagaaagaaagaaaacaaacauaaaaguaggagacaaagacagggaggcaaaguuagaagaaugguaugugagcacaauuaugacaugagugagugugugugugugugugugugacuaucacagugggaucugaaggauggcucauaaauaaagacauuuguuuugaagccugacagcgugacuucuauccccaggacucaccuaguagaagagauuagauuuuugcaaguuguccucugucuuccuucggugcucuauagcacaccacucccucucuaaaugugccuacacacacaugcaaaauaaugaaaaggggggcuagagugguggcucaucugguaagagcacuugcugcuccuccagaggaccuggauuugguuccugucacccacaaccaucuguaauuccaguuccagagaauccaguguccucuucugacuuucaugaguaucagguuugcacucagugcccuuacauacauacagggaaaauacuccuacacauaaacaaaguaaaucuuuuuaaaaaaaaauuuaaaagggacuggagagauggcucagugguuaagagcccuugcuguucuugcagagaauccuaguucaauucccaguguccacaucaugacuguaacuacggcucuagggugucucaugaacauuuugaccucuacaggcacuucaugaauauggugcacagacauauaugcagaugaaacacuuauaaaauuaauacaucuucuuuucaauugaaaaaacccgaaaaaccaagcgaaucugauuugugcaaucgauguguuuaauaaaaguaaauggagcuguucaguuaguauccuguagcaauuagucucgguuuguguguguuugguuuugguuuuggucugugacuuuaaaugucaucuguguguuacacugucccguuuugguucuucccaguugcagcugauguccccacacuguguguccccauauauacucagcucugucuccuccuuguuaaugcuagguuuauucucauucucuagguuaaccuggaagucaacgaucuaaaacuucuuucacaagaagcagcagacaguccuguagacaguggacagggcagcuuugaaacacucgagcccuugagugaaagagguuuguaauauauguuauguuaauuuuaggaauagaaugugggguccuggguugugagugauuucaguuaaucucauuauuuucuugacuuaucgaauuaaauuguuagugccccaacuuuauuauuuauuuucuuuauaauaaauaaaaaaauagcagugcuuacauauauuuuuaaagaacauccauuccuguuauauaacaggaauaaguaauauguuauuuuuuuauuuuuuauuuuuuuuuaguuaaaaauagauaaaaugucuaauaguuacuucauugccuggcuaaaugcauucacuauagaacaggauuucuaacaccugccaggaugauuagaacaacucuacacauuauaaauguauaaauguauauaauuacauuucuuagcaagagagguuuugccacagaaauuucuuuuaaauauauuuuuagauaugcuuugcuucaaugaguucuuacuggcaguuguguaaucccauaaggugauauaucacauguguaauuaaauauguuuuuaaguagcuuugaagaaggacaaaggacugggggauugggugccuucuuuuuaaaaaaagaaaaaacaccguuuccuccagauucugaugaagagauuuuugugagcaagaaaccuaagagcaggaaaguguuacaagacagcgauucugaggcugaggacagagacgaugcuccggagaaacccaccuacgacgacagcgcagaggacacucaggagaacuuacauucagggaagagucagagcagaagcuuucccaaagcccuggcugacagugaugagagugacauggaggaaacuccgagucaggagaguccugagacucaagaggcuccuuccuuggagccaggccaccagacaggacacucuguggacuucaccaccggcagaaagcucuccaaaacacuccucagagaaggagcugagggaaaagcaaaauccaagagacggcuggagaaagaggagagaacaauggagaaaaucaggagacuaaaaaagaaggaaacaagaugugagguaugcugaaauuuucugaccuuuguaacuguuguuauuguuauuuuugaucagggucucaccauggagccuucacuguccuggaacucacucuguagaccagguuggccucgaacucacagagacuugccugcuucugccucccaagugcuaagauuaaaggugugugccaccauugcccggcuguuucuuucuuucuuuuuauuuuuuaugacacaauuucuuuuuuuuuuuaaaugggugaacaauauacccuugaguauggaugaauauuuuauguaucugcuuguugagguacauucuaaaaacuaauuagguuuuguuuuuuagguagguugauauuuuagaaacauagauuuuaauuccugauaaucauuucugcacacaaaauauagcuuuaaauuaaccucuuugcauaaagagugaugguuauguaauuugcaauuauugaucuucuuugccauuguagaugcauuaaggacauuuccaaauaaaugggguauuguuuucuugguguguucuuguaguaauucuucauuacuguuccucugaugaaguugaccuuugagaggagaauuuuuaaugacacauguaucaaucaaaaguuuacuuguuaacuagaaaauuauccucaaauuuuaucuauuaaaaguuuacuugccgggcagugguggcacaugccuuuaaucccagcacuugggaggcagaagcaggcagaucucugugagucugaggcuagccugguuuacagagugaguuccagaacagccagggcuacccaagagaaacccugucucgaaaaaacuuaaaaaaaaaaaaaaaaaaaaaaaaaaaagguuauuuaagcagggcagugguggcgcaugccuuuaaucccaguacuugggaggcagaggcgggcggauuucugaguucgaggccagucuggucuacaaagugaguuccaggacagccagggcuacacagagaaauccugccucaaaaaaaaaaaaaugauuacuuauuuuaugaguacacucuugcugucuucagacacaccagaagagggcaucagaccccauuauagauguugugagccaccaugugguuggugggaauugaacucaggaccucuggaaaagcagucagugcucuuaaccacugagccaucucuccagcccauccucaaauuuuauaaaguaauuaaucguuccauacguauuuaguugauuuuccaagacauauuuacuguuugcuaaguaaauauuggguaguuauauaaaaaccacagcuugaguuucaaaggguaaguguaaguuaggagccagugagaauguuccagaugagagacaguuaaauuaccauaugcugcugugagaugcuaggcuucaaagugauuugauggugcauucucuuuauugucuaggaaagugaugcagaccggccgcuuaaugacaguggcugucuccuugaagauagugaucuuuuugagacagguuuggaggaagaaaaugacucugcacuggaggaugaagagucguuagagucaauaagggcggcuguaaaaaacaaggugaaaaaucgcaaggcaagucaagagccagcccagcccagccacugugucagucucugucucacgguugcauuuauuguuggagcuugcagacuuuaaacuuaaaauacuucucuguauguggguguuuugcuugcauguaugucugugugugcauacagugcccauggaggccagaagaggguguuagaugccuuggaacaggaguuacagaugacuguaagcugucuuguggaugcugggaacgaaccuuggucccuuguacuugguucuguggguaagaugguuugcuguccaagugugaggaccgaaguucaaaucuucaaagcccagaucacaaagccauguguggucaugagccguaguccagcacuggguugcugggacuuggugaagagacccugucucaaggaagugggggaguggggagggauaagagaguaggacaccucguagccuucucuggccuccauguguacaccaguacacaaauaaauaaauacaacaaacauguauacacacacacacacacacuaaaaccgaaacaaaaaagaggaauauuuuagcuagguuuaucacuauugcuguaauaaacaccauggccagaagcaauuguggaggaaaggguuuguuuuagcuuauaguuguagcccagcgugaagagaagucagggcaggagcaggagucauggaugaguccugcuuacuagcuuacuuuucagaucuugcucagccugcauuuuuuuucuuuuaauuaguuaauuaauuaauuaucccaauggcugccuccccagucucccacacaguucucccccccccccaucuccugcuuccuuucuccucuuagaggguagaggccccuccuggguauacacacuacacacacauacacaucaagucucuucaggguuaggagcauccucucacacuaaggccagacaaggggaacggauuccacagacugguaacagcuuuaggaacagcucccacuccaguggaugggggacucccaugaagacagagcugcauaucuguuacauaugugugguuuggggggcuagguccagccuguguaugcucuuuggcuagugguucagucucugagagucccaggguccagguuaguugacuuuguucgucuuccuguggaguuccuaucuccuuuaggguucucaauccuucccccagcucuuccaugagcagccugcccuuuuauacaagcugggaccaccugucccgggauagcaacuuccacagugggcugggcuucuucuccauuaaacauuaauaagacaguacccacacagacuuuuccucaggccaaacuuagagaggcauuuucucaauuaaggucuccucucccagauaugucuaaauucaugucaaguuaacaaaaaucaaccagcagaaaggauuuucucucuguguguuuguuucauucucuuuuuuuucccgauuauauuuuauguguaugaguguauacauuugcauguauguauauacaugcauucguauguauauuguaugcguuugguaccuguggaagccaaaagagggcauuggauucccuggaacuugaguuauaaacuucugugaacuauaauguagguguuagguccaaacagaaaacuuagggcuauaauuccauuuguaucuaauuuuuuuuuucuuuuuaagcacaguaggaaaacuuuucucugguaauuauuaacuuaagaguaaaguagugugguguaauaagaagcaucauuuuaccagcccuggugguuguacuauccaagauacuugggaggcaggaggauugcaaguucaaagccagccugagaagcuuaaugaaacccugucuuuaauugaaauuugaggccaggggauuuaucucagucguagaacacuugccucgcaugugcuaggcccugaguucuacuccuuauaccaacaagagaaaaacaucuuuuuaucugaguuuaguuuugucuuucuuuaaucgauuuucaaucuuuuagaaaaaggaaccaacucuggagagugaggcuuuuucauuagaagacggaaaugaguuauccaaaggcagugcgaggaagguaaggcacacccuacccacuguuuguacagucucuuuccacaggagugggcguuucucaagaucaauaucguaucuuauuugagucucuugguaaccaagcucuuuccucuuuuuuuauauuuacuucuuuuuaaaagauuugugcuauuuuuauauguauauguuuugccuauaugucuguaugucauauuaauuuuuauguguauguguuuugucugcauguguguguaccacauguguuuugccuguguguaucuguauguaugucuauuuuauguacaugugucuugccuguauggugucugugcaccaccacguguuucuuuuuuuguuuguuuuuguuuuucgagacaggguuuuucuguguagcccuggcuguccugaaacucauucuguagaccaggauagccucgaacucagaaauccaccagccucugccucccaagugcugggauuaaaggcgugcgccaccacugccuggcucaccacguguuucuuuacguguguuuugccuuuaugcgugucuguguaccauauguguuuugccugcauguaugucuguguaccacaugcaugcagugccuaguggccagaagaaggcaucccagcccuugaaccuggaguuacugaugauugugagccaccacauagguguugggaacuaaacccggauccucugcacaagacaagcaggugcucuuaaccacugagccaucucucugucaugcaagggguuucuuuguacacaguaggaacagaaauaaauaucguucauuaggauaaauuuguuuucagagacuugcuaauaaaugcauuccuuauucuuguagugaguguuuagugccaauuccuucucuuccuguuucuuggagacaacgacucuucaggaauaaauaucuuccuggaaaacaccauuaauguaguuucacuuuguuuuguuuuuaaggaaagaaaggcagcgaggcuaaguaaggaagcauuaaaaaaacugcauagugagacccagcgucugguccgagguaauacaagccaugcgaugcagcacaaugggcuuugguuugcuuugguuugcuuugugguuuuuuugucagcucaucuuggauguuggggaguugguuuguuaacacucauaaugugaauucauaacacaugagugugguauaaaauuuagaguuaaacuugauaaauguccauuguuucccaagcccuuggaccauuaauauaaacagaaaauuugcagaacugugguagagcuaaagaggaccuauuuuaaaaaauauuuuaaauuauauguuuguguauguauucguguggggugguguauaugugaguguaauugcccagaggccacaaaugucagauccucuggggcucgacuuauguaagcugcugaccugacggguucuaggaacugaacucugauccucucucagaacaugagugcucuccucccuagagaggaaacuguugucaauggacuggcuacauccggaucccuguaggaaguuugaaacacaugaaauuauuugagauauauaaaggauucuguuugaaaugggauccaagaauauauauuuguuaaaaacgcaggacuguuuucugucucaugguagcuuuguuuuauauuauuugguuagcugaauaugaagugacauuucagaauaugcacaugaguauuuccuuguuuuguuccauuuuuuuagaaucugcacuuaaucuuccauaucauaugccugagaguaaaacuauucacgauuucuucaaacguaagccccggcccacgugccagggcagugccauggcccugcugaaguaagaaccugcuuuccugugguuacagucucagugaauguucaguuuuguagcaucugguauaaaguuuagacuccuuagucccuuaacugauuuaaaccacgcaucccgaguugggagaugagagcacuucacagugagaauuuucaguuccaccucuugucccuucuaggucauguaaguaucagucgggccauuacaaggaaaccguaaacccugcagaugcagcuggaaugggugcugaggacuccagcagagguucugagcagaggacaggggcuggaauugcagcggaaacuaauguucucucugaggucucagaagaagccgggaucacugcuggaucagaugaggcuugugggaaggauccgguaagacgaggagagcuggaaauugaggagacugagaagcacagugaugacagaccuuauucuccuggggacagauccaugucacagcaggaauccuccauccccaggaucgaagacaaugaggggcaucaggcuggagaccucaccgaaucugacccuccugcccuggagggagaagaacugaaaacaguagaaaaaacagacgcaaaagagggaaugccugaacagaaaacccagucugcagcagcagcggcaguggcaguagugacggcggcggcggcgccaccugaaaaggugagacgauucaccguggaccgacuuagacagcugggaguggauguuuccagucaaccucggcugggcgcugaugaagauuccuuugugauacuugaugaaccuaaaaccaacagagguaacccuugaaacagggaagauucucuggggugguuccuaccugcaacuuuugcugcuguggaagauggggagcgugggagaagccagugauugcacaugaucuucuagaugcacuagaagugggcagaauccuguucagaugagguuggcagaaugucaggguaaucuuuuaagucuuuuuucagauggaaaccuggugauaauuaacauacugaggaggcauacugcuguuggguuaugguauuuaggaauuuauuucugccuuuucaacuuaaacaccuagauuuuucuaugacccugugucaaaucuuauauuaaaucauucauaaaaacauuucauuuuugacacccagagagaaacacuuugauccacuuaaauugucugcaaaauugaauuucuuccuccacccccacacucaaaagauacuaaacuaucugguguauuuauaaaaugcucuacuccuuucugggcugacagagcaaggucaccugugaccuuguaagaguccuguuugcaauggaggcauucugucacacaugcagguaaaucagacaccuaucccucacuuaugguacuuucaccgcaggaccugggaagauagcucacugguuaaaagcacuuguugcucuaccagaggacaagagggaguuugagucccagcauccaugucugguggaucuuaacucccuauaacuacagcuccagggacucugacauucucaugucucguguuucucuggcuagccucaagcucacuguguagccaaggaggaccuuggccuucugaguacugggauugcaggcauaccugguuagugggugcuggggauuaaaccuaggacuucaugcaugcuaggcgggcacucugccaauugagucucaucccuucccuagcauauauuacaaacuguuuaacugaguaucagguauuuaguuguugaaacaggaucucucuguguaguccaggcuagccuuaaacucccagcccuccugccucuccgucauaguguuaggaauugguaugugcuggcgcucaggccugggcucucuccaacccuucuuagaaagaaaaaggaaagacacuguaugguucaggcgcuauacgaaagguauauugaaauaguguauucaaauaaaaagacuaaagaagcauucacauggugguaacuaaagccguuuacaucaagacuguaccagucagcaacaacuuguuggcaggugcuaugucagccacggggucugguguguagaguaugcuuggugguuuuguugaauagaugggcuuugugggcuuguagaggugagagaaugauauuuuaggaagauauuuauuuuuuuaacuuuuuuuugagucagggucucaauauauaaccuugacuaucccagaacucacgguguagaugaagcuggccucagacuugcagccuuccuccaccccugccucccaaguccuggaauuacaggggugcacucccagcaugccugagaaggacaguuuuagaaaggacagaagaggcucugcacaguacuuauugagagaagaugagaguuugauuggaacuaguauacaguugaggguuauguaacacaauuagcauagauuccuuagcagaggacaagaaggaacugcuccccacagcaccgaggaaaaccuguugcuaaaugauucuaggaauuaucuaagauguuuugugaguaguccugagcugagauacaggaggaaaacauuuugagaacauaccauauuaauuaaauacugguagauucuuuauuaucuuccuugauucuuauaggccugcgagguuacuuugaaaaaugaaacugaggcuggugaguugggucauuuuuccagcauggcacuuagcuuauauagagcuuagugcgaaaguugccacaggaugcacacuuucuuuuaacucagcaugcuuuccagccgggugcgguagcucacugcacuuuaauccaagcauuuaggagguagaggcaggcugaucucugggagaucucaaugcuagcuuggucuacauagaguuccaggccaaccaggaauagaguuaagacccugacuccaaaaaaaaaaaaguuuuuuucauuuaaauaugauugacaugaaaguucgguuuccagagcagucuuuuucauuguauucuguacaugaccuuggagucuguccaugcaguaaacuuagauuuagcauuugguugggcacugugugugcaaguaagacacaaccccuauauucaaggaaaugaaaauauaauugagauaggcaagcagaccauugugggacuggaugguaaguaaagcgaucaguuugugucacuggagaagaugcauaggagccguagagcacgugacaccuacuuggauuggagauucugggacguuuuagaaagaaagagggagaggaaaagagaaagaguuguaacgagaauuuugguuucuuuaaaaaacacagaaauagccaggcgugguggcacacgcuuuuaaucccagcacucgggaggcagaggcaggccgauuuccgaguucaaggccagccuggucuacaaagugaguuccaggacauccagggcuacacagagaaacccugucucgaaaaaccaaaaaaacaaaaaacaaaaaacaaaacaacccacagaaauaaucuaagaauauguuuucaguuuaaucccaggugugagauauggggcuuuuucagauuguccauggcagcugaccaugaugauuaauuagucucaugcucuagaaagggugugauuuugccaacugcggauaugucugugauugugcgauguuuggaauuugggggacucuugaggguauaucagaggugggaguugcugucggucacaguuuguuaaauaguugugcuugaagaaggaacaacaagaagaaauuagauauccugaugguagugaagaucaaacuugcuccgaggaauuugacagccccaauuggcaggaagcagucgaacgacaaugccguccucuuuccccucucucccugauucucuccuaccaaguguuagggguugaaaagauagaagaaggggguggagaaagguggaagaaaaggaguccacaaaguaacauaagucuggcuacacagaucccugaaaccugagguagagauggggaaagacagcuuuucugguagagacaauugcaaacgacacagauacuagaaaucaggagugccggcugguggacuucaaggugguaggggcauugaugguagccuagauccagaagggcuuugggaccacuuuagagcgguagagcuucaguugagccuuuucuaguaaaggacuguugaaaauuuuuguuuuaagcagggaaauggcucacucacuaauuuuaggaaguucaagcugauaacuagcacagcugaugccuuguauggauuuaagauuaaaauuuagagggcugggcaugauaccgugugccuguaauucuagcacuuagaaggcagaaaaaggauuauugaaaguucaaggcucccaugggcuauauagcaaguacuagacuagccaaggcuacauggccaagaaccuguuucaaaaacagaagaaacagaaaagggggcugaagagauggcucaguaauucagagcaugugcugcucauacagaggauccaaguucagguccagcacccacaucugggcgcucauacccaucuguaacuccaacacugggggaucugauacuuuggccucuggggcaccuguauucaugugcacuuacacaggcacacauucacacaugaacauaauuaaaacuuuuaaauagauuucaaaaaguagaaacaagaaagaaaacagugauuuaucacaauuucuuuaucucauagagaaaugaauguagauuuaaauuuaaauauguuauuccuauucuuuaugagggcacaggaaccuagugggaaugagagcaguggaccagagcuacgggcauagacuugagcuggggcagagguuuuucacuugaagagaugagauacuaggaaaauggagagaaggagaguaagggaugggugagucagguaauaaaggcgaaggaaguggcugccucaccugacuccaggcugaagagcuugagagucgucacauucucuaauuaugaaugaagacacuuccuugauguuauuuuagagccucggugaaaccuuccuacucaacuguuuuauuuuauuagcaucaauagugaucugccuauuucuguucucuuucugcugguaccaccuguugcuuccaacuuuaccgagucacuauuaauaggaggcagacucaggcuuucucucacuguucuuuugucuguuaguagauacaccaucuuuuagagcugggguuuuacugcugguaauuguuagaggcacaauaagaagauuuuguuuccuucucuagggaaaguaaagaacacuuguaggccauaaccauacagccaauggcauggaucugagugcaugcuuuuaagaagugaaccauuggcugggugugaugcugugcgcuuagagccuuagaugguggaggcagaaagauugauacuuuaagauaagccugggcaacgugagacccugucucuaaaaauaaacaaaauaauaagauccagcaaaaaaauaaacuuuuuauauucuuuaauuaaucuugccucuuuugagggggggggggguuuguuguuuuuguuuucguuuuugagacaggguuucucugugcaguccugacuguccuggaacucacucuguagaccaggcuggccucgaacucagaaaucugccugccuuugccucccaagggcugggauuaaaggcgugcaccaccaccgccuggcuaaucuugccucuuuuaaaaaguuauuauuuguuugauuuuacgcguaugugcccgaauguaugagugauccacgugugugcaggagccccuggggucagaagaaagcacugaaucccucagaaugguacagguaguuguuagcuaccaugcgggugcugggggccgaaacaaacccaaucccagguccucugcaaccagugagugcuccaaaccacugagccaccucuccagcucuaaauuauacuuguuuguugagacagugucucaauguguagcacuggcugacuuggaacuugcuguguagaccaagauggccuugaacucacagaguccaccugucucuuuaaucccaaaugcuggaaucaagguauucaccaccacaucuggauccaauuaaccuuuuuaauagcugaaaugaaggcaguuuuuuguuuguuuuuuguuguuguuguuucccuacugauuugauacuaaaaaaggaacugagggcugcagagaucucagagaguaaaggcacuugccaccaagccuguuggccuggugaucccugcacccacaagaugagaagaaaggacuaaagcuuguccccugacaucacacagggcugcggcaugcguuccuacacacacacaauaaauaaguaauacaaacuugcuauuaaaagucugguuuuuaaaccagagagagauagagggagagaacagugauagguuacagugcauuaauuuugugcaggucuuaguagcaaggggaguuugguuucucuguuacuuuccucacuacuguuaagcuggaaaacuuauucuuaacugggaucuucacaugagcauggcacacugacauacuggcucacauuuggguuuagaauuggaagccuugaagcaacguuucuggaggcacgcuaacccagcagccagucccagggcuugucagacggugaacgugaacaucaucgugaaggacuugggcacuaacgggaaggaggagcugaaggcagaagugguacccgucacuuuggcagcagagaagcuggagggagcaagccacgcaaagccagguaguugucuuuacugugaaaagccugugguaggaagucacaggaccuuuucccuuuggagacuuagagauugaaccaugccuucaggaugauucgaagguggcacggagagagaugggggugggccagauagcuuucauuuuuuaaaaauaguauuuaccuaauuauaaaaaguaauaaauauucacuguagaaaaagagaagccaggcaugguggugcacaucccagcguuugggaggcugaggcagaagacuuaccacuuuuacuauauuacuuuuuaacuguuugucuuuauguaguaaguguaucacugucuaccucaugacuucugagccagagacuuuuccagugcugagacucagacccagggccccuugcuugcuaaccacaucccuaucccuuugagcuagagacuucugaagcuuccuucccuuccuuuuaacaguuacucauaaucgccuggguacagacauucucuuuuauacuauuccauacugaaauaaguaaaagccuaaagucuuggguuuuccuuuuggguguucagaauacaaauagaguuuguauuaaauugcuuacauuuguauucaguugcuuaaauugcgugguuauuucuugugccuuguagccugucauacccaaagcaugucgcuauuuuucuguucaggugaaaaacugcagauguugaaagcuaaguugcaggaggcaaugaaacuccgaaggcuugaggagcggcagaagcgccaagcauuauuuaaauuagauaaugaagauggauuugaagaggaggaggaagaggaagaaaugacagaugagucugaggaagauggagaagaggaggugggagaggaggaggaggaggaucaagacauucaggagguuugggaaauuauauaauuuuguuacuuggcuaugaugaauacgagaaagauaagagcuaagguuuacuuauuauuuauguguauggguguuuuacuuacagugccugcagaggccagaagaggguacuggguccucuggaacugcagacaugguaguuguuagcuaggugcugggaucugaaacagaguucucugguagaguagaaagugcuuuuaagugcugcaucaucuuuccacccccccccaccccccagggugugugugugugugugugugugugugugugugugugugcgugcauguuuugccuguauguaugcguguauaccaugugugugcuuugcagauggaugaaaauagcuaucuguguguguccucuaagcucagcacauacaguucuuuuaccauuauugaguaccugcaguucacagcuguguguguccuguuucuaccuguuaguuuauguauuuugauauagugcuauauugaaaauaacuuuacuaauaaggacuuuucugacugucauugacugaguuugaaaagcaauuguucuucuuuaggcugaggucagggaaaguucucaggcaggaggucuuucuaacuucgucccauucuuaguaaaggaggguguuuauggaagaaccucuggcccugucucauaguagcuuugcagcucagggaaggcugguauccguuauauggcuauucggugugaaaagagcuuucuuuucaguugaaagacauuguaaguccuuaacccugaguaaagaaagagcagggagugucugagcugggcagcacauuguauugucugugccugacuaggaugcacagucaucuuuccucuaggcugacuacuuuccuacugccuuaguaacaugccaguauaaucguccuucauaauuuuguagcaauuugaggaguauggaaagcucuaaaagcuaggcaggugugguggcacucacauuuaauccuagcauucaggaagcagaggcagguuggucucuguaaauucaaggcuagcuuggucuacagagugaguucagacuagucagggacccaggcccauguggugagaugcugugugaaaaacgaagagaagaaaaagaaaaaaacccacucugucagaggagugagauuacugauagugcuuggacuuaguuuguuuccagucaccuuuucaggcuugagcuguagccuauaaccaagaauccacauuucaggcuagguguggaauuacuuuuaacauuuuuugacuuguauuauuauuauuuuuacaugauuggcauagacuacagaauaucuucuugguagugaagauacagaaaccaaagaugaaaaagaaacagauaaagaaaauacagacaccaguagugacauuggcaagucuguugcccucuguguccccaagccucucucuucagacuccaccuuacuucuguuuaaggacagcucuucuaagaugggguaaguucuuauaaggaaauacaaaauucuuuuggauuucugaagacuuucuuaaaggugugugagugugucugugcacggguaugcgcacacgaguguaggugccugaggaggccagaagagggcacuggauccacugcagcugggaaccagucuuggaaccucuagaagagcagugugcacucuuaacuaugggccauuucuccagcccauccuugaauuuuuuuuacaagagaauaggaaguaagaacucagcaguuuacuauuuuauuuuguaguuacuuuccuacugaagaaaagucagaaacagaugaauacuuggccaagcagucugacaaacuggguaaguagugauccuuauguagaacguuucuuuaguucugauauguaaaggccauagucucucaaaaguuucuuccuuccuuuuuuauucuauuaauagcacauucuuacauguagcaauggcagggauuuaugaauuaaaaugguuuucauggcccauuuuuuguuuauuuuuuuaacauugacuuacuuuuacucugugagcaugagugucacaccugugugaaugugugugccuggugcucacagaggccggagaggguccuggaccaggacuuacagaugguugugagcuaucaugugagugcugagaauugaaccugggucgucuguaagaaaguaagggcccuccaggcccugggcugcaugucuauaguugaccauggacauaggguggauccugaguggguguguguugauuuguugauugagugacacaugagauaguuuuaugcaaagaucacagagaaguauguauuuagacagaagagaaggaagagaguguccgcgugucacugagcucagaguaaugagcccuaaguauacaacacucuugucaggaugaccuggagccuagaacuuaagugauuugccagugaauuucaccuguucgauucucugcucucuuuucuaaacaaauguaccucguuccuguguucagaaugauaccucucuccucuccuuuagaugaggaugacucgaguucacugcuaacaaaggagagcagucacaauagcagcuuugagcugauugguuccacaauuccauccuaucagccuugcaacagacagauaggccguggggcaaguuuucucccuacagcaggauucagaucgccguccccugggcuguuccgagggaguuugaucagcucggcuucuaagguaaggcggggagaguuguucucaucucuguucacugcccacauugcuaaauagagugcgucccagccaaccaacucccaccaccgaggugcucagcuuuagaaauccacccgcuucguguauuagcaggcguucuugcuuacagguaguuuuccucggguucuguugacaguacauugucuuccucacugugguugcuugagagcggaugacauauugcaaguagcaacuucuguuguuguggugacacuggauggcauuugugaaauguuuugcuuuuguuuuuguuuuggugccagaguucaggaaaacugucugagccuucacuucccguagaggauucccaggaucuguacaccgccuccccagagccuaagacacuuuuccuaggagcaggagacuuccaguucuguuuggaagaugacacucagagccaacuguuggaugcagauggguagguaguuuuguguuucugugggugggaauaaggcugggugcugcuuaauuuuguuuaaaaauaaaaugagcuucugccacuccaucugcgcuuucucuucugagaaagagaagguguccuggccauuagucuuauauuccacgaguuugaacgaagucuccagaaaauaaaauguaaauaccccuugcuggcauuccuauucucugaucucauuucauauacacaguccuuguauuauaagggcuuucgcuguucauccccuuguguucugauuguuggguaagauuaggauauaguacccaucccugauauaucauuagaagccaccuuuauaccuuagaaguuagucuuuauaccucaccuuuugacaaaccuugcccguccucccugucuagguuagcaugaggcuaaacuuguugccuggguugaggcccaguguuaguuacuggucuuguggcucugacaagauccugagaaagccucuaaaaaaggagguuuacuuugaguacugguuccaguggccaucgugugucacagcggggcagucauggcagcaggagcacaggcauggggcacaucgcccccacagucaggaagaagaaagagaugagugauguucaucuucuuuucuccuguuuagucagucccugacccuggcccauggaauguaccacgcaccguuagagugggucuuccugccucuuuuaaucuaaucuagcuaaucccuugaagacacacccagagauguguuuccguggugauucuaagucccuucaccuugaaauuugagaucuucacauuuagcuucuugguuuucuuuuuauaauucuucaaaauuacauuuuguuuaucuuguguguguacaugugugagcacagaugagccaccguauacaugagaaggucacaggacaacuugcugaaguuaguucccucuaccuuguggauucugggaauggaacugaacgccucaggcuuugcagcgagcaccuuucccacucagcggucuugcuggccacguucagcuucuaacccuggugcuggaagucaggagguuuuuaccugucguuugucucuccucuggguaauuuccgacacuucacuguacucguagauuuuuaaacauuagaaaucaccgccaucgauaucaggcugugaagccccaguugccacuggccagcauggacgagaaugccauggacgccaacauggacgagcugcuggauuugugcacuggacaguuuacaucucagccugaggagaaaugucaaccaaggaagaaugacaaaaaagaaaacauggaggaacuuuugaaucucugcucgggcaaauuuccuacucaagguaaauguucugcgagaguccagguagcacagcgagaauucagucagcucaugucaccguccccggaaagaagcucuugcccccucucuguaagugcacagaaaacagggaugggauggaauccugccacuuccucaccuuuacagugacacugucaacuuaggacugcuuuagcuucagcaucacaguguauaacuuaaucucucuacggagguuagaacagugucugguggggaguaaacguugcaugcuugcugaaacaggaagugggcucucugagguaauuggguguucauuuuguucaugacugucuuccuggggcucagcacacaguaaauaugaggaaggauuuguugaaagaauggauggugaacuuuuccacaucccaccuaagaacugaauugagcugguggguacauagauggccaggagagcagagguggcguuuccuuccuuacuggccuuuccuuguugagguagaugccuccccgguggccccacuggggcugaggagucaggagaaggagagcagcacagaagauccgauggaagaggcacuugcucuuugcuccggcucuuucccaacagacaggugagucucaaagguugucgggaacgcaggaagaugaaacccuaggauccgcuggcauagugaugcacaccuuuaaucccagcacucuggagacagaggcaggcggaucucuugaguuccaggacagccagggauacaccgagaaaacaaaagcaaaaaaacaaccaacuaagcaauccuaggauccgguucucuguguuuagcaacaaacuaaguaacuuugggaaaggcagaucuuuuaaggugacuacaguuuuuauauaaacuaaguauuggcaaagaucagggaaaccucugcuuguucuuggugagcugcuagggaaacaaguucagugguuucucagagcugauaauagaauugccaucugauccagcagcuccacuuuggcucuagagaagucugagugguggcacaugccuguuaccucaaaaagaaccucagaaagccuagugugguaugugcuuagaauccaauagucuagaaacaggcaagaaaaucaaguucaggccagguaaguggcucagugucaaauacuugacaccaagccuaaagaccugaguucaaucccuagugucuaacgaggugggaaagaaccaaccucuacaaguugaccucuggccucuuuauguaguauaguaguuauaacguguguaguuauagaugcacaugccuguacauucacacacaguaaauaaauaaauguauaaauaaaugaaggcaagaagggugaggucagcccugcuacuccuuucuuauaccuaaaugaauaaaacagguuuuuauaauuuguguuuaacauaauuugauaauagccaaaauaaagaggaaguguggcugcugacuuguuaagguuauuguugcugugauaaaacaccacgagaaaaagcaaauuggaagggcuggagagauggcucaguguuuaagagcacugacugcucuuccaaagguugugaguucaaaucccagcaaccacaugaugguuuacaaccaucuguaaugagauugaugcccucuucuggugugucuaaagacagcuacaguguacucaccauauaauaaauaaauaagucuuuuuuuuuuuuuaaagcaaauuggggaggaaaggguuuauuuagcuuacucuuccucaucacuguucaucaucaaaagaaaucaagacagaaacuuaagcagggcaggaaucugaagacaggagcugauacagaggccauggaggagugugcauacugacuagcucaaccugcuuucuuauagaacccaggaccaccaguccaggaccaccucagugggcugggcccuccuccaucagucacucauuaagaaaaugcacuacaggagcuagagagguggcucagugguuaagagcacuggcugcucuuccaaacaaccugggcucgauuccuggcaacugcauggcagcucacaacucucuauagcuaggguucuagaaucugacaucuucaugcagacauauaugccggcaaaacaccaaugaguguaaaauaauacagugaaaagaaaaagaaaauguccuauacacuugcguaccacucugucuuauggaggcauuuucucaauugaggcucccuccuccaugauuauagcuugugucagguugacauaaaacuagccagcacaucugcuaaauagaauuuauaugcauuacauggcuuuaaaaggaaggaaauuuguuuuuguuauuugagaccaggucuuccuaugcagcccauacuggccuggaauucacuguuaguucaggcugaccucaaacuaguaauccucugcuucauccaccaaguguguacaucaaacccagccaauaggagggaaguaugacacaugcuucaccauggagggaccgugacgauaugcuaggaacaagaaacauuugucacugagggacaaguacuguauaagucugccuauauagucacuggaguaagcaguuugacagagacaggaaauuagaugguggcuggagaaagagaggaagauuugucuaauaggcguagaguuuuuacuaccugaaggacuucggagguugcuuauauaauagucucaacguaauuuuuucuguuuuguuuugagacuaggucucauucuguagcccuggcugaccuggaccucacucuauagaccagauuagccucaaacucacagagauccuacuuccuucugucucccaagugcuggaaugaaaggccuggaccacuacacccagggaugacuagccuuucuagucaguccacucugagcauccuuaucucugccuuaugaggcuguaauuacaggugggccacucugccaagcuggcacugaugcagguucuggggucaaaacuccaguuuucacaguagcaggguaaaugcuuuagcccucaggcucaaaacaccuuuuuaaaaagacaaaauaccucauuucccgcuucuuaaaagaaauuucuggugcugaugagugucuuaaguccuuagcuuggcuggcugcuuguggugugcuuucaguaacuuaguguuuuguccucuagggaggaagagggugaagaggaggaauuuggagacuuccagcuuguuucaaaggagaauggauuugcuagugacgaggugagugcagagagaguacaaccaagcuccacucggugcuccccugcccucguucuugagaacugagcuuagcgucuuaccagaagcaguguccugugcugaggcguggggacagaacuuuauaaacccucuuguugccuucugguuuugucucauggcgcuggagcucaaaccugggaccaugugcccgaaauccuagugcuuuaggaggcugagguagguuugugaguucaagaccagccugugcugcacagcuagacucugucuacaaaguaaacaguuuaggaacagggaaaagagcacaggacucuguuccgugcuuaaggcguggcagcacucccuuacugugaucccuguugucgguguguaacugaguuugcugcucugccguggcaggaugaacacagugacuccaaugaugaagagcuggcccuggaccuggaggaugaugaagaagagcuccugaagcagucugagaagaugaagcgccaaauguagguguucuguccagcuucuagacaguucucccaaguugagguauagccugcuaccuuuuuaaauaaacuugcugguuugguuucugcuuuucgagauuaacauuuaaaccaguccuucauggccuugaggcaaaugaggugacugagcagguaaaagugcuuccugugcaacccugacugccaggaaggcagucuagaucccaugaugaaagcagaaaaccaauuuccagagguuuuccucugaucuccacacuugugccauggcacacauaugcacaugaauaaguuuuuuaaaacccuucuguggccacuucuuguuuuguuuuuuggguuuuuuuugagacaggguuucucuguguagcucuggcuguccugaaacucacuuuguagaccaggcuggccucgaacucagaaauccgccugccucuuccucccgagugcugcgauuaaaggcgugcgccaccacgccuggcuucuguggcuacuucuugcguacucaaagaugguucuauuuuccuuaagugacaucaauaccaaauaucucucaauuccucccagacccaaugacauuucaguagcguugcuuccuacucucaucguguccuggaauagucucucucuaaucaggugugcucuggcuguuuguuagauggguauuagucaugugacccaagaucaggagaacugagucagucccuaugcccuaagacuaugcugauaacugaccuuggcaggaacugcuccuaugaagucugucauuccugguuuucuugauucucgucucagacaaauggccugcuuaauuuuuuuauauuuaaaauauuugucacucaugagaguaaaacuuuuagaguauucaaaagaauguaugagcuggggauauagguagaggacuugccuguaugaaugaggcccugagcuuaaucuccaccacauacuacuaaaaacauaggugggugggugggugggugggugggugguggguaagcuaauggagggauggacagauggacagggauuggcagugaagcucaauaguaaagcacugcauaguauguguaagguucugguuuauccccagcaccacaaacgugaagggaaggaugggggggaggagggaggaaagcagggagggaacuguugauaucaauuggccagaaugugugugaaagcauugguaguacauuuccucauaacaucugggauuuaaacaauuucuuuguguguuucacuuugcaucuuuacuuucccucauagcauauccauaguaucauaaucuuaagcaguuucacaaagguaauuugauaaagauccaguagcuuauagcaugugcaugacuuuuccauucaugucaggacgucauauugaucucuauuagauuuauauuguugcuuuuggccugucauuucauccucuuaagauccagcugggguucucauuugucaccugucacuuuaacuuuuuuguguaacuuuagaauauaaccaggucuuuuaacccccagagguaguauuuguuaaacuuauuuaacugcagagauuuuucaaaucaguccuuaaagaauggcaaccagcuaggcagugguggcgcacgccuuuaaucccagcacuugggaggcagaggcaggggguuucugaguucgaggcuagccuggucuacagagugaguuccaagacagcuagggcuacagagaaacccugucuugaaaaaccaaaaaaaaaaaaaaaaaaaaaaaaaaagaauggcaaccaaagaugaacugucagcaacauuccugagaagccuggagacuaauggccguugaaggaacucuccaggaagccuagcauuuagagggaaaauacaauauaucucugacuaagaggucaucuuucaagcuaggcacaguggccgugcauuuaaucccagcaccgaucuacacagugaacuccaggacagccaggguuacauaaggagaacuugucucaaaaagaaaaauaacucaucuaucagacccaccaaauuucugcuucuugugaccauagagaagaggacuuugaaggcugccuucuuaaagagaaugaaguuagaaaaauuaauaggccggcggguggugcagaccugugacuaccuacuugaaugcucagcuaggacaaugauacgucaaggucacccuggccuacagaguuuuagcuaucccaggcaacuuaccaagaaguaucucaaaauguaagaguagagcugaaguuuagagggcuuuagagaacagccucacuugugcaaggcuauacacucagucuccagcaccucaccagaaaaggaacuagaaaagacaaacuguaauagugucgacaacagggaguucuggucuugcuguaucagacuguucucuaagcacugaugagcuuaaauacaaaacaaauaagugugaaccuucuagcagguacuccuaaauauguaguaaaaauuacgaguuuucugggaccaggugauggcuuuaggugaagcugcuagcuguacaagccugaugaccugaguccgauccccagaacccaccuauuggaaggacgccagcaagccagcugggugugucggugugcauuuauaauuccccacaacauaagagauaggagaauggaggacuggagagacggcucaguaguugagaguacugguacuguacuuccagaggacccaguuucaguucuuagcacccacaugguggcccucaaccaucugucaccccaguaacaauggggucugacauccccuuuuaucuucuguacacacugcaagcauguggugcacaggcagaacacucauaaaauaaucaaguaauuuuaaauguuuugguuuuggcugguugguuugggguuugauugauugauugauuuuuuuuuuaauuucugaaagcuuuuauuaauuuauuccucccaaaagaacaacugcaaaggaguugaaaagucaagaauuuauugucuucauaacaaaaucggcuuagaacuggaucaccuggcccuuucucuucuugucgccucccaguucaaaaugcuugcaucucuuaauagccagcauccucuuagaucugcaguugggcucaacacacuccagucucagcacaaucuucuuuguaguuuuagccuuuuuaccauagccacucuguuuccugucauaacauacgccgcuuucccugggcauaaaaagaguccuugcccuucuuguacugugucaccuugugggccgggugcuucccacauuucuuggagaauguccggcgggucuuaggcacguucaccauguucgcaggaucgcuaucagcucggaaugaauugauugauuuuuaaacagagucugucagaaugaccugggagcuuggaggccagcuagccuggacuauacagugaagcagcugaaacagagaucccauaacacaguggaagccugcaggcacucacucacacacaacauacauuuuuaaaguuuucuggcuguaggauugcccaagcuagguugaguccaucuccuacaugggaaccgguuggucucucugagccuccuuacacgauuucuauuuuuuuuuuuuuuuagauuuauuuauuuauuauauguaaguacacuguagcugucuucagacacuccagaagagggugucagaucucuuuauggaugauugugagccaccaugugguugcugggauuugaacuccagaccuucggaagagcagucgggugcucuuacccacugagccaucucaccagccccuuacacgauuucuauaugaacaacucuagaucccuccagaacgagugguauuuuuaggguuauagcuucuagucuccuugcgucuuaggcauucucuuuauuagcuagcaaaugacacgagguauuaggcuaauggugucaccuguaaaguacagcaacuggcacaugguccggguuaagugugcagcguuuaaauaucaaaagaguacuuuauauuaucaaaguguguuauuauaaauugaaaccuacuauuaaugguucuacguucugcuuuccuuuauuacuaacccuuuggcucuucccacauguauaucaugcuuucugcgcacauuccugcgcccucucucauucuccccaauccugacagcugucaccccaccccucaccucaccauccuacuuucagcuuuguuuuggcucugauuuccuggguuugaugagggcugucauguggggcuguccacugggacagggauaaccauggggguuuucugcuuuucuuacuguauccauauucuguguguguccacugucucgucucuaaucuuuccaauugcuuucuaggagacugaagaaauacuuggaagaugaggcagaggugucaggcagugacgugggaagugaggacgaguacgauggggaggagauugaugaauacgaagaggacgucauugaugaggugcuuccgucugaugaggagcuggagagucagaucaagaagauacacauguuaguauucuaacgagcccuucuaagcagcaagacgcccuggggcagccuuguuuaccaggcagaauggucccgguguccgacaccuuguuucuguuguaggaaaaccauguuggaugaugauaagcggcgacuacgguuauaucaagagagguaccuugcugauggggaucuacacagcgacgggccuggacgaacaagaaaauuccgauggaaacacauagguaucuugguccuuuagaaagaaaggauuccaauguacauauuuguccacuuuaagaugguaaauagcaaucagaacuaaaccaggaggcuggagagagaugcuugccuagaaacagaugcucugaguucuagccucaguaacacauuagaaaacaacugggcauggccgugugccaagggccugccucagcuugaagaggguuucugaccaaagggguaucugcgagcaguaucaaaucuuggguccaagcugacuguucuccuguguucugcucuccagacaguucucuugcuauucuaaaaacucuguggauaguucaucucuugcagaucaaaagcccaaauuuuuuuuauuuugcauauuaauucagucauuaccccauuuugauuaucccaugaccccagccccuugauucuuagagaaaacaagcacuuacacagacaaugagauagcuggggggggggccucgcccugaaauuaccauguugaucaugccuguaaacuagcucugucccaggcuaaccuggaacacaggaaucaacuuagcugggugggaucuugccuuacgaucauugcucccuaauuuuccucaucucccuccuuaguaucuuucugaccagcuggcucauagugcagcugccucuguccuuuagauccaugaaacuccuuauacaauucguauugcauccuuauauuuugcguaguugagaacuuauguauuuuugaacucauguuuucagcauucugucccacagccuuaagggcguccugagggucauuuugcugagacauagacauguccuugccucccagacucaugcugucucugauuaucauggaaucaguaccuuggcagaggacauuccucaaaggaggacugugaaaauauguacauuguuaaacaaacaagccucucaccccccaggaaaugucgacacuugacacucguggaggcucacgcuccuggucagggacggaaaccaugucagacugucccuuccaugaccaagcuggacuuggcaguggugccugccuaugagccuaagguuugggagguagagggaggacaaccgggaggcaggaucauccuuagcuccauagcaaguucaaugacaaccgcugcuugcaacccuuucuggaaaacaagcacaaacagaaaaaagcaccaggcuguguggaagauguggcuguauccacugauuuccuuuuguggcugggaaagguuuaugucaaagcguucacagauagggguuugguuugugucugucugagcacucccucugugaggauucccgaaugcuagcuaagcgccuuaccucucuccuuuagaugauaccucccagauggaucuauuucacagagacuccgaugacgaucagguugaagaacagcuugacgagaccgaagccaaguggaggaaggaacggauugagcgagagcaguggcuucgggaacagguagaaagaguccaagaaaaucgccuguucugacuucaccugccauauaaacuuagcaacaacauauuuaauccuuuuaaucuugggguuugcuucccucacacucgccccccccaccaccaccaccaccacacacacacacacacacacacugaaaaggucaccauaaguaagucucuggcuaacuauccaauguuaaaaaauauguauuuuagugauaggaguuguaucacauuccuuuaaucccaguaucuggauggcagagacagguagaucucugugaguucuguaugugcacgugaaagacccccucugggagucccuccuuggggaggcgcgcacccaguaggacacugagaccgaacucgcuguaacuacaugaggcuuuaauggcacacaaacacacaaacaacaaaggagcgcucaagccagcaugcuggggucaaaacucaugcaccgcgcagggggcaggggaguucgaccccggcccaaacuuuuuacaggcuuauaaaggcaaaaaccacaaaccaaaaguggggagccaaaagaauuugcgcgguuacacaugauuggcuuauuuaaauguuggcggggugauuucaaauuaacaggguaguaugugccggcuaagguguagggaggcacaagggcuugggacuucucgaggucagcagaacaccuggucaauguaugauuuauggggggcuauagggaggcgccgcccgggaggcgccauccugccagauggccauuugguccguccugauagcccuggcuaguuccugcauucucuuuuuuaucuuuuauggcuggacauucuuagcuacaggguggguuuggcugugccuggacccgccugggucuauucuucagcccugaauuucuugaacuuagauaccacaaugcuauaagacccaaaauuauaaguuuuugcucuucacacguggggucggggagagggguguguuugaguacagugccuguggaggccagaagaaggugucagguccccuggaguuagaguuccaggcaguugugagcugacugccuacaugcaugcugggacccaaaccuggguccuggagaggagcagcacauguuucuaagcacucagcugcccuccucaccacucagacaucucuccucaccacucagccgcccuccucaccacucagccgcccuccucaccacucagccgcccuccucaccacucagccacccuccucaccacucagccgcccuccucaccacucagccgcccuccucaccacucagacaucucuccucaccacucagacaucucuccucuccacucagacaucucuccucaccacucagacaucucuccucuccacucagcccccuccucaccacucagacaucucuccucaccacucagcugcccuccucaccacucagccacccuccucaccacucagccgcccuccucaccacucagacaucucuccucuccacucagcccccuccucaccacucagacaucucuccucaccacucagcuacccuccucaccacucagacaucucuccucuccacucagcccccuccucaccacucagacaucucuccucaccacucagccgcccuccucaccacucagacaucucuccucuccacucagcccccuccucaccacucagacaucucuccucaccacucagacaucucuccucuccacucagcccccuccucaccacucagacaucucuccucaccacucagccgcccuccucaccacucagacaucccuccucaccacucagccgcccuccucaccacucagccgccccccucaccacucagcccccuccucaccacucagacaucucuccucaccacucagccucccuccucaccacucagcccccuccucaccacucagacaucucuccucaccacucagacaucucuccucuccacucagcccccuccucaccacucagacaucucuccucaccacucagacaucucuccucuccacucagcccccuccucaccacucagacaucucuccucaccacucagcugcccuccucaccacucagcugcccuccucaccacucagcugcccuccucaccacucagccgcccuccucuccacucagccgccucuccagcccuucucugcuuucagucuaaggcagcaaagcuuguaacaaggagaacaaauggcagcagccaggcuucauagccuagccugucuucuuucuuauauauaucauauuuuugguauaucuucuuuuuguauauauuacuauuuuuugcuuguuuugguuuuuuugggacagcaucuuacuaguaucucuguccuggaacucacucuguaaaccaggcagccucaaacucauagacauccaccugccucugccuccggagugugaggauuaaaggcccagccuuuaauuuuauuguaauguauaugggcguuuugccuacauguaugucugugcaccacaugugugccuggugccagcagggcccagaagagggugucagacucccugcaaauggagcuacagacaguugugagcugccauauggguucuaggaguugaaccuguauccucuggaagagcagccagugcucuuaaccacugagccaucuccccagcucccuuacacugacuauuuuggaaagcugaagguaauguaauguugcaugaguuuguuuuguuuauuuuggaggcagaggcuggucucucauuauguauuccacacuguccucgaaaccugccucagcucuccaagugcugggaucauaggcaugagcuauaccuggcugggaucauaggcuugugcuauaccuggcuaacaccgugaucuuccugcucaggcucaacaggggaaaauugcugcugacgaagaggacauuggggacgacagucaguuuaugaugcuagccaagaaagucacagccaaagcacugcagaagaauggugagcucuuccuucuuuuaugucuggcagcuuggaucgugagugcuggugccuuggaggggacucuaaccuucagggacuguggcagcuaacauaagccauucuguaauacugucuuaaaggagccauugaggugaggagaggcagacguugucucuuagcuguuggucaguagaaacuguacuuggguuuauguagcuguuuuggcucaaguguugaggcuuggccggugaauuguggcuucucucugaguugcccaggauuuauccgcucaguuauuagggcuggcaucugaacauugguguaccaaccugcagaaccauuucucucauaguacuccacagcaccaacgacuguuuucucuuacauuagucuuuguucaugauuaacugacaagcucagcuucauuguuuccuuagugacacuugcuauagucuuaaagucaugaguauaaaauaaacaagaguucuuagcuuguuaaauauagcaggaauuauacccagcuuugcccagaacacuucuuucuguguuuucuuuccagccagucauacugugguuguucaggaaucaaagucugugcucagaaacccuuuugaaaccaucagaccaggaggugcucaccagguuaguugggacuaugucaaucugacaucauggucugcagaucagucugucguccagggaggggggcgcacacagggcguggggggucagucaggacgugcagaucagucugucguccagggaggggggcgcacacagggcguggggggucagucaggacgugcagaucagucugucguccagggagcgggguauacacaggacgugggaggucuugcguagguggaaaugcauccccucaguaccagggucagggugggcggccagggauagacgcccuucuucuuguuggcauugugguuugauagcagguaacuucucucuucagcugaagacaggcucccugcuaaaccagcccaaagcugugcuccaaaaacuugcugcccugucugaccucaaccccagcgcuccccgaaacucaaggaacuuugucuuucauacacuuucucccaccaaggcagaggcagcaaaggacucaucuaagccucaggugggauuauaugugggacuucccagauagacuuuacuuguggggauuuguuuuuuaaagauuaguuuguauuuuaccuacauauauguacaugcacuaagugugugucugguaccuggggggaggggggggggagaagagggugccagauccccugggacuggaguuacagacagcuguuaagcugugggugcuggaaacagaaucugguucucugccagaagaguaagugccuaaaccauugagccaucucugcagucccagaauuguguguuguauuuuuaaaaaacguaugugugagugagugaguggguguggggggggggguggggagguggguguguaugugagggugugugugggggugggggugugugaugguuuaguggguaagagcacuuacugugcaagcgugaggaucugagcugaaucuuagcacauacaaacggcaggcauagcuguaugguugugcaauucuauaaccugaacaucgggcagagagaagcugcuggccagcuauccuagcugaaguguguaacuuuguggucagagacagacugucuuaaaggaacccgucagagagcaauggaggaagaugccaauguccuccagccuccacgugcaugcacaugaauacaucacacacacccaaaaaaauaaaauaaaaugaaguaaaaauucuuaucuaacagcugcuaugguguuagaauguuucacgucucaagaauuuauagcggaguugcugcuccaauggacaaucagcucaucagcuuuuaaauucgccuucaaacuuuguuuuuugucuguuagucaucugugcuuuaacugagaugcuaaagaacucacugaaggaaagcacuugugugugucuugacuccgucuguguucucucuaggucagaagaaggggacugucgucaaugaugucaccgucuccuaagcggcuaaagacaaacggaagcaguccagggccaaagcgaagcaucuucagauacuuggaaagcuaacgccauccaggaugccagugucuguggaaaguacucagaguaggucuggcggggagggugggacugcuguuuccgccgaugaccuccccuucccucagaaucaacucguaaugagccgagcuucccuucuccccacacagcucucagcagcacucuucucuccuaguguuauuuuucaguuuggccaccaaucucagcacaacagagugcccagcaucgacuuacagaauaauugaagucucacuucuuccguuaagcacuugacauuuuuuccuagcaguuuccuggguugacaccacuuucaagucaagguguucagaggaagaagaaaguguggcauuauagaaaauugcagaaagcacugaaagccagccugggaugaggcucccacagccacacggcccuuaacacaguaccaggccgagaagcacgcacccagcuguugcaucguccuguuccuucugugucauguaaacuucuagucuugaucucugauuaaccuucaucgccuuugacauaaggacucaagcugguaccuaguugagaaagagguuaucccucccuuucugcaccuuccccaggacuagaguuucaacuuaaagcauuuguuccagagccucccucccuucugcagaaaccugaccacuauuuauugcugcuuuggggccgaguuucuugcccugaccaucagaggacauuuuaauauuucaucacuaauauugagagcagaccaguagaauuuaauaaaaacguugaagagaacugcuauuagucgcuuucuuuggcuuucagaaacauaggccaguucucuucuaucagagcagaauucagugcugcuuugcaaaaaccauggcaggugaacguuggcuucagugucgaaagcugagcgugagaaguuggaugagguuguguccguccuuuauugagagacauaaagcagccuguucgacugaugagauuaagauguagguuuucuguuaggugcuggggcuuuugguuuggguuuuucuaauacucaggaugcugacuuggacagaacauacauuuguauauuuguaaucuuguaaugggagaaauguguacaaagcuguuuuaauauguauguagguuuucaauaaaucucauugccuugugggcagga

SEQ ID NO: 12091 - RNA, 57347 nt, Mus musculus
gcggguccuucaaggcaucuguuauauuauuguaacaaacacagauuccucuguuugacaguuaaauaguacccaagauggacaguugaccuguacaagcaaguugugcauuaaaaaaaacaaaaaaacaaaaacaacaaaccaaacauacaagcagccuauagugcaaagcaggcccacuucaggaagaccagcucacugcagggaguauaccucaggguaacaaugucacaaaggaugacacccacccacacaauuacaguaacauuguaucaacccccuagguuccuugugcuuucugucuagccugugcuuucaaguagcacuuuaaaguagccuugcaaauaaggacccuuuuccuuucauuuuuguuuuuuuucucuccucuccuuuuucuucuucuucuucuuuuuuuauuagccccagcugccugugcucacuguaggacucacgacaagacucaaacuucacuguuaaucagggaugagaaagaggcgaugggggaggggugacuuucuauuuccaccgaccagcguuuggguauaaggaaggcuaguugucugggguagcuuacccagugcuaggcacugggauccugaaaguaccuuucuuggugaucuggaacagucuguaccauggaccaguagcgaagcagguaggagggcaaugggucguagcugcuuccugagaagaggugagaaggcccccucugggugcagggagcuggaagguuaccucagcuacuuccaagagauagaguuuuuuuuuuuuuuuuccuccaguaagggugggacaagagacacuguaacaggagguauucugcucaggauuguccaggauugucggggacccccugaccuaccagaguguguauguggguggcuguuucaggugcaggcaauggggaaggccaagcacaaggcagaggccaucacuacggggcucacucaguuugaaaaaccagccgugggccagccagcucugguaagagcuuuuuaaccaaucccacugacaaucgcccgcccacagacugaagaggacaucugaucucugcuuggaugcugcucugccaucgcacaccucaccagagacuccacagggccuccuggaggucuuguccccuucugugaagaaugugaagucaggacccuggugguggggugaggguggggguguccugaugacaucacacagcaggaggugggcucuuguauacacagacugcccccuguuuuagaugcuugacugagaugcuuuugguucaaaguugucugcuucuagggacaaacaaguugggagcaggacuguggccugggaggcaaggcccagagcacagauuggcuggaccuagugcgcagggcuaaccacccuaucgauccccaugguaagacuuucggccaggaccugucugcccccugagaacccaguaggcaauucaggcuggaguaugcuggacagugugaggccuuccuugcuuuagggaccugccaccccggaugagucugcucuggggccugguguuuucagguaaguuaggacugaucaggggcugcuggccugggaccagggggaagucaaguuggggacguguguguguguguguguguguguguguguguguguguaugugaaagagagauauggcuccucucucucuucaggggagugaaaccuucccagggguuugaguuucccuuugguuugaugggcauggaugguccccagggcagugugugugugugugugugugugugugugugugugugugugugagagagagagagagagagagagagagagagagagagagagagagagagagggagggagagaaaguccagacaucucugagccugagcuucucuugccagcaaaggcccuccccacacaggcagggguagccucugauucuagaauugauccugggcauggcuggagacaagagguggguuugggaugcacagcuagagaggacauugauuuggguuggagcaguguccugugggagguccccacauccucugcucaaacuuguggcuggacagagcucugggagccacugccagcucuggccccugggaccaggccaaagucuguuucuucuuguagucucgggcuggagggaaggauucggcuggcccgagagucuccagggugcuuaguagggccgccacacggccucguccaugcggcccggcgugcucagggccgugggcgaguugcuguggcugccgucggcuuccacgccaucagccuggcccaggcugggguucaugagguugccugcugacaccgaagcgccgcuggggcaggaggucagcaugcgggugggcgagcgcucaccaccucccgcggcugccauggagaacugguaggagccggaggaggcgccguaaaagaggugguagggcgcgggguuggccugaaagggcccgcucuggcucuguggggccccgggguagggcggagggagguaggugugguggaagcggcugcuggccggcaugcccgccacgcucaggcugcccaggcuggugcccgaugguguggcgcuguaggggaaggcggcagacauggcucccggguagugcauccugggguccgggaagcggcucucugugaggcucugcagcguagggaaggagcggucaaacuggcgggggucggagaagggguucaggucugaggagccuagggacacacagcaaaaggggggugucaaucaggugcacagaccaagaccacuguggguuuucucguacugugcggugacuuuccuggggaucucuuccucaggcugugcugugcagggcugugcccugugcagagggcuuuugcugcagaucuggagugagcggaacucugggucaaaacagaggggacagcccucccuccuccugugugucuuucccagccugcuaggacagacaccagacagggcucccaccucauuuugaagagcugacaagaucaagggugugaauagaguccccagggacccugugagacugggaguccuggccucggaagaggaaaaaccagaggcagagaaacagaaaggcugauuccccacucaggcagagaaaguuccagagugcuuccgaaggccucucuguuuacugcugaggccagugcgcgugcgcgugcgcgugugcguguguguguguguguguguguguguguguguguguguagauagguuggugguagguuggugucuuagcugugggggaaucugcugguccacacccccacuuccugagccuaugucccucaaggcugcccugcauguuggucacacaacuacacucaugacaccuucaucuaccuccguugcaaaauuaaacaccuaguuggaggcacuugggguccggaccacacagcaacaccaggggucuggaauucucaguggacuccaagauagagagugccaaucuguauaccuacuuuuguaaucaugggcaaagcuaaucccauuggugggaaaacagugacccaagcaagggagcggcaugaaggucacagaacacccuguccugggucccaacacuggccccauagcuacugccucuuuggggaggcagcuggacucucccgguggcuucuggagccauggcuuugacucucacucccaugugucccuugucaagucacuuaaccucuccgcaccaauuucccaaggaccuagaucaaauugaguaaacucaaaacacagaugacagagccaggcccagcgucugcgguguuccauuugucuugcugccucaucuuuugcugucacaucccuugcucuggguccccagaaguggcugcccaugugaaugcugggauuggggaccccugaucacaaaagcaggugugcugauuggcacccccuaucuuggagcccccuugagaauuccagaccccugauggucaggacccccaagugccuccagcuaguguuuaguuuugcaacagaggcaaaugaaggugucauaacaugaaaccccgaccuagggcccuccugguacccuggcagcaaugucagggcauagucccgaguguggcccagagccuuggccugucagccucagcuccuucaugcauggaaggccaggggaggcccuaguccugggcuagcaggguugguacuacucugggugggcccucuggccaugaucaaguugugccugaggaaucagagcucaggccuccuacuuccuggguucugcccagggugucggguacccucagguaacuggcacuccuugggucucugggcaucagugccucugggccuggcugugggucacuaugaaggguugcccuuggugccaggugaggagaacagacaaaggggcaggccacuggagcguucugaaauaaaaacuggggacuccuuggcuggugagugugucuugaggccugggagggggagauggcugaugcccaucuccugcagagaggaugcugcaagaugagaggaugcugcaagaugagaggaugcugcaagaugagaggaugcuggauauagaugccugcuggcaggggacccugcucuccaagcagaccaaacaagacuugggaggggacagugggacucugguccugcagcugagagccugggccauguggagcugccaguauucccuccugacucuguccucauugucccagcuuccccuccagagugguggggccauacaugccccaggugcccccucggacccucagcagcuuccucagacuccugugcccaugcucagcuucacagccccaggaaaucugagcugucggggccacugucaggaagccaagcuagcagcucaaggaaauguuuauuuucuccaaauugccccgacugcugcauacagcugaaugagcccuuugagcugugagaagcccccauugugggugucugcagcaggguggggugggggacccugggucuuggcauugccugcaguguccaaagcuaggggucaaggcuguuaacaggcuccgagggaagugguggggcauccugaggggagucccaccaggagggagggccagggagugugacucuucaugcgugagucugccaaagccacucugugacaggagccucuucacuuuguggaugagaaaacacaggcucagagaaguuaggcgaccugccuaagaucacacagccagugcgaggcagggcuagaaccggucagguugacaagauggccgagaguuugcuucuuccccagggcauccaggacccucuccuaaacaccaaagcgccgguuggagcuaucauuggcugaagaaucccaugucaggguucaguaagagaaggacuggccauccaugccauacuagcuaggugaggaccagggcuguguggaagcucauuccggcuccugggagcacacaguccaaauaccacacucucacugugacagagcaaacaugcauucuucucucaugagaaccaauggacaggaaccugcuggccucuggggugucccuggcuuagaccccaucccuucuaagccaggcucuguaggugcuggccugagggggugacauaaggacaaacuccugguuggagcugagcaugagggagaugcugaacacuuaucuaaagggccuggggcucaaaugccaaaucuccaacucacaagcccauggguucaggcaugcuggggucagggccuagccuuaccuugggcuagcuuccuggcacauggagagaugguggcacuaugccucugacacugugucaugcacagaacacauggauaauaauuuucccagcagugccugacccccauggaaugaccaguguggagaagggcagaugguaggugacagagguaccagcauauagcccacucugauccuaauguucaggucacucucaggcccaccuaaggacaagccagggagacauuagacucagccaccagaaggccccgaccugcuucagccucuacugaaucaugugccacaguggcccugagccagcacuggugaucagaagggacagguaccacaccgggcagcagcuagcccucaggccucugugguuuggcaucugccccugacugaccugagccagcuacauuuagccuccugucucuggcuccuaacagaaguaugaggccggccauagggcuggccaggcaccugccccaugcggggccaaugggagauuugcuugcagcccagcuuccucaucugugcgacuggggcagccgcugaccccagggcucucuguuugugucacucuagauggggagacugagcuaagcagcacugccauccuuuaucaaagcuacuggugugacuaacacccagcagugggaagagauagccucacccuaucucuccucacugugagagagcugagguaguagggcuguguguacaguggggacacaguugccauggcucuauggacaccgcaggauugcccucgcguccccguggacuaauaaacuucagagggagggauggccacaucuguucccacucaucccggggucaggcacugugcaugagucagugaacauuugaugagggagugggcaaaggccugguacagagaagcccucgggagaccugcgaguguagacugcagacugccccagcuguccaccgauaaacagugggggauccaucuuccccagggacuuggccugggauagauggacugcauccuggauccuuauccaccgcccugcccgcuccccaagggucucugcuccuccguaccuuggauuggggucugggccuggcugcugaaguggcucguggugcugagagagccacgggggcugggugugcuugguguuacacgcaugcgcaggucuccaaagcggucggggaaggccuuggucuggucuucuaucuucugccggugcccuguggagcauggggaguccaucagccacuauaaugccuuguccugcuaggaaguucuuccuggagucuagcuuaggucucuguggaacucugauuuucuguacagaacagggaucauagcuaugugccacuucagacugccugaucucuccucagaagaauggucauucuuaacaucacacucagagcucugauuggaccggcaaguugugauguuaaccucugaacuaccuccccaacguggucugacaggugagaauacugaggcaacaggccuggaagaaugucucaggcagucagguugccaaggagucgggagaagcccccagggguggcaugcagaucuccacacuccauggaucccacaguucaugcacuccugugaggacgugaggcugugggagggagcucuggucaccuggcccugaccaaccuagcuacccucaagcuugucuccccuugaggccuuaggaaggaggguagaggugugguauuaggggguauacaggcuucuggucccugcccagacacagugcacacaggagucccaggcuggcugugcaccugcugagggccgaagacaccuggacgaggacaccuggagugucacuaagugccacgagcacucccagucacccaucuuucacuucucaaacaacacaccgaguuucuaaaacagaacugagcccuggcugcagagaccccuugucagugagggccugugcccaucggcuuucaaguuucuccucucagccgcucuuuggguucaugugaauggaaaccacagagggagacgacauugauggaacuuucuagagaggguguguaugacugugccacuuucuccuggagugacaaucccggaagcucaguguccucaccuaugagguggggacaacgacuagccucucagaaaugcccucacugccacccuggcucccuggaagaaugucucaggcagucagguugccaaggagucgggagaagcccccagggguggcaugcagaucuccacacuccauggaucccacaguucaugcacuccugugaggacgugaggcugugggagggagcucuggucaccuggcccugaccaaccuagcuacccuaguaugacacagagagcaacauuauuggaugucccuugagccugccugucacauuuccuagggguguagcugccucucgauccucuccucaauauacagccaucugagugccuccuucuggguccauaugagcucacaccuccugucuggcaucucugcccaaugcccagacccuagcucaggacugccucagaaacugagcgggaggucccggaaggcacaguucagcagguggccaacagcuagggaacccugcuguccucucacgaggcaccagccaaguccagugguuugcuuggcagcagcugucaccacuccaaggcucuagaaagugaaggggaagguguggccugggggcaccugucgcuggcugcagacucuaaggccugccuccuccaaccuccccacaacuacccaaccccugaaagucugcaauaagacaggcaagauggcuagggacugggcagaaggaggggcuuguggcucacugaggaugccuggcuagggucacgaugcucucauguuguuucuggcucaguggaaaugccaaagggcagcucugaggcuacuggagaugccagggaccaugaaguccaaggcaucucaacaggcaggaagccuaccggauggacggaggcugagggcugagcagucagcuugggugcaaggaacugggugucucagucaaccacagcucuaaggcagccaauggggccacgcggaugcuggugcaaaaccucaggccuguugucauuguccucgcccgcugaacucugagucacaguauacuguguuugcagcaguuccuauggccagcaggaagguaggcgcgggguaacugugggcucaagggugggccccaacagguauaaccuggagcucacgcaucacacaucuacccugagcuacaagcaccaccccuaacacacugaccacaggggaggcagaggacacaccaggacacugagaccaggguggcgacuaggaagccggcccagaucccuaacuccagggacccagugucuugcccauuacucuccugugguaaagggcaggcucccuggaagagaggacaccgccaggaaugcuuccugugccugugcagucccgaagccauugccagggaggggcagaggggagucugcugaccccacauggccagggcgccagagagucucagagccacgaggcugaggcucucaugcugggagcagaacugaacggaagcaaggaugccuggccggugccccggggaggcgguggccgcagaaaaagccuuucauucuuuuucccacagcgagagcauggagcugccuggcucccucacccacacgugucuugccccucugugcuuccugccucagugguaguccuccccccagccuccacaaccugcucaccuauguccccucccuuggagagucacugauuuaaaaaaaucacaagaaguuugcauugguccaacuggcuuccagcccccaguggaaagagaggaggcagcuucggccuccugcugcacccagccugacaagaaccaacacgcccccauuguacagguggaaacacugaggcugggaagagccacugcuggacugacaguugauauaagacaacuggucgcugcucucccagaagcccaucucaggaaggggccugguugcgagacucuuuauggcguuggggcccagcccagagugcucucugcacgcagugggaggggcaugagcagaggaacaggacugggugucuuaguuacuuucuauugcugagaucaagcacugggaccaaaaaguaaagggaaggaaagaguuguaacucccaggucacacacacuccaccugacuggcuugaggaggagcaagccugucagcagcaguuucuccauggccucugcuucagcuccugccugcaggcuccagccuucagcuccugcccugacuucccucagugauggguguggcccaagagcuguaagauaaguccgcccccucccccaaguugcuuguggucaugguguuuuaucaaagcaacagaaacccuaacuaggacacagggucucagcagaccccagaaggguucugccuugcuuugaaacucagggcugagucccaagcacacaaccacugcagacuaacuggcuuuccucugggccucaguuucccugucugucaagugguuguuauuguaaucccuccccuggccccagggcuagaugaucuggucaaaauagaguccuccuggggagaaggaugccuggagaagggcuucaagcagggagucugaucacagcgagugccugggacccugcccgugggaggcagaccucagccagcacacuccaguggccccggacccauugaagacagccaucaugcagugguagccuugccaauguuucggauucccacuagguuuccgcuguuccuuuuauaaaauggggauuaaaaagcuuaacgcugccucccuucucccuaaggguggagucagaccuaagcaguacacagccccgcaggcucugaacuucacaggaggugacaacccugcuuugaccugauucccacuccugggucaacagcucccauugagcagagcuaagccauuagugaaccccacaggcaggugacacggguccaaggcuuuagacugggagauuuccuaaagauacauaaauaauccaguugggacuucauuacugcucccaaccaagcuaacaugggucccuccaccugccagacuuccuggugucucgugagccaagcgagccucugccaggauuaguuccugucuguggcagguggggcaggaggaggcugggaucccugugccggguggaccacacauauaaccuuaaggccacaacccuccgaaaagcucccuuuccccucucagccgcccugcccccugcaagucucacagcgggaaagagaaggcgcaaggcggaggucacaaggugauccuaaaaccuggagugagccgccuagccuacagagcgccuccgacucagacagaggagagcugggcucuggcuggcaagaggccagcuccaugucuagccucaaagaggcaggagguagauugcagagagagaaagagggagaaagcgagagagagagagagagagagagagagagagagagagagagagagagagaaagagagaggcacagucggguagggcccugagaacaaggugaguccccagccaucagacccugggcugguccagaguuucccagcagccucccuguagccugcaacccacacacacagcagccacugugcgcuugcugccgcggcuugcucugcggccuguggggagauuuacaccggacucggaucagccgcucggauggcaggcgggugccgggccugggguggucugcugugaauuggcccccugugagcagaugaaaaccagugguggcugggcagggaagcuggcuggcagagggccaguggcagggagguagcaggcucccgcccagggcugcaacuggggcuuccaggccugggccugauuaggggaguugggaggucugagguuaacccuuucccuucucuugggcgggcucucucagaucugccaggcuuuccuugggugcucccaggcucugggggcacugaugaccaggaguggcugucucucuggacccaagcauccuguucucagcuuccccacaccuggaggccaggauggcaccgcccuucacuugucuccaaggcccagguauagcacugggccauuuucucugcccauaccagguccugagaggucacacugcuaugcccccuccgcccuuucaggacugaaccucaaccaggaagcccucccacccugcccacccuuugccuacuauggcuuccuuuuagcuuuguugaagcgaacaaaugauuuacucagcucaguccugaccuacuuaaggaauaucagcuaaacgcuccugugggcauccucggggccaggugcaaguagcagacaggcaaaagagaacgcuggugugguggagcaugcagaccagcacagaggcauaacucuggcaugcuguggcagcugugcaaaggcccugaggcaggaauguuccuggcagaagccagcagcuggagggaggaagaggguacaagagaggaagaggccaccaccagauuuggcagggccguggacacuguaaaaccugucuccuccuuucuccuguggaaugugagacccaggagagugggaccagcagguggcggguagugcuggagguauggcagcccgugccugggaaaauauuuguggaaauugcuuugugggcauuuagaggaagagaagcuucaggccaucccuucagccucccgaagggcauggaagcugggucccacacuuuugguagcagcaccugcugugccuggagaguuagcugcccccagcuguggccacugcugcugugcccagcuccugaaccaccucccaucccagagcuggauucagcucagcaaccugcguuugaaccaguccccauuaacugaaagggauccaucagagaccgaggccacacagggaggaagccacuauaucagccucagccugagcuggccacccggcugcauacugggcacacucugcagggcacuagaggggaccgaccuggccacagaagccacagcugggucucagggaugcaggacugauacucccagacucuggaccagcccuagccacccacagaggcucugaccucacagggguuggcaaguggaggaaggggaaacugcagaaacccgagagccgugugugugugugugugugugugugugugugugugugugugugacacuuccuguaugauagugauaagucaggacucuuaugaucccccuaagucccagacccacacccucagcuuguaccucugggagaugcacugaugccuggagaugcuaaggcaaucuuaggaguggcucuaccucuccaaggugcaggaugcuccuagagucaguucauggaaacacugcaugaggcuaugcauaccggguuucucagugcugccgcugccuguggggguccccaccuguauauagggaaacugaguccagccaagaauacuaagcaggucgggucuagagaauaggaacucgagaccugauuucugggucaguuaggccauaggcagaaguuagcacagcccaaggaugggauaaccuggaguaacauggaaaauagcccuucucuucugcucuguuccaaaaaugagcuaguaagaaggcccagagagggauacgaagugucuuaggccacacagcaaucccagccucugaccccaucuaucucuuucuguucugucucccucccagcuggcuuauuccuuaaagggccagcugagcuaugguggguuggggaaccaagacaaggugugcagaggacucccugagcagguugacccacauccucacccacaggccucaagaagcacagggcuaacagauguacacaggauauucuugggaccugcaggcauugccuggccacuuagaaccucucuaugcugcccuccaacucccagacccacugugggccaggaucagaucagaucaggccccuucacagagaaggcacucagugccugucuccuggccauacacggucggucgcugaggcccuggcugaggcgacugcacaucagucaccucuguaaguugccauguacagaugcaucuguugccugugcacagcaguagccuaggcaucaguauccuaggcaauugcuugugcaaacccauuuuucagacaagaaauaugaggcugaaagugaucagcccaagaccugcaguucagagcaugggagaaggugacccugagguaacgugacuuccccaaguccauuguccaucucugccucccaccacccccccuucaaagaacuacuugcuggagcacuaagugaggggcgaagccugacucuuggcuggaauggcucucacuaauguggaccuggcgagccacgcuccuuugaguuuccuggguaccagaaagaggucucaggcccugcccuccugucccaagcccuggcagccugaggcaggagcauaucccccacaaauacugguccccacaaacacugggccaucaccuccuagaacagggaaaccuuuugacucagccaucaugaaaagcuucuuuaguacaugugcaaauuccacccucugcugcagacacugagggacggacucugagggacagggaauugccaaaugcaggugaugcucaguguacacucacugcaucccuauucucagggaugcccagggaucccguagccagugugccugggcuccgaagaugcagggcuuucagaaggggaugugguuucauggcacccucgguagcuguucccuuacauccuucaucacugcagaggcagcuggggugcagagcagacuggccuaagccucaucccaaaugcugcccgccauggugcccuuccucuuuccugcugucccuagagagucugggccaucuuggucuccuugcugacccuucagagccugaggcugagcccagacggcugaaguuuagcacugagacccuuugagugcuuggaaggagacacagagcuacagguacagcccccggugcccuucuccccuggacccuuugcccugacuagggcucaguagcacuuacgucgggguucccgggguccauccacagugaccuugauggcucggugguagguagccacuuggguaggguuggugaacacggugauugugagcgugaaacucuucccuggggaaaucaaggcaggaauuggugaaaggugcaugcacagucccccagccucccuccugggcccagccgccaguaguccaacacgugugaucacagagagaaggcagggagaguguaguucaagcuguugggcuugucauucaaggccacaggagguguggccuuagcuguccuccgacuacacagggcccuuuuggcuuucuuccuucauucuaugagacuauauuuuugugaucaucuacuuagggacucauaugauuuugagguaaagaugggugugugcuuuuuccugagagcaauuagugaucuuuacagggaaaaaaauugagaacacaaaacauuauuuaaaaagaagaagugccgggcuugguggugcaugccuuuaaucccagcacuugggaggcagagacaggcagauuucugaguucgaggccagccuggucuacaaagugaguucaggauagccaggacuacacagagaaacccugucucgaaccccacccccaaaaagaagaagaagaagaagaagaagaagaagaagaagaagaagaagaagaagaagaagaagaagaagaagaagaagaagaagaaaucccacccacaguuccacugacugagacggccaccaucauuuggaguuucucuuucacuccuccggauggaacaguuuuuacacaguuguuauggugauaacauccauagcuuuucauuuuuuaauuuguuggguuuugagacaggaucucucaauguagcccuggcugucuuggaacucaauguaaaaaccaggcuggccuugaacuugcugagauccaccugucucugccuccccaauucuagcaccugucuuguuuguuuauuuauuuauuuuuauuuauauuuuauuuauuuauuuacuuugccugccugcauguauguauguauguaugugcaccaugcaugugaucuggcacccucaaagaccagaacaggacaucagauucccuggaacuguacuuagugauuguugugagccaccaugugugugugcugggacucaaacccagcuccccugcaagaggagccagcacucuaaccacugaggcccccgucuuguuuucuuuccucaugccauuacaagcucuccauaaucuucaauuuuuaauggcuacuaaguauucccuuggcagaagucucagcuuugauugguccacccccuuaugucaccguuaaguucuugcuguugugugcagcccucacuguagagggccgaucugggagcuguagacacaacuguuauuuccagaacccuguucuauuuuuagauagauguuuggcuucaaugucuccauucaaaauuccucagaggggaaaaucuuuuaaaauaauaugguuuugguuguguuuuuuuucucuuuaccauuuaaaauauggccuuccaugugucaaaaucucuuucuacaucucuucucuguaaacuuccucccagagaguuacaagggguauugagcgagggugucaccucagaggcccgggaugaguuugugguggccgaucuugacucucuugggacacguaccucaucaggagugacgugaggucacacgucacccaaaugccccggcuucugucuaucacaacggaagaucuucaauuccucuugguuuuguuugccuuucuuguacuagugagacugaaacugucucuggccacuauccaucgccagaauccaacacacaucgcuaucuccucuucuugaggcuuucccguuggggcuuuaggacuuuugacaacuguugcaucugaagcuuguucgcagcuauggguuguggcccauaggcuauguggccaccauagucugauuucuaacuucaccucuuucucacgauccauuuucucucugucucucugucucugucucugucucucucuguccuccccuccuuccccccucuuucucucuuucucuuucuucuacuguccauguuagagaccuccccaggcaggaaguagaugaagguguacuuucaaaguacucuaccuugaaggccaaagguuuagggacguacgucaaagggcaagccugauuuuuuucuaccaucuuagucauuuuaucacgcuguacacugucuguguccagggcuucaucucucugccuguuuccccaaugucuaggccagcgccguuaccauuuaagaugagccugggugggugggguggggacaagaugggacuccacagagacccaagcuccauuccccacguccagcuuugccucuguggacugacucucaacccaaguuaguggcuugggaacucccccugggcacuccaagcccaggcauuugugucucucuggaguggcccccagagaugcccaggaggcuacuggagacaggucauguuaauggugcccuaagaagagggccaguuuucacaguccugcucuccaagaggacacaggcaaucuuauuguucucuuugcucaagggaaaauucuagcuccagaaacaggagacgccugagcauggcuaaggcagccaggccagccagccagcugagccuccaaacucaagggcuucugggagaguaccgagcacccugggaaauagacccagcacuggaagaaggucccugagguggccagcagagcccaggacacaaauauuaaggcaucuauccuuggagguuugaguuaggaaagccagcccggccgcauccccaggcccagggaccauuugcuugauuucuggaaaaagaacugcagacagucuggggagacacagggcagguggccucagauuccuuucuacuccccuuggggacacucuucucucugccuucucauuuugaggucauuucucuccuagacuccuccucccaaccaaugggggcacgaaggggaaguuggaguggcugucugaccucauugcuucuagggccacaaugaagggggugggguggggugggguaggcugauaccuggagccuuagcugccaggacuccagacugagggcuaggucuguacuggagaguccuuuuucagauguaguccuuuucaaugaggacuuccccuagcuacuuuauuuaaaggugacauuuuagaggccagggggagggggguugacuucaguguuagaagguuugucuagaaugcuucagguccuggguuccaucuccagggccaaaacccucaaacagaguggagauuuucaauuuggccucugugguuggcccuucuuaguauagagcuggccagggaucugggacaggaaaaaaaucugcaauaguauuguccccaaccccuaacuggaagagccucucucaagccagagugcaagccacaagccacagaagucuaaugagcagugccugugaccuugucaccaacaagcuacgcagacauuuacagaucacaugacaguccuuagagauuucucugaauagucucagugcuccucauaaacucaacguuauggucaucaccagaaccacuguuggagcuuacuguggaaucuguuacacagaccaccaguucaccaugaucccccuccccagugucuaaauguagcuguuccccucuccagcuccaugugccuccugccccuggaccuguguaaaaguuucuuugcaaaguucacuucagaaucugccugcuggcucacuuucucucucuuaggugcuaaguucacaggggccagagugucacccuaucuccaccccacccuacccccaguccccaggaugcuaccccguguaugauagagaccggauuaacuauuuuaaaugcaccaacuuuccagaugcaaagacugaggcucacagaggagcuggguaaccacagcucccauaguauccaggcaggacucaagauucacacacacaacucaucaucugccacccaccucccaaccugccccagggaacagaccacaugccacuucugaggucaccagcagcuccuugccuucucaaccaaccacagagcuggaaagggagucagguuuugggccaagagcaagagaccuugagaaagauggguggagugagcuguccccaguuuccuuggaggugcucagugcgagcauuucucugaugcagggaacuaagaggaagaugcaggagguggcuggcugggcaagagccuagcaaccaugcuauggugccaggccacaaggccaugagucgcaaucaagaaacuaugugggcucugguugcuggcggcaggggugggggauggggauaagguuaggggaggagggggagggggcccguaggaaggcuguccugaucaggugugugaaacacguguacccugcaacccugaccaaucagcagucucaagugggucaggaaguaugacugacaagccccgcccacagggagcugucuggacuccuggggccuccccucagcucuguaaccucccagcuucagcaagaugcguuuaucccucgccuagugaugccaucagcccgcacauacagcucucuccccccaagccucucuccacacaccucugcagcuucucagccaguuaaggacaagguacucagugauucacuccuuugugccuaggccagugguuacucugucuccuagaugacaagcuggggauucgccauggugaagaguccggagaacaccagcccucggguggaugcgugcucacuaaaguucaugcacagguggacaggugcgcgcgcgcauguguguguguguguguguguguguguaagcacacacaagcccagcacugccuagggccacaaagaauuagauuauccuaggugggaaaaauggacuuaaaaacaaccaaccaaacaaacacucaguuuuacuuaaacgaaagcaaaauuauggauucuuuuucagaggaugggggucuuguuuuguuuccaucugggggagggggacagaugcagaugcggcucagugguauagaccguuuguccugcaugaaucagagccaggcuuugauacuuagcucugcggaaaaaagccaaaacagaacaccucucgccccccccccccaagaaaaaaaaccaaaaacccuguucacuauucuguaaagaauuuccccaucuccagcaaauccuggcacaggcugacgcuugaccacguucucacuuugagcccugucauucuguguugaggggguucugugaagagugcgcugccccacugccugcguugaagaggcggggccucacugggucauuuacauauucaaauccgcauccgcaauaaauggcuuuucuuuggcacuacuacggaaagacggagcucuagggauugcugguagaagguggccauggccccugaaggaagcuguggugcagauuuggagacaucaagggcagggaggggugcagaggcuggcugggggcuuggcuggcucguacuccuuucugcucacaccugcaguauugugagaguaacaggguugcuggugcaugccuuuccuuuuugaaaaguguucugggauucagacagaaaucaggauuaaaaaaaaaaagccaaaauucuuggguucuuuagcuggcccuaaagcggcccuaguucucagugucagucagaggcaggcucucagacaggaauuucccaagcguugggacaggcauggcagaaguguggcaccaugcacucuggaccauggcacuacccuccucacaucagcacccaugccucucccgcucaacagugcacaccuucuggguuucccccgcccccggccaaaccacacugcaaucagagacucagugaguguuagugcucaaagagaccucaaaggcucucccagugccaaccauuuauagcacaaaagcucuacccuguaccuggaccucaguaucuggaaacucacacauuuauacuggugucuuuaauucaccccaggucucauuaaaaugugcgauuauccccucccccucauuucacagauaaagaaauggaggcacaaagaggcuaaauuaguuuccuaccaccauccagcaagucccuagcuggcuuggaacucaggccaaggucaaccgcccuagcucagacuggaaaaccaggagccaagagcuccgcccagaguucugugggcauaggcuuccuucucccucccaggaccaaaugauccaaaagcaugcaguucgguggauaccuuagaaacaucucucucuuugaggggccuuggaucugggcgguacaauucacuaagagaugucaguggguuaggugcgguagcacacaccugcgauccuagcacugaggcagagccaauacuaaaaaucugggguuaaucuuggcuacauaacaaguuccaggccagccuauacuauaccuggugugagacugccucaacauaaauaaagcaaaaaaacuucuuaguagcagaggggccacaguaagagaaucaugaucaccccuuucuuucccugcuaccucucaagagagggagcaguguggaggaagaagagaauccugagugccuaaugccuccugggguucaccauccaccgacuucccuagcuagcgacaugcuauaaugugcccccgcccccgcccccaucaccuggacccuacacccguggcacuccacucagggccagaccuucaauuaaguugcaaagggcucagagauuggggaugacaaagggggcuuggggacuaauuaggagcagcaacgaaagcuuaauucauaaaagcaaacauuuuccacccaucaaccugcaaccaguuaagggcuacguuugaaagaaaucugugcguggggaagggagccaacaggaacaggaaauguucgaaagaauguaaacuauuucaguuucauaaaaaguaacaaguaaacaguuauuacaugcaaauaacgcccugguuuuaauuaaugcugaaaagucaaaaauauguuugacauuuguauguauauacugaacggcugcagcgcacaaaauggugcccagaugcccggugggagcuggcuggcagcucgcagggaacuccaaccuugagaaggucuuguuuauugguguugaaaaguaccauuuugccccagcaauagcagccagaagccggcucacuuccuaacccuggagggcucccagaguuugggaaggugauugcucagccacuacucagcaggcuagucugaucucccuauccccagggcaugggaacagggagggcucuuccaccccagaguuacaugaugacggguuucgggucccagcaaccucccacucaacagccccuggcggcagccacuguggcgucugguccugcuuucuugcuacuaccgggguggaucaggcuggcacaucagccagcgugagccuggccagaggcugagauggcgcagccuucaaacuuuucauuccaacaucccaucaccccacucagaauccucuauuugaaaguaccugaagaagccuccagcucuggggagaccaugcgccugggagaccacagaggacuuguacccccggggagagaggcugggaugccucggccccaacugaaagacaucuaucuauacccugcuugagcugugcguacaggaaccucccucagcaucuuuucugagaucacagaugcuagcgggaggggggggugguggcggggggggggggggagaagggcagcaccggagacuucagaaguugcuaaacccugcgagaaccugcgagaaaacucuccuuuacucgaaagagaucacagacauauccacauaaaaggguggcacugccuaccgggccuugcugagacgaacuagcuuuccucaauucucauccccaccuuugccaucccagaguucccccugcucaccucgcccacugcggcccacgaaucgaaggucguugaaccuggccacuugguucuucaugacagcggaagcguugcgcagcucggcggaguaguucucaucauugccggccaucacggucaccaccguuccauccggcacaucccccagggccaccaccugaggaaacgggcaggagagaggauggcuuagaaaagccaaaaggaagggcucacgcagcugcccgcccaggucccaggcucucugaggaguucugagucagggugaaagaggcuuaaccgcguguagauccguucccaauacaaccaaagccuagugaugagcuccuagccuccagacucaaauccugggucuagugguugaugggagcuccaagaaagcauccauuuuuauuacauuaagucuaggcuagagcuaucaaucaacaaggucacagguaaggguggggcggcaaaggagacgacacuguucucggccaaagaaucagcaaccuuaauaaccgggcuacuccuugcagucaauuaaggcacuggcccuuagggguacggaauuuggcccugcagugugaccaaggcccaguuaaauggccucaacagagccuggauucguuaugcagagaaaaugcaaaaugcaaaacaaacugcguuuuugcaaguugauccagaaaaccccgggguaagaggacagggugguuucgaucacugagcauguaccugcugggaacuguuggauggguggguggagaugccccuuaaaugucaucucuucccccacuccuucccacccaaggcgcaucaagaggcagaugccuuuugaaccagacuuuaaacagagucacagccauuuaaacguggcugccgugugcagggacuggggauccagaugguaaagauuucaaggagaaaauguuuggggucugauuaaaaaggccagauuuccugucaacauccugucuucuuuuaauuucaaagauuccuuuuaagcuccaagugacaguaaaaccuccgaucugacgauuacagucacacggcccucauccccuccucccccuucuccccuccucccucuccuccccgggagauuucccccaaugguauuuuaagaugucacccgggagaccucaaagagucaccagccuuccccccaccccuuuccaauuugaagucuuaaugggagcaaggagggccucagcugccagcagccgcguuuccagccaccucgggcaucacuaccucccagccgcuggcccuuccuacucuguccuuucucacggcagcugugagagguuuaggggaaaaccaaggcguuuucguuucaucuggcugccccccuuacaagagagagagagagagagagagagagagagagagagagagagagagagagagagagagagagaaacgaaacaguugccuaucccugguaucguugaaaaauaaauucucugaacgacucuggggcuaccaggauggaggcauuccccaagucucugccuaucuuucgggaugcagacuuaugccggaggcagcccuuuagaaccggccuacggucgcccugugcaacacuucagccgcugagguugagagugugggaaggaaguguuucugcugcagagcaggaggcgcggugcuaggccaggcccuccucgcccucugugccccacaccucccggguccucgcccagcuccggcgguccucaucccaguuaccgguuagacugugccaaagaaucugggagccccaguccuccgguuuccaugccacuauacucugcagggccccgugaaggccagguggaacgggguauggcuccuccaggcugucugugccaccgagaaggagcgccccaaguguccguguccuccggcagagaggccgcgguguaccguucccaacgggaggucugggguucugacucuuggaauaggaacggcagaagaacuccccacgcccaguucuccuggacguccuccugguaccuucccugacugauguaaccauauuucucucuggacccgggcucgggcagcggggacacccagguuccucucauguucugucgggccugggcuccugcagcgugggugaccaggcaccccuauguccugcuagccgggugacccccuuuucuuccaccacgguaccucccauguucucuggggucugggcucuuauugcggaucgccuggaguccagcggggguccuuccgggaguggcauccugcaguaggggcgcccggguaccccggugucuugccagcugggugacauccccuuucauguccuacuucuaggugcuccccaaguccuccccgguaugggcuccugcaaaugggggcgcccagguuccccgguguccucccggcucgggccccugcacucaccuugaaggcgaccggcagcgucuuguugcagcgccagugcgagggcagcacggagcagaggaaguuggggcugucggugcgcacgagcucucccgcguggucggccagcacguccaccaucgagcgcacuucgggccgggugcggccgccggggcccgcgguugccugcgcgcuuagcgcgccgcuguucucgcccaucuugccgccgccgccgccgccgcaggggaaggccguggaggggggagugaagcggcggcuggugcucgggucuacgggaauacgcaugccgcggccgucagggcgcgggcggccgcagccgcgggaagcgggaggcgggaaggcggcggcucggggcccggccagcgugggggguggggggaggggcggcgccgggggagggggugcgccccgacggucggccgcgcgcccgcuagucccgcauccggcgcgcgcggccgccccacggacucggcggccgcggccccagcccggauccuagagaaucaaguggcggcgacgcggccgcccgcgcgggguuaguaccccgggccucggggcggggccgugcgagcgacgcggggcgcagccaaucgcagcccccaggcucgggguucgccguggaggacccgguggcucgggcccgcgcgagccaagcaggggccaggcuccgccccagagggucuagacacccgcgucccgguagccgcgcggggagccgcgguccccggagucaggagcggccgcugcgaccugggcagacaucggguuuccagccuccuggcugcggcucgcuuccccucccucgagucgcagccuggcugcuucagcucuggccaccgcagcccggaaccugcacccucagcugguugccgcggugacacccaagacgguuuucucauucccuccacuccacaaacgauuuugacccuagagcuuccaccccacgagggaguccacagcuccgcgcggccuuggcucucgucucuguggcuucugugucaaccuucgaggcagacagaauagggguugccacagggaccaacagugggguggggacaaccacacggcuccuguccacucaaaacuaauuucaggaucgcgcaggccucguggaguuguccucugucuuggcagcucaugggucuuugaaaacuacaauggggccuacaacagugugcuuuuuuggaacauuccaugcuacaccauacgcaugcaaccaccguccgucuaguggaaguggaugagggucuguggcagaaagaagucuuaacgcucagacugcuuucuccccacggauggaaagggguccuccuagggccgggccauagucuucuuggcccuaaagcgcugagccuacagagcugucaggugcccugugggaaaucggcccuggggucucuguguuccucaugcuccguggcccagcaacuccuggacuucacuaacaacaacucuuucccgucccgucuccuaagccuggcaugggggcacagacacacaacuagagaguccacggucaccggucaccgagggcugugcucuccccaaccccgugcacuccuuggacggcagcaacgaacgaaugcauguguuucucucacugcuuuggaaauucgacugcauuuucguugccagcgacagugaaucugucugcaacuaccaauacaagccccagaagcgacacgauuuaggauccgauggcgacagaggcaucaagaccucauccuggcucugaccucagcuuagaacacuccauuuugucaaaaaacgaaaucaggcgcuguguguacaacagcgggguacuagguauguccugagucuaacgagugccaggagaauuguauucugccccucucugggccuuaugccagcgccucaagccaccagggaagcaaggacagugaaggucccuuacuggaacuuuuugagaaccuaugauucggaguugaccaucacuaggccuugggccgccauggaaacagccucuggaccagaggggaucuaggaagccuggcccugagcaugggcccucagggggcuccccuggaaagggagcaccgcuagucaccagguaggacccagaccgagucgucuauucugcccucgagcgauugugggccgugacuggcagccucugcgaugcgaugcauaaauucgauuucuugagugauuccaguuugcaucugccccauacuagucccuccgccugauuucucuuucugaucuuacaacaaauuaauaaccgggucuccggaaaguggggcuacaggaaugacccaacaucugacccugggcccggacucagcuauaacccucggaagacgcgggcaccagauccaaggguuggggaagugcuggccuucaguacgcagccugaggucgcaggugaagggucgcccgggcugaagcagugucgugaaccgcccacuaguuggcgcuggcgccuugcuggcugcucaguugcccccaccagacucagagcacagacuugcgccugcagcaggggcagcacgggcagcacggguuuuccaagccacggagcguuggggaagagcuacuuucuggagagugcgcgccugauuucucuuuauaccaguggucacauaucagguaaauggauagugugguguuaggccgaggguugccugcccggguucucacaaagagauacgguucuuuggagucccagauaccgaagggccugcaaccagcagaagucucccuucaacagaaaggcgccgcccuguuucccuacuucuguuccugagcuccguucugaggauaggauagaaggcucagacuuucauccuuauaccugucuagaaccagaccaguuuccuucuuucuucucuggaccgacaaaccuagaacuauuuauguauggucaaauuuucagaccaggagagcugccaccaaacaggacucaucgcucccucucccuuccccaccgugcguacauauguuccgucuuucuuucugucccacagucgggcaacagucugccuucucucaaaugcucucuucuaagagcaccucacuguguccccaacaggggacaggaagcagagaucaaagcuccucucucacguguauguccauuguaggguaaauuggaccagccugggccaucuacagcaggcucuuauccugagaggacacccccgcccuccaagccacuaaggcuucuuggcugugcaauguugccucugucuuugaggaaauggacugagugggucucauuccuuggaagucaggagacagggaaggguagguuucagcacacuuguuucuggcucaucucugguuaguucuuaagucugcuuccuccaucccucugguccagggacccugugucgaauauuccugagccuuccucucaacuguacaggggagaacagcugaaucugggaucacgugugaagugcuuggcacaggacugcuccagaaagacgcucuaucacgccaacugucuuugccaagugucacacccucaccugugaaacacucaucuggugguagcuuucacagcgcuuucuagaacucagaaccuaggacagagcuguggccaccuugcuccuccuuucuccuaggcuggccugagggcuaccugcugccuacagacuaucgggugcuugccuuuacauagagcuagcacugaaggcaacuuuugagggccuucuugcugucaaggcuccagaccuucacuacugcccucccacaagcagcccugaccuaaguagaaagugaccaucaccauggacaccacaguccuuuuccucucccccagaggugucgguuccuucuagaaauggagugucuccauucuggucccggcacccaguguggauccugccuacagcuuagucucuggaacucucaggggacuuuccuauguugagggacuucuuucuaacauucuuucuuggggagggggaacuagggguuccugcuggcaggagaggggcagugagcacucccuccccaaggcugagagaaagugaaagccauaaaaugcuguuaguaaacacaacucuguauccuguuuucagacguguguaguuacuuacacgguauaaaauauugaaauacaaaagaugucauguaccccgacugagcacaccugcugaacccgucagaaccagcgguuggucagaguacuguaacuaaauugagaagcaaucucuugagagagguggaggccccauuucagagguuucaacucuggggucaucucucccgggugacuugagggaagguuacugaauggguggguguguuuuccaauugcagaauugagaaccggauuuagagggagggaggggaaggagggagagcugggacaccuuucccagcucugucccagcuggggaagggggagggggacuggcccugaaauggguugggcuagaagaccagucccagccuuggcugaggcuugacuagaaaccagacagucugcuggccuuagagauaugacugaguccccuauaacuccacucagcccauucgguguagugggauggggcaucugcagacccuucaaaccccgggggacagaaaguucccccagaaaggccuaggaaggggggagugcaacgcugcuaagcucacgucagugcuggacuuuaggguccuaagcaagggccaggaaggaccaaaguuguuucccuauggucucaggcucccaucugagcaaggagcuuccuaagucauccugagucccaucuggcucucuagucugugaucaaaaccuacaagccauuccugcacucucaggauccagucaccuuuuaggggaugggaauccccacucccucaugugugcccuaucuggaugcaguuuggcucugaggaggcaaucuugagagaacucauugggucuugggggguggaaaggaagcccgcuaucacugucaccucuguaucuggagggaguugguccagccuggcaggugaugacccccauggcugcuguacagggugggugggugugcgcagggcaggcguugagagcccugguucuugaaccaccugcugugugcgccugcucagccucccugugugugcaucagaggggcagagauuuuauucucuggguucucaggaugccccgggguucccugaagaaugagcuucuccuguagggacucggcaccucaacagcacucaccagccucccucuuugcugucuguaccacagcagcgacucccacugugcacccggagcccaagaaggccucugacagaaaucuguccuuugucucagcucacaccuaucaagaugcccacagcaagggaugcaguggucagggacaggaagggagccucugccuggcagucaccucugucacauucuauaccccaugcucacuuaugccaccuuaaagcauuuuuuuucuggggccaucauguccguuauacaagagaaaaacagaagcccagagagguuaagaaacuugcacaagguugcacagccgggaaaccacagaacugggauucccuccagggagccugacccuagagcccacguuccuggccacucugcugucucaaggagcagaaucagauuagagaaguaacagccauggggcagcauuagauuccucgcagaagaguccuggguuggcuucaguauucuagugucacucaugaaggcucuaagacaccaaguccaagaccccgacauugucaaauagcggauccaaggccuaaggagggaagggucuguugagaucggaaccuaggccagguuacucucugggcaucuccugcugccaccuccugcuggcuggguccccaucuucugucugucccgugcuguaggcuguaggcccccuuguccccaaagcccacccagcagugccugggccacaggguccuauuagggauuuuccaccccuccaaaaaggucuuaaugccugucaguccuugugaaacuuuaauuaaucucagaggccgacgacuugaaggagagcugccuuggccucacaaggcugaagaugacggcuccguuuauguggugcggaggaacgcugcagacauuccugccagcaauaaaaaccacauggcuuuuccagcgucgcccuuggaaaagagagaaaaaaaaaugcagcccucugcggaaagaaagcagcuguguacuguacgcauggcgugagauaaaaacaggcguuccgagguggagaacaguugggcuuuuaugucuccuccaugaccaccgucaguggcagggcccagcggucacccucuuagccacaggcagcucagagaacaggguuggccccaguggaaggccuuuagcugcuaaggaaaagagccucagcccuuccaccugggcugggucuaagcucccuggcugucucugaggucgugccagcacccuagggugugaccugcaccgugucacagggcccuuacuccucagaagggcacgcacugugcucaaugcacgcucugccgcagcagcuuugaaagguuucguuccuuggugaacaaggauauguguuuuauuuuucaugggcucccccaaaucauauggauacauuccuggccacagagcucccacaggccaggaaccuaccccaugccauggcuuggcucguaaggugaaaggagcagaggcucacaggcaugacaggucaaagaagucaacauuuguacucaguucucccagacucaaaaaugaggaguguguguguguguguguguguguguguguguguguaagagcauucgagugugccugugccuaugcguguguuuguguauauuucuuugugugcaggcacauauguauguacauguggaugccagagguugauaccaggacucuuccuuguuuacucucuaccuuauucaccgagguaaggucuugcaacugaagccagaguucaccauacagcuuaucuggcuagcuagugggcuucgaggacaaccccccugucuccgacuguggacugucacucucgccuggcacccccaaccacugcgcauuuugcaguguuccuuauuugcggggccaggugaccaugugcacugucaagcuuuuuccuuauuaccaaauaacagaaaguacaagauaagugcuucgaagagccugguuagaacucuggaggaccuggcccauguccacagggcuggaccaugggguaguucuauaaccgugccauuuauaaaccucggagggggucacuggccugagccugggaugugugacagagucaaaggucuuuuccuucucugggucuugggcucucuuucagggacacaguggcuuggcaccugccucaucccuaagagaccuagaauuuauccaccuacaguagaucuguucaucuuccauccaauggcuagagaaacugagagcuaggaaggacuauugaauuacccaggucacucagggggcuggcaagacccuggcccuggcucugggcacugacugacuugaagccgcuuucaucccauguccauagccacacuggccugucaggaaccucuagugccaaguguggaagucacagccacacuuccugaccggguguuaacgauccccacucuggcccguaugguuccaauuccccacagacuuccuccaaacgguggccuuagguauugagguaaagacuuuggguuuacaucaugggagccauaugcaucuggcugccuggaagggagugggcccuucuucugcuauccuggagaucacaggcacaagugucaucaugcaacggugacgcaggcccccacagcucugcaguaccuugaccucagagucaugcaugaucgagagagaggagaguaagcgaccccggcucgggcguggauggagacauucuccuuucccaucaugugcucccaggacaagggcaccguuccagggcagugcugcaucucgguaaugggagaauggauuggauuuguuucacagguggagugggaagagacccuagccgugcacccgagcuuucccccgcccuacagugacccaggguagagagcagcccaccugccuggaucagaggaagauggcucauugguaacaggacccuccaggccuggaaggcagagcacuagccuaggcugggcccugggcuccugcuugauugacagguuguuggugccccucccccagcuuugucucucucaccugaaaguggggaacauuccugugcucaaaauggggugugagguucuggcgcacaggggcuucagagaccacagcucccgauagcuauuccuaucuuggaggaagggaaucacugaacccauuggcuaaggcccuaugacacccccagggaccuuggcguggggaggacaauuggagccacgucacaugacaagcuguuaaggcaacugggggcuuuguucuggagaaggggccaccccggguaagaaguccuccuucgaugaacagguuccguuugcgucuggguguuuucuacguguguaaaugcgcaugugcauauagguuugcauguacaugcgugugcaugcuuguggaggccagaggcuaaugccuucuucccuuucuuuccacuuuauuuauuuuuuagauaggaucucucguuggcccggaacuuacuguuggugcuaaauugguuggccaggaagucucaggcauccuccugucuccaccuccccaacacugagacuguagauacacgcgcuaccacaccuacuuuuuuaaacguggguucugagggaucgaacucagauccucaaguuugcauagcaaacacuuuauugacuaaauugucuccucagccuuggcugcuaucaucaucaccaccaccaccaccaucaucaccaccaucaucaccaucaccaucaucaucaucgcagcagcagcagcacagggcggcauagaucccuaacuggccuugcacuuuguguugcugaggauaauucccgauccucccuugucuaucuccuggguccuaagaucucagguauguaccaccaugccuggcucgcuuuuaaaucuauugaagaacccccuguggcaaugaccacaggaugcugagguggaaugggagacggggagacggggagugcucgcucucggcuccacacaaggaaaguaaguucuaagaauguucuagaaagagaauggagcuagugagcugcaugcugugagagacagacacuagacagugaggaauucagcugucaaauagggcaggaggcuaaagcagguccaggggccagggcagagucagcuaaugggcaagguuuauggaauaaaugagagagagaguccgaggcuguguuaugaucccgcugaggucaggccuuggagccagcaucugggccucaggcugugugaccguggaguucccugaggucaacugcucaccuguuguguggagagaacaagucaccuccaugcucucucuccucagcuucccucccucaggucccccaggguuggucaucacuucuccauugcuucugcccucacaagcccauacggccaugcuggugagauggcucgccccagggaaaggcacucaaaggccgcuaaaccuuuuccugggaagccacacggagaagaaaagaaccaguuccugcaaguugcccucugaccuccagaugugugcugacacaugugcacucccauaaguaaauaaauauacuaaaaaugaacucagaaagggcacaguauaugcagagaccagaaagugacccccacccugucaggagggugugucuggagagaggcuccuucaggguaggagggggaucugaaacagcuaagucuccugugggcccagaggcuugccugcuuuauuuuaucgccguucuuucauuguucaacaaaaaucauuuuuauaugcucuucugugcuuaaagcuuuacaauaaauguuuuaaaggcaagcaauauauauuauauguaugcauguacauacacauccauauauauuuaagcuggcuagguaugguggagucugcuuuuaaucccagcacucaggagauggaggcaggagaaucucugugaguucaagaccagccaugccuacauagugaauucaggaacagcuggagcugcggaauagagggccugucucaaagcacauucuuaaaaaacaaaguacacugcugugugucuguaauuccagcacuugagauaugaagcaggaagaucaggagcuuaaggugacccucugcuacacauggacucuggagccagccugggcuacacgagauccuguuaauaaguaaauagaaaaggcuuuaaaguuucucugucuuucaaaccucagagaucaaacaagauuacauuuaggcgugcgccuuuuaucccagcacccaggagccaggggcaggcagaucucugugaguuugaggcuagauuggucuacagaguuccaggacagccauggcuacauagugagaccuugucucaacaacaagaagaagaacaacagcaaaacaacaacaacaaaucacuaccaacaaaacaagcaaacaaaagcuuacaucuguguugcuauacagccguccaugacacaucaaaaugaggucuacuuaucauuucagcuuuuauuucuggauuucuuaugaugccugggauugaacuuacaaccucccauguuccagguugguuucaccgagccacuguccccagccccaggaauguuguucuuggcuaaauaacuguuucacugacacugccagucuaccaagcucucuccugagcucccaguccaauggccugauaguucuuaaagauaccucagggcacaggcaucuccugguacccagcaggcaacuagugcccacugagcaugcucccugcaaccuccacaaauccuaccaccaaucuuccaggucccugccgggguuuacuucacaggugacagugcguucagccugagaauucagcuugggagagugugguugagacauggaggaaggcucuggcuguugacacagugauaugcgccaaccgcauccccaccccccugccccgcccacccacggacccucgagcuccuaacaauauacaucggauagauauuugcagacaaguuugucucagucuccuuagggauuaggcaacucuaaggcaacccuguucucacaggaggaagcugagguaaaaguggugacuuggccaaaguucacaacggagcagcgcagcgagugucagagcugaaucaggccgggucugugggcuuggcuccacaguggauccuggggauggacggccagcaggggugaauggcaggggcuggggaggaggggaagcugcuugggaggucucuucccaaucuaagcccacgcacugaguggcuggcugucccuucucaccgugucuuggggagggagcccccugaggaugugggcagcugacccugggauacagugggcuuauaaauccugccuggccauccuggccacagucucccaacagcggugcccuuugucauuuguugcuggggcgagugucucacuggucacaguguaacaugcccaggguucucacaugcucacaaauguccucagacccagagucuuucucccagcccaucucagaaccucagagccuuaagcuuacagaccuggccaguucucaucccaaccugguccccagggacugggcuuucugucuugggcucaggagcugugugcuuccauuagaaaguagagauaaagggagagaugagaugggagguacuaauuucuauuuuccauaacacugggcacacucagugugccauggggggccaggaaugcagcaagggguguggcagcugguagggaagacagaagaccugcaaggauugaugcugaggagagccuuagggcaaucaggaagggccuccuggaggaggugacuugggcugagcccugaggguugaggacgguuuaaagagccagcagcugguagccaagcucaccgcaggacaccagcuuccuuccccacaggcuccugucauccuguaucuaaccauggcuguccucugucuuuuaucucaucugagaaccagaugagaaccagagaaggauucagguuccuggaagcuggggaaacugaggcugaagaggggauggauucagguagugcugccuggguacuacuuguggccggagccugauggcugcgacuccugcgggucaccggcugugucugggaggaccaggguuggugcugggcacgguccccagcggaaggcgcccggcccugauuggaacaagguggcgacgccccgccggucgcauugaucucgcccgguguuccagccccggggcggggccgcgcugggcgcuuugccggcuuucccagguguggggacaccccggggaaauggcuuuucaugugguuguggcaaagccuugccacccagcauguggggggaggaaaaggaaugggggcacgcuggcagugaggaggagggucuggaggcuggagacccacagccagccagugccagaucccagagaggggucgucggggcucccgaaagguugugggacauuguguucccuuacuguccuauucccgcugugugccacauagguuugggacuuagccccacguacacacagggacacugcugcuccugugcugagggaucugccugagucagagguucuuugucuuaguucugggcugcggauguagcucaguuggugcgggcgccuagcaucaggaagcccuggacgcaaccuucagcagcuccgagugaacuagagauggugguucaggccuguaaucucagcggaggugggcauggggugggauaguggaggaucaguuguucaaggccauucucagcuaccccggcucuucccucaaaacauacaaaagaaccccccaagagccccaggaccagguuuuagauaugagacugacaauuggcccacacuggagggagggguuugggcagaauaccccuguguccaguuugccucacuggagacacagguccacagagggugugcugaagugacuggacacugaguggccaccuaggagaccgcggagggcuauggcacgcuacuagucuuaaugggcauuuucuuucugguacccagauaggucuucuaaucaaaacaaacuuguaguacauggauuuauuuguaugugugcaucuucaggcaugugugcggaggucagcuugugggagcugguucuuacccuccaccauguaggauccagggaucgaaccaaagccauuaaccguggcagcaggcacccuuaccccugagcuauccugcccacuccaguucuuucugaaucucgaacucagaucccucaugcgucauggaauccucucugaucuggggcuggcagcccuaagaagucuggcccuugucgucaguaagcacccgcucacugguuuccugaaaagugagcacucucagacuggcuagcugcuuagcagcauggggcuguacugggacaggguugggggcaguggaggacaaggaggggugggggcgucccugauugccugccccuuucugacuggccuugaugggauucugugagccuuguucccuccuaugcucuguuuuuguuuccuucuaaacugucccuccaccgccccaguccauccacugagaucuugagcaugccagucucuucuacucccugccucaaggccucugcuggccugcccgcccgccugucugucugucugucugucuguccaucugucugucugugugcccaagucaauucaacucugccuggccccuccuccuucucugagcccccuuugcaggcagaaucauagugaugucuaccuccuagucccaagauccggggauaaaucaucuuacagggcaaaggggacuuagcagaugccgugcagguuaaggcuccaagaguaaauuggguuaugcagguggcuuggagacuagucugggcuacgcagguggguguggaggcagugaugagaacagucagagaggcauggggaacaggccagagagcuguggggacagcaggggagccggcacugggaggagaugggacccaucagcacuggaugggaagacgcuggaagccaggagccagggacaugggacggagccggagcaggacccagcaacuaugacaaccccacagcaucagaacagaguguaacucaguccuuugcucucgucggauucucguugggauuucuggccacacugugcucguggucacucuggagagaggcaacgaguguccuggguccggcuccucagcagacaucagugcucugcaggcagcucuugucuccuguguccugugucacugggagacaagagcuuugcucugacuagagucucccacacagagcagaugggaagacuauaagccuguccccacugcagcgauguuuccuuguucaccugaagucaggaaaccuggcuguccugcauuguauguggcuccucagucccuccuccucaucugaggcaaauccuggcuacacacccggagcucagcacaugcuugccuaauggguggaacaaguggauggaugcucuagcgcuuagccuagugcacucuggcuccagaccauggccaggaaauggaaagcaaauauucuggcacuugggagacuggaggcaagaggaacauuacaaguuugaagccagccucgucuacaaggugaauuguaggccagucagggcuacguggcaagacccugucuaagaaaacaaaacaaaaaucaagccaucucuauaccuggaguggugcugagcucuuucuaacggucuaugcguaauggcccggugaugucauuaacucauuaacccauuuuccaggggacaaaaccaagacccagccaagagacucagcuacagaguguaagagcugggaaaugccaagcacucaagaggagcaggacauuccagcccugucucccuccuuacccucuucucacagcagagucucuauuagcccaaggggucuucauuuuauggcuaccaaacuccuaugcauacaccaaagccccaucuucauuuccccucucugugaaacuaccuccaacacuccccugccuccuuguacugauguucugugaggacuugcugguggcccuugccuuuccaggacugugaugcccugaggacagacaugggucauuuccagcucucuggaaaggaacagaggcuucccagagcuuugcagaccaggcaaaugagugaagccugccuuucccacuccgggccucgguguuagaguucagaguccacaagagggaaaagagaauccuucacucccuccucucuuaaaacaaaacacauauuuuucuggguaugaaaauaauaccuauucauuaaggaaaaauuggaaaauaauagaauuauggagaagaaaauuaaaaccaccccaacucugccacccagaaccaugcuggcaucugcccuucggaugcuccuuccuccuguguagcucuuacugccuccuuccccacccacccccaccucccugccucccugggcuucuuugcuuccuccuauaaugcugagaacggucagugcucacuguuugaaaugacuccauguacugucaucgaguuccuuccaugauggcagcaacuagaggcugcugagccuggcccccagauugggccaccauuguguugccuugggccaacagcccagcuguuuaggguguccauggauuuccaucauuuugagggacacccucucggauggaaucggucacaucccugaccccaccacccuuaggacaaauccuggaacagagauggccaggccaggacugagugcucugccacuagcccuccagcuguuucucagguguuccuaaugggcaagaaacuggaggcacagucccuuuucuucccaagaaaagccaauucacacccaacgacuccuggcuccauccaagggugagaacacccgacacccauuuuuuuuucggugcuccauucaagccaugucaaaggcuuuccauccgucucugagaugcucaguuuuaaguggauagucauaggucagccggggcuuaggaugcugugaccucaggcuagacaaagcucacuuuuuaauaaaccccaagcuggccaggcaccggauccgggagaucuguguucuuggaggugggagcgguugccuccugucccacagcagagaacacagaaaugccacggcugggccucacccacagagaauuugcugaggcccguguauagcugauuuuccaccgcaggcugcuggcgcuguuauugagagcugagggacuggggggcauuguggucuggguagcugagcccugcucugagacaccugcagcuagcugucagcggccacagucuuaucuuugcugggcaucagagugaagcuuaggccugacagugagguagccagauccugccugccuggaguccccuucuccggugcccugggaguuucuccuuccucaccuuucacugcuccauggaguggagcgggcuuggggguagguagcagggagaacuuuccaccgagccccucuccacagucauccugugugcucacaggcuucauuccugcugugcugcauccccuccccgccccccaccccaagacaaagcauucaccaugcccuggugauagacgauucauuuuuaggccgccucacaggaagaagaggccagaaaugagcucugggguugcccaggacccuggggacccuccuauuugcaugucuuuccccaucaccccgagagagcuguggauuucaccucacuccugagaggcuucucagcucuggcacaggagaccggaauggccugaaggucccuggugucccccugugugagugcugaagggcucaaagcccaguagcaugccaccagagucuccguagcccucuugcuucucagagcgccacccccacaucaugccaucacauuuguguuuagacaggagcugggguauguggcuggggucucuaagagugugagagauuuccugguaagagaagcaggucuagcacugaacccccacccccagccucuccauugccucucugggaugccuaggugggugcaucuacuguggcagggccuggcugcugaagugacagaagugacugcgccuguaugaggcucucugcaugcacaccacacaguaagugggcacaaggcccaaagcccaaggcccagggcucagcaugcagggcgugagguagcuauggggucaaacguuggcugcuguauugaucugguaccaaggagggcacagaugggaaggacuuggggagggacuguuccacagaaguuggggggggguguacuuuggagcuguguggaagacaggagggcuggcagcccugugcugucagggccuggggcagcuggaucuggggggugcuugcuggggagaauugccuugccuuagccucucuuauuuauugucuguuuaaacaaugggguucauaaaaagcauuaauugagcugccauccuacccacccugggacacaaaucacaagacugcagugagaaacggggaaauacagacaaaugagccaaacugucaaagcuggagaucucauccccugagagcaugggggcgggggaggguggcgucccaggaacagggcuccuacaguacaacaguggcaaaguuugucaccaggcucugcaucccuugcaagccuccuguggagcucagccuugucucugucgccucugacaacccugaugugggugcuguucucuucgggugcggcauucaauauugagucaaagaugguugggcacagcucccuggcugcggaugucagagcuaagaggaaacuccgaauccaugaguugguggccaugagugaccauccacccgcagcccuagucuccgacaugaaaccccagaugccacaaaccaggccccaaucaugauccuagcuugguucuuuguccagguaccacugccuucaaccccagccccgguugcugaugaagcuauagucccacuacaucuguuuaccaggccucucagaagcuaccccccagcaccacagguaaaagccaagggccaaaggcccucucaccagccccaguguccacacaggcagugcaagaagggugguaccucuugccaucccagacuacuuuagaccaagucccugggcuccaggugcccucagaccuggacaggcucugaggccacaggagccucauugagcuuggguugucuguccaugguuggucugcagaguuggcucaggguaccaacuacaagcccccauguccccacguccuucugcuccucuccuuuucucaccugcaccccaggcaaggggggugguguggaccugggguugcacggaagucugaaggauucugcaggacccucaggucccaucaaagcucacucuggcugaaggcccucucucugugccucaguuucccuccucuguccaccaccuucugagaguucacagccagguuccacggccuccuccucugggcccucaguuccauuccucaggugacagacugucucccgcucccaucccccaccccaccaccuugccauccauacaugcuucucccucucuagaguuggagagacgugugaccagugcuugagggagccugggggagccaaagaguguuccuucacguagggaaacccagauuucuguguagcugcccuguugugaggugugaaugcucccaggccgcugccugggcuugaacccaggcuguguggucucaggcaggugcaacaaucucuuugggccuugccauuuauuaaguggguuugauacuagcaucuccuaaccaggcucucugagcagagguauggaaaucacucagugucugaauccugagacuacuuaaaagucgagccauuaucgcucauacuuucuagagauucaauucacaauuucucucccggcaggaaugaaggugcacugaagagaccccccagugucccuuacagaaacaaaggguuacaaggagcuggauugucccccggagucucaagcugagagaaagaaaaggcugaagccuggugccaggcugaagaggaauuuguccucuggaaacagguuuucacagucugagcauuugacacaucuccuagcuauagagaucgaccagaagccagagggugauggucaggagaugggcgggaccacaccuugaccugacuuagccacgccccucuugugcucuauuuaaaccgaaaccuccugucaggaccugaagauggacuuuuggagucauugguucucuguuccccuucuuaaugugaccucacuaaguaagucucucuuuuuaaauuaaccuucucuuuaauuggucuauugaggguguguggcugagccuagcuuguuagagaugccaggacccuaacaacuucagaccacaguguggauuucugaaccuugcuuuuguacuuucuucccuaacacgcucccgugacauccucugcuguuccuggcuggagcugcuggcaggugggggcauugcaucuuucccugaaacauccuaugucgagguuggguagggugaacuuucuaaagaccaugcucgauagcauaccaaaggcucugacaaguccugcaacacaacccugugugauacagcagccccugucuugcacauuuugagcccuauguacaggacccaauaccuguguugaacacacacagggauauuccacuuucauuuccugcacuuuaggaaaaagacaggaauuggaacagcagcucuugguaagggaagagugggccccauucacagacaccauucaagguccucccaucccuccuccacugucugacuccgccccacaucagccagugcuccccccaccaagaggcacuuuugaacuuauuaggugcuuuuuuuccccccucccugcaacaucugaugaaguaaacagaaucaccaggaguuguccucuaaacuguaaaugcauugcgcacgagaccucccguggucugagagagaacguaggaaacaguugggcgugccuuuaggagaauaguuaaaaugaaauuaauaggaggcguggggagaaugccugugguuaagaccgauggcugccguaccagaggacccacauucuguucccagcaccgaugacaggcagcucacagcugccucuaacuccagcucccagggaucugagucucugggcuucaggagcacccgcaucuacacccgcagaccugagcacacauucacacacagacucacacaccugugcacacacucagagacucgcacaccugcacauaauuaaaguaaacaauaaaaguaaaucuuuaaaauaaagcuaauaaccugaccucacgacacaggcacccagguacacggaaggcugaggcaaaaggaucaaaaauucaaggccagccugggcuauguauacagaaggguucacaaggccagccugggcuauguaugcauacagacugaauuuacauggccagucugagcuauagauauauagacucaguucauaaggccagccuugggcaacuuaacaagauccuguuuuaaaauaaaaagcaaaaaugagacuggggcuguagcugaguggcagcaugccugcccagcaugcacgaggcccuggguucaauuuuuagcaccaccacaacaaacauaugaaugaaugaaugaaugaaugaauguuaaacauccaguguacucgcuacaccaggcuguguauggaguguuuaguguuuguacacaauaguggucgugaguggcgugaguagacaugacccugacacuggauucuucucagccuacaggcauggugacagcgaaugguuuuccugagggucugggguacucuccauguggccucacacacggugggaaaccaccccacggagcauucuagaaggaaagauaccaaaugauggugcuuuggucuagggggggcgggucugcagcuugcuuuuuauuuuuuuaaauaaauauuuuuuaauauauauuuuuuuaaaagauuuauuuauuuuauuuauaugacuacacuguagcugucuucagacacaccagaagagggcaucagagccacuacgugguugcugggaauugaacucaggaccucuggaagagcaguccgugcucuuaacuacugaggcccugcagguugcuuuuaaacuccguggauuuuguagguguuuuaugacuggaaaugcuaugggguugggguuggcuggacuguuuguccaggugcugucaaugucucugaaauuugugguuuuugcucucagcagucucauaucugugugugugugugugugugugugucacaaugcguguguagaggacaaccuaggguauuuuguucugcuguguggggccaggcuagcuagccugugagucccaggacuucccacccccugccucccaucuugcuguagagguucuggccuuacagaugugcacagauguaccuggcuuuacguggguuauggugaucggaacucgaauccucaugcuuuuguaacaagcauuggguuacugggccaucucuccaucucuauccugaaagacuuaaugaauuuugaacacggguccugcauccucacuuuuuuuucccccuggagugucccugagcuaggucucauuuuagcugauuggagucucugcucuguccuggacagaccacagacauggccaucccuggcacagucuacgugcuugagaagcagugugcuuugucagucugucugugugucuagggagggauaaaaauaggggcccgggcagcuugggagcccuguggucucaccacacucaugcaugcacgcacauacagagcaaccuaucuccucugugcacaucugcgcaggccuauuucagggagcugccugugugucaugggaugugggguagccaccacugcccagccugcagucugcccggacuccaccugccgugaagucaugcccagcucucacagcaggcugucuccuuccuuguucuucucccgggucuucuccacaggacacacaagcuccaucuccaggaacuaacuccuccgugugacccuuucauuccguuuacuccgcaugucuuuauccccccagaucugccuguuguggauuugguucagacucugucuuccucaggaacauucaggaagucucugaacaggguugggaaugaccagggggaguucuguggcugauguggugcaucugggccguagggaagaggagacaugguccagguaggagguggcuuucaugucacacagaccauuugcuaggcacugaccucuugcggagacuugcuuuugccaaccgugacauggugauaacaacgacucuguccacuacguggauucucguggaagauaaguggaaaugagaccugacucccgcaggugcagcucccaccguccuuacucuuuccuuuggcuuugcugggagcaggacccaccaaacucucaacaucugggugcauuuggaccucauucaugaugcccguucaauuagacucaauguguucauacgcaucuauagaggucccgggaggccgagucagggcugucagagaucuaagcagggcuguagcaggcucucaggguuccagaaguccuuaacuaugagucuuggggaaggacugccucucuucugggccuugcuucuccuaucuguaaacuguguguguguguguguguguguggggggguggauauuagccccagcaggagaaauacaguugccugcuguguacacuccugcgugcuuacgcacaguaggucagcaguucucuaccugugggugaugaccccuuuaggagcugcacaucagauguuuacauuauaauucauaacaguagcagaauugcaguuacgaaguaguaucaaaauaauuuuaugguugggggcgggucaccgcaauguggagaaccguguuaaaugucacagcuugaggaagguugagaaccacugcaguagugccaccagaggggccagcaguacccacaaaagagacaaccaggccagagggggagcagacugccucucccagggagcugcagagcccuugccucagacacaagcgcagccugggcaucugcucuaugcaagguucuacccugaccaggggagauccugccgucccuagccagcaggccagagccacggugggaaagcagacggagcugugaggagaagcagagagaguggguguccuucagccucggcucccgggaggccaggguuccucuucugcuuccuuucuuuggaaauacaaagcagggucuucuuccuacugcuauaaguaacacagacuccauguugagaacuucccacaaagccucuggacuccgauggcucugcucgcuuccggugaccggagcugcugcuggcauuuucuuuccuuuauuuuuuuuugcucgaagauggccuugcgagguuuccuucccuuugccgaagggacuugacuucauguagggaacggggccagggagaugucaggguuuccccacgggccccacuaacccacgaggaacucugcuccccaccugcacaugcaggaccuguaauccuuccuaagacacccuggaucuggaucaaugcuacuucccagaagcaccugaggccuccagcaccugagugagaccuagaggacaucuuccgagggacaguucuugggcagcaaccagcacucccaggugaggugggcuugggacgguaaggaagcucuccuguucucugccccucccuucaucuucuucccuuuccuucgggaccuucaagggcccccucccaacaucugcugccucucacauuagccacucccucuucucggcagauguaaaggggccagauguugcccgacagauguucaggugggagacaagaaaggaccuacaucaguuccgguccaauggcaguggagcccuggcaggaguuaaggcuccccuggacucuccucgggaagguguuugggugggugguacugaccguggcaaccuucaaaacuguaacuuagacgcaucucuccucuccgcccacacgcaagucugagccuugugccaaaaaugccuuucccagacuuaaaagaaaaccccaaagaggaaccuaaaccuccgagccgccagcacccauaggcuaggagagcucuggcucgguguucagagaaaaaccagccagcggaggggaagugaggagggcauggaaaugcgcaugcguggaacagcagugcccucucaucccucccucaaucaccaaccccgcagguuccccaucccggacccucaccccgcgccaccgcagcaagggacacucccuggaacucucuuuagaugcuucaagagugaggggugaugacaacaggcaucccaauucuugggaaaaaacggcucuuaaaaggguggccuugaagcggggucuugaggagaaaggcaaggcuccuaccuucuauuaguucgcagcuuuuuuuuuucauuugcuggaagaggaagaauauggauucagaauauuuuguggcacuaaugaaggucuuggccgugucgagcucugcacuacccucauucuaucccuaggccucccaaacagcuugcgcugggugcuguuaaugucucccauuucacagagagaacaagcacagagaggugaggcacuucucucuaggaugcacagcaaagacgugucuagagccggguuuauacggcugaauugugugcuguguccucugccccacgcaccaugugcaaagggccucgcagucuuucugagcugcccagcucucccuagaaaggcgggagccauaugcuggagaaugagcaagccugaggcuucagacaggaggccaaugugcagcagacacucuuagccugugccgugcacggggccuuggggguuaaaccacauucccagccucaaccccuucuauacaacuggucaauuuuccucuuugaaauuccuguuaguuccucucuccucuccuccccccacucugacuaucucuuauucuuccucucucccucucucuuccucuuugucugucuuccucuguuuuucucugucuaacucucucugucauucucccucucucccccucucuuucccccauucucugucugucucuguuucugucucucucucugucucacucuuccuccucucucuuccuuucugucugucugucucucuuagucugucugucucucuuugucugacucuaucucuguuauucucccucuugcccccucuuuuucccuuucucugccugucucugucucucucucauuuuuugagacaguuuuaaauaucucaggcugacugaacuugccguuagaggggagcgaugaccuuaaaugcuugaucccccugccuccaucucccgagugauaagaauuauaggcaccuuccacuugaugcagugcugagacucaaacccagaccucacgcacaggaagcaagcacucuaccaacugagccuccuuccuggccccagcucccgccaaacaauggguaaaauugaggguugagggaaccaagcugcuaaguagcuucaagccaugaacccugaacuaagugcaaggugagcagcaacuuccccaggggucgagggaaaaacuccaaaacugguuccccuggagcuaaaccgaaccuuucauaagccugagccucuccuuggggcucucuuucuucaucuaagaaacaaggagggugcugucuucugcccacuccaucuuucuugggaauaacuucuuauugagguacuggucucaguucuuguccugacugcugaaggcgagacccaguuuguccugccccgucucuccacuccaccaugaguagcauccagggcucuucuccaggagcugcuguuucaaggucugugauggugcccagauaggacacccaagcuuggaagccuuuuuuucccucuuuccuuuccuuccucccucccuucucaguaaaugacucaagcagucugacaauagcucugggaacugaggcucagaguuccaagguucugguuuguugcagaugaucuuggagagacuucuuggugagugggugauggagauguaggccaggcugggauguagcucagcaaaagcacacuuaccuagaaugcccagggcucuaaguuuaauacacacacacacacacacacacacacacgcucacacucacaggcacauacauaugcacaugcacauaagcacacacacagaaacacacaugacacacuaagcauaggucugcggauggcacaaaaccagacauguacaccaaucagaauagaagggcagcuauagccaugugauuuuugacaaaaaagccaaaaugcacauugcaauaaagguagcauuuuuaacagacaauguuaggaagacuggguuccccuaggauggagagcaaagagggguacuuaaccucacccuucacaggaagaacuccaaaugagucaaagaauuuuuuugagggcuuauuuacuuuuuccuuaugugugaggguuugccugcauguaugcaugggcacugcaugcaugcagugcccguggagguuggaagagggcgcuagacacccuggaacuggaauuuuaaacgguugugagccucugugugcaggcugggaaucaaagcugugcagucuagaagauggcucuuaaccuccaagccaucuccccagcccugggucaaaggucuucaugucagaccagagacucucugucggaagaaaacguaagggaaacacuuccagauacagguugccuuucugaguggaauucucauucaggcaauuaaggccaacaacugacaaacaggaccucgugggaugaaagaucgaaaggcuccauagagcaaaaggagcgagucauacaggcaacggcuuacagaauggggagaacugguuugcuugcucuguaccugacaaauuaguaucuagaauauacgaacaacaacaacauuaucaacaacaaaaugagcagacaauucuccaaagaugaaaugcaaaugggcaauagauguuugaaaaacgagcguccccagaguaagacaaucaaaacccacacugcaugcaaaccccccuccacaggcauuaagaaaagcagcaaacucuggccuggcgaggcacgagggagccuuucuguacuucugguaagaagcugaucuugcuaccgugcaagucaguuagagggucuucaagaaacuagaaauagcugggugugguggcucacaccuuuacuucugggauuauggaggcagaagcgggcagauaucuuuaguuugaagccagccuugucuacauagcaaguuccaggucagccaugacuacguagugagauucccgucucaaacaacaaacaaacaagccacccuacaaauagaauuuccacacuguccaguuauacuacuccugggcagucacucaaaggaaccccagcgcagccauagaggacaaaggaaagugugugugugcauguguguguauguguguguauguguguguguguacuauaugcauguauguauauauauauguauauauauguauguauauauauguauauauauauauauauauauauauauauauauauauggauuuuuuauucauaaagaagaaaucagacccaucacacgcaggaagaugagcagcuacagacaaucacacugagcaaauuaauucagcuuuagaaauaucaguaguauguuuucucucguuuguggggccuagacuuuuauauagauaccuacaaucacauaugcauagaugacaagaaaguggaagugaaacuguccagggggccagaggaccaaguagagggggaggggcaggcagggagagggaggggggauaugaagaaaaaugcuccaaauauaauauaugcauccguugauuaaaaaaaaaauaacuuaagaacuuuuacauuuaaaaauauuuaaaaagagaggcugccaauggcagcuuccuaggaguuggggucaugagcugaccuucuggaugcagcacugaaccccaauucaggguugucuccccaccucucagaaagucaggucugccagaugcuagacuuccuucucaguuauuccucucuucuugucuuacagagucuucuggaaggucauguguucaggccccuccccuucagguaaccaagcaagccccagcuuugauguggccaccucaaggcccuugccaucaaugggcccacuaucugaccugcagggccgccaggggccgccgguuggccguagugggugcggaugaggccuggauacacagucccacuguguggggccagcucacacacacccagacccugugggcagugaggggcuacuaggaacuucuuuccagccuggggguggggcgagacagggugguuugaggagaugguuuguagggaggccuuaggagccaccaucaaagaagccugguagacacggcgccaugguggguggggaaagacuggcggacacucauuucccaccaagcucaguggaggagaaggccauggggucauaugcucagggugagcacaggaugggcugucagugggggcguccuugggcuuugagauacugggugcuacauccccccaaaucucccuguugcuggcuguaggcuaaagcuucgggaagaacauagaccucuguccugcucucucccccuucggugccauccaagucaggcaguugaggcuagacaugaugcgacccauuuugccagcacccggcuaccacacaggaaugcccacgcccgagagcccaguucccguuucuccccaaggucugagcugcccauugaccccagccucugagcaggguucucuguucaucugguuuuuguccauagccccagaagguuggugaucccaccaucuccugcagaaggggaaacugaggcacaagguggcgaaaggaucucccccaugugagcuaagagaggcagcaucuaggcuucaacuagaaaguccagguccagagucuaagcuuggcaaguuuugugcacguuuuguggaauggcugaauuagcaagugaaagccaucucugcacagggugccccuaagucugcgugcaagcagugccacccacuucuucagauccugacguucugucugugaaugagcaaugccagggaccugcagcuuggagguaccuuaaugccaagaaaggccucggguugccaguccccaacagagcuuaagauggccccuuggcccuccauucucuccuuggcuucuggugcaggagaaacaugaggaaaaccaugggguguccugggcccagugaauggccugauucaagggcaggauugagaaaucaugaagggggccuggguaacuucugggagguuccacgcaagcccugccugacuccgagaaggcccaguugccuguccccuguugccuccagagucuccacacugucaguugagcauugaugcccagaggcagggagggcauagagagacggaugccagagaaaacagagaugaaguuauucucuuccaaucuggggggggggggcucagggcucccugacagcucaggggacccacccuggguggggucagggacacacagagguuggagucagccuguccucaaagcaccaacucuaacucacacauccucauuuaccaugaaagaauggcacucagagacaucaagggccuugcuuggagucacacagcacaugggcauuggugaccaccagaggacugagcuuucugccagcacugcccaauucaucggcauggaugaauuuucagaucuaaacccaacacacgcugauuccacagucuggggcggggaucaagcucucuaggaguggggcuggggccuugcugagggagugaggaggguuggcagguguucggagaaggaaggacaggggaaguggagagacugcaggagagagagccacaacagggaucucuauugcaacacuccuaaggugggggauccugagaaccagugugugggaacgcgaugguguggggguucaugaccuaagcagaaauccaggggguccaucaccccggcuggaaacaaugauaacuuccccucuguuagcaaccuugaaacaacuuuuagcaucuuuuuuccagcaugacggugccacuaacggaaaccacagguuguguucggagggucauggcagaugacccuuuaugucuaucgucagcacuccccuccccacaccccgaguuauacuaguuuuucaauccacagggagggcugcugucacucaggugucuccagagaggcucgaggucacaauucacaagcuggucuuaauauauuggaaacugauccugaggcaggagcuguggggguucuaaauuagagagcugagcaaggagagagauaggagacaagggcaggguaucucuuugggaucuccaggcugccuggugauuccagccucccgguaccuuccaccugcugacuagggaccagucacucugccauaugaccucuuucuucuugggccagagcugcuaugaccccaucuuuguccugccuccagcugccguguccagggcuuugugucaggacccccaucuaaggcagccagcacuagcuagcccugucuucuacgguuccuuuguuuuaaguucaacuucuccaucuugcucacggagggcaaaugguuuuuauaaacucuuauuuucuugccgagcaauuacuuugaacuaaucccgaagacuauaaaggguguguacauaguacaacugcagugguuggauguuacaggacccagggcaaacauuuaucgucagccacagccagguuuggaggaagcaucccuucucccguggcucaaccacaaucaaagugcgcaaccugccucaggcuucccaggucaucaggaaagagauacaccuuauucuuagaccgguucuugccacacagacccgaaagugucccaaaccaagugcugagcacugccauggucacagguuacagcugaccauggcagaccucuaugucuuaccuggccacuucaacucaaaaaagguacugucucccaacccuagaauucuagaauauucuccagaggggcuagucccccuguacagcucagacaacagaacaccacagcuacagggaacuugucggaggcagagacguuaguggccuauaucgggucauuuguugagguuggcacagcuguguggcugaagcuuggggaccugggguccccugaucucaggugacaguuuuguggacuccugcuaaggaguaggaaaguggccgagguaugagaagccagcauaacucaaaggccagaggcagggcaggccucucugggauuuagccuaaaccagacaucuuggcccgauccuugcugagggacacaucgcaaaguucugaguccuucugugccacgaauagagacaaaagccacccccaaacaccuuccucuguggccaguacuucaaacuuuccaggggcagggucucccacaguauccgcccauguugagcagauucucauagaggccuguggguccuuucuccacccuuuguucccacuguccugagagugcgcagagaauacugggggugcuccuuaagaucuuaaggccugggcagagcccuggcccugcuggcuucccaugggccucccagauacaucugaccuuugucuguuugagcccuggucugggcagauuaucccggugcccuguaaaggaggcaggaaccggagagccaugcucuugccuugcucucuccaucccagaacccucugaggucuauagguggccacugccacugucacaagcuugacccagcugagaaucaaagucacaccgcgacgcucauaccaggagaccacggaggccaccaaucccucuccccacuuaaguucucagaggcuagccgcugagguggccagagcagcggauuagagaguaauggucugagaacauuacagcuccccaccggagagagcugagccgauccccgccuucagcacuuaccucguaugaagguugguguauaguuggggaaggagucaaagaugcuguuggaagccaugucgcacgcugacaguggcaaggacucggccucaggggguuggguucagacccacuugguuggcugcuguuuuguuauauauauuuuuucaaguugcuuucgaaaauaaaaaaggggagguguugacuuuuuuuuuuuaaaguuugguuucuuuuuuucucccccugcugcuacaaaaaaaaaaaaaaaaagaaaaaaaagaagagaaagaaaaaaaauggggaaagaacgcgagagcgucugugggcgagagagaagaaaaucuccaaggaaagaaaguuucgguuuguacccaagaauuuggcuucccagucccacaggaaugucuagccacaaauuuucaacagcacuaugugcagaguaucauuaaauggugggaaggggcucugggcagucagggcggaggagcccggggcugcagcagccaguccagacucagcagccuggaugaaugaaugaaug

SEQ ID NO: 12092 - RNA, 69154 nt, Mus musculus
cggagcgggcgcugcggcgcgcgggcgggcggcgggggggacgcgggaggauggagcaaguggagauccugaggagguucauccagaggguccaggccaugaagaguccggaucacaauggggaggacaacuucgcccgggacuucauggugaguguccguucucgccggcgccucgugucgccagccgccgagcuccccucgccucucccggucggucggggcugccagcgcuuugugugcggugcgaggacaggcgcggggcgcgcgcccagccgcgagcgccgucggcgagcuugcgggaggcgaggucacccccgccccucagccucucuuuuccgcggccgcuaccugcgcuccccggcccagcccgcuccggccccgccgcccgcgacuaccuauugucuccccggccgggcggcggcggcuggagugcgggcucgccuucccacgccugccuuccccgccugccccuccggggagggucgaggcgagcugucuggcugcggccagcggagcggcucgaggcugccggagagcgaggguguagagcauuaacucgcugggucccuguacggaugccggccuugguccgaguggacggcaggacgacuccgugucuggguucacaguuauuagcucagcgcuugccagaggcuugaccauaaggaaucucaugguuuaccugaucuccauuuaucuggucagguuucuuuucguccugagacccagguuugagguggcugugaggccagugugacuuuagaucgaaaagggagggggauaucaguguggauggggguuauccugaaggaagcucacuccggacuugaggggauauugccgaagccggaggggaugugacuaucacuuccuauccgggguggggguggggaagcugggaacaauagucaugguaggguggaggcgacuauaugggcugaagcccugggagauaaccuucccguccccccuuuuccgccaccccccuuuccgcccucugcuuguguaggcaggcuugagugaguggagguggggguuaaaagucuaguaugugaaauuucucuaggugcauaauuggagagaggguaucaauuccgaaggcgugggaccagaagcugacuuccuacauuacccccuccucgcuccuuuuauuuuucuguuggacaauguucccucuaggguuguuucccggcuuuggaggcggugguugcggcugcugcuccuacggauguugcgcaagacuggggcguuguaaacccuggaggucuggggaauggaaaaggaaaugggacuuugggaaguccuucgcucuuuagcggggguugggaauagcaaaugaacuagggaaaauuuugcucuggacaaggugcacuucuaagaauaaucaguucaucugaaauuugguuaugaaaagccauaugcaguugaggucuauaaaaaugaguggcuacgaaacauuugcuaguuuuuauuuaaagugcaaaugaagugauuuuuaguacugaaguggguguucacauuuuaaagagauuucugucuaguaaaacuuuaguguuaaaauuguuaauggcuugaaaaguagacuguuagccuugcacaguauuaguaguauugugggguuuugugacuuccaccuugcaguuuuauaaaaauagaaaguaggaacaagauacagugaggacugaaaauguagaucaaaguccaguuauuccuuauuuuaaacauuuucugauauuuagaugauguuuuggaaaaaguacuuuucuucuuaccaucgaauuuugaugguuaguaucuguugaaugauaucauuugcaaacauuggaaagagcccuccuuuuacuacucuauaguaaauguagaagaaaacaguucauugaggguguguagaacuaguggcuugucauagaaggggccuuguggcccuggcuguuggucgaaugcuugcuaucuugcuguccuggacauacucugucaaggaucauuguuagugcaggccauccggacaggugcccagucccugcacuuuuggacaggggaucuagucuugggguucaugcuuuggggaugacucagggauuccuauuggagaugucauguccaaggaccaaauguguucccauucuuccauaauaccaaaguauagcuagguaguucuacaugagagauuugaugacuaaggcuauuauucuuuuauagggcuugcuuuuuuaauuuccuaacuugauaagcaguagcuauaauuaugauuguuggcaguugccucuguuuuuuucccuugacuagaaggcuggaaagaacuguccucugucauggaaagagaaucaaagaugaucacauaaauucuaacuuuuguuauuaaauucugaaguggauuuuaaaauccauuuuaaaaaagagauggugacauuuuuggaaaguaugucgacugaaaucacuguugaaauggugucacaugaagcugccaguccacugaugccugaacuauuucaucauguaaauaauuuccaugccucccuuuuauaauaaacgaaugaugccuaaacugacagccauugucucugaccuuuaguuucacugaacuguuacaaauauuuccaaauaaaauguuguaaaugaaaaaaaagaaagaaauuaaaaucuuaugaaaauucagaaucaauaaagaugauuaaguggaucuccaaaaagaaacacagucaacaucaaaauaaaauuaaaagucaaaaaaaaaaauccauuuuaaaaccuuaacauuguagaacugagucuuaaaagguaauaucacuauuauaacuauuucauuauaaaguaauaguuucaaaauugcaaauuauagaauauaauuauuaacaguaaugauauaauuauaaugguaauacuuuauauuugggugauuggauugggcauccauacuguggcccuauuuuaaggauggagcuacucccauucucccuauaucuauguuuauaauaggucuaugucacaauaaguacauauauuugccuuuguaaguaguuagaaguuucuguuuguuuuguuucugaggggcagggagcugaacucacucaggacccaggcuguccuugaacuggugucagcccugucuccgccucccuaguacuggcugggaugaaagguaugagcugccauaccugugcuauguucuugucuuuuggguuuuuuuaagcuuagauuuuggugucuuuuauuacagcuacuuuuuaggaauaacuuaagcaugucacaaugugacuauuauaguuaaacuauuggcuuguauuucaauauuuguucuauuguacuuuuauauacuuugauugacaugaauaaagccucugcauuguuuauuccuaauauauuuuuacaagaaguacacagucagaggauacaaaacauaugcuugcaacuuuaaaaaguuacuuuauacaauagucaguaauguauaggugugugggugugcgcauauauauguauauauauaauuaucuugguuuuuauuuagugguuuagaaauuguaucuuguuugcuuuggauuuuuuuuuucuaaaaagacaaaaaagaguuuugucuuuuccagucuggaucuaauacagccuaggccagccuugaacaugcuguguauauuaagcucaccuaggacucuggauccucuugccucuaccacucagaggcuagaauaauuugucacuauucgugacacgaauuucuuguuuacuauuaaugauagaugauugucugccuccauaggcaugugguagucuuuucauguaauuccagcagacaggagaugaggcagggagauugugagauugagacaagcccagcuuaugugagagcugugauccuguccuaaagauggacggaggaaguaggaaagaaggaguuaacuagagcuuauucuucuuggccuuggccuguuguaccuguucucucaaaaggagaaaccuaggcaccaagguuuuguggccaggcacauuguacuugacaugcuaauuuugcuaauaaaaugaacuaauuuaugacaggucuggaucuugaucuuuacucucaacuuucagacuaagaucaugguacacaucaguauuucacaauuaggcuuugucuuuuauuuucauuuauguguauggcuauuuugccuacauguaugucauuguaccacaugcaugucugauguccagaagauggugucaguucccuggaacuggaguuauaauugugaguugucacuggguacugggaauggaaccccagauccucuagacuagccaaugcccuuaauagagucugaaacaacucuugagcccucagaguuagguuuuauuucauacccauugccugaaguugacugaggagagaggcagccuggaaccauguauugaggaccagagaaccaguauauaaugcagagaaaaggugaugccugagacagguagguuuuggacugugaggagagggugguggugaguccacuuugugaaggaucuuaccaauguuuaacaguuaauauucuguagggccauaaugaucacugauuccuagcuggcuugccuaaccuucugacauugcaacaccaaguugucaucuauaaauucucauuggaaaaccaugugguugaguuaaaaaaaccaaaccaaaaaagcuccagaaaaauuucauuauguuuuaaaugaguuuacagauugguguugggccacauucuuccuuaccauguugugcauguggaagcuacagguuggaaauaccuuucaggaucacagggaaaagugagguuauugagaauaacaaauaugcuuguuuaacauucuuguggucuucucuucccuuccucacacccuaccuuccgagccugguuuuuaagauuacuguaagccuuaucuuauucagauauguucugguggagaaacugaaagauacuaugaaccucuggagggcaggcaguggaaugucuuaagaaagguauuuguuuggcagaaagggcuuuaucugaauuaagucaaggaaacuaggaguauauacgacauacuugaugaggguuagccagccucaagcaggauggaugugcacacucauggucccagagcccagaaggcugaggauacugaguugaaaacuagccugggaaaaggagaaagaagaagaaaagggagaggugucuuaaugacucacuagguaccauuuaguacaguggguggaggaauaagaaaagaaacaaggagagcugaucaaauaagauuguaggagaacggcucagaagagaagaugaauuuaguuucagacguguuaaaugccccugaaguguccaguacaagucuggagcucauauagguagcagucaugaguuuguaggagguaauugagcaucccgagugacuaagcugauucggacgagcauuaucuuaaauaggauaggccuugaaaauguguugugguuguuccugggaagguguggucagaguggagggacaggaaccagggaugucugaggagaaaauugucacuagagcuaaguccuagugcuugaaggccuggcaggguguaguugagaaaccacccacucgguuugacuggugggagguuugccaucuagacaaagcaguuugggguuaggguguagaaggaagccagauuacaguccuuggaagagaaaaugggugauguguagguauaguuuucuuccaucuagucuuaacauuuugaaacuagaugguagaaucugaaaaaagacaaguuuugagaguguuuuuuuuucuacuauuuauuacugugcaucuauuuucuuuuaaguacaaauaaguaaaacccugaaaucuucagauuuggugcuuguguuuagaauuuuagaaaacacaaagagauucugaaagucuacagagaucuuaagcuucagagacaaaauaaguauaaaauauuguuuauucaauauuguggccuauaggguuuuuuaaaguuaauaauagcuuuacagagauaaaauugccuauaacugaguucauucaaaauguauagcuggacuagagagaugacucagugguuaagagcacugacugcucuucggaagguccugaguucaaaucccagcaacuacgugguggcucacaaccauuuguaacgggauuugacucccucuucuggagugucugaagacagcuccaguguacuuacacauaauaauaaguaaaucuucaaaauguauaguuuacuaguuuuuaguauagcuacagaguuuuguacagucauuaccacaaccaauugcggaacaucuuaagcaccccaaaagaaaccccugcauguguuugaggucacucccccucuuaguacagcggucaguuacccaccuuuugccuuuggagacuugcugaucuggacagucuguguagguggaauuggaauauuuguagcugaguucccguguuuuauuuucuuugugcucugcccccacccuguuuuuguuuguuugcucuggugucugaguuaggguauuguuguguaguaccugguguuugaguaacgguauugucccuuaccccugcaggccaggugcauggcuguccuuuugcuucuucagucucccgcugccaccacacugggcuggcaugcuuucaagauucauucauguugcaguaugugcuaacaguacuuauucuguuuaugacugaaauauaaucuguuauguggagagugcaucggauuuauucauuagucuauugaggggauuugauuguuuccccuuuuggccacuaugaacaguaaugcuacugugaauguugguguguggcuuugugugggccuauguuuucaguucucuuagacuaaaaccggaauuacuggaauuguuuaguugguugaaucucuuccaaaacuguauauguaacaccccacauaauagaauauauguggaucacaguuuugcuauguccucacguccgucuuucagauuauuguuauccuugcagguaugaaaugguauuuuggcuuagcuugcaggauuuuguauauguaacuaguuuuugaaagcuaguaauaggaaauauuuuuuaguccuuaaaauugagcuaaucuucaugcuuaauguugcugauuuaguuauugcuuuuugcccaucuuuuguguucagacaggcauacuaaaauuuuagauuucgcaagugggcagacaaccuucuaguuuuccagauuuuugagacagugcgcuaacgauuuccuuacugugcuuauuuccuagaaugguuuacugcauuuauuacaauauugcuggguuguuuuuauuuuuguuuuuucaguguuugacaucuaguuuugaaggccaagcagugguuaagucacaccuucuauuucaucccagcacucaggaggcagaggcagguggaucucuguguuggaggccagccuggucuacaaagggcguucaagacagccagggcuacacagagaaacccugccugagagagagggagaggaagagaggaaagggagggagggagggagggagggagggagggagggagggagggagggagggagggagggagggagggagggagggagggagggagggagggaaagaaaagguuuuaagguuuugaaaggacaaaagacauuaacauucagaugaauauaacuuuucaugcauuaaacauguuuauguuucuauaccacucauuucauuaaucucauaaacauuuacauuucugacuucccucaucugaaaaucucuuaagaguagaggcaggcacauaauauuugaucuggcccuaagccuugacuguaauguaagugcugugguccguugcauauagaaacuauaggcaaguuuacugcuauuaagacagauuuauucaucaggugaaucuuucaaaaggccuaaaaaguccauaguagucuuagacuacuaugagagcgauuucuccccuuuccuacaaacaggugucacacaaauguggcagaacuuuuaguaaucacugagaaagaaaaugugauaaauaaucagauuggucaauaauaauuaaggcacuuuacugcuaaccuuaggaccugaguucagucccugggacucaugugaaggaaagaaggcaggaaggagagagggaacuaacugccauauccucugauccccacuugagcguuguggcaugcauacauauguaguauauauguggaaagguuagcucauacuguucuugcagaugacccaaguucaguucccagcacccacaucugguggcucacaucugccuauaauaacuucaguuccaaaggauucucucuugaacuccuugggcaccuauauucacaugugaacccacugacauacacauaaauaggugaguaaaaaauuuucuacuuuuuaaaaaagccagacugaaguaaaaccuuuaaauaaggaugcuuuguuauuuguaguuucuucugcauaaucugauucugugcgugcuuagagauuggggguuuaucuagguggggcacaccccguguaucauguacuguuaaagguguuguguuaauaaaguacccaauuucaacuguuucuggauuuaauaaguaaaaucuagauaauugucacugugguuucuugugaacugguggauguuuggcauguaauuacaaagcaguucuugcagucuuccagugucucgucuccuucagucuauuccauggaucguucucucuuuccuaacauacaugaaaguaucuuuaggccaaagggaaccauacuagugagaugcacuuaaucucuuccuucuuucuuuuaauacauccuuauagaaugcauuggaaaaaucauggaagcauguuguuuucuuuguuuguuuguuuguuuguugcuauuuugauauauuacucuguagaccaggcuggccucagauucacagagaucugccugccuuugccucaagcacugggaccaaaggcaugugccacugauacaugauucauuuuuauuaucucucuucacccuuaucuggucuacacaggcuuuaggacagccaggacuacauacagagaccuuaacucaaaaagaaauaagcaaacaaaaauuuuguuugcuuguagccuaaacuguccucaaacuugcaguaguucugucucagccucuucagugcuggaacuacaaauuuucaccaccauaccaugacaauuaaaagcuuagaaucuuuaccuaaaguguagaaggggacauguacuuaacucccacuuccugggauaaguauauuaguguaguugaucuagaagcacguguucuccccugcagaacugaauguuaguacuauauaggaaaagggccuuugauuagauuugaguugaaaaugugcuaaagugagcaaagcgauaugcaguuguucugaaccaccacucuucacaaagaggcuggaguccuucaacagguuucguguucuuguaguggcuaaaauguguagauuuauguaacuacucacuggcaguuaucucuccugaaaccacacaaaaaucuuguuuccggguauuagguagucaauguguauuguguugcuagcucguaguagauggaagaaacaagcgguaguugcuuucagaagcuuuuccuggggcuugugaggcggagauccuguuaccaagggcuuugggguugaauauuacucacauuucauguagcagguauguagcacaggcuggccuggagcuuaagauagcuugccuuggcauuccgaguaugggauuacaggcacgcaccacuacucaguucaguagaguucuugaagcuagugauuuuacugaugcacgaaguccugcuuucucucucugcccacuugguucagcugaugcuuucuuauuugcagguuuggaaauugagucaaguaggggaguacuuggguagcaugugugaagccuuaggauugguucccuuccaacacuaagaaagcaaaguaaucaaaaaaacuugguuuuugcucuuucuuucuuuuccuuuugacacugaggauuccuccaagggccuugcaugauaaccccaugaucuacuguuggguuauaccccuauuuuaguuaagaguuucuaguacugugaugaagcaccgugacaagcagaaguaaccugggaaggaaaggguugauuucauuuuacaguuuguaaucugucauccagggaagucaggucaggaacucaggcagggcaggagccucaaggcaggaaaugaugcagaggccaaaggggagugcugcuaacuggcuuauucacugugacuugcuuaaucuuuuuuauaucacccaggaccaccagcccagggguagcuauacccauagcaggcuggccuucccacauuaaucgcuaauuaaggaaauacacuacagacuucacccacagaccaaucaguugggacauuuucuuaauuuagguuagguaaguccaaaaugauucuaccuugugucaaguugacauaaaaacuagcaaacacaaauacccuacuacaagcuuaguguuuuucauugcuucugucagauauguucaaaaauaacucauuuuaaaauuacauuuggggcuggagagaaggcucagcguuaagagcacugacugcucuuccaaagguucugaguucaaaucccagcaaccacaugguggcucacaaccauccuuaaugacauuugacucccucuccugguuugucugaagacagcuacaguguacuuacauauaaaauaaauaauaaauaaauaaaauuacauuugagggacuagaaagauggccuggugguuaaaaacacuuaaggacccaaauucaguucccagucagugcccacauaggauggcucauaguugcucuaacuccagcuccagaggagucagugcucucuucugaccucuguaggcaugcacaccacauguguauacauucacacaaacacacacacacagaagugucuguuuagagacuguauuugaaggcuggggagaugacuccaucuuggcauguaaguaggaccugaguuuagcucucuggcaccuaugaaaaaaauccaggcauaguggugcacuaaguaaucucaguacuagagagggagaagcagaagaucccaggagcucagccuuucuaaccggaucagugagcuucagguucugugagagggcccuccucugucaggaaaauagauaggaagcaaccacauucacccacacacacaugcacauucacaugcucaaagaaacuacauuugaaaguguuuguuagugguguggguagguuuaagauugcauuugcccugagaagcacagugagacaggaaggcguucauagacccugugcuacagagcugugaggagccuuucuagggccuuucucccuaccuuaaauaggauggcuuuacuucuggagucauagagccuagugguaaaggaauucuaaaacuagaaguuaagguacuugugaugaaucuugaaaggugacugguuggguguaaccaaaguuaccaaaugaaaacagaaguuuuccuuugacauugugcugcauaggcuaauauuugcucauauuaguuacaaaacauuaauaaagccuccccaaguggagcauaauuaucuugaaauuuuuacaaaaaccuuuauuugauguuaauagccuaccccucaaacuagguuaagauuguaaggggaaaaagcauuaccuggaugacucggcaugucagugcuccugucuguggucucccaugucugucugacggacgcuuuuuacuuggcuuuaguucucgggacuccucuuugcccauuucugcugaauaagggcacccuuuacuaaaccuuacauuaacuaaucuguucugagguuaaggaaagagcucagcacgccuagaacuuucugauaccucacguccagguugcugagaauacaauacacucggcagugaggcggguucuguuuaagugugagagguuggucaaggugagaacuuauucaucuguagaugaaagaaacuucugaauagaaagggagggauguucuacuaggaaggcagcccagauuaguguauaguauaauacaugaucuuuucuaaaaccaaacuugaaaaaacaauuuggcgguuucaccccucgcuagccaccuuuccauuacuggaacagguaugugagguagucaccucuuuauuaaaagagaaaaauggaacuuguuuuugcaguacauguugcugagcuguuacuauuguuccagcucuuucaaacuuuuuuauuuuauguauaugaguguuugcuuaaauuuauguauguguaccaugguaugugcaugccuagagagcccucagagguuagaacuggaguuagagaggauugugaccugccauguuaguacugggaaaugaacccauguccucugcaagagcagcaaguucuaacugcugagcuuucucuccagcauacuuuuugucuguguuauggagugcugcuuguacugcccuugaacuugugugugaucuuggauuauaggccugugcuaucaggcugggcaaaaaguuguaucuggccuacacugucagaggcuccaguucaugauaguuggucaaguugcuuuuggauauguaacaucaugguggagaguguuucagaacggacagcuaucuucauggucagaacaugggaggaauggaguuacccacagucccauuugaggguguuuccccaguaacucaauaaccaccuacuagucuccaccucuuaagauccccagcacuucccaggaguuuaauguaguacacaguauuuauucuucaugauguguuaaagaaagagaaguggaccuuguggugcaugccuuuaauccuagcacuuggcagaugucugugaguuugaaacuagccuggucuacauugugaguuccaggcuacaugaugggacccugucucaaaaagaaaagaaaaagcagauguuuucuuucuguuuaaaguaacaguguguacauuccaaucuguggcuuucucugcugcugcuccaggugaauaacuugggguaccgccuuuacucuuaguuuauuuucucucugaaccguuuuucccuguugagcucuaauuuuauaccaguaguuacuaugaaaccuuuauauuuugaauuaagaggcucagaacuaaauggaaucuugagaaucaucuuccaacucaaaaacauucuauaacagccuaugauuacauucuguaacacuucugugauuguaacuucauaaacugauaaagucauuuccuuuuaaacuaaaugauuuccauauuugcucauuuuaaaauaaaaaaauugagacagauaauaaacugggacugagaaaucucuucauuucaaaauaagccaagacuauauauaguguuuccuauguacauagcuugaugaugaggaaagugacaucauuuugcaaauuucuaauguuuggguucauagaggauaacuaauucuuagccaugcucuauuauguaguaauggaaaugaagaaaaucuaguuuuacagugauaguaaagagggauauguuauuaaucucuuuauagugugguuuuuaaacauuggucuuauauugaauggauuugcuuuaaacugugccuaauuuugacauguuauacauuuguuacugggaaaauauuaguucauugaguucccuccaacuucuaaauguugauagauuuuauuuauaauaucaaauagucauuaguaauacuauugcuaccucacugaagagggagagagggagggagagagagagagauauauaaacauuuugauuguuggcuugaaggcucugugucauuuguuuuccuuugaagcaauaggcuuuuuacuuguuaauuuugaaggaaaccucugggauauggcuuuagcucuuaugugaaguccuuagauuugguuuagcaccagaaaagaaaugaaggagaaugucuaacagauaccaagcuaggauauaaaaaugauauuauucuauggaaggauggcauuagugaacagcaaccuaggccucccucgugcuaggauuacaggcauaugcuaccacaccugaccagaucgaaauccuuuuaaauuuucucaugagguuuugaacucgggaccucuggaagagcaaucgaugcucuuaaccacugagccaucucuccagcccuagaaaauguguuuuuaaucuccaaguauuucuauuacugguuucuauuuggauccuguuucuguuuaauagcauacacuauguaauuucuuuucuucuaaauguguuaaguuuuauauuauaauggccuguauuuaugccucauuauacggucugucuuggucaggguuccugugcacuugaagggaacauguauuuugcaguugcucaugaaguaauuuauaggugucuauuauaucuaguugauugauggugguguugaguucaauuguguccuuacugauuuucugccccucgucugccugauucuguuaaauaggugacaucuccuacugcgguaaguggacuccaacaaucccccuuccguuucugucaguuuuccuuaugugcuguggugaaucgguguuaaaugugcgcagauuguuaugucuucuuggagaacugacagaauccuuucguauugucugauaagcccuucagucuucaucagucacuuguacaguucacuguccagaauuaguauggccauuucuugacucaucuuacaaugguagauuuuugucgguggguguguggauucagggucucucucuauauauagcccagaguagccuggaacucucuucuuuuuuauucuccugcaugcugagauuguagugugugucacuacacacagucccacuauccauuuguuuuuagucuguauaugccuucuuaauaaagugaguuucuauaaccaaacauauauaauuguguuguuucuuuuuuuccuuuuuuuuuuucuuuuuuguguuguuucuuauccacucucaaaaucugucuuuuaauugaugauuuauacuacuaacauucaaugucugcuacauuuguuauguuuuuuugucucccuuguucguuuuaucucacuuuuuugccuuuuggcuuuucacugagcacauuauauuaguaauacuuucccuuuuuaucauuuguacuuuuucaccuuuuaaagugauugcccuagaacuuguauauuuucagcuaauccaacucaauuuucuuauuuuuagguaaguuagguaguauuaguuuguuaugguuuuuguugucuagucacacacacacacaugcgcgcgugcgcacucgcaugccuaugauaaaauaccaugaacaacaacaauguaaggaaaaacuuauuuugaacucuggaugcagagauuagaugucuguaguaguggggaggacuuggcagcaggaucagggauuacaucccaccuaaguaccugggaaguagaagguggugccuccuauacaucggagugacacuauaacccucaaaggcuaaucuucaguggcaugccuucuccagaagggcuccacauccuaaaagucccaucaccucccaaacagcaccaccaacugagagucaaguguugaaacacaugagccucuuaguucuucuguugcugucaauauuauuuuauuuguauguacucaaaaauauaagaguauauacauauguagauuuugugcuaguauguguaugagaacuaccuguuaaguauaagugaaauaaaaguguuagcuuagccuguaaucccaguuguuugggagucugagggagaaaaauaaccauuuucaaggccugucugggcuccggacuugacuuuaaguuguguuugcaacuuaguaauaaauugguuuauuuguuuuguuuuuuagcauuuuauuuuauuuucuccuuguuuaccuagcuucuaaaaucauaaauaacucuuccauuuggccuucgauagguaaggcauaaagaucuguucucuaacuucacauggugaagauggugcacauacacgaaaaguaaacaaaggcaaauuuaaaaguuuaagaacacaucugcgaggcaaacguaagcaguucuuuuaagauaaaauauuuacuguccaaaaacauaaauaucuccuaaagaucaaaacaccugcugggccgugguggcccacaccuuuaaucccagcacucgggaggcagaggcagaggcagguggauuucugaguuccaggccagccuggucuacagagugaguuccaggacagccagggcuacagagaaacccugucucgaaaaaagaauuuuaugguugggggcggucaccacagcaugaggaacuguauugcagcauuaggaagguugagaaucacugcucuagugaaaacccaggcacauggcaugauaauuaaggaaauguaaauaaaguacugaacacugcuggggguggaagggaaccagucuuuccaguaaucagagaaauguaaauuagugauaauucuuuuuuuuuuuuuuuuggagggccuaacuaauuuauagcugacaaaauugagaacaauagcaguauagaagagaguauaggaaaaugauuguaaaacuauucauggggaaguaaaaugacacuuucccuacuugggaagguagguggccacuucucauagaauugacacguguuagguucuggaaauccgucuguaauauaugcauauaaaagauuguguccuaguaucuaaguuacaccaauuuuuugugaaaccuaaaguucacuaacuaaaccuguggacaccuguagaagacgagaaggacuugaagaggaaagacaguuugcuucuucacuuuagacuuauauggagaagagcuucuuagcaggccugagauugcucaucuuagggagaccuccuuuauacggcugcgccuuggcugaugucugggaacuugggccuguagaagaguucccuugucacgagugguucuguucucaaguugugguucaauugugucucgauugcucgggcaauauggcuuaugaucaccuuccuuccauguaggcguuuagauuguuggggugcacuucuuaagaaugccuguguggccaggccgugaacccugggcaccgucucucuagugaguuucccuguagacaacuugcuucagggauucuuggguccuuucauuucacugagagagaauuaggggaaacuuguacuucugagcuuuauuucacacgcuuuuucuuuuugaugcuguuguuuuguauccuuuagccaugacucugagugugauuauaguuuggaucacccuugauucuugggcaaguuuuuuuauacauaaguauucugaccccuuguuuggcacaugacuacauugcuaccaucuuaaaaaggucagaguuuguuggagagccagaguccuuggcaagcugaggaagaacuguucuucaggagagaacagaugaacauauuugggaaacagaggcuacuaggagcugguggaaagauuaagagaugaaccggaagaagccugaguagcaagccagaggaaacaggaugagguuuuauuugcacgcugcggggaauugaaccuugggccuccugauauuagaaaagcaccagugaacuguagccccaguuggaaacuaugaguugccccaaggcaacaggauuuuuuuuuaagaagcugaaauuaaaauggaaguuuugccuugugagauuguugguaauaaagagauggauuuuagaacuucacauacguuauuuaagacaagaugacuguggccucgccacccuggaugcacuccaucucccagcucuuagaagcuaugucagcucaggccugguuaguauuuggauggaagggcaaguguguuuuuauuuaagacagacuacuccauuuuuuuuuuaccaguuucaaaucaguaucauuaaacaacaaagaucaaauuuuaaguagcauuuuauugaugccaguucauuagcugugguguucuaaaugugaauaucaaccccugugaugcgccgggcgugguggccacgcacucgggaggcagaggcagguggauuggucuacagagugaguuccaggacagccugggcuacacagagaaacccugucucgaaaaagagagagagagagagagagagacagacagacagacagacagagacagacagacagacacacucugcuuuacugaaugcauagaagacacuggcauugucgaggaaauaaaaagauaauauaaauauauaauauaaauaggaaaauauaaaagaugacaucagacgcugaauuauagucauuggcaguagugaugaaauuaagcgccaggguuggugaauaaaucuuaaaacgggaaaaucagucacgucaguaauccgugaccaugaugacugccucugagucuuaaccuucuauuauacauuuuugaguucaguauugacucuugaugacucuuuagauuauugacaaccuccugaaaguaaguuucaguagaguuguaacaggaaaaaaagggucguuuuggguuuuuguuuuuuuuuuuuuuguuuuguuuuguuuuguuuuuucagaggauaagugguuuaccaggaaauguaguuuuucuuuauaaaacuucuggucuauugaccacagcucuguggcacuccagccuuguaaaaauaacuauuuuccauauagcggugaauuugaacuguuuaaacugcagacaugauaauuggccucugcuauguuuguuuaggcaaugagaaauaucuauuuuacuaauuuagggcuuugauuugucuuuuuaguugaacauaaagagaauauuauugucaguuaauguauagcagugagucuugauguucuuaauuuuuuuaauggcaguuacuuuaguauccuaugaaaauuggugacuuuucuugaagguaagauacaucaucaccaucuaaaggaagacacuauuaggagccauuguuuucauguauuguuggagacagggucucaaguacacaaggugaucucuaacuccuuauguagcaaagacuugaugcugaugggugagaaggguggggggagacagggucucccuauguaguccuggccuuccuagauggaacucacagagaucugcuuguuucugccuccucucaagugcugugauuaagggcaugugguacaacguugaacauugccuuaaauuuuuaauccucaauguccuaggcacuggaucaccacuacacccagaucaggaaccaaguucugaaaaauucacuucauggacagggagaaaaagagaucauuggaguuggaauuuacuuaggagaaucaguaaacauugguugcauuguucagugaacagaggcauuagauagaaagaagaugcugguaauagaggugagccugccccgugacuugaacaaacgcauuucuguccauuacuuuauaaaauacaucuuucuuuuuuagguaauguuguuuaauaaaacuaauauauauggcaaaauuauauuagauuuguuuacuguuuguggagugugaguguacaucacagugucacauggagaucagcaggcaacuuucaggagucaguucuucugucacauggguccugggguucaaacucaguucaucagacuuggugggaagcaccuuuaucugcugagcaaucucacuggcccaaaaggcacaauuuuauuacccugcugauuuaaauagucuuuuauuucuauaaaauacuuucauaguauggaaaggauaaacuuagauuaaaaguuuguguuucuagcugggacugguagaacauauucgagguaccaggacuucagaggcagaggcugaagaaugucuccuaugaguuuuggugauaggagcugccguuaauaaaaugugaugcccuggccuacgucuucaaggaauucuaguuauaccgaggguggugugcuuguguacuggguugugaccuccauuagcgguccauagaaagagcugggguagagaugaggaagcaguugggaggaaguggaugacaaaguguuacaacaguacuagucuuagggaaauguuugacgaugauuucuauucugguguacugagaagcaaagacagauggaauaaaugaaccagagaagucagcuagggcaaagcacacagugaauuggguuuuuuguuuuuuguuuuuuuuuaucuaagaaaccccgagauucuccuuuauuuuccucaguuauauccuuaauuaaucaguccugaguuacagcuucaaaugaaaaaacaaacaaaaacaggcuggagagaugacucagugguuaagagcacagaccucuuuuuccagagguccugaguucaauucccgguggcucacagccaucuguagugggauccaaugccuucuucuggugugucugaagagagcaacaguguacuuacauacauuaaaucuuaaaaaaaagaaaaaacaaaaaaagcaaaacguggugcuuuuuugccaguuucaccugcugauauacaguuuuguuguguuuguacagaguuggauaauucuaguacuuuccaacagggucuuaaacuucuuucacuuggacaccagauauauacauaaacuagauauauagaucaagccuuuacuaaugaugagucauaauucuuuuuuuuuuuuuuuuuuuuuuuugguuuuucgagacaggguuucucuguguagcccuaguuguccuggaacucacuuuguagaccaggcuggccucgaacucagaaaucugccugccucugccucccgagugcugggauuaaaggcaugcgccaccacgcccggcauaagucauaauucuuaaaaacaauucuuuggcaugcauuugaucuuacuguuuguuaaacugagaguagggcuaaggacauagcucagaaguacagugccuggcauuggaauccacacuaauuaagggauuaagauuagagagauguaugugcuaauaagguagacacuuuuaaaaaaaauuuacaguguguaugagcugguuagucuuuauugucuucuugacauagccuagagucacuugagaagaggugaccucaacugaugaauuucccaaggagauuggcuugucugugaccauguguuugaaauugccaugacugauguggagggcccagcucacucugcguggugccaucccuagguaguugggucugggcuguauaagaaccuaguugagcaugaaucagauuaaucucuaugucuucugauucaguuuuugcuugugcuccuucccuggcuuacgcuguagccuguacgauggaaguaaacccuuccucucuaaggaaucauguuugucauagcaacaagaagcagcgugugggggugaggggaagggagggagagagagcgagcagcagaaugccugugcuaguuuauagcaugaauauggagauaggauaauuugugugggacuugguucucuucuaccguauagggucuguagauggaacucuggucaucaucacauuugacaacaguacccuuagccucugagcuaucuaacuugccugugcuuacauuauauuaagaaauccuggcuaaauauuugcuaguguagcucauagagcaucuucauuguuuuucagaggugauaaaauuugauuuuuauaauuguuugugcuaaaaauaucauuucacauauauaaauaguacaaauauaguacaaaugauaacauaauacuuggggccgucucagaaauuguucuaaauucucucuugaucccaagcuaggauauuauuaagugauuuuuuuuuuaaugaaacauaacuuagaaacucacacagcaguuaggggagccacaugugaaggcacaggaaugugugcauggcgaggucagaaguuggcguugggugucuucccucuaucacuccccacuccguuuugagucaggccauuucauugaacauggaacuuccaguucaucuagacuggcuggccagaaacgcccaggggucuuucuaucccugcuuccccagugcugggauucccugugugaucugcugagcccagccuuauuacaugggcuuuggagagaagccucuggucccaugccaguacagcagcacuuuaccaaguaagucuuacugguuugauucuaaucaagcauuccaagcaaguacgguccagagauaugcuaauuugauaguuacgugccaauuaaagucuguuuucuuuaauuaaaccacuauguuuuuauaguagcugaaaacuugguguguacggguaaaaacaaaagcagacuacaguucauuacaugcaguagucugagaugaguaguuucagguaaugauuacguugcuuagcaugaggucacacacaguaaaaucagcugaugcgugcauuacaggugagcacagccagagccucagaugggcugugcuugacucgggcgucaguuuuggugguugagcuuuuagaacccuguuacugcccagcuuuccucucaaccacauucagcccugugaccccugaguuguaaguaguuuucccacgccauucucaggacauuguaguccuucuguuucugcccuuuuauuguuauagccugagcuuucccuucauuuguuacacggcugugguacccuuucuuccacccucuccagacuuucuaaacuacauguuuuuuuccuuccuuacuaauuucuucuccaauuuccuaugaaaagucucuaauccucuuucucagaauuauuugauacugcaaaccuauauguaaaauaaauacaaaggaaccuaacaguugaaaauaggauucugggggcuggagagauggcucagcaguuaagagcacugacugcucuuccagagguccugaguucaauucccaauaaccacaugguagcucacaaacaacaaucuguaaugagauuugaugcccuuuucuggugugucugaagacagcuacaauguacuuacauaaaauaaauaagucuuuuuuuaaaagaaaggaaaagaaaagaugagauucuguuuuaucaagcuaguuagucaguacuccuucaaaggcuuggucaggcauucagcagcagcaccuguuaauugauuaagaacgaaaguguucugguuaauugaccgcagaccuuuugacugucugggaccucagcagucugaccuuccugguaaacugcuuuacauuauacagccguuccaaucagacaaauuggcccagaauauauuuuuuugauaaucagucuaagaaaucugaaguaacaagucauacuuaaaagguuuuuuggcuaauaguaauuaaugauuauugagucauucuaggcgccagccucuuugcuaagucuggaggcuuuaucugaauucuauaaagguuauaacacuggauugaauguguucauuaucacacauuaucaaaaccaaaauuuuaauuacugcaacuaauuguaaggcuggcuauauuuuugauagguaggaauaaagugucuacuuaaauuucuuuuuaauacagcuugauaaacuucuugauguugacuuuucaaagugcaaaacaaaguuuuauucuguuuuauguugaauaucuuaauuuaaaugaugguuuuuaagauacuauauuuaacuuuuauauauaagacuuaauuuacauauaauaauuauacauaugucuuguacagugugacauguauguauguauguauguauguauguaucugugccuguccauacacaugcauacauauaaaauaugcaaugaccagaucaggcugaguauacuacucagguagacgcuaggguuuuuguuuuauuuucauaaaacauccauuuuaaaguggaauacauaaagcauucugugauaugccagaccuuaagaacauuggauaaauaaaaauuuaaaauuaaauauuuacuuaugauacagagacauucuuaauaauuaucagcuuuuacauaaaaauuuaguaaaauauuucucaguaauuaucccauaaaugaagugcuuggaugaugcagcaggugcucgagaagugcguggcauuuuauacuucaccuuggucgucguccuccuuccuuugcucguaguucuuuucuuaguaagacugaugaaguacauuucucuucugccagugcugcuuuggcuguuuaaauugacauccuucuuuaaauaugauuuucacauaauacuuuauauuaaaguaaauaacuugaaauauaucuuuucagauuaucagaucuuugagcagagaaaguagaugugcaagacgugauugcuaacagggaaucuaugagcauccguuugccuuuucuguugcucuccuuuacaucugauuuuuggguguucguacaaucugaaaauauaaaagacacacggaucucuucacuguccauuucccagcauucccauuuuccuuccaacaacugcaagguuugguauuagauuucuuggggacauguuuuaugcauauguacaaacagacauguuuuaaauuucuuuaaugcuaauaguggaacacuuguguuuucuucuuuuuacauucaguggagauuuuugacauggugccauauuccuauauuuaagacagagcuuccuuacuugcuuucuagccacaucauauuugauuguaugaaacaaauuuauccaguccuauuaauaggguauuuuuuauuguuuguggacuucugcuacuacaaacauugcaauacacaccuuugugcauacuuuacuucaugugugccaauuagaucuggagggcacauguguagaaauuuaagauagguggauuuguaacugccagcucucucucuccuuguuugguaauguucuuuuuggaccuacauugagcugaagucucauuauucugguguaguccagugucccaguccugugagugcuaggguugcaggcauaaggagaccuggguaguuuacacaucuauauaguuugagauuuuuaccucuauaggaaaaguuaccauaagcguaugaauuuuuacuuuggcauugugcuauacuggcacagcaugauuuuuguuaagaggagaaaaaugaauauucuuguguucagacucuauaaaguauagucuuuuuuuuuuuuaguaaaacaaaaauaaccauuuacaguguaagugccuauauguaaaauuacuuaaaguaaugauauaacaagaauaagacaagauucuuguguguuaaaauucucuaauuuuaaaaaauauggaaaaaauauggucacgaaauucuuaacugcuugagggucagcaucacaggcuauaaaaauaaacuggugaaaaaauuaaauugcuaccagaccuuuuuucauuucuuuugcauuuaauaaugaguccuaaagucaaaaugcuuucaauaugccuuuaauccuucaagaaaguaaacuacuuugaaauuaaguuuuagaaauauaguugaguagaaccuaaacaauucacaaugccaacuuucaguucugcugaaagcaggaaguguauuacugacaagcagaaauauuccagcccaaagaacaucccuacugccauaugugguaagaauuugucacuaacccacaaaccacuucuguaauucagugaauaagcagaauuagucuuuguuggacauuuccaguucagugugaaagaacuuuguuuugcaguguuuuacaaguaacuauuagcaugucuuugagagagccuggcacauccuggguucuccugcacuagugagaggggaaaccugugcuuaauuccccgaguacgauuuuaaagcuuaaggagaccuuauuaaacacagaaauucucaucuuauuaaugucuuuaaauagaauuacuucuaguugugcccccuugcugcuuuaauaaauauuaaucuuuguuugcacuuacucuaaaaagaaauuauucuuaggguuaauuuuuuaaguaauagggaaacuaacagcuuagagcaauaggagaauuaauugugaggaauugggucagcagaauucauugaagagcucuuuguaaaucauuaacaguuuugaaaauaccaauguuucucuaaacuugaauuuuauuuucuuguauuuuaagcgauugagaagauugucuaccaaauauagaacagaaaagauuuaucccacagccacuggagaaaaagaagaaaauguuaaaaagaacagauauaaggacauacugccauguaaguuugaaaugcccuugauagaauaaauagaaaugcuaucuagcccuuugucaccccacgagcuguuccugaacugaauagcuaaggagguagaaucaauccuucccaagguacacugcagagccaucuguggcugugcuucuuagacuccguuucuucucguggagcaguuugugguuuuguuuugguuuguuuuuuacuaaaaacaaacaaaagaaauaaaaaguaaugucgacaauugggauaguuucuuaaaacacugauuuaccugcuaccugauuauaaaggagccuuaauugauugauuaacuguggauuaaaaaugggccauaagaugccucagaaaccugugucugcuauccucagcagucugugucucuuaagcauguuucaaguugaaaauguuauauucucauuacaauuauaugcuaagauacuauuguuuucuagcuaaguaacuguaaacacaugcuuaagucagaguccacauucuaaaaagguaucuuguguuggacaugcauuuucugaaagcugcuguaguguuucccuuccaguaucuauucucccuaacaccauuuccuuaacuguugcuauuagagcuucucucuaaaguguccuuaugucacagggaccuaguagugaccuccuagacccagugcucuuuuccaggguuuucuuuccuguuaguguuaugccauuggcagucuauuuucugaguuucucuucuuccaugauaacccucuuucagaucauuuccuccugcucauucccucuguuccacugauuucuugugugcauguguaccuauguguguauuggggauggucagaagucagcccucaguguggagguucaggagccgcuucugguuuuguuuuucuuuacuugagauuggguaucucacuguggugugggcuuuucaguuagacuagacuaccuggccugcaagccucagggaucugucugccauuguccaucucccuagugcugggagcacggcaagcgguuuacuaucugcgccaucucuccaguccuccucacuaguuucugugccuaaauuuaauccuccuacuguuaacuguucuacauuauucucaucugaggauugugugauuagacacuauuaauaaaauuaacaaagaacugcacagaguaacagugaugaguuaccacucuggaagucuuguagcugugagacucaggacuggucuucacugugucugguuuucucaauuuuaaguugaaguugguagugauaauacaucuaaggccugcuuuggauguuuaauaggucagaugucuuuuacuaacccaacacaguaaccacucaaggcuuuugcucuaaauauacuccacuuuccuuaccaggugcuuuagucuguucaggcugcuguaacaaaaauaccauaaacuugguggcucauaaacaguggaagugcauugagagaaguccagaaucaaggcaugguaugccgugagcacucacccaccgauucauaguuggugccuucucacugaaugcucguggagaacgaggagcaaacaaguuuccuugggccucuuuuuauagugacgaucguugaacucauuagaacaugcucuccucaccuccuaaaggcuugucuccuugaugcucuugcauugggaauuagguuucagcauaugaaccuugugggaauacagucagaccauagugcuaauccuuggaauaagaguugucuuaguuaggguuuuuguuuuguuuuuccugugaagagacaccaugaccaagcaaacucuuaaaaaggcaaacauuuuuuuuuuuuuuaaagauuuauuuauuauauguaaguacacuguagcugucuucagacaaaccagaagagggcgucagaucuuguuacggaugguugugagccaccaugugguugcugggauuugaacucuguaccuuuggaagagcagucgggugcucuuacccacugagccaucucaccagcccaaaaaggcaaacauuuaguuggggcuggcuuacaguuucagaggcucaguccauuaucaucauggugggaagcacggcagugugcaagcagacauggugcuggaggagccaagagugcuacaucuugauccgaaggcagcaggagacuuuuacacaggcaaccaagaggugggguuucuucugcacugggugaaaccugaguacuaggagaccucaaagcccaccuacacaaugacacacuuccuccaacaaggucacaccuccuaauagugccacuucacaugggccaagcauacucaaaccaccacaggaguuaauucagauuucuggauacuuuauuaaacauaauuuucaguacuguccacugaugucuuuuccccccucuggucuagagaaauaaaucuuaacuggcuccagguuucugucucacauucauguuacagaaaguugugagcauauacucugaugauauagaaaagaacgugcagaagucucucauuuuguuauuucauguucuagcauagguaguagacagugaauacaaaugcacauaagcucuguccucugguugauuaguacuaauagggauaauguagaaagggcgagggccauugagaaagcuggaaccaaaggaaagcaucagguuguuaacaggagggaggugaauuuuaguggcaggccagccuuccaaaaaagaaagcccuccuuuauauugguugcugauuuaugugauugacccacacacacacacacauaaucacaacaaaaccauggcgguugauaauauaccauuuguaggugggaaacugagccuggagaaagcuaaguauuuaucacagugcucacauaauggacaauaguuuguauccaaugccaugauauucagauaagaugguuguggcacuuaaggauauuuggcaguauuugaaggcauuuccucuaccggcuucuaguaagcaggcucccaggguaccagugcaauguaauguccugagaacagacuugucuaagcugaaguugagaaaccuuuagaauggccgcucuucaucuguguguuaaagucaggaggaccugguucacaaguagaauuucaauaaauuucuaccuguuuugauuugacauguaauauugaaaguacuuacauauuucuuagaaaauaguuugcuaauuuccuuugaauguuuaacauguccauuguugcauaagcacacuuuuaaacagcuuuaacauacaguuucuauaccaugaaacguacccauuuuaaguauauaauuaauuuucaaaguaaacuuaggucaugcagugacuaacccaauccaggguuuggaaauuucauuacuuucaaaaguucuguauuuagucccaggcagcugcuaguauucuuucggguucuggauuuuguucuuuaagaaauuuaacauagcugucauuucauauauuaucuguggcgcuugauaucauuaacucagcacguuuucuuguuauauuuguguuaugguaguauuggugugguaaagauuuuuguauaaacacacuuuuauucuuaagugcauauguaggaauaucauugcagaccuacagaaguuuauauuuaaccuuuuugguuuuaugcggcagcaaguugcuguguagccgaggcuggauucugaauucuuacuccuccugccucagccuguaacagugaaccuuuaggcauguaccacaacaccuagcuucuguuuagcuuuuuaagaaaauugagauaaauguauuucaaagucacuauccuguuuucuauuuccaacauuaguauguaagcaccaguugcccacauuccuaccagcacucguaaguuuuggauuuuugcuugagacugugucugcuugguauuaagcugcuagcuacaagcauccuuccuuccucagccuccugagcagcugaguuagaggugugagccauuguacuuaguuagcugcaggacuuuccuuuucugaguguguacaccuguucacacgugcuuguggaggccugaggucaaugcuggcaguuuuccucaguugcucuucagauugaagcaaagucuuaaugaaguucagagcucacuguuaaggcuagucccacugucuagcugcucauauguacucagcaagcacucagcugcuucaaccacgagacaucgucccagguccagacuucuggugauaguuuuucuagugcuucuugauguguuucuaauuugauguguuuuucaugugcuguuagcuaauucuuuggugaaaagucuuccaguuuuuuaaagaaaacuuuauuuuaaucuuaguguguuauaagaauucuuuuuuagaaccaguaaaucuaagagguccuauuguuagaaaaaaauaaugaaagauaaaauauuuguuauuuucaguucuguccaaaugaaauuauagauaaaguuuauuacuguggauuuccaguggaagcaaaaacaauaaaccauuugcaauccugaaaaaaaaaaaaaaaaaagaauucuuuuuguuguuccugcuuggguuugaaauagagaucucauacuugccuuagccucaaaccuuccuagugcugggauuacaaguguggauuaauguccaacaagaguucuuaauacauccugaauccuagaaacuauucccagaauuaaauuucucuauuagauaaaagguuacuuaccuauguuuguuuguuuguaagggcuaaaagugagaaaggcuuuggaguuggugaaauggaaauagucugccuauuuuguuguuaaauaggaagauuauauuacuucacauuguguaugguuaaacuuuuucaucuuaagaaacuuuuaagaguaaggaagaaauucccaccuugcacguaggcagccuaacauguaggcuaaggaucuuaacuaucauuuuggaaccaguuguuguacucuaccuuagagguacuuugacuagagagugguaugccguauggauaacaguuauuaacugggaccccuuauuacuggcgaacauaguaagaggaagcauuuacaguuagucagcauuauccugacugaauauucuagccucauguaucagaagcagcauuuuuggaacaucuauuuucuuuucuaaaugguacuuuaaaaagggaagccacauaaugugaaugaaaucagugucagagcacuagcaaacauguaaccauuuuagugccugaaaaauuuuuagagauaguuuacauagagauuauucuuaugucugucuuauaucucuuccuacaaauuuccaaaauaaagauuuuaucccccaaaaauaagaaaaaagaacuuuagugcuuuauauaauauuugaaccaaugaaaaauaaguuacucauuguaguuggccuuguaauaguuuaguuuaugcauagcuguuuccauuucuaguuuuucuuuuuguauguuaauuggcuuucugauucauuguggauuaaaaggccauaaugugauagucauaguuacaguguacauauucugauccuuucuaaaccaaagguaguaauuauuaggcagcucuaauaccuuaccaaccagaugucugagguuucuuuaaauuacaaguaauaagauguguauguaccucaggaaccacccugucuucaaccaugaagcuguacauuaagaacaaauauaauucuguaguauucuuuuuuucuuuauguaugugagcauguacauacauguuugugccugugucgguuuaugugcaccacaugugugcagguucucuggggaggccagaguucaucagaucccuugaagcuggaguuacaagugguugugagccaucuggcaggggcauugagaaucacugugauccucugcaaugcagcaauggccuauaacuacccagccgucucgccagucuuuagucuuaugguauuagucccccaaaauauauaguuuccuccuggucaaaagucauaaauuaggaaaacuuguaauuugaagagacaaagaagaaggaauaacuaaaucuauguguaaucuuagaaaacaucaagaaaauuguuacuuaauaguuuuauaacugaauuuucuggguuugauaauuaugcuguauuuauauaggauuuuagucuuaagacagaaaagggggcuauuccuauaaccccagcacuuaggaggcuaaguacaaagaaucaugaguuuggaggcagagacaggcagauuucugaauucgaggccagccuggucuacaaagugaguuccaggacagccaagacuauacagagaaacccugucucgaaaaaccaaaaaaaaaaaaaaaaaaaaaaaaaaaaagaacauaagaaucaugaguucgaaacuaguccagacuguauagcaagguccugguugaaauauuccuacccaacacaaauuuguagcuauuauuagaaaucucaguagcaguuagcuauaacucuacauuauuuuugcaauuucuaucuaaaucuaaagucauuucuaaauauuuauuauaguuuuuuggguuuguaagauuuuggucuuuuguuguugucuugaaauagggucucucuagaacuuaguauguagaccaggcuggccuuaacauagauagaggcuuacaagaugacuccaugagcuaacuuacuugcugccaagccugacgaccugaguuguuuccagaguccacgugguggaaggagagaagcagaugcugcaguccauucucugauacagcccauguggcacgcauguucaauacugucccaugcccucauauacacauaaguaaacaaacauaguuugaguaaggauuuacguaacucauuaaugcacagcaaaauaaaacaaauccugauauuggaucguaaaagauugaggguuuuuuuuuucuuacaugucuaauuuuuuuccaaucaugucauacuuugguaucuuaauucauuagucaugauuacuuaguuuuuauaauuucugugaaauauaaaagauagguuucuuaauaagaacuuuaacaaagaaacaauaauuaugaaguucugagguuugagcuggggagauagauggcccagcaggcagcaaugacuauuccuccagaggacuggguccagcucuccagcaccuacaucguagcucgcugucaucuaacuucuguggucauugcccacaccugcacacacagauauaacugcaggcaaaacaccuauacacauaaaguuuuauuuuguuuuugguuuguuuguuuguuuguuugucuuuuuuuuuuuuuuuaagauagaauuucucuauguagcccuguauguuauggaacuuauaggccagguggccuagaacucacagauauccaccugauaaugcuaggauuaaaaacaaagaaucaaaacaugcugagguuuaaucccuagacaccacccuaguuaauuuggaucaaucccuaauguuuuauauuucuaaaguuccagagauaauucuggcugcaucuuuaauaugcuuauuuacauuuuuuuuuguuccuuuucucaaagguuuauuuuuuuguuaaaaauuaccuuccugguaccuaaaacuucacuuucuauuuuuuaaaguacaugugauauauuuguaaucccagcacuugguagcugacaacaguucaguggcuuugugagcuacauugaggcccugccacaaaaagccagagaagaaacgcucgcaugccaccuggauauaaguaaugaaaaucuuuucucuuuuguaguugaucacagccgaguuaaguugacuuugaagacuccaucccaagauucagauuauaucaaugcaaauuuuauuaagguacguaugaaaaugaaggaagguuuccuugcuacacuucaugccuucccauagagcgauuuuaucaaagguauuaacuacccaacaugguccuaauaggaaauaaaagaaaacccugucuugcacguccuauuugcuuuucuuguagcuaccuaugccacauagaucaaaccauauauagauuagaagagacaguuuucugugugcuacuuuuacaucaaaggcuuauaagcacugcuaggucauuauguaaauugucuuucaguuuauguguaccuauauauuauugaaccauaugauaguuuccaauuuuccuuaguagugaaauuauaaugaacacuguucuuuugaacaauuucuuaggaugaacuaacagugcugaaauuacuaggugauacugauuuuaauuuauaaaauauaacugaaauuuuaaaaccuuugguaauuguuacuauguguguugacaacucugggccacuguguaccugugaucccaacauuugggaggcugaggucaggauugcuguaaauuuaagaccaucaugagcuaaagaauguggcugucuuaaaaauaaaaaaaaagauauaaacaaaugaauauguaaauaaaacagcauauauauaaauagauauguaaauaaaaacaaagugguaggcaucuuguuagauaacuugaguuauacuugaaccaucagugguagcuagguaggugggugggugguugauuugagacacaauuucuuuauguagugcagacuagcuuggaacuugaaauucucuugccuugcauucccugguagugaggaugugcgcuugcucuacucugcccagccugucagcucucuauacuguuaucaagaaagagaugcagccuccugugagacuuguguuuaaaggcucuaauguguucuauaggcuauuuugugcuuuugagucuaguuauacaacuauuacagcuuuucaaugacuuauauuaucuuauugauaauaaacgauaguaagaguagaaaaguaaauuugacuuacugauaaauuccaaugugauuuucaccuccaguguaaaggugaacuguaaauaauccugcccguguuuaaggaaggaagcuuugagcuuuccuagcuauccucuccagacuccaauggaggucaugaagaagauuaccagggaucucagagcaacaaaaguuuuuaaauguuuggggugagcaagcagaaauguggcccucuguccuacccaauaaagcucugugaaauuugcaaaaaaaaaaaaaaaaaauagaauagaaaaauuaauauuguauuuauaggacaaauaugguuugggguuaaaaaaaaucuuuuuuuuuuuuugguuuuuugagacaguguuucucuguauagcccaggcuguccuggaacucacuuuguagaccaggcugaccucgaacucagaaauccgccugccucugccuccucagugcugggguuaaaggccugugccaccacgcccggcaaaaaaaaaaucuuuuaacaaaauaaaguuaguuauuacacuaagacagaaauuuauggauuaaacaaacaauggauauuuuacuucaaauacugucaauauauacauuuuuuaugggugcuaaguucuagauuuguuuuguuuguuuuuuaagacaguuucucuguguagcuuuagcuguccuggagcucacucuguagaccaaucuugaacucagagauccaccugcuuguuccucuuccagugcuaggauuaaaggcaugagccauuaugcccugcaagaguucugauuuuuuuuuuuuaagauuuauuuauuuauuauauguaaguacacuguagcucucuucagacacuccagaagagagcaucagaucucauuacggaugguugugagccaccaugugguugcugggauuugaacucgggaccuuuggaagagcagucggcacccuuuaaccacugauccaucucgccagcccaagaguucuaauuuuuaacuacucuuagggcacugauucaguuauaucccaguucauuuauuuuaaucagauaucuuguuuuaucuguucuuagcuuacuaauuucaaacccauaugguucugaguaugcucucacuuugaguaaauucuuaagguggucaugggaaaagcugcuaacuaguuucguauucuuagauucaaacuguacuuuuguguuucugcuauaguuaacucucucucucucucucucucucucucucucuuucucucucucucucccucccucccuccaucccucccucccuuucucucuuuuucucucucuuucuuuuuuggcuagguauuaaguuuuuguuguuguuguuguuuccugagucagagucucucaguuauauaguccuagcuguccuggagcuguguaaaccaggcuggccucaacucaaaaagauuacagaguaauaggccucugccugcugagugcugggauuaaaggcaugcaccaucauacccaagauuuuguuuuuauuucuuaguacgaaguaaguuuuaauugcugauucuguacaauauauccaguaaauuagcaaaagcugaaaugaauuggauauauuuuugccauguuuuauacucuaaaagaaaaaugacucuugaugaaaacauuacuaauaaaauuugaaaccuuaaugaaauauucuugauaacuauaguaaauguaaaguuuaccuuucacucuuucaggguguguaugggccaaaagcauauguggcaacccaagggccuuuggcgaauacagucauagacuucuggaggaugauaugggaguauaauguuguggugagugacuugucauagauuuugagaucuauauguuuaaugaccuuaugugucuuacugagaaagaaguaaggcaaccuuuuuuuuguauaauuuauuuuuauuuuaugugcauugguauucuguccgcauguauguguguauaagagucuaaagcccaggaacagaguuacaggcaguugugagcuugcaugugccugcugggaauugaacccaggucuucuggaagaguagccagugcucuucacuacugagccacuccagccccuaagaaucuucuggguaaccuuuguguuguuuuuaaugauuguauucauuuuuauuuauugugaauugguauuagguuuguagauaugucuuugugagggugugagauccucuggaacugcaguuacagacagcugccaugugggugcugggaauuugcugccaugugggugcugggaauugaacccaugucucugaaagagcagucaguacucuuaaccucugagccaucucuccagccccuguaaaggccuagcuuuuuagguauaaugaccuaaguguaauuacauuucuagaaaagacaaaagcuacuuuugaagauggcucauuaaauucucacaaaguaguucacauauuuuaagaaaagcgugacuaagucgggugugguggcgcacaccuuuaauuccagcacuugggaggcagaggcagacagauuucugaguucgaggccagccuggucuacagagugagauccaggacagccagggcuauacagagaaacccugucucaaaaaacaaaaaaacaaaaaagaaagaaagaaagaaaaccaugacuauaguuuaaauuuuguccuaagccaaccaaugauauagcuaguaaauaacuuuaaaaucauuuuucaaagaagaugaaugcuugcauagaccaacgaaaugauugauaguauagguaugcucuuuuaaaaaaaauaauauuuuuaauuuauuguuugagaaauucauacauauguucagugcaucuccaucauauuuaccuucuacuccccuuaucucgccccucuugacuuucccuccucugacuccaccuaaggguggaaggugaucgaucacccuuccaguuucuucccuuagugcuucuuacaagcacaccaauguagagccaugcacugagccugcugagccuaccgaagccuguagcccucgggaaaacugacucagcggucagagcacgggcugcucuuccagaagaccuaguuuugauuccccgaagccacauggcagcuuacaaccaucuacaaccccaguuccagggccuucugugacauccuugggcacuaagcaugcauguagcucagauauacauacaggcaaaaggcccauucauacacacaaaauuuaaauuguuuuaauuaaaaaaauaaagaagaagaaaagacuguuuucccucccacgcagccaucaguugucugcaucuucucaaccaggaguggggacuccaugugccugucuuccauucgugacagacacaucuuuguuucuuucuuuuucuuuuuuuucuuuuguuuuuauuuuauucacuuacgucccaauaucugcuuacuuuuuccucccaauauccccucccacagaacuuccccucauucucccccccccuucucuuugagauggggaccccacgcgccucaguacacacaucaggucacuacaggacuaggcacauccgcucccacugaggccagacaaggggaacuuaauccacggucaggcaggcaaaauacucaggaagagcccccacuacuguuguuguuggaccaagcugcuccucugcuacauauguacauggaggccuagguccagcccgugcucgcuauuugguuggugauuccgucucugggaagccccaagggcugagguuagcugacucugcuggucuuccuguggagucccugacuccucccccagcucuuccacacgacuccuggagcuccaucaaguguucagcugugggucucugccucucuuuccacuggcugcugggugagccucucaaaggacaguucugcuagguucaacagccauauuuuauaacuuuugucugaaagcaggauauuuuggguccuuccuaggaaaauagauguaaauauauuaacuauaaauuauuaaguaaaauaaguuauuauaaaagaauguaaagaaccucucuccucgccccuggucauucagggggaugcauaucugaacuacuagcauuuugguucccuuuggcuuuuuuggauaaaggggaauagugugccccuagguuugaaagcaagaaacuggcuuacaggauccuuuggagcgucgucauuggaauccacacuuguguggcuguggaaaguccgugacaaggagcucucauuacuuucucaugaauguuacaauggcuuuuucugugauguugcagugauucuaaugcauuggcauccuccgcugucccuuugagauuauuaagaggggaaugcaauaacaguacuaguguuugcugacaguuucauuuuaaagugagauuuaaagcaggaacacauuuucuggauaauggcaacauauuaugucugcauagaagguuguauuuucagaaguaugcauuugccaaaauugggagaauugucacuuaagauuuguauuucauuguuauguauuuucaagauaaaauauuccauuaaacaaauauugagcucuagauaauaugcaugcugaguuaccuaguagacugauaucuacuguauacuaaggcauugaaauaccuuuauaaauaaggugauagaaggauaaguaugauaauuguuauaauaguuuaaugauaacagcuuuuacuauuaaaauuuucaacuuuuauauuuuaaauauaaaaugcuucuauaaaaugaggaagcagauagaacuuuuauuuagagguuauuaauuuuaauaaauucaaccuuuuuuaaaguuguauuuaacugugcuuuaauauuugguuaagaguaauacuaaauuagguuaauacccuaacaguauuuuaguauaacucaaaaauaagaaauaaaugaaccagauuagaguuuaauccaaacuaaguaaaucauuuuaaaugaagucacuuuuauuuaguuuuuguuuagaagaugugauuuucauaguucauuuaucuuaugcuuauucuuaagauuuuauucuuaugugugcuuugccugcacauacguuuauguguuauguuugugcagugccugcagagaucagaaaaggguauugggucaucuggaacuagaguuacagauaguuacuagccaccaugugggugcagggaaccaaaaccagguccucuagaugaacagcuaguaucaaggaaacuuuugcucagaauaaaagauaauuauugacauuuguauuucacuugaaaaguaaaacuauuuuuaacugauuuuuuuuuuucucucccaccccaacuccuucuuagaucaucgugauggccugucgagaauuugagaugggaaggguacguuaacacauaguguuuggggaauaggaguuccuggucauuuauuacuucgguuaucugaucccauguaguuaaaggguaugcacuucuuuuuugugcucugcuauuuuauaugauacauggagcacaaacuucuguguuucagaaauucauuuuauaauauacuaaaauuaaguguauuguuauguauaguuuucaaauguuucaugauauuuuaagucaaauguaauuuauugucuagaaaguaauuuuuaaaaugguaguaaaauugaacauuaaaguaguucugguggucagcaauuuaagcuacauaugaugucauacacuuggaaugccaacacuugagaggcagaagcagggagcaugccacaaauuugaagccaagucaguuuacauaaugaguucuaggccaguuaaaucuguaugagaucuugucucacaauuuaaaaagaaggaugaucuuaaaaauagcaugacuauucugauaagucucuuugcaaaaacuaaucuuucuguaugaguguauugcaugugugcauacauaggcauguguaugugugugcagauagagucacaugugguauguauaaguaugaaaaaccagaggucaggaccaguuaguauuuuucuguuugucugucccuuacuuccccucuguccuucuugcuugagauaagggucucucacuaaacugggagcuuaccauuucagcuucaccagcuggccacugaguguccagaauuccaucugcccuacaguauaggcggauauacuaugccugaccuuacaugggugcugggcucaaaauucagcucugagugcagagcagguacuauaucuguugaaccaucuucccagcccuaggacuaaaauauuucuaaaagcuuaagaaaugucauacaguuacugaacuuuguucuauuuauauuuuuugcacaacagaaaaagugugagcgcuacuggccuuuguauggagaagauccuauaacauuugcaccauuuaaaauuucuuguguaaguaccuauuuguauguguuuuaaaaauauuuuuaaaaauuuguucuuugagaauuucauauacaaguacaauauauuuugaucaaaucuaucccugcccccauuuuccagguccucagacucaccaacuaugucuuucucccaacuucaugaccuuuuuaaucuacugaguuggugcacaugguguagggcaguaaacuggagccaugcaaacacccuaaagaaaauuaacugucccugacccagcaaccaacagcuggcaauagccccuccccuuggaguaggacuguauaagccccuccucauccauguuggaaguugauuggcucugucuuguucagggagcugccacuccaguguuuucaguguguaauagcccuguuacacccaguuucauggccguccuuuccaaccuugagcuuuuagaggcuuccugcuugcccauggugguuccugagccuuguggggaggggucgauauggaugucccauguaggugagcauuccacaccacuugcucuuugcuccuuagucaguuaagcgucucuguauuugccucucucuacagcaggaagaaccuuccugguugaagcuugagaguugcacugauggcuuuauguaaagaucaguuuggaaggcuguuuguccaucuagcaaaguaauagaagugguuucuccccuagggcauaugaccuauccaguuuacagugucaggcuugauuuccauccuguggagcagaccuuagguucaaugaaaaggggauccuauaacauucaugccacaauuacaccaguagucuuguuuugccaggucagcuauuguagcucacacaguucacagccagguaagacuuacaccaucaauacguaucaccuuuucugcauuauaaaagcgacacaguggagaggaugccuccacauccacaguaccuauuuuuauauacaugauuucaucagaaaagccgcauuguugacugaacauuuaaauuguaguaugguacaaacucaggcuauuacaagcuaggacuuaauuccaugcagacuuucacuuacaguaaucaguacugauguuuuaaacugcuuucagauucaggaggcuuaggaacaacuuuuucuuuuuuuuuuuucuuugguuuuucgagacaggguuacucuguguagcccuggcuguccuggaacuuacucucuggccuagaacucagaaaucugccugccucugccucccgagugcugggauuaaaggcgugugccaccacgcccggcaggaacaacuuuuuuuuuuaagauuuauucauuuauuacguguaaguacaguguagcugucuucagacacaccagaagagggcgucagaucucguuacagaugguugugagccaccaugugguugcugggauuugaacucuggaccuucggaagagcagucgggugcucuuacccacugagccaucucaccagccuccuaggaacaacuuuuacaacuguuauuuucuuuacuuuuaugaugauucuguuagucuuuuuacaucucuugacaauguacaugugacuguuucuuuggagguugauauagucacuucugaucaaauaaauggaaaagaacauugcuaacugagguauaucaugcuauccuuccucacauuuuaaaauuaggaauaaaguuaaauuugaauccugaaaguaaagauuauucuuuacagcagguaacuugacaugagccugaaguguaggcuggcccugguugaugcuggaauuccagcaucacuaaggaggauuguucaaguuuggccuggucuguguaacaaguuagcagugauucucaaccugugggucacaaccccuuucauaaaccucugucuccaaaaauauuuacacuacaauucauaacaguaacaaaacuacaguuaugaaguagcaaggaaaguaauuguaugcugggggucuccacaacaugaggaacuaaauuaaagauccacagcacuaggaagguccuuggugcaggguugacgugggagaccauuuagugaccucuggaguuaaacuccaguucagauacuaccacaguagaaauuugagaaaaugaaugaagugauucccaugcuagaauuauaguggaugucuauuuuauuaaugaauagcauauauuguccuuguuaaugacaggacuaaacugucugugguuacaacuaacaaggcaaaaccaagaacucagcagcagacaaaugucaggcuaauagacucaaagcugugcauguucaaccauaauaagguaauaacuaaggguuuuucuccccacauugcugcucauuuagauugagcguugagugugacaagggaaagaaaacguggugaaugugggaugcgguggcagacaguaacugacauuccucuggauuguuuccuuaaaugguuucggggaugauugccacuucaguauucucuguuagaugauagagucaggauuaaauaaucacugacuagacacuuuuuaaagccaguaaguaaaaauuagacaaaacaguaggaagcaaaggggguggcucaguguguuaggugauaauccuaccuagcaugcucaaggccuuggggcuuagucccuaccaccauuuuggggaggaaaaaaaaaaaacacuuaaauggauuacuuuuagauuuuuaaaauaacuauuagauacauccaaaauucuaaaugcuaauuuuagguuauggaccuuuacguauuugugugucuguggguaugcccacaagcacuuuuuguucguuuguuuguuuguuuguuuuucaagacagaguuuccucuauguaauaacucugguuguccuggcucuuuguagaccaggcuggacucgaacucacagagauccgaugccugccucugccuccugagugcugggauuaaagauauguguuaccacaccaggcucaauucacaagcuuuuaucuuuuuaggaaaaugaacaagcaagaaccgacuacuucauccgaacacuuuuacuugaauuucaaaauguaaguaauucccauuauagaguaaaaagaguuccuauuuccauucaucuucauucuucccaucucucccccuccuccuucccauucuugcugggaguccgagucuugcuguuauguaguuuauuuagugagugucuugagccuuaugcugaucaaacuguguaauaaagcagucugagguuacuuuacuuaggacaacagaauuuucugugugugucuugcauaauuaugcuuucuuuguugcauaguuuucuucuauuaacacuuugcagauuauuguuuuauuuauuacucacuuguacucagaauuuuuuauaaagacaaaacuaaauuuucauuuaaagauugggauauagcucaguggugggggccuuugucuagcagguacauagguucaauucccagcacuauaagaaguuaaaaagugagcuggagagaugguucagcaguuaagaggacugacuguucuuccaaagguccugaguucaaaaaccagcaaccacauggugacucaaccaucuguaaugagaucuaaugcccucuucuggugcaucugaagacagcuacagugaacuuagauauaauaauaaauaaaucuuuuuuuaaaagagagagaaauuaaaaaguaaauauuaauuuagauuuaaauuaaaguaucuucaggcuguugacuuaaauguuucagagucaaaaaaugauaauuuuucagggaagaaaccaaagacauguauaaaaagacauuggaaagaugcuugucagcuuuuuucuccucuauuauuagucugucuuggucacuguguuagucaggauuucuauugcucugacuuaacaccaugaacaaauacaacguggggaggaaaagguuugcucagcuuacacuucuauguugcuguugaguacugaaggaggucaggauaggaacucagacugagcagggaccuggaggcaagugcucaugagaguucaugggggaggccugcuuacuggcuuauuucccauggcuugcucaaccugacuuauuauagaaccaggaccaccaacccacagauagcaucacccaccaugagcugggcucuagcuauugaucacugagaaaaggccuuacugcugaaucucauggaggcauuuccucaacugaggcuccauccucucugaugcuagcuugugucaaguugacacacacaaucauccaguacagucuugucacagcauucuucccagcucauuguaaggcuaccuacuuucugucuggcaagcgacacacagucuuucuucucacugacuggacuaaugauagcccuuuaguugagucauuucuuuuacucagguugcacauuuuaucucuaguuaguaccuuaacuccuacaaguguaucagauauaucaguuauucuaacuauaaaaguauguauugcauagauaaaagggauuugagaaguuaaauaauuugccuauuuaguaauugacaaauauagaacuugcauauuggaacugaaacccaagcucuguucuuucuacugacaucuagaauaaucaaucuuaaaaguuauugaggggacuaaggagacugcuccaagguuaaaugcccuugcagagcucccagguuaguuucuagcacagcgcugauggcuagccacucacauuccacucagaucuaaaacucucuuugaccauggggcaugaggcacacacagcauacauauguccguggacucauaaaugaaaauaaauaguuuuuagaguuacugaggcaucuuuggauguuuaauuuaugcgggcuaucacuuucaauauuuacuauaagguuaaaauuggggaaaaaauuuaaagacguggaauacauagcuuacaaguuuguaaauacauucuucuaauuacugaauuucugcuuuucuuuuuuuuaauauuuauuuauuauuuauauguaaguacacuguaggugucuucagacacaccgguagagggcaucagaugucauuauggaugguuguaagcuaccaugugguugcugggauuugaacucaggaccuuuggaaggacagucagugcucuuaacugcugagucaucucuccagccccugaauuucugcuuuucauguaggaaucccgucggcucuaucaguuucauuacgugaacuggccagaccaugauguuccuucgucauuugauucuauucuggacaugauaagcuuaaugaggaaauaccaagaacaugaagaugugccuauuuguauucauugcagguacaaaauaauuuucuaaauguagagaaguacaguguuuauguuuugugagauaagguuuuauuucuacauuaauaugauguuuuauuauaucuugagcuuuuccuagcccuguuaugguguguuugagaauaagacccugugaauugauauaaucuaaucugguuaauagacugucuaaauguugcuguaaaacaucauauuuccucauaugaucagugucaggcaaauuuucaugagugaugaagucucagacuuuaaaaacuguauauagauauaaaggccuuacugaucugagaucccguggucugcagagaagugcuggguguagggacacgcuuauaaccccaaaccaaggaggcugaugugagcuuuagccgcucagggcuaccucccgauaauguugucccuuagcagaaagaagggaaggaaagagaggggacagacaaagccuuaccugacacauacuaaacaugagaguuuaaaagaauucauugcuaguuacacagcauagaugucauuuguaagauauaccugaauuucauagcucuuacgauguagauuguaagguguuuuccaagugacaaacauccugugcuggauuuuguucccgaggagcaagcugccaugucuguaccauuguugucauacccugaaauuauaguuuacaaacuucugaaaucuuaagcaaacaugaaacgagcauucuuuuuuuuuuuuuucaccuuuuaaggaauuauggugggugauauuuauuguuaaauauucuaaucuccccacuuuuuuuuuuuuuuuuuuugagaauugaaggcuuaucacugcaucuuauguaggccaggcugguaucagacuuauuaaauagccaaggcuaucuuccuugccuccacucuucugcuuggauuauagaugugugcuaugauaccugacauagcauuuuuguaguaaguuaaauauaaacuguugguauacauuuacuggacaucuuuauuaaauugugcuguguagcauugcccaaaguaaugaccugccccuuaacaggcuuaaguuuagcuauaucucuguuaaacugcucuguaaaauguuuucacucuuuccagguaauacuaaguuccaauuagucuuugcaaauuuagucauguugagacauaagaagucauguaaacacagccuucaaauucugccauucuugaagggguaacuaauuuuguguuccgagugcagguuagagguuguguuaaauaagagcagguguuuuuaacugagcucauugaccuguuuuuauugucugauuauuuuuccuacuuauaagccaugaaauauuuuaaaugaaaagcaaagaaacauuccaguuggaaggaagauagccuuaauuuuuuuucauaucugggaaauuaagaaugugugccuaaacauuuauaggauuuuuauguccuuaaauauugugacuucuuuguucccugucucaucugacagacuuucuacuccaguaaacuccguauuauuuaugauagaacuaacgagcucugaaacacuuuucagaaagguuuguuaauguucuguggcuucuuugaaugaccacuacucuuuuuuuaaaaggcggggucuuaauagccaaggugagccuugaacuuuuaccuccccauuccuaggauaccaaagaaggaagaaacaccuuaccuaacuuaguuuuaauguaaaauuauucaaaggcucccuaaaguggcucaugccuauaaucucacugcauagcgacugucggagcccagccugggccgcagagugagacuaugucucacaaagacgaagagaauuaacaacaauacaauccuaaaggagcaaaccaacaaaaacccaaaaaccagggagacagcaaaggaaacaacuaagcuagguuuuaaacacaggaaaaauagcugcuacuugaauuguauguuuuuucuauugcugucauaaaauaucaugacccaaaauaaauuuaaauaagaaaggguugacuuagcuuacaguuucagaggaugagugugcauaauguuggggaauagccucagcaucagaaaguaaggcaaggcuaaacccugcaagccuaccaauauuuguccuccaacaaggccccauuuccuaaaggucucauguuacaccaaccuccuaaaggggaccaacuggggaccaaguguucaaaugugugagucuggaagacauuacucaucuaaaccaccucauccaugcuuaaggucuacauuuauaguguauagaaaaauguuagggagaauacaacuuuuaaaagaauaaauguugaaucaaucauaaaaauagaagguucacaguaguuuacaguauaaucaugguuauauuguacaguaauguauaagauauuucaaaaccuaauuuuagaauuucacuagauaaauauguauguuuccaaguaguauaaaauuuacuugauuccuuaggcaguuuuucuauuuucuaucuugauauuucaaaagaccuuagaaucagaguuucucaaaaaucacacuaaauuuguccugcuaaacuauuuguaucuguaauugaauuuuacuauaagaaauaaauaaagaaaacacagcacgguaguuaugccuguaaucccagcauucuggaaacugaagcaggaacauuaugaguaggacaccaacaugaguucaauucccagcaaccacaugguggcucacaaccaccuguauugagaucugaugcucucuucugguguacucauauaaauaaaaauaaaucuuuaaaaaaaaaagagagauuauugguuaauuacuuuuuuaaaagguugauuuauuucaauuuugacuuuucuuaccuaacuggugucuuuugauuaguaaagagagcugccuccaggagaauugguuugcugguagauauacagaaaccaucuaacaaauuacuagauuaaaacaaucuuuucauaguuaauuaaugguggucaaaaaagaaagcuuuuguucugauauugaaagauaaagaaaugguuuaacuugauuuuuuuuaacaacuuguuugaaauuauuuccuguuccauccuguuauucagccaauaacuauaauucauaagucuauuucaguaggguuuuucuaguuuuaaaaauuauuuacaggguggugaugguggugcacaccuuuaaccccaacacuugggaggcagaggaggauggaucucugaguuuugaggcuagccuagauagacuacagaaagaguuccaggacagccagggcuugcuacacagagaaaccauguaugggggaaaaaugaugauuuaaugcuguuagaagacaguguguuaacugaaguaacuuaaaagcacaucuacaaaaggaaagaaaacguacccauuuaauauaaaguguguuuguugggaucuuaaaaccuauccccagcuggcugggaccucaaguacucaugccucagucucugaagugcucgucaccauaggcaggccucccacacccagcucuagagcgagcauacuucacaagaaugcuuccuuccauuuaauuaaagucguuguaaaaacaguguagcuucagcguguucugcuggagcccagcccggguuugucagcugccuuuguguauggacuugggucacuaaggucacugcugcuucucugaacugauccuacacuugaggcuuucucucccauaccuacuacaauuuacugggucuucuugaccaaaacaguaaagccauugugagcauucuauuaugcuuauaacuauugagaauaauuuuaucucuacaggggguuacuggcgagaauuagacuuauggggguaaggguuuacagguucuuugugaggcacuuacuuuuauaaauugcugaauuacauuuuuaaauaucaaauauuaauguuaaggaugguacuguacucuaauuuguauuugauuuacuauguagaauuguaucaaauuucuuauugggguauaauuagcauaccuuuuauuuaaagaaaaaaacaacaaauuuuuuuucucaaacuuuguucccuuagugcaggcuguggacgaacaggugcuauuugugccauagauuacacguggaacuuacugaaagcagggguaagaaugccuuuuauauaguaucauauucaguuuauuguuauguuaaauuuauaguguagguuuuuugguuuuugguuuguuuugguuuuuuagauauacuauauuucuagaauuagucuuaccauauaaagagcaauguggguaaguguaaauguuacagcugccuugaaacuaugaacugcaaaccagggugggguuuguuuuccacugagugaauucuuucauguguaguguuuaagagugcugaccccagggccaaagugccuagaaucaauucugggcuuguaguucacuacccauggcauuuuaguugugacaguugcugucagcauuguaguuucuaccuguuauuuccauuaaauuguguuugaaacuguggaagacacaaggaucagagucccuucucugaauguguauguguauguuucuuguauauguuucuuuugcuaguucuauacuauguucauuuucucuguguuauaggcaaacuuuaucuuucauagcuugaaauuugcuaugaauaugucagucagcauuuuguuaaaaaaaaaauagguucaaugcuuaguuuuccuuuuacaucaucuuuuucccccuaccauugcuguccaucuguccaagucuccucucccuccccacccccccaaggcaagagcaaguuuuaaauaauucuuaaauaaucucucugggauaaaacuucauuuuuauauuccccuaagacuaaucuuuuucuaauaugaaacguuuuucaaugaaaaaaauugacuagacugcgcucuucccaguuguuuauguuugguugguugguugggguucuuugcggggaagggggaugaaacacagggucucacuauuugguucuggcuucagagacagacagacagacagaggcagagagaccaggcugaccuugaacucagagauccuccugcuucugccucccaaguuuuuggauuaaaggaaugugacacugugccuguaucucauuuguaacauaaaaguaagaaauuacaggacuagauugaugaccuagcaguaaagagcacuuccugcucuugccugggaccagaggucaguuccagcacccacaccaugacacauccugaaacauaacuuucaggauagccaaggccuucugaccucugcaggcaagcaucuggugcacauacauacuuauauauguagauaaaacacauagaaauauauauguacuugggagaggauagugcuuagacagggcuucacuguagcuuugacuguuguaaaauucuguagaccaggcuggcuucgaacucacagauucaccuggcucugccucccacgugcugggauuaaaggcgugccgcaccaccucacagcauaaaugaauauuuuuaaacuccaaaacuaaaacuggaaaaggaagagauagaaaagggagagauauuaaaauacuagcaaacaaaauuugggaaaaaguuucagaauauuuuaaguauuuguuugaaacaucacuaaaguuguuuauuauaguccccacuugauugaauuuaucuuaacauaacuauaaaccuagagcuuagcuggaacuggauauaaaaaugcuuuuuagccgggcgugguggcgcaugccuuuaaucccagcauucaggaggcagaggcagguggauuucugaguuugaggccagccuuuucuacagagugaguuccaggacagccagagcuauacagagaaacccugccucgaaaaaccaaaaaauaaaaaaauaaauuaaaaaaaaugcuuuuaaugucucucgagacuacagcuuaaaaucauucuuugcuugucagucuuccucauggcuccagaauguuucucucagacaaccaaauccuacucacuucuuccugguucagacugccgucuuuccuggaguagaguugggagguacagacauaccucaguguggacuggauacgcugugcgugugucuuuacagagacgagccugcgggucugccuuagcucuuucacuugugucgugcauggccguggccaaggacacagaggccuagaaaguaaagucaaauucuuuaucuuaggcuuuauccauauucaacgucuuaguucuccgaguaaucaguuucccaugauuuugucagaauaaccuuuuauucacacuuauguguucaugugcgugucaguaugguguguguauguguucaucugugcacugguauaugcaccagcaagugguggucagagguugacuuucuggcucuuuuacaccauaguuucuguguuaaugucucuugguaaacuagcacugggguuucaggccccagcgccacaccagcauuuaugucaguucuguggaacugcagccagguccucauacuuauuuacaugagcacuucccugacuugagccgucuuucucaccccuucagaacuguguaauuuuucccccaccuaucaguuuuuuguggucucuguguuuccugcaugggcuagucacauucugcugcgugauucugaggaccggauacgugcaucugcagcacugucugucuuugucugauagcuagagcgcaguaaauacuugcaguuauccagccuguaucuaaggucugugugaaaacuuggaggguauuuuacuauuuucugauaauguuauauucuuuguuuuagaaaauuccagaggaauuuaauguauuuaauuuaauacaagaaaugagaacacagaggcacucggcaguacaaacaaagguagaguugguuuuucucuuuguaaguuauauuuuuguaaguguuucuccuuggaugcuccucacugucucguacuuuaucauuucucuuuauaauaggagcaguaugaacuuguucauagggcuauugcucaacuguuugaaaaacagcuacaacuguaugaaauucauggagcacagaagaucgcugaugguguaaguguucuuggcucacuagccuuggcagacuugcgaucuugugcuguaggugggugagguggucugaaaaaggaguuucgguuugggguuuuuggggagguggagcuggggguucaagacaggguuucucuguauagccuugacuauccuggaacucaacucugaagacaaggcugaucuugaauugagagauccccaccucugccucccaagcgcugggauuaggcguaugcaaugacugccuggcucacaggaguuaacuuuuaucugaugugggucacuaacucacuuuacuuuuuaucaguuacgguccagaguuagugauucaaacugaauaaguaaaauuuaaaaggaucuuaugucaaagucuacauucacuauuguuucaaguacaaacuaccuuuaaaaacuuaacugcguuacugcucucacccuuaacuacguaauuguacguugaguuuaacugaaauuuauuuuggcguggcaguauaacauuuuguagguuuuugcauguacuccauugcuuguuuguauuguaagacaaucuugcuauguagucccggcuguuggagguucucuugccucggccuccuugaguacugggauguaauauauauacaugcucuuuaagaacagucauaggggacuggagagauggcucagugguuaagagcacugacugcucuucugaagguccugaguucaaaucccagcaaccacaugguggcucacaaccauccguaacaagaucugaugcccucuucuggagugucugaagacagcuacaguguacuuacauauaauaaauaaaucuuuaaaaaaaaauagucauagggccaccagaaagucccuuuuugucaugcuguaacuccuugcuauauuagccuuaaaugaucuuacuggagcugcagauuguuuaguuuauuauuaagggcuguguauuuguguguauacaacaugauguggggugagggauacauaccacaauguggagaucaugugucaaucaaggaaaauuacuuuuccuguaauuuuaguaaaacuuuuuuuuccccuuggcagaaugaaauuaccacuggaacuauggucaguuccauugauagcgagaagcaagacucuccuccgccaaagccaccgcggacucgaagguacucugugccuuagggaaucuccucuagaaggaugcuuacucuacugaccuaacuaaaaugacaacaucggauuuuuucuuaguuucauaacuaguuauuuuuuuaagauguaggacauuugccaauuauuuguuauugauaagcuaagguuuuugauugauuuuuauauauaauaucaauacuacacuauacuaagauacauauuuugguguuagaauacgaaauauccccuuagcugccuuuaaaaugggcuaggaggacucucuagaaccaggaagucagagaacagucaauguuuggagacacugcccagauccucuccugaccaaauucuacugaaggcucauuuguucuauguauggcaggcacaaagggaagaagcgagacuggaaagcaguguuguagaggcuuaaaggagaaaggauuuuauuuuguuugucuaaaguuugguuugacagugcuagugucuccugcaugugagacaagaauucuccucuccccaccuccggccccaggccacaugcccagcccugagggagggcaagcauagcgcaugagugaguguagugagugugugugugugcucccaacagcaucugccugagaugaaaccgcauucacaccugggugcaacacagagcauuuaagacauuaagauuacaauuacaauuaagagauucuagcgaggaguuauggauaguucaugccaaaccauuuagaacugucuaacgugggaagccuacaaacaguaguguuugggaaaauucacuuaggaaugaaaaacaacaaguacaaauuaagaugacgcuggaugucaaaugagcauugaagaaacugaggcaguuuuggggauugcugcaagcuauaaccugggcuacgugguagguuuuuaauuaugguuuagauuuacucauuugaccuuaugugugcuuuaucugcauguaugcauaugcagauaaaucucuguguguguauguaagaaaguggcaucagaucccuuagaacuggaguaaugggucguuguaagcaguugugggugcugggaaucaaacccugguccucuggaaaaggaugcugagccaucucaccagccucaaguuuaacuuuuuaaaagacaauuguaucaaauucaaauaagcuguguuaaagagguuuauuuauaaaguaguagacaguagaaaauagaauuuuaaauagagguuuauuauuuuaguuaguuuuaaaaaaauaaauaaggggcuagagagauggcucaguggucaagagcacucacugcucuuccagagguccugaguucaauucccagcaaccacaugguggcucacaaccaucuguaacgggaucugaugcccucuucuguuaugucugaagacagcaacaguguacuuauaaaauaaauaaaucuuuuauauaaauaaauaaggcuggagagauggcucagugguuaagagcacugacugcucuuccaaagguccugaguucaaaucccagcaaccacaugguggcucacaaccaucuguaaugagaucugaugcccucuucuggugugucugaagauagcuaugguguacuuacauauaauaauaaauaaaucuuuaaaaaaaaaaaaagccgggcggugguggcggauuucugaguuugaggccagccuggucuacagagugagucccaggauagccagggcuauacagagaaacccugucucgaaaaaaaagcgauagauagauagauagauuuucuugguugauaaauuauguauguaauuuagcuuuuaaauaauauuuaagguacuuuuuuuaauuugccaguuuucaaaacaccagaguauguguuuuuaaaacugacaguauguuaaagugcaucuagauucaucaaagccaaaacuaucaaagagcaacuggaggaaaaugagcagaggacuagccuguuuaaagauuacagccuuucagagcaaacgugcagccuggcucccgaaugggaaaggcagaaagaccagaaacucaaggucaggccugucagauggcucaguauagucacucagugucaagggaaucugaugaccugaguucaaagccgggugucugucuucugccugccagugugguccauacauagcugcacauccacaucgaacucacagauaacgaggaaaacuuaacucauugccauccucaacuacauacagccuggucuucacaaggcugcauuuaauuagauaaauauaacaguuuauuuccacuaguuacaaaaacaaauaccagggcuggacagggagauagcaucagaaagguaaaauaggagauaauuccagaguaggugccucugcuucauagacuagagguggagacuauugcuuuucguuaguaucguaggacuuuaacaauaccucuauguuaccuugauaaauacagaauuuccuuagcuuacgaauuagaacauuguaaguauauuguaaucagucaacuuacuuuuaaauguuaagcauuguuaaagcccuaucuguccuccucaguugccuuguagaaggggaugccaaggaagaaauacuacagccaccagaaccucacccggugccacccauccugacgccaucaccuccuucagccuucccaaccguuaccacuguguggcaggacagugacagguaccacccaaagccagugcugcacauggccucaccagagcaacacccagccgaccucaacagaagcuaugauaaaucagcggacccaauggggaaaagugaaucagcuauugagcacauagauaagaaguuagagcgcaauuuaaguuuugagauuaagaaagucccucuccaagaagggcccaaaaguuuugaugggaacacacucuugaauaggggacaugcgauuaaaauuaaaucugcuucaucuucuguaguugacagaaccucuaaaccacaggaguuaagugcaggugcccuaaagguugaugauguaucucagaauucuugcgcggacuguagugcggcucauucacacagagcugcugagucgucagaggagucccagagcaacucacacacaccuccacggccagacugcuugccucucgauaagaaaggacacguaacguggucacuucauggaccugaaaaugccacaccuguacccgacucaccugacggcaaauccccagauaaucauucucagacucugaaaaccgugaguuccacacccaacuccaccgcagaagaggaagcccacgaucuuacagagcaccacaacagcuccccucuguugaaagcuccccucagcuuuaccaacccucuucacucugacgacucggacucagacggagggagcucugauggugcugugaccaggaacaaaacuagcauuucaacagcaagugccacagugucuccugccaguagugcugagagugcuugcacuaggagaguauugccgauguccauugccagacaggaaguagcaggcacgccgcauucaggugcugagaaagguaauacagugucuggcacuuagcucguuaucugccugccucuguucuaagcauuuagcucggucaguucacuaucacuccacaccacacuugaaccugcaacaaaaguuaguugguuuuuagauaacuuuuuguuuauuugugcuuugguuuuuuggagauaggguuucucuggguaucccuagauguccuggaacucacucuuuuagaccaggcuggccuccaaaucccagagauccaccagccucugccuccucagugcugggauuaucaacacgugcaccacuacaccuggccaaauaccauuuuucuuuuuaaauauucuaauucagagucuuuuccucucuccaccuaguguaaaugccuauaaugagcaggauuguuuuauagaaguauacaaccuuauuuaacaucucugcauuuacauuacuauguuuuuauucuacucuuacacuacauccaaucacagguuccccucucuccugucuucccucccccccagaucuucaccccuccccagcaaaagagcaggccacucaggguuaucaaccuacaagcugcaauaagacuaggcacguacccucgcauuaaggcuggacacggaagaaagggguaccaccaaaaacaacagcaacaacaacaauucagggccaguccccugcccuuacauuuuaauuauaaguuuauauuuauuguuaccguaauuugaucuuugugucaauggaauuagugauacaaauacuauagaacccuugcuuagccauuuaauuucaccugugcuucuuguaaauacuuaauaguccuauuuuccuaccaaugacuacaaaauaacuuuuuaaagagcucuuuucauaaaugcuuacaaauaaaguuacuuugagcuggcaaguuaagccauaacuacucagcuaacuagagucaguuuuauucauucaaagcugagcagggugucuauauacccugcuaccagguuugcuccuuaauccuaagcagaugccaaguccagaggacacguguacucacucacacuguaggauuuugagaguggguuuccuauguauuucagacgggccuggaacucgggauccuccuggcuccuuugcccugggauucuaguuugaugcaccaugccugccauagagcauuugguucuugaaaucuucguggcgccuuuccucuugcuuuguuuuagagacaagggccugcagcuucaucuuucuggcucaauccccuauacucugagauacccaggaauguacuaccauugacugucacaguauuuuucagggauagagugauggcucaauuaucaagagcacugggccucuucuagaggacucugguucacuucccagcacccauguggcagcucacagcugucuauauaacuccaguuccaggggaucuaucacucucacacagauaugcaugcaggcaaaacaccaaugugcauaaaauaaaaauaaauaaguaaacaaguagacauauuuuuauuguuccuaauuacuuaccuuguagauuauaucauguacuguuuguuuuauaauugauuauuuaauuuguuacuugcuuuguaaaacaauggcauaaaaauauuaggaaauuuuguauuagaauuuguuagugaggcuggagagauggcucagugguuaagagcacugacugcuuccagcgguccugaguucaauucccagcaacuauauggugauucacaaccaucuguaaugggaucuacugcccucuucuggugugucugaaacauagugugcucacaaacauaaaauuaaaaaaaaaaauuguuagugaauuaacccuaauauuuuuauugauagcaaaaaaauauuuuauauaaguuauuuauugccugaaauuucauuauuuucucaggccugaaauuucauucagauuugacccaaguaggccccacacacuguguaauguugagaagccuuuguaaaacauggcagucucuaguugaacaagucuuggguugggggaggggcuacugggaguugacuugagucucuuacaugcucuagccuagaacucuaacuccagucaugauauguaaggucuacagaaagccugaaaggccauuuauagauccaaggagaagcaugcaguugagaagcaaggaccaguuagaaaacagacaagugauugucaagaaagaaccugguaaauacuuagcagugugcagaacuuagucccaguguuguguguccuuccuugaaauaaugguuucuuacuguggcacuuucucagugccacucuagguaaaucuaucaaguauuguauuggaacuguggacugaaggcuguacuuugugugaugucaccagcucuauaaacaugagggacacggacaguccgccaaccucaaugcuuguugaaaauguacuuaauauugagcuuuuaguacuaucaaauaugguaaaaagauaauguccugccagaccacucauuuucaaagaaaauaaggauaaagccuggacagacuaguauagguucaucaguauaguucccauaucuauccugccuagacuggguauacacgauaauagcucuaguauggucucaggguuugguuugguuuguuuguuuguuuuuucucuuucucucccuagagcaggaauucagagauccaauacacugguuuacccugaguuguaaggcuaaccuuaauuaaugcauuaccuccuaucuuuucuaggggcuagauagguuucuacugcuguaaaagccuuuaaaaugacuucaguuuauauccuugacacggucaggugauaguguucacaguacuuggcaguaaauauaugguuauuaagauauuaguagcuguauuauaucuaauagauaacgugacuuaaaauguuacuguaguugcuugagaugugaccaaguacauauuuuuccaugagugaacagauggauggugcacugugguuccauguuuugccccgcugcuaggguguggaagugccacaggacagacuaaacacugagacaguagacugcacuuacccugugcccacugucaguagcacugauacaccacucagggugcgaaaaugcagccuacgauguagggagcuuaaacugggguccccugauuccuugguguccaaucaccacuggaaaccacagaggagucagagacggugggucagggguccacaagccugcaaugagccaguuucucagacucauggacauccagaugccaguggaagucucagaagagccaagaauggagguggcccauaggcuguggcucuguaggugaaggccuucuccaugcuccccguggcaguucuugauggaagagacuguccuugguucuaaaguguuuauugauuggucaucauagaaaaugugugcauaacaacuccuugaggugaaccagagauuaaauaccuuuugcaggaaggaauguccagaggggaagcuuauuggcuaaacccucaggacuccucuagauaccucauuagcauggaacucuguucugaccaccggucacguuuccucuguggaaagaguggcacauguuccagcccagaaaucugguagggagcgggaggcgccuaccgucucagggaggagccugggugcuggggacugcaccugcucagccuuaccaaguucccugcacaugaaagucaugcugucagucaugagggaacacuggcuuucaccaggugagcagauugcugcucugcacacagagcauccucagggacagcaagccuccgcgcaaucagaguaaugucuccgggucccacagaccuguaggaggcguucgcuuuguacauauauguacagaccuguaggaggcguccgcuuuguacauauauguacagaccuguaggaggugucugcuuuguacauauauguacagaccuguaggagguguccgcuuuguacauauauguacagaccuguaggagguguccgcuuuguacauauauguacagaccuguaggagguguccgcuuuguacauauauguacagaccuguaggagguguccgcuuuguacauauauguacagaccuguaggagguguccgcuuuguacauauauguacagaccuguaggagguguccgcuuuguacauauauguacagaccuguaggagguguccgcuuuguacauauauggagucuguuccaucuuugcuccgugagaugcuuuacucgucuccauugugaauugagcgguaacgauguuuucaguguuggacgguugggguuuguuuuuuguuuuuguuuuuuucaagacaggguuucucuguguagcccuggcuguccuggaacucacuuugcagaccagguuggccuggaacucagaaauccgccugccucugccucccgagugcugggauuaaaggcgugguuuauuuuuuuaagacaucaaggaaguuaguucuccguuuaggugguauuuuacuaauuuuaauugucugaauuuuguguguuuaauucagaugcugauguuagugaggagucgccuccuccuuuaccugaacgaacuccugagucuuuuguauuagcaggugagcguaaugaguauuucuuccauauugcuggguuuauuuaauuugccaacuauuauacugaguaauuaaaaucaaaauguaaguuguaauugaugcugacaguuuuuauuacucacuugaaagcucuuuaaguaguauuuuuccauaccuaaaguugcuaagugacuauauuugugguagucauuggaaacuacuagaaugaagaaggcaaaugcaauuucaaauguauucacagcgagcgcaguugcuguuucauucacuaauccagacaacuucugcugcuucacuuucuagugaauguaaguuaacauucaacuugaguugugaaugggcauguuuaugaagauaguuucuaaaauuuauaggauuuuuuucuaaugacuuuaauaaaaaaaaucaaggauuaaagacagaaguuucaauauugagauuucuuuucuuguuccccagauaugccuguaagaccugaguggcaugaacuuccaaaucaggaguggucugaacaaagggaaucugaagugagucguguggggacuggaauagcucuacguuagcuccaccuuagagcuguuauccucaguuaccagcuuccuccauuccugcacuugaccauuuuucauuaguguuuuuacagguguuuguuuguuuguuuguuacuuuuugagacagggucccccauagucagacuguccucaacuugugcccaggccugcccuugaaccauugacccucccucuacagucucaguucaaggauauauauuacacauaugcacuacuacaucaggcuguauacucagauuaaaaguugauauaaaauguguaagauacacuauauuuucauaaggccaucucuuccaacuguuauuccguuagacugcuuuugaaaaaugcauaaacuagaccauguuuuaaaucauuuuggagguaugaauaggacuuaguauugagggaguaaaccacuauaacuagauuuuguggcccuaucacaaccacccuagguuuauuuuauauucaaggaaaaguacauagugguaacuuggacucagaaacaccacaauuggauaaaauauaguagauuacuauauuuuguguuccuccaugcauuagcuaggugggggugcugguuuuguuuuuaugcagaaguuucccuucacaguauauacaucaggauacuaagcugcagagauggguuaguggcuaagagcaaucgcucuucaagcaugagggagggccuaggugugccccagcccccagggcugcacagcgguagagacaggauaagcacugauccagauucacugagagacucaaaggaauaaagcagagagugguagacuaggaugccggaugucauccucucagcuuuacacacacacacacacacacacacacacacacacacacacacacacacacgcacacacgcacacacacaugcacacauacgcacacacaagugggaaaaacuuuaaguaaagcauaacaaaauugcaagcauaaugauacaccauugcuuucuuuuucuuugauauugaaucaagacacaaaucaagcauggcgugcaugccuuuaauccuagcacuuggggagaugggagaaagaauggcaggaauuugaguccacccuuggcuacauauugaguuugaagcuagccugggcuauaugggauucuguuucaaaaauuaaaggacuuuuuuuauacaccuuaauuucuugggguagaucccuauaauugauuaaguguuauauuuauugcacauaagaugaacuuucuguaauaaauauaaaaugucuuugcagggcuugacaaccucuggaaaugaaaaacauggugaguuauuuguccuuuuuaccagaaacuuuacagauuaauuuauuuaaaauagcacauaccuugcuucaugcucuuugguuauuccuguauaugaaggucucuaggauaacugcuugagaaaacacaguucugugacauaauucuucuaagcugacucacucauagauacuguugaucugaguuggaaagucaugggaacauucacuaucagaaguuaugaguuuauguguugcuucuuggauaguuguugcauuucuuauuuauuaaaacaucuagacguuauggguauagcugugauugagcacauaguuaacaggccuaaagucuagguuuacucucuagcacaaaaauuaacaacaauuacuuagcaguucauuucugugagagugaaugccgcagacugaccaacaagaaggaaaugugcccaugacuguugagggcguuuguguucaaucaguaguuaauacuauaaguuagaaguucuguguuugauggaggauaucucagugagugucuagcauucgaaaguccugaguucccagcccuucagacaucaggcauuccugcagucccagaacucacuugcagggagcggaaggaucggaaggucaaggccauacaaaccugucucagacuggagguggggaaggagugcuugaaggauucacuauccucaaauggaacaaguuacuaaugacacugcugucacuguucccacucuuacucuucugaaacauguacaguagggcucuuggugcccugcuccuucccuaugcuccagguagcaccaucuccuguacccucugccuuucugaaccuugacuucuaaagcugaguccuguuccuagcugaccuucacuugacuaagauugacauuuuagaucugcguccucuuuugucuuagaagguggcccugagaaccucgcuaccucucguuaucucuccuguucccaucauaucugccuguaaucuuaucaugaaguucaccacacuacuaagaugacuugugcaugucucuuacuaggccagcaacuggaaggcuauaacccccagguccuguccugcucuuggcaggacuuuguggaccuuugagcugaauuuguuuguucauuuuagaaaauuguuuuauggcuggugagauggcucccuggguaaaggcacccucugccaaggcugacagccuguguuuaaucucuaggauccacguaguaggaguuacccacuccugaaaguuguccucuggccucuacacgcgugcuguggcaccugcauuaccauaaguaauaaauguauaugguuuaaaaggaaaccaaguagggagggccugaugaugaugaugccugaaauucuagcacuuaggaagcaggcagaggguuuagaaguuaaaagccaaccugggcuacauagcaagacuguuuuagcaaaauggaaagaaaacaaagaaaaauggaauugggauuggagggguaggcaaagaguaacacaacagaccuuaaggacagggaacaccuuuggacuuaucuggguuuccagaaagguuuuucccugaaguugaaggagaaugacacaaacuacaaaggaugcugggugcgcugcuuaucuguaaucugaacacucugaaggcagaggcagaugaaucuccgaaucugaggccagccugguuuacuuagcauguucccucucaaugggagaaggaggaagagagaaaagagggaaggaaaaguuguagaagaauuagucuucauuuuuuuuaauauaaucuuuucacugcucuuuaaauuaguaaaauaacaacaauuuaaacaagaagacuucaaaaaaauuaguauuggccuggggaguaggaaauugaaauugcccagcaauuagaaaccuguuuaaccacucuaaccacuuuaagaaaauauagcaugccauguuuaggguugaugaaaugagguaaguacacaagaacauucccauuaccgaccuguagacugccugacugaagcugggcuucugaucuuagcccacaggagagcuggaacuuuagaccagccugagcuaugcaaugagacugucucgaaacaccaccaccacacacacagagacacauagacacacacacacacacaccccacacacacacccucgucaccccgcuccuuguauuuaucauggaaucucuaggaaagacaaccauaaggugaaacuugcucuuuuauucuauauguuccuccagcaaaguggugugagugugaugcugccuuaacgauggugacuaaugaggacuuuuaucuuagaugcagggggcauccacacagaggcuucugcagacucuccaccugcuuucagugacaagaaagaucaaauaacaaaaaguccagcagaagucacagauauugguaacuuacuucauaauucuaaaagccaggcauaauggcucucuuucaaugcuucuaucuguccuuucccaucucuuuggauuaaaguuggauagaaauauauuuuguuagauauuagaauggcuaugcaagcuugcuucuuagguccauuuguuuggaauaucuuuuucuaacucuuuacucugagguaaugucuaugcuugauauuaggguauguuucuuguaugcagcauacauacauucuguuagacugugucuuuuuuuuuccuuuuaguuuuucaagacaggguuucucuguguaguccuggcuguccuggaacucacucuguagaccaggcuggccucagaaauccaccugccucugccucccaagugcugggauuuaaggcgugcgccaccaccacccggcuuagacugugucuuuuuauuaaggaauuaagaccauugauauugagagaugcugaugaccaaugauuguuaauuccuauuguuuuggugguggugguggguguagauguuccuuuuggauuugcucgucugagguuauuuauuuccuguguuuucauggguuuaguuaaguuccuuggguucaguauuccuucugaaaccuucuguggggcugaauuuguagauagauauuauuuaaauuugaucaugaaaugucucauuuacuccuucuauggugauugaaaguuuugcugggucaaguagucuaugcugucaucucuuagagauguagucucuuagagccugugagacaucucagaugugauucugauaggucugccuuuguaugcuguguggucuuuuucccuuccugcauuuuccccuaagacaggguuucucugugaagcguggcuguccuggaauuuacucuguagaucguucugcuucugccuugggggcugggacuaaagguguggcugggaucaacuaccugacuucccuugcagcuuuuaauaauccuucuuuguucuguauguuuaguguuuuguuuauuaguagugaggggaucuucucuucugguccaaucuauuugguguucugugugcuuauacaauuauaggcauauucuucuuuaguuaggaaaacuuuauaauuuuguugaauuucuuuuuuaucaauuuguguuuucuuuauugcuucuauuuucauuuuuaggucuugaauuguuuuauuaguuuucuucaucuguuuguuuguuugccccccacauacacccuugguuucuuuccauccaauuuuuguuugcguuuuucugauuuucuucgauggaauuauuaauuucuucuuuagggaccucuaucaucuucauauacuuguuauuaaggucuuuguguaugugucugugugugugaguggaaaggaggcugcagcugguguucuguugcagugguaggggugacccugauaauuggguuugggggaacagcuauagauguauucuuaaaaaaauaccuuuuuaaaguccuuuugaauguuaauuuguuauuuugguuucuuuggcaauagguuuugguaaucgcuguggaaaaccuaaaggaccaagagagccaccuucagaauggacaugaugcagggagugaaaggacacuucacauuauacuggaacacucaagugccacugaaagccaggcuuauaguauuccaucuuuaaaugugggacugauagcaguguagauuguuaccuuaauguuuuugcugggaccaucuaccugccuuauacuacacuuaggaaaaaguauuauauuguuuauuuuguaacuucaaguauuauugccuuaaugucucuuaacccuguuacaagcugcuuguagaccuguuaauauaguaauacuuuuaugauaaauugaguuaaaggacuacucuuuugcuguuuuaucauguaugcauuauuuuguauauguacagggcaaguagguauauaauuugauaaaguccuaaaauauuauuaacagaagauguaagaauuucugcauggucuaagucuuuguguaucuuacuuguaaauuauuugcccugaaguuuuagaaaacaguuucugaauuuuaaacuugcuggauucaugcagccagcauugcagguuaucagagaucaaagauuguaauaauaauacauuuuguaaauuguaagcaaaaaguuauuuuuauacuauauacugucuaauuguucauccuaaugguucuuguuuucaucuagucauggagauucaguaagugccuuggaacaauauugaauucucuuagcucguguguguuacuuuaaaauuugaauucaacugggguuagaagacuaucagaauauauguauguuucaggauauuugaccugccauuaaaaaaacaaacaguuuuacacugcuac

SEQ ID NO: 12093 - RNA, 27045 nt, Mus musculus
cacauuuugagauugcacccggcuaaggauggcugauccuaccccucagcuagaugcgccagcuccccaggaagucaguagcgaguuuaagaagccgguuuuaccagugccuuccgcaguacgggguaaggcuccggccuccagucccuccguuucugaggaugugaagaaagaaugucucgcggcgcagcuggacucuggaugugaggagcccgaggucccgccaccgcagccggacagccaggagaccggggguccaccgguggagcaacuccgcuccccgcggguagcuccugcgucuggcgguccgacccgggcuccuccguaccgagagccaucguggggcagcccagccacggcccccuacagucucgaaacccugaaggguggcaccauccuuggcacccgcaccuugaaagacacgagcugcugcuuuuucgggagacuugcuaguugugacauaugucuggagcauccuuccgugucucgguaccaugcuguacuacagcaccggggggcggaucccagcggagacucugagggucaugagcagggcuuuuaucucuacgaucugggaaguacccacggcacguuccucaacaaaacucgcaucccaccccgcacuuacuguagaguccacgucgggcauguaaugcgcuuuggaggcagcacucggcucuuuauccuucagguagguagaaaaaucuaaaauaaaaaucuugggacuucacuguuuuugguuuuucaagacagggcuucucuauguagcccuggcuguccuggaacucucucuguagaccaggcuggccucgaacucagaaauccgccugccucugccucccgagugcugggauuaaaggcgugcaccgccacgcccggcgauucugaguuucuuuaagguuuaguugaguaaaaggauucugguaaccaaugacaaaagcacaggccucauucuggacccacaggucuguguacguugcugugucucagaaaguaauuuucucacuucugaauccauauauguauauauuuuacccaugauucauuagggaccagaggaagaccgagaggcagaaucugaauuaacaguaacacaguugaaggaauugcguaaacagcagcagauauuauuggagaagaagauguuaggugaagacucagaugaagaagaagaagcaaauaccacugaagggaagagcaguagaaguggucaagaugaugagcugggcugcacguggggaauggguaagaaacuacuacugaagguggcacccucaagugcuuuugaucauacagcucagaaggccuacagcugaaguaggguaaauguaauuugcaagcccagggucauuaacuuuagugaguaaaaguguugaauuaugggcauuauacauacaccucuuucucaccguguaauuugcuuauugcguuuaucauuuaaacacacacacacacacacacagaaagagagagagagagagagagagagagagcuuucugagugcuaauuaucaccuggagggcauggaaaaauuuacuucauuucuuuggcugagaaaucaguauuugauauuuuuucaccucucaggcuauuuucacaaaguacaaaacauucaagagguuauuguauagcuccacauuuuggaugauagauauucaggcuuauaaaaagauaguuggugagggccgagagauggcucaguaguaagagcacuaucugcucuuucagagaaagcucagcccucagcaaccacgugguggcucauaaugaucuauaaugucaucugaugcccucuucuggcauguaauuguacauacagauagaguaccccuuuacauaaaauaaaacuuuuaaagaaaaagauaguuggggcuaauaaggcauugugaugcaggccuuuaaucuuagcacuugggaggcagaggcagguagaucucuguuaguuucaggccagcaugaucuauuuauugaauuucaggauagccagaguuacauuguagagaaauccugacuugagugaaugagagaaugaaugaaagaaagaaguuguggcccagugagauugcuuagcagguaaaggugugugcugccaguugugaugagcugagugugagcccugagaagcacaugauggaggaagagaauaggcucccuccgugugcacuauggcacuuguauguguauggcuguagaugucaggacagaacaaaugcagaaacacuugugcuaaguguaaagaauaagccagaaaccauuagcaugcuugagcuagugucagaaaagggaugugucacuggggacuuagagcugugcuauucaguacaguagcuguuaucugcaugcccaauguggcucauccacaggcuugucuucuaagugcaaaccacacauaggauuucaaugacaaaaugaaaaaaagaaaagaaaauauuaccauagucuuguaauuauuaugguaagaugacauuuuaaaguagcuaauagggaacucagaauuauacucauaacacuuacauuucuauugcacaguacuaauuuagaucucuuggaaacuaugaauuauuuaacucuuguguguuuguguuagggggcauggucuguggaggucagaggacuacuugcaggagucauuucucuccuuugacuuucuggccccagggaucaaaagcagguugucaagcuuggcagcaggacccuuuacuuuauagauuuuaaauaagaguuucaagcugaagccaggauugugguggcaguaugcaacuuuagucccagcgcuggggaggcagaggcaggcagaucucugugaguuccaggacagccaaagcuacagagaaacccuuucuuggaaaaagaaaaagaaaagagagaagaaaagaguuucaagcuagaaccugaaggaaaggaaaaguaguccugaggaagcugcacacuggcacuggcguucagggcggaggcgguuggcuuuaagggaguguuguguugaccugucuuucuguuagacuggagaauuacuaauaaucaauauucgaaucaaugaagcuugagaggaaagaaagagacuaggcuaggcuagagagcucagugguuuuuuucuuucuuucuuuucuuuuuuucccgagacaggguuucucuguguagcccuggcuguccuggaacucacucuguagaccaggcugaccuugaacucagaaauccgccugccucugccucccaagugcugggaucaaaggcgugcaccaccaacgcccggcucaguaguuuuuuucaaagugugguggguaaaugucucuaaagugaugaaaagaagaaaaagccauggaaagaagucuugucuguuacacagcuuagaaaacauagauauucauaauggugacuuugugauuguuccaacuucugcccacagauaucuuucuguuagucacuuucagauacagauaaauaaguguguguguuucuugaaacauugucuccauacagucaggcaauccuccuuccuccaccuccugaguuaugacuacaggugugugccccucugccagcucaucuaacuauguccugauucggcuuagaagguucauaagugucauucacacacccucgucuuauguguucuuucuucugucuccugacuccugcaggagaagaugcuguggaggaugaagcugaagagaaccccauugccuuagauuuucagcaggaccgggaagcguuuuauauaaaggauccaaagaaggcucuucaaggcuucuuugaccgagaaggugugugugugacugugguucuggcugugacaguaagcugcucacgcucacagcagugcugcuuccuaaagcugugacuuuugccuaauacuugcacauaauuugucuguugucuuccucauuauuucuuguucugugaucaguuucaauagcuuucuuuggcucuguuuuuauuuuuuguugguuucugaggcccagacacugggugugcuaggaaagugcuuucucuaucaccgagagagagaucuugaucaccagucacagguuuauguugaaaauaauaaaauucucguuugucuuucuuucugucuuaaauacuuuucuccuaacuuaacacauucuucucaaaagaucuuggauuuagugguagggaaauaaaacaaagccuuagaauuuauuauuccuaauucacauggucuuucauaaucaguacuuuuuaauguauguguucuagaaaaaccuuagguguaauugucaggaacaccauauacuuucuuugagacaaggucucucuuuguccugcagcucccuaauugcuggacuggcuagccucugagcccugggaauccucuugugucugccucccuaggcugggauugcaggcauaggccaccgugcccagcuuucuuccaugauuuccaggacauugggccuggaugcuuaugcucucuaggcaaggcucccacugagcccuccccacagcccugucuuuacaguucuuaguguagauuuuaccuucaugugauaagacguguucucagggagaauuguuucaguagauauucuuugaagguacccagucuucacacauauggacagacacguacaaccacacacacauacacacacacucacaauugauaaauaaaaguauguauggagagaugauugguuuggauguuuuguucugauugugcugagaucaaauccaggaccuugcucaugcuaggcaagcauucugucacuaagcaacaaccugugacccccaucuccuggagaccagguaggccuuguagguaugagcuucuugccucaguuucugaaugccuaguauuauaagcuguauguauaaguauacacagccaagauugauuuccaggaggugaucccuggcagugcucgcugugauguuagacacugagaucuuugaucugauacaguccuuacuggaucaaguaguaauuuuagaccugacugagacuguucuuuuccugcaggagaagaguuagaauaugaauuugaugagcaaggacacagcacuuggcucugcagggugagguauguucuucucguuuguauucuagcugugauuugagaccgggucuuguuuuguggcagucuucccucuuuugccuacugaguacuggguucaugugcucuuuccuugcuaauguguauguuugaaaguagccaguuucaaguuaacauaugguugcagagaauagcccaagaguaacuucacucugcacuuuaggcuaguuccaagugugggccuugguagcuuaauagcacugggagcuggggugaaaugaaugaaagcggguguaaaugacuugaaguccaacugaggcaagaaagagugaaguuaccugaaagcaugaaaugcagucaucauggacacucuugauagcuguuuucaugagagucagagcauccugcugagcuccacccccuguaaaccaaugcagguuaccuguagaugauucaacugggaaacagcugguggcugaggccauucacucaggaaagaaaaaggaagcaaugguacagugcucgcuggaagccugccggguccuugauacacugggcuugcuacggcaggaagcaggucaguauuaaaaacccuuuucuuuuacaaaacaaagaagggaaauguacugcaaaagcugcauaaucucucuacguggauaguguguaaacuguacagaacuuccugaagcagagacaagcauucccucucaacauccuaagacaguuaguuauauugucuuagacauuuucuguauguaggugaguguacauuuaaaacuaaacccuaaaacuggggcugguggugcacaccuuuaaucccagcacuuaggaggcagagucaagcagaucucucugaguuccagagaucugccucagaaacccugucucaaaaacagaaacaaaaaaccaaaaccccuggcuccugagccagacaugguggugcacaucuguaguugacaaaccagauacaggguaguugcgauucaaagucauccuggcucauguauucaaguucaaauuucuugguuuauuucuauguuuaguggucuuuuucuuaucauuaucuuuuuauugacugauuucuuuuuguuuuucugagacaggguuucucuguguagcccugucuguucuggaacuugcucuguaacccaggcuggccuuugccugugaagugcugggauuaaaggcauacaaccaacaugcccagcuuuguuuuuacuguuaauuguuguaaaauauauggugcauaaaacaugcugcaauuuaguaauaugagguauauuuauguaaucaucacuacccggcucagaacuuuucguuauuccuggcgcaauuguagcccaugaacauuaauuccauucuccuuccuaccaucccauaugucugauguucuguuucugucucuaauuucacuucuuuauaaagcguguggagaucagaggcugguguuagguaucuucuucagucccuccuuacccuuuauuuugagguagaaucaauaaugaaccccaagaccuaggauuguuugucugaccagcuugcucuugaucaauguuuucugugucggggauuacagguaggcucccugcccagugugcauuggguacugaggcucugaaccuggcccucgcacuugugagacaaguacuuuguguauuaagcugucugucuucucagcacaggcaccuuguacauguaacuuauuucccucuccucuccuccucuucuuccuccuccuccuccucuucuuccuccuccuccuccuccuuuuuuaggcagaguuuguaucccaggcuggccucaauccuguuauauagccaagaacuuccaaccuuccucuaccuuuaccucccagugcuagauuacagauuuguucccuugcaccuuguuaggugcugcugaggaccaagccaggggccugcauacacacugcuaacugagcuacauaccagccuccaauuuucccgcccuuuuucuuucucaaucucuaaauuaaacaaacaaacaaacccuuuguuaugaacuguuuuauuuuuaguaucucggaaaaggaaagccaagaacugggaagaugaggauuuuuaugauagugacgaugauacauuccucgaucggacuggccugguagagaagaagcgccugaaccggaugaagaaggcugggaagcuugaugagaagccagaaacuuuugagucacuggcaaguuguucauagaagcagcuacuuuuaugucauuauagcuuuuacaaacagcaacauagaaaucuaauacugacuuacaacuuuuguggucuaaauucagugguaagaaaaugacuaguuuuauuccaguuaguggagaaaagcguuugcucgcugccacucacuuuccccagguucgcauugaucaggcaaugagcagucuuugaauaugguguuacuccccagauucucccccaccccgaaaaaagaaaagaaaaagcuccaaguuuggguguucacaaugagacugauguuaggccccgacauuuaagagaagucggaagaaugguauuaccuuagucuggaguggcacaaccauucaggagcuugcccuaaggugacaugcauuuaauauaauauuuagcaauuuccuagcuuaaaacauucaacgucuaccaguaacuuuucagucacucauucuauuugaguuuuuuaauucuaaaauuaguuccacuagaauaaaguaaacaaaugaaauaucaucuccaucaggagccaacuuagauggacuccugaaucagucaucuuaauaaaaccuauaauaguauugacagugggaaggugauggggaggaaaacaucugcugacccugucgauuuggguguuauagguugcaaaguuaaaugaugccgaaagggaacucgccgaaauuucugaaaggcucaaggcuucaagcaaaggugagacugucagucaauaguuaccgaguaccugucauauaaguauguacugcaucaaaaaaaaaaaaaaaaaaaaaaaagaagaagaagaagaagaaggggggacuggagagauggcucagggguuaagagcacugacugaucuuccagaggcugugaguucaauuccuagcaaccacaugguggcucacaaccaacuguaaugggaucucugaugcccucuucuggugugucagcaacagugugcucacauacuuuaaauaaauaaauaaauaaauaaauaaauaaauaaauaaauaaaucauacuuuaaauaaauaaacaaacaaacaaacaaacaaagugcugcaucguguuaggcauugggauacacuggaacauucaggcuuuggagguacuuucaaggagcaauauagcuuuuuaauuuuacacguguuuuuaugaguguuuugccuucauauaugucuguguaccaaugcaugugugguacucaugaaggccagaagagggcucuggguccccuggaacuggaguuacagaauauugugagcugccauaugaaugcuggaaacugaacugagauccucugcaagagcaacaagugcugagccacuucucccacaauguaacauuguagagcuagaaaaauauucuuuuaaauguuugguuuaauuucuuuuauuuaauaguugaugugagggcuggagagauggcucagugguuaagaccacugacugcucuuccagauguccugaguucaauuccuagcaaccaucuguaaugagaucugauguccucuucuggugugucuaaaagcagcuacacuguacucacauauaaucaaugaaucaaucaaucaaucaaucuuugggccagagcaagugggccuggcgcaagaaggaagaaaaaaaaaaaaaagaguucaaagucacccuuggcuucaugguguguucaggucugccuggaguaucaagugauacuguucaaacaaccucaguaaaucucugcccuuugcagcaccuuuaaaaaagaaauagcugacgggaaugaagccuaaaucacuucccaaggucucacacagcuauagcuuuuugguuuuuuccugguaucaguggcgauggcugcucagcuuugcauuugugagcccuuuguuggacugaaguuaaaagucuuugggcugccuguguaacaugucuccuucccuuggacaguucugucagagccaucaucucaggacucuuuagaugcauucaugucagaaaugaaaucaggcagcacauuagauggggugucccggaagaaacuucaccugaggacuuuugaacuaagaaaagaacaacagcgacuuaaaggguuaauaaaacuuguaaagccggcagagaucccagaacuaaaaaaguaaguauaaguaguucuaguugaaaaacuuggagacaguaucucauguagcuagccuggccuugaacagggugcuguagcccagcgugaccuugaacuuguguucuucuuucuacuuuaccuguuguguagcugugguuugcaugugcugaggucaggggucagcuuuuguuguugguuuuuucuuuccaucauuuggguucugagauuggacucagacuugggguuggucuuuacccacugagccaucuuuccagccuaauguugaacuuuuaaagaaaaguuuagucaaauuuuuauucuuugaguauuucauauaauguauuuugaucauauucagccccucuccuccccucaacuaaauguuuacccagagggcuauguguauaauuuaaaaaaaaaauugcauccugcuucuacuucccauauauagaugugccaccacauccagucuuacuuaucuuuacagaauuauuaaauuacagaauuauuaaauuauugauuuguuuuguuuuguuuuuugagacagaguuucucuguguagcccuggcuguccuggaacucacucuguagaccaggcuggccucgaacucagaaauccaccugccucugccuccccagugcugggauuaaaggugugcgccaccacugcccggauguguuuuguuuuuaguacuaagggucaaacacagucuucacacauaguaaguacaugcuguuaccuaugagccaugcuccuggugcagacaaccuuuaagaacaaaaggauagugcuggagagauggcuuaguuguuaagaguacuggcugcucauccagagucaagaguucaaaucccagcacccacaugguagcucacaacuaucuguaauaggaucugaugccuucuucugggugucugaagacagagacaguguauucauacauuaaaaaaaaaaagauaaaggacuauuuaugaacuauagcuuacuagaggauuuuccauggauauuauauggauucuuaauuaauuggaaugauauaaaggguuuuuuuaaaaaagcauuuaaaaauaauuuuuauuuuuugacaguuucauaaauauaucuacauguaauauauuuuuauugauuuuuuuguuaucuuugaucuuuuuuacagucuagucauuauucccuuccuguucugcccuccaacaguuccucaucccauuccuccuccccugucuccaagagguuguccccacacacccugccaggccuccccauucccugggaccucaaguuucucaagggcuagguacuuccucucucguugaggccagaccaggcaguccucugcuguauaucuuucugcagagcaaacuuccuuuaaaaggaacgugcacaaaggagucauaccuccaauauauaaaaacuuaugcaagauaauagguaaucagccacaaaaaaugaaauaugcgcacaaagaccugggcauguuagugcaugccuguaaccccaguauuugggagguagaggcaggauaagccauccucugcuacguagcaaguugaaaacaaguuugggcuacacuuggcaaugugugugcgugcgugugugcaugcaugcgugugugcgcuuaggcagagacaggugggugaaucucugaguuucaggcuagccaaggauacauagugacacccugucucagaaaaagcaaaaaacaacaccacacacaaccaaaacaaaaaagaaaaggaaggaaaaaaaugaacauuuggagcuugggauauauaguucaaucauagagugcuuguaggcucuguguucaauucccaauacugcaagaaaaggaagaaggaaaagaaauguagguuuauuuauuuagguuuuguuuuugagacaaggugucacuaaguagccuuggcuggacuggaacucacuauauagaccaggcuagcuucagacucagagaucuaucugccucuguggccugagugcugagauuaagguaugugcaaccauaucugaccuaguuuucuagacucuugacuuuacauacuuagaaaauuauuaauauauaauauuguuuacaauaacaaaauaugauccaccacguaaaugcuuaucaagaacaaaauaaaauauuauauaauagaacaccauguagcuauuaagauaaggaagcaaguauuuuugaaaauugugggauuguuaucaaaauauaauaaauuacaaaagcuauauuaacuauaguacaguguaauauuugcauagaggaagaaugugcagguacuucuguauguauaugcauauauguauguauguguauauauauguauguauauguguauacauauauacauaaauugaccccuaaugucuguuuagucaaguuccuuacaaauacacuuugagguggggauuugucuacaagugacucacucuagagaaaucuguauugaaauaaagaacagggaacaagaugggcaaaguugugcuuucaagaauuauaguggcaccacagauguccuaaaggccaggggcuuggacuuuacccucccccacaccaacauugaccacaggcuuugggaacauaagcaguucugagaaaggcguagacauggaccuuggugcacagcaucuucaguagcugauuaaagagaauaagcgaggguuccaaauggcaucuacuuuucugucucuggaaauauuuauaaaagcugacugagugaauugucucuggggaaaggaacuggaugacuggaggacaaccguuagagagaaacuugagaguguauaaauucuuuauacuuucuaagucaaugugugaguaaacuugcaccaacgagagacucuugcaccaaguagccauaguguuuuagguguaaaauuaugguugugauaacaguuuuagcuuugacaguuucaauuuuuuaauaagcaacuugaaaaccacauuaacaguugcauugcagucuggacaugguggugcacaccuguaauccucgcaugagggaaacugcccaggugguucucaaguuugaggccaccugcacuagaauaguaaguuccaagcuagccuggacuacagagcgagagcaugucugaugacguggcagaaugcgugguggcucaugacugcguuuccagcguuugggcgcuugggaagcuguacuauacaguaugacacccuaugauauuaaacaguaugcacuauuaaaguuucuucacauaaaguuuuacaaauucaguucuucaaaauacuaaccacauuucaagugcuuagugcccaaauguggcugauauuuaaucaaaugggcaaugcaauauaaacauuacaaguuuuccauuauggcauaaagcuccauuguacagagcuacuuuagguugucagugaguguuugaagccucuaacugcuauguaagcaucuagauggguuaugugcuggauggugguggcgcacaccuuauggguuaugugcuggauggugguggcacacaccuuuaaucucagcaccggagcgcagagacaggugaauauugaguuugaggcuagccuggucuacagcaagaguuccaggacagccagggcuacacagaaaaagucugucccaaaaaacaaacaaacacaaagaugggcuauacuuuucuuuuccuucuccagugacuguugucacuguagucaccaucugacagaugcaaaguccugggccauguugggaauuacaggcucagggggcugugucgccuccucaguaggcuugcuguccucugguuuaugucugcauacucaucuuguggucaugucuguuucuccggaguguccucgucaguuucuugguauuuuuaacacuguucuguauuauguguauguugcagguugaggcguaguacagugugugggggucagaggucaacuuugcagagucacuucucuccuuccaccuuucugugggcucacaggguuugaacaggugcucagaccugacugccaagugcuuuuaccuggugagccaucucgccagcccaguuucauggcacguaaggcaagaccuaaaacuuaacuagaacagauauuuauaauuguuccucuuccuaggacugaacuucagacuacaaaugcagaaaacaaaacuaagaaacuugcauugccucucuuuggugccaugaaaggaggaagcaaauucaaauuaaaaacugggacaguagggguaaguugugaguuagaguguguugaacuccucguccuugagcuaucccugaacuagguuuucugucuuauucccugguuuugugagaaagggcuguuggauuagcaugagcaucucuugcugagauuagugaacuggacugcaaagauggcucaggugucgcucccaaguaugaaguccagaguucggggcccaguaccccguguaaagugaagcauggcccugugcagugugaccccagcacggagggcugcaaaggcaggguugcuggggcuugcugacugacagccucgcugggcugcagggucaguaagcagggagguggagagugauggaggaggacagcugacgccuccccuggccucgugugcacacagacacaggcgacuuggaaagaacucggauauuuuuuuuuuaauuaguuuauuaguuuaguuucuuuucuuuuuuuucuuucuuucucccccuaccccuuuucuuucagcagucucacuguguagcccuggcaguccugagcuaguuuaauguuucuaaugugugccauauuuaggaaugaagugccuauggugauauuuuuccccaugauuuacuuugcuuacugcuggaauauuguuuuuucuccuuauuuaaaaauaguaguucccugagaauucuguacauugugcuuugaugauauucacuccccucuccaacuucucccaggucugcgccccuguccuauccaccuaacucuguaaccuccuuuucuccuuuugucuccuccuccucuuccuccuccucuuccucuuccuccuccucuuuuccucuuccuccuccuuguuuuuguuuuguuuuguuuuuaaagguuuguuuguuuguuuugugugcguacauagcugucuuuggacacaccagaagagggcaucagauccuauuacagaugguugugagcuaccaugugguugcugagaauugaacucagaaccucuggaagagcagucggugcucuuaaccacugagccaucaucucuccagccccuguuuguuuuauuuuuaagauaggguuccuuuguauagcccaggcuguggaccaggcuggccucaaacucauagaaaucugccuaccucugccucccagugcugggauuaaaggugugugccgccaccacccagcaccucuuucuuuuuaagccacugaaccuaauuuaugcuguccauauauucuuggauguguguccuucugcuggggcauaguuggcugaauagaggguguacuuuuagagaaaacucucucucccacuccuagagcccaucauuugccaauagcuccucaguuaggcauagaauuuuguaccuuccucccauuucccuagcugaggcuguagcccagucuuacugacacguguucucccuugagguucccuccucuccagugacaauagcuuauuucaaguugauuaaaauuaccaacauaaugacauaagucuaaacgauucagcuugcaaugccuugcagguuuauuuucuaacaguucuagauaguugagguucaagaccaagaugcuggcauaguugguaucuugugucuuacagauggcugcccuuuaauacaguugccucucccuuuuauaaugucagguuuaccaucuuagggcccagggcuucucagccauuugacuaaggauggcucauuguaacuuaaucacuuaucucaaaugagaugacauuccaagagaucuuaggaguugggaccucacacauggauuuauaggggguguauguaaaucaguuuauaaaaagcagcuauaguguugcauaucuaucauuaacauacuggggagagagacaggaacucaaguucugggccagccugagcuauagagcuaaacaacaaaacaacugagauggaaagaccuugaauugugauggacuguugucugauaccagaggccugaagucccagucacacaugugacagacguaaaguuauggaaaggaaaguauccagguuuaaauagaagagaaauguuuguuuugguggugguguuguuauuuguuguuguuuuuagagauuuuauuuauuuguuuauauauaugaugaguacacuguagcugucuucagacacaccagaggagggcaucagaucccauuacagaugguugugagccaacaugugguugcuaggaauugaacucaggaccucuggaaaaguagucagugcuuuuaaccacugagccaucucuccagccugaaaaaugguuucuuaaaaggcuuuuuaaugcugggcaguggugguagauguccuuaaucccaguacucaggaggcaaaagcagguagauuucugaguuugaggccagccuagucuacagacugaguuccaggacagcaagggcuacacagagaaacccugucuucuuuuggacugcaagcauacaugcaggcaaaaugcuauauacauaauaaauaaauauuuuuuaaaaggcuuuuaaaaagauuacuuaacuuaauuuuauauuuuaaaaaaauguuaagggacuagcuagaggcccagaacuauaaucucuacuugggaggcagaggcaggaggaucauuccaaacucgaagucauccuggucuacauagugaguuucaggccagccagcacuauguaguaagaccuugucucagaauaucuagagggucaggggagggcaguaagaaugauuuuuuucuugaaaacauauauuugauuuacuucccugaagacuuuguaauacaucaaaauucuuugacgugauaugacaggauuggauccugcugcugucauucaccugcaguagaauucuguuucccuacagggugcuucagguaucuuauauuuaacaauccuaggauccugugugcagcacugaagguggagccugacuuugcaucugcaagcacgccgcugaucuguauacgggguguuguguucaucaucuuuguuguuuugguuuuugcuguugcagauccaguuucgguucuuauauauguucucugguaaucuguggccccagaaauugcugaaaacauuugauaagauguauagaugaacaaaauuuccuuuggaggucacacuucuagcagauuucuguggggcuuauuauccuggagauuugucccuuuuuaccuucacgcagaaauuccuguuugugguuuuauuucccauguagaaguugccacccaagcguccagaacucccuccagcuuuaaugcaaaugaaggaugaaccugaaguagaggaggaggaggaagaggaagaggaggaggaggagaaagugaaggaggagcaugaagaacgaguggaggauggaggugucaggcuucuucaggagccugagcuggagcuggaagcagcaguggagcacccgagugcucccucagagcccucgugcuccaaggagacuaaaagccaugguagugucuuuauuuccccugugcuggcuagucgggcaguuguguucauuuugguagaguaaaaaaugcaaaaccacgcugggcagugguggcacacaccuuuaaucccagcacuugggaggcagaggcagguggauuucugaguucgaggccagccuggucuacagagagaguuccaggacagccagggcuauacagagaaacccugucuuggaaaacaaacaaaaaaugcaaaaccaguuguguuuguuguuacagaggaucagaggauauguacaugugaaaauagcagguuuuucucuuuuuagcaagccuuacauccaauuaggcaacaguugguuauugccaacagagaagcuacuguaguaccauucgguguaucuugucauguuggucuguguuuuguuaaugcuuguuguggcuaauuaggacugucaacugcuucccucccuugucaguuuguguaguacucucugguguuguggaagguaggcuacaggaacaaggcuugcagaaggucuagcuucauccauccagucuccuguccuaaggaugcagugucuuuagcaauagggacuuaccuucaaccuuugggcgucagugaggggcaaauggcaacagcuuuauuguuuguggaguuacuuggacuacccugaccguuguucucuuggguaagaguuucuaucuagugucuaggguggaauuuuuauuagguaguggauggucuucugagaauugaugucagcacaaaugaaauacuuaaauauuuaaaaacacagguuuuaaaacuugguuuaaaaccuuaaagcuuggggacugaagagauggcuuaggggucaauagcacuaacugcucuuccagaggucccagguucaauucccggcacccacauggcagcucacaacugucuguaacuccaguuccaggggaucggacauccucagacacaugcaggcaaaacaccaaugcaaauaaaauuaaaacaacaaacaaacaaaaaacccaaaacaacaacaacaaaaucuuaaagguuaaauaauuaguaaauccauaguugugaaggauuauuguaggcuuuugguccucugucuuuuuacuuauuuuuuaacauagaauuauaaauuauguaaaugaauucugaaucuauucagaaucuagagccugcuuuuccuauguccucgaaguauuacuuuuuaaucuuuaaaaauacauuuauuaccuauguacuuaugauucugugacuacuguggcacacacguggagguuggggacagagagagcuggaucucugcuuccaccauuguggacucaggccauccucaggcuugcuggcaagugccgccuuuaccugcugaaccuucuuacuggcuuugugaaccagauaagggauaauaaaaauauuauuuuuauaauaugauuuuccuuuauuaagggucauagugguucaacacacacacacauaugucaugauuuuuuucuuuuaacuuuuuaaacauuaauuuuuaaauuuaauugaaaacuauuaaauuuccuuuauugcgugugguggugaggcacguguguucuguuugcacugggaggugagagguuggcucucaggggucauggcuucugccauguggcuucuggcaauccacucagguagucugucagcuuuggcagcaagugucguuacuugcuaagccaucucauuggcccuauuaacuuuuguuauuguaaaaauuaaauaauaaaucuugauacuuauuucugguaucuuuuaaauauauaucccuuguaguuaaauuuguaaguuaggugguagauacauacguuuuuaaagacuuuuuguuguaagaauaaccauuaaguuuuucuugaagguuuuuuuuuaacuuuuuucuuaaagauuuauuuauuuauuuaauguuuaugaguacaauguagcuaucuucagacacaccagaagagggcaucagaucccauuacagaugguugugagccaccgagugguugcugggaauugaacucaggaccucuggaagagcaucuagugcucuuaaccacucuccaucucuccagcccuaccugaaaguuuuuaaaaguggaacugcagugguucugcuaggcuuccggagaccccuuuacugaagacuuaaggugaauggaaucugcuguagucuaacugaaugacauagaaguguguaacugcucuucuugucuuugcuuuuuuggacucuaccaugaaugaauuaauaacaauaugcccuggcacugcuuuuuauagaaaguauaucucaacucagccaaguggagcagaguaaagauuaucaagagaugggcaaaauagugucgucaugugaggacccuucagguaagcaggauagcugcuucuucacacagugcugccuggcuuuauaagggggagguggcagccgcugccaugggaggcagaacagaaaauggcaggcauacagaugcuagggcuguacagagguuucuguucaguaccaucuuaccugccuauuacucuacuccuaguccauuuccuggcuucccaucugucucacagagcacucagugccucucaccucucugaccagauggaagaagccucuccagcacuccaucucggcccaccguggccugccguggaaaggcugcuuuucucaggcuuugccuguuacaguuaaacuguagaauagguaaagcagccccaucacauucuaguuuauagccuagcuuuccuauuuaaagacuaacagugaaagguaauuucuuuuuuuuuccccacauuuuuuuauuagguauuuucuuuauuuacguuucagaugcuaucccaaaaguccccuauacccucccuccgccacucacucccacuucuugaucccuggcguuccccuguacugggacacauuaaguuugcuagaccaaggggccucucuucccaaugauggccgacuaggccaucuucugcuaugaguauguuugugaaugaaauaaagaucuguuuuauuuuuuaaauuauguggauaugugugugugugugugugugucugucugucugucugucugucugucugucuggggauagauguacaugagugcugcuguucucaaggccagaaguacuucaguuacaaaugcuugugagccauuugaugugugugcuaagaauuaaacucaagucuaucuaagauuaguguaugcuuuuaacugcugagacauuuccccagccccuauauauuuuuuaaauuuauguauaugugugucugugauuauaugcuacauguaugcaggugccuacagaguccagagguggcaucagauucgcuuggagcuagauuacaggugguuguuaguugcuugacaugugcugggaaccaaacucugguccucuggaaaagcagcauguacucuuuuaacuauuucuucuucuucuucuucuucuucuucuucuucuucuucuucuucuucuucuucuucuucuucuucuucuucuucuucuuccuccuuccucuuccuccuuccuccuuccuccuuccuccuuccuccuuccuccuuccuuccuuccuuccuuccucccuuccucccuuccuccuuccuccuuccucccuuccuccuuccuuccuuccuuccuuccucccuuccuccuuccucccuccuccuuccuccccuccuccuuccucccuccuccuuccuuccuuccuccuuccucccuucuccuuccucccuccuccuuccucccuccuccuuucuccuccuuucuccuuucuccuccuuucuccuuucuccuccuuucucccuucuccuccuuucucccuucuccuccuuucuuccuucuccuccuuucucccuucuucuccuucuccccuccuuccucccuccuccuuccucccuccuccuuccucccuccuccuuucuccuccuuucuccuuucuccuccuuucuccuuucuccuuucuccuccuuucucccuucuccuccuuucucccuucuucuccuucuccuucucuuccucuucuuccuccuccuucuccuccuccuucuuccuccucccccucaucuucuuccuccucuuuuucuucuucuccuuccccuuucucuuuuccucauccccuccuuccucuucaucuuuuuuaaaaagauuuauuuauuucauuuuuaugaguacacugucacugucuucagacacaccagaggaagacaucagaucccauuacagaugguugugagccaccaugugguugcugggaauugaacuuauaaucucuggaagaguagcuagugaucuuaaucacugagccaucucuccagccccaacuauuucuucuuaauauacauuuuuuuaacaaauauuuaguuuauuuuugguucugugugugugcguauaugcauguuaguaugugcacaugaauacuagugccugugguauccagagguguuggauucucuggagcuggaguuacagggaguugugagcucugccagugggaguuggcugcaaaugugcuuaaccacugagccagcucuccaaaccuuuauauacgucuuaagguuauagacaagccaguuacugaggugucuauggcuucacuuacggcaccaucucaggguuucauucuauaauauguuuacuccugauaacagcuguguauacuauaauauacuauaauauguuuacuccugauaacagcuguguauacuuuaccuuaaagcagcaccagcgaaugaauauaaacaagacagagaugagccgaagaaaaagaaaucuccugggccuggcaaaguaaguacuucaguuuucaaaaacaaacuuccuguggugguucuuugacucuugagacugccuuagaguuuucagcagcauuagcuccuugcagaaaucuggacucuucuuuauuuucguuuuuuaauucuucgucuacccugcucauguacccuacaggcuaccucuuauuaauugauuaauuguuuuuuccuauccuguaugggaugcaaagaaaucugaggaacauggucuuaucuccuuccuuuugugacacaaaaguauuauugauguucuccacugugaucauaauguuuacccuauuguaaaaaucauauuaaaauaucaagagcuuccugcuucaccagcuccucagaaggggacaaguagguuguucugucccaucuuggguucauuguggagugacuaacucacaagaggagucgcagagcucggugugcaguugugcuggcagcugugguuccuugcagcagagggauagcagggacagucagcaacuggagaaagcaccuggagcaaaauguaugcaaccgugugcaaggcucagaguccuaauccacuagagacacagauguacuuaguuuccuuagcagcuagcuguggcaaguguaacuaaguggagaaacucauuuacggacucagaaccaagauucuauugagggugcauguaaggcauucccugcucaacauguguccucuuuccaugcuggcaagaggaaagugaguacauugagugacuguggaggcagagugagccauccuugccugucaggacuugguccagccaaaggccagccuggucaacagccuggucaacagccucacaaaggccagcaaagacagaugccagcuuucucuuaccacuccuuuaauuucucuuucaggggugugugugugugugugugugugugugugugugcgugcuuuuuuguuauuguuuuuguuguuuuugaggcagggacuuuccuuguagugcaggagugccucauaccccuugugucucagcuggccagauguuaacacuacuauauagggucuuguauaacuggccucagggacagcuuaguuggugaggugcuuguggggcaggcgggaggacccggguggguuuggauucucagcacaugucuucaguuccaguacugaggaggcaggcaggccaaacagccaaauaagugaacuccagguucagcgcagaaucaucugucaaaaaaggaugcuagguggcuuagugcagacucuuacuugcugacaagacucacaacuugaguuugauccuggacucauuuggugaaaggagagaacugauucuggcuaguugaucucugaccuccacauaaugccccagggugugcacacucaaaagcacaaauaaauauaauuuuaaaaguuaaaaaaaaaaagccagguguggugauguacaccuuuaaucccagcacucaggaggcagaggcagguggaucucugugaguuucaggacagccucaucuacagagcaaguuucaggacagccucaucuacagagcaaguuccaggauagccuggacuacagagaggagcucuggaaaaaacaaaaauuaagcaagcaaguaaauaaauaaaugaauaacuagugggacauguacggugcacacaccucuaauccuagaaccugggaggcagaggcaaauggaucucugugacuuugaggccagccugguguguguaauguauuccuggccaauuggggcuucauagagacuuugucucaaaauaaaacguggagagcaauugaggaagacacucgacacugaccucuggcuuuguaggaaucagagucagucauagaaacuguucucuuaguuuuguuuacugagagggagaaaaacaguaauucuuacagcuaaaagucuuuagaaucaaacaugaugggacaaacuugcaauccuagguaggaugaucacaaguccccaagguaccuugagcuacuuagugacacucugacugaacaaacaacucuugugaguaaaauaguauauuuuuucuuugcaguuuccacccauccuuucuuccaaauauccugaggaugacccagacuacuguauaugggucccaccugaagguauaguguuuauuuuuccuuccuuuaagaaguguguguguguguguguguguguaugugcauguacauacaacauguauuucuguugcccauggaagacagaagaggguguuagauuuccuggaucuggacuuaugggugauugcaagcugccaugugggugcuggguacugaacucaaguccucugcaaaagcagcaaguacucuuuuuuuuuuuuuuuuuuuuuucuuuuccgagacaggguuucucuguguaccccuggcuguccuggaacucacucuguagaccaggcuggccucgaacucagaaauccaccugccucugccucccgagugcugggauaaaaggcgugcgccaccaccgccuggcucagcaagugcucuuaaccuuugagccaucucuuucuccuauuuauauuaaguagguuauauauuuaagaaagcuuacaaaguguauauaguaagucucccauugauggaauuaaaggauguaaagagacauaucaagugaguagaauuggugcauccuguguagagccucacuuacacaacuuuuaaaagauuauaauggccuaguguaugguagagugcuugccuugcauucacagagccuuggguucaaucccuaguacugcauacaccaaguauggugguguaggccugugaucccagcauucagcaguagaaauaggaugaucagaaguucaaggucauuuuuuacuacauagcaaguuugaggcuagccugggcuacacuuagacccugcuucaaaaauacauaaauaaauauguaaaaauaauuuuuuuaaaguaaugagacagucacacacauuugaacacacauuuuaguuaggguuuuacugcuguaaagacgcugugaccaaggcaacucuuuuaagaacauuuaauuggagcuggcuuacagguucagagguucaguccauaaucaucaaggcgggagcauggcagugucuaggcaggcauggugcaggagcaacugagaguucuauaucuucaucugaaggcugcuagcagaauacuggauuccaggcagcuaggaugagggucuuaaagcuuaaacccacagugacacaccuauuccaacagggccacacuuucuaauagugccacucccugguccaaguauauacaaaccaucauagacaccaacugaauauugacgauagaaauuauuguuaacucuuuagaggucugaaugguguugaauuaugguuuuuggaaaauguccuuauauucuagacauguucacagauguaaugacaucugagauuuaccuuuaaaugcucuggugguugagaauaagagcacucggauacggauuggagauggagaggacuggccacauuuuauucaccacuaaagcugggggaggaaagcacgcacucuuuauguuucuguuuauuuuugcaagaauuuuacauuuuauuaacuaaaagaaaaaaguagauucugauucaucaaaucauuuuuuaucuagagauaacggaauauuaucaguuucuuauuauuaacucuuaaugcauuauacaaaaugccuauauaaaagauguuuuaguaccuuuucuauacaaauggagguuucuuuucuauucauuauuuguucuuagaacaacuguuuauuuuugcucauuuacuugacaucauaguuguguguguguguguguguguguauguguacauacucgcagacacaugccauggaaugcauuuggaacucagggcaauguguaacaguugauucuguauuuucacuguauagguuuggagauuuguuggacuugacagcaagugaauuuaccuacuaagccaccucgcugguuccuuguucuguuuuuuugguuguuuuuaauuuuuauuaauuauuguuguauauaugauaugcaagugugauagagauggggaacuguguguucuguggugaucauuuggagauugaggcaggaggauuaugaauccaaagccagccuggucagacagguguaugguucuuuuuuauggcagacuuuuauuaaaauaguuaccucauuggauauuugcuauguugcuacucauuacaaacaacucuauaauaaguaaucauacuagaugaauuaagucaguuucagaaagaaaaauauuacauguuuucucuagguauaaaauuguauguguauacauggcaugaagcuguucagaggagcaaaggggcuaagggcaggggaucgaggaaggguaguagaguaugggggguauacucaaagcacauuacucccaugaaaaguccugucuaugaaauaaaucaacuaugaagaaaauugauaaaugcuaaaauugaaaaggauaaagauuauuggacaaacaaguaaacagaauacaccagguacagagacacaucugugggagugcugacaauaacauccugggucaaaggccugcccagaauggcacgcuaaggauaugcuagugcgcacagcguguaagagaugaugugcuagugcauacagcguguaagagaugaugugcuagugcauacagcguguaagagauaauugccucuccacaggcugaucacacguugcuuuucuuggugggugguguuucuaagacacuaguaacuauuacaacuuuagguccuagaaauauuugcuuucuaucuacuaauaaauguuaaguagaaagaaacaauauugugagauuaugcccaaaaaguaaauuuucagaacaaaguauuguggcacuugcccuuaauccagcuuuugggaagcagaggcaggcaaggcgacagaaaaauucugucuugaaaauccaaaaauuaaaaaaaaaaauguagguaaauauucugcuauaacggagacugccuuacuugcuuugcuuucgaccuacugauaucugaauuuuuuuuucuugacuuuggaaaaguaaacacuuuucuuuucuugucuuuucuuuugauguaggucaaaguggagauggcagaacccaucuuaaugacaaguauggcuacugauuggcucagagucccaaaggaagaccauguggaccgcaggauguuugggaggaaacaucaagucauggccaggaaucagaugaccguuuguaaaaucuggugacuggcucuuucuucuguaucccugguuuccuauaacucccugcccauuggauucuccucaauuuccguguuuauauuuaaguguuuguguauauauguaaaaaaagagccauguacacuagaaucaguaaagaggcaugacccauua

SEQ ID NO: 12094 - RNA, 27045 nt, Mus musculus
uaaugggucaugccucuuuacugauucuaguguacauggcucuuuuuuuacauauauacacaaacacuuaaauauaaacacggaaauugaggagaauccaaugggcagggaguuauaggaaaccagggauacagaagaaagagccagucaccagauuuuacaaacggucaucugauuccuggccaugacuugauguuuccucccaaacauccugcgguccacauggucuuccuuugggacucugagccaaucaguagccauacuugucauuaagauggguucugccaucuccacuuugaccuacaucaaaagaaaagacaagaaaagaaaaguguuuacuuuuccaaagucaagaaaaaaaaauucagauaucaguaggucgaaagcaaagcaaguaaggcagucuccguuauagcagaauauuuaccuacauuuuuuuuuuuaauuuuuggauuuucaagacagaauuuuucugucgccuugccugccucugcuucccaaaagcuggauuaagggcaagugccacaauacuuuguucugaaaauuuacuuuuugggcauaaucucacaauauuguuucuuucuacuuaacauuuauuaguagauagaaagcaaauauuucuaggaccuaaaguuguaauaguuacuagugucuuagaaacaccacccaccaagaaaagcaacgugugaucagccuguggagaggcaauuaucucuuacacgcuguaugcacuagcacaucaucucuuacacgcuguaugcacuagcacaucaucucuuacacgcugugcgcacuagcauauccuuagcgugccauucugggcaggccuuugacccaggauguuauugucagcacucccacagaugugucucuguaccugguguauucuguuuacuuguuuguccaauaaucuuuauccuuuucaauuuuagcauuuaucaauuuucuucauaguugauuuauuucauagacaggacuuuucaugggaguaaugugcuuugaguauaccccccauacucuacuacccuuccucgauccccugcccuuagccccuuugcuccucugaacagcuucaugccauguauacacauacaauuuuauaccuagagaaaacauguaauauuuuucuuucugaaacugacuuaauucaucuaguaugauuacuuauuauagaguuguuuguaaugaguagcaacauagcaaauauccaaugagguaacuauuuuaauaaaagucugccauaaaaaagaaccauacaccugucugaccaggcuggcuuuggauucauaauccuccugccucaaucuccaaaugaucaccacagaacacacaguuccccaucucuaucacacuugcauaucauauauacaacaauaauuaauaaaaauuaaaaacaaccaaaaaaacagaacaaggaaccagcgagguggcuuaguagguaaauucacuugcugucaaguccaacaaaucuccaaaccuauacagugaaaauacagaaucaacuguuacacauugcccugaguuccaaaugcauuccauggcaugugucugcgaguauguacacauacacacacacacacacacacacaacuaugaugucaaguaaaugagcaaaaauaaacaguuguucuaagaacaaauaaugaauagaaaagaaaccuccauuuguauagaaaagguacuaaaacaucuuuuauauaggcauuuuguauaaugcauuaagaguuaauaauaagaaacugauaauauuccguuaucucuagauaaaaaaugauuugaugaaucagaaucuacuuuuuucuuuuaguuaauaaaauguaaaauucuugcaaaaauaaacagaaacauaaagagugcgugcuuuccucccccagcuuuaguggugaauaaaauguggccaguccucuccaucuccaauccguauccgagugcucuuauucucaaccaccagagcauuuaaagguaaaucucagaugucauuacaucugugaacaugucuagaauauaaggacauuuuccaaaaaccauaauucaacaccauucagaccucuaaagaguuaacaauaauuucuaucgucaauauucaguuggugucuaugaugguuuguauauacuuggaccagggaguggcacuauuagaaaguguggcccuguuggaauaggugugucacuguggguuuaagcuuuaagacccucauccuagcugccuggaauccaguauucugcuagcagccuucagaugaagauauagaacucucaguugcuccugcaccaugccugccuagacacugccaugcucccgccuugaugauuauggacugaaccucugaaccuguaagccagcuccaauuaaauguucuuaaaagaguugccuuggucacagcgucuuuacagcaguaaaacccuaacuaaaauguguguucaaaugugugugacugucucauuacuuuaaaaaaauuauuuuuacauauuuauuuauguauuuuugaagcagggucuaaguguagcccaggcuagccucaaacuugcuauguaguaaaaaaugaccuugaacuucugaucauccuauuucuacugcugaaugcugggaucacaggccuacaccaccauacuugguguaugcaguacuagggauugaacccaaggcucugugaaugcaaggcaagcacucuaccauacacuaggccauuauaaucuuuuaaaaguuguguaagugaggcucuacacaggaugcaccaauucuacucacuugauaugucucuuuacauccuuuaauuccaucaaugggagacuuacuauauacacuuuguaagcuuucuuaaauauauaaccuacuuaauauaaauaggagaaagagauggcucaaagguuaagagcacuugcugagccaggcggugguggcgcacgccuuuuaucccagcacucgggaggcagaggcagguggauuucugaguucgaggccagccuggucuacagagugaguuccaggacagccagggguacacagagaaacccugucucggaaaagaaaaaaaaaaaaaaaaaaaaaagaguacuugcugcuuuugcagaggacuugaguucaguacccagcacccacauggcagcuugcaaucacccauaaguccagauccaggaaaucuaacacccucuucugucuuccaugggcaacagaaauacauguuguauguacaugcacauacacacacacacacacacacacacuucuuaaaggaaggaaaaauaaacacuauaccuucaggugggacccauauacaguagucugggucauccucaggauauuuggaagaaaggauggguggaaacugcaaagaaaaaauauacuauuuuacucacaagaguuguuuguucagucagagugucacuaaguagcucaagguaccuuggggacuugugaucauccuaccuaggauugcaaguuugucccaucauguuugauucuaaagacuuuuagcuguaagaauuacuguuuuucucccucucaguaaacaaaacuaagagaacaguuucuaugacugacucugauuccuacaaagccagaggucagugucgagugucuuccucaauugcucuccacguuuuauuuugagacaaagucucuaugaagccccaauuggccaggaauacauuacacacaccaggcuggccucaaagucacagagauccauuugccucugccucccagguucuaggauuagaggugugugcaccguacaugucccacuaguuauucauuuauuuauuuacuugcuugcuuaauuuuuguuuuuuccagagcuccucucuguaguccaggcuauccuggaacuugcucuguagaugaggcuguccugaaacuugcucuguagaugaggcuguccugaaacucacagagauccaccugccucugccuccugagugcugggauuaaagguguacaucaccacaccuggcuuuuuuuuuuuaacuuuuaaaauuauauuuauuugugcuuuugagugugcacacccuggggcauuauguggaggucagagaucaacuagccagaaucaguucucuccuuucaccaaaugaguccaggaucaaacucaaguugugagucuugucagcaaguaagagucugcacuaagccaccuagcauccuuuuuugacagaugauucugcgcugaaccuggaguucacuuauuuggcuguuuggccugccugccuccucaguacuggaacugaagacaugugcugagaauccaaacccacccggguccucccgccugccccacaagcaccucaccaacuaagcugucccugaggccaguuauacaagacccuauauaguaguguuaacaucuggccagcugagacacaagggguaugaggcacuccugcacuacaaggaaagucccugccucaaaaacaacaaaaacaauaacaaaaaagcacgcacacacacacacacacacacacacacacacaccccugaaagagaaauuaaaggagugguaagagaaagcuggcaucugucuuugcuggccuuugugaggcuguugaccaggcuguugaccaggcuggccuuuggcuggaccaaguccugacaggcaaggauggcucacucugccuccacagucacucaauguacucacuuuccucuugccagcauggaaagaggacacauguugagcagggaaugccuuacaugcacccucaauagaaucuugguucugaguccguaaaugaguuucuccacuuaguuacacuugccacagcuagcugcuaaggaaacuaaguacaucugugucucuaguggauuaggacucugagccuugcacacgguugcauacauuuugcuccaggugcuuucuccaguugcugacugucccugcuaucccucugcugcaaggaaccacagcugccagcacaacugcacaccgagcucugcgacuccucuugugaguuagucacuccacaaugaacccaagaugggacagaacaaccuacuuguccccuucugaggagcuggugaagcaggaagcucuugauauuuuaauaugauuuuuacaauaggguaaacauuaugaucacaguggagaacaucaauaauacuuuugugucacaaaaggaaggagauaagaccauguuccucagauuucuuugcaucccauacaggauaggaaaaaacaauuaaucaauuaauaagagguagccuguaggguacaugagcaggguagacgaagaauuaaaaaacgaaaauaaagaagaguccagauuucugcaaggagcuaaugcugcugaaaacucuaaggcagucucaagagucaaagaaccaccacaggaaguuuguuuuugaaaacugaaguacuuacuuugccaggcccaggagauuucuuuuucuucggcucaucucugucuuguuuauauucauucgcuggugcugcuuuaagguaaaguauacacagcuguuaucaggaguaaacauauuauaguauauuauaguauacacagcuguuaucaggaguaaacauauuauagaaugaaacccugagauggugccguaagugaagccauagacaccucaguaacuggcuugucuauaaccuuaagacguauauaaagguuuggagagcuggcucagugguuaagcacauuugcagccaacucccacuggcagagcucacaacucccuguaacuccagcuccagagaauccaacaccucuggauaccacaggcacuaguauucaugugcacauacuaacaugcauauacgcacacacacagaaccaaaaauaaacuaaauauuuguuaaaaaaauguauauuaagaagaaauaguuggggcuggagagauggcucagugauuaagaucacuagcuacucuuccagagauuauaaguucaauucccagcaaccacaugguggcucacaaccaucuguaaugggaucugaugucuuccucuggugugucugaagacagugacaguguacucauaaaaaugaaauaaauaaaucuuuuuaaaaaagaugaagaggaaggaggggaugaggaaaagagaaaggggaaggagaagaagaaaaagaggaggaagaagaugagggggaggaggaagaaggaggaggagaaggaggaggaagaagaggaagagaaggagaaggagaagaagggagaaaggaggagaagggagaaaggaggagaaaggagaaaggagaaaggaggagaaaggagaaaggaggagaaaggaggagggaggaaggaggagggaggaaggaggagggaggaaggaggggagaaggagaagaagggagaaaggaggagaaggaagaaaggaggagaagggagaaaggaggagaagggagaaaggaggagaaaggagaaaggaggagaaaggagaaaggaggagaaaggaggagggaggaaggaggagggaggaaggagaagggaggaaggaggaaggaaggaaggaggagggaggaaggaggaggggaggaaggaggagggaggaaggaggaagggaggaaggaaggaaggaaggaaggaggaagggaggaaggaggaaggaggaagggaggaagggaggaaggaaggaaggaaggaaggaggaaggaggaaggaggaaggaggaaggaggaaggaggaagaggaaggaggaagaagaagaagaagaagaagaagaagaagaagaagaagaagaagaagaagaagaagaagaagaagaagaagaagaagaaauaguuaaaagaguacaugcugcuuuuccagaggaccagaguuugguucccagcacaugucaagcaacuaacaaccaccuguaaucuagcuccaagcgaaucugaugccaccucuggacucuguaggcaccugcauacauguagcauauaaucacagacacacauauacauaaauuuaaaaaauauauaggggcuggggaaaugucucagcaguuaaaagcauacacuaaucuuagauagacuugaguuuaauucuuagcacacacaucaaauggcucacaagcauuuguaacugaaguacuucuggccuugagaacagcagcacucauguacaucuauccccagacagacagacagacagacagacagacagacacacacacacacacacacauauccacauaauuuaaaaaauaaaacagaucuuuauuucauucacaaacauacucauagcagaagauggccuagucggccaucauugggaagagaggccccuuggucuagcaaacuuaaugugucccaguacaggggaacgccagggaucaagaagugggagugaguggcggagggaggguauaggggacuuuugggauagcaucugaaacguaaauaaagaaaauaccuaauaaaaaaauguggggaaaaaaaaagaaauuaccuuucacuguuagucuuuaaauaggaaagcuaggcuauaaacuagaaugugauggggcugcuuuaccuauucuacaguuuaacuguaacaggcaaagccugagaaaagcagccuuuccacggcaggccacggugggccgagauggagugcuggagaggcuucuuccaucuggucagagaggugagaggcacugagugcucugugagacagaugggaagccaggaaauggacuaggaguagaguaauaggcagguaagaugguacugaacagaaaccucuguacagcccuagcaucuguaugccugccauuuucuguucugccucccauggcagcggcugccaccucccccuuauaaagccaggcagcacugugugaagaagcagcuauccugcuuaccugaaggguccucacaugacgacacuauuuugcccaucucuugauaaucuuuacucugcuccacuuggcugaguugagauauacuuucuauaaaaagcagugccagggcauauuguuauuaauucauucaugguagaguccaaaaaagcaaagacaagaagagcaguuacacacuucuaugucauucaguuagacuacagcagauuccauucaccuuaagucuucaguaaaggggucuccggaagccuagcagaaccacugcaguuccacuuuuaaaaacuuucagguagggcuggagagauggagagugguuaagagcacuagaugcucuuccagagguccugaguucaauucccagcaaccacucgguggcucacaaccaucuguaaugggaucugaugcccucuucuggugugucugaagauagcuacauuguacucauaaacauuaaauaaauaaauaaaucuuuaagaaaaaaguuaaaaaaaaaccuucaagaaaaacuuaaugguuauucuuacaacaaaaagucuuuaaaaacguauguaucuaccaccuaacuuacaaauuuaacuacaagggauauauauuuaaaagauaccagaaauaaguaucaagauuuauuauuuaauuuuuacaauaacaaaaguuaauagggccaaugagauggcuuagcaaguaacgacacuugcugccaaagcugacagacuaccugaguggauugccagaagccacauggcagaagccaugaccccugagagccaaccucucaccucccagugcaaacagaacacacgugccucaccaccacacgcaauaaaggaaauuuaauaguuuucaauuaaauuuaaaaauuaauguuuaaaaaguuaaaagaaaaaaaucaugacauauguguguguguguugaaccacuaugacccuuaauaaaggaaaaucauauuauaaaaauaauauuuuuauuaucccuuaucugguucacaaagccaguaagaagguucagcagguaaaggcggcacuugccagcaagccugaggauggccugaguccacaaugguggaagcagagauccagcucucucuguccccaaccuccacgugugugccacaguagucacagaaucauaaguacauagguaauaaauguauuuuuaaagauuaaaaaguaauacuucgaggacauaggaaaagcaggcucuagauucugaauagauucagaauucauuuacauaauuuauaauucuauguuaaaaaauaaguaaaaagacagaggaccaaaagccuacaauaauccuucacaacuauggauuuacuaauuauuuaaccuuuaagauuuuguuguuguuguuuuggguuuuuuguuuguuuguuguuuuaauuuuauuugcauugguguuuugccugcaugugucugaggauguccgauccccuggaacuggaguuacagacaguugugagcugccaugugggugccgggaauugaaccugggaccucuggaagagcaguuagugcuauugaccccuaagccaucucuucaguccccaagcuuuaagguuuuaaaccaaguuuuaaaaccuguguuuuuaaauauuuaaguauuucauuugugcugacaucaauucucagaagaccauccacuaccuaauaaaaauuccacccuagacacuagauagaaacucuuacccaagagaacaacggucaggguaguccaaguaacuccacaaacaauaaagcuguugccauuugccccucacugacgcccaaagguugaagguaagucccuauugcuaaagacacugcauccuuaggacaggagacuggauggaugaagcuagaccuucugcaagccuuguuccuguagccuaccuuccacaacaccagagaguacuacacaaacugacaagggagggaagcaguugacaguccuaauuagccacaacaagcauuaacaaaacacagaccaacaugacaagauacaccgaaugguacuacaguagcuucucuguuggcaauaaccaacuguugccuaauuggauguaaggcuugcuaaaaagagaaaaaccugcuauuuucacauguacauauccucugauccucuguaacaacaaacacaacugguuuugcauuuuuuguuuguuuuccaagacaggguuucucuguauagcccuggcuguccuggaacucucucuguagaccaggcuggccucgaacucagaaauccaccugccucugccucccaagugcugggauuaaaggugugugccaccacugcccagcgugguuuugcauuuuuuacucuaccaaaaugaacacaacugcccgacuagccagcacaggggaaauaaagacacuaccauggcuuuuagucuccuuggagcacgagggcucugagggagcacucgggugcuccacugcugcuuccagcuccagcucaggcuccugaagaagccugacaccuccauccuccacucguucuucaugcuccuccuucacuuucuccuccuccuccucuuccucuuccuccuccuccucuacuucagguucauccuucauuugcauuaaagcuggagggaguucuggacgcuuggguggcaacuucuacaugggaaauaaaaccacaaacaggaauuucugcgugaagguaaaaagggacaaaucuccaggauaauaagccccacagaaaucugcuagaagugugaccuccaaaggaaauuuuguucaucuauacaucuuaucaaauguuuucagcaauuucuggggccacagauuaccagagaacauauauaagaaccgaaacuggaucugcaacagcaaaaaccaaaacaacaaagaugaugaacacaacaccccguauacagaucagcggcgugcuugcagaugcaaagucaggcuccaccuucagugcugcacacaggauccuaggauuguuaaauauaagauaccugaagcacccuguagggaaacagaauucuacugcaggugaaugacagcagcaggauccaauccugucauaucacgucaaagaauuuugauguauuacaaagucuucagggaaguaaaucaaauauauguuuucaagaaaaaaaucauucuuacugcccuccccugacccucuagauauucugagacaaggucuuacuacauagugcuggcuggccugaaacucacuauguagaccaggaugacuucgaguuuggaaugauccuccugccucugccucccaaguagagauuauaguucugggccucuagcuagucccuuaacauuuuuuuaaaauauaaaauuaaguuaaguaaucuuuuuaaaagccuuuuaaaaaauauuuauuuauuauguauauagcauuuugccugcauguaugcuugcaguccaaaagaagacaggguuucucuguguagcccuugcuguccuggaacucagucuguagacuaggcuggccucaaacucagaaaucuaccugcuuuugccuccugaguacugggauuaaggacaucuaccaccacugcccagcauuaaaaagccuuuuaagaaaccauuuuucaggcuggagagauggcucagugguuaaaagcacugacuacuuuuccagagguccugaguucaauuccuagcaaccacauguuggcucacaaccaucuguaaugggaucugaugcccuccucuggugugucugaagacagcuacaguguacucaucauauauauaaacaaauaaauaaaaucucuaaaaacaacaacaaauaacaacaccaccaccaaaacaaacauuucucuucuauuuaaaccuggauacuuuccuuuccauaacuuuacgucugucacaugugugacugggacuucaggccucugguaucagacaacaguccaucacaauucaaggucuuuccaucucaguuguuuuguuguuuagcucuauagcucaggcuggcccagaacuugaguuccugucucucuccccaguauguuaaugauagauaugcaacacuauagcugcuuuuuauaaacugauuuacauacacccccuauaaauccaugugugaggucccaacuccuaagaucucuuggaaugucaucucauuugagauaagugauuaaguuacaaugagccauccuuagucaaauggcugagaagcccugggcccuaagaugguaaaccugacauuauaaaagggagaggcaacuguauuaaagggcagccaucuguaagacacaagauaccaacuaugccagcaucuuggucuugaaccucaacuaucuagaacuguuagaaaauaaaccugcaaggcauugcaagcugaaucguuuagacuuaugucauuauguugguaauuuuaaucaacuugaaauaagcuauugucacuggagaggagggaaccucaagggagaacacgugucaguaagacugggcuacagccucagcuagggaaaugggaggaagguacaaaauucuaugccuaacugaggagcuauuggcaaaugaugggcucuaggagugggagagagaguuuucucuaaaaguacacccucuauucagccaacuaugccccagcagaaggacacacauccaagaauauauggacagcauaaauuagguucaguggcuuaaaaagaaagaggugcugggugguggcggcacacaccuuuaaucccagcacugggaggcagagguaggcagauuucuaugaguuugaggccagccugguccacagccugggcuauacaaaggaacccuaucuuaaaaauaaaacaaacaggggcuggagagaugauggcucagugguuaagagcaccgacugcucuuccagagguucugaguucaauucucagcaaccacaugguagcucacaaccaucuguaauaggaucugaugcccucuucugguguguccaaagacagcuauguacgcacacaaaacaaacaaacaaaccuuuaaaaacaaaacaaaacaaaaacaaggaggaggaagaggaaaagaggaggaggaagaggaagaggaggaggaagaggaggaggagacaaaaggagaaaaggagguuacagaguuagguggauaggacaggggcgcagaccugggagaaguuggagaggggagugaauaucaucaaagcacaauguacagaauucucagggaacuacuauuuuuaaauaaggagaaaaaacaauauuccagcaguaagcaaaguaaaucauggggaaaaauaucaccauaggcacuucauuccuaaauauggcacacauuagaaacauuaaacuagcucaggacugccagggcuacacagugagacugcugaaagaaaagggguagggggagaaagaaagaaaaaaaagaaaagaaacuaaacuaauaaacuaauuaaaaaaaaaauauccgaguucuuuccaagucgccugugucugugugcacacgaggccaggggaggcgucagcuguccuccuccaucacucuccaccucccugcuuacugacccugcagcccagcgaggcugucagucagcaagccccagcaacccugccuuugcagcccuccgugcuggggucacacugcacagggccaugcuucacuuuacacgggguacugggccccgaacucuggacuucauacuugggagcgacaccugagccaucuuugcaguccaguucacuaaucucagcaagagaugcucaugcuaauccaacagcccuuucucacaaaaccagggaauaagacagaaaaccuaguucagggauagcucaaggacgaggaguucaacacacucuaacucacaacuuaccccuacugucccaguuuuuaauuugaauuugcuuccuccuuucauggcaccaaagagaggcaaugcaaguuucuuaguuuuguuuucugcauuuguagucugaaguucaguccuaggaagaggaacaauuauaaauaucuguucuaguuaaguuuuaggucuugccuuacgugccaugaaacugggcuggcgagauggcucaccagguaaaagcacuuggcagucaggucugagcaccuguucaaacccugugagcccacagaaagguggaaggagagaagugacucugcaaaguugaccucugacccccacacacuguacuacgccucaaccugcaacauacacauaauacagaacaguguuaaaaauaccaagaaacugacgaggacacuccggagaaacagacaugaccacaagaugaguaugcagacauaaaccagaggacagcaagccuacugaggaggcgacacagcccccugagccuguaauucccaacauggcccaggacuuugcaucugucagauggugacuacagugacaacagucacuggagaaggaaaagaaaaguauagcccaucuuuguguuuguuuguuuuuugggacagacuuuuucuguguagcccuggcuguccuggaacucuugcuguagaccaggcuagccucaaacucaauauucaccugucucugcgcuccggugcugagauuaaaggugugugccaccaccauccagcacauaacccauaaggugugcgccaccaccauccagcacauaacccaucuagaugcuuacauagcaguuagaggcuucaaacacucacugacaaccuaaaguagcucuguacaauggagcuuuaugccauaauggaaaacuuguaauguuuauauugcauugcccauuugauuaaauaucagccacauuugggcacuaagcacuugaaaugugguuaguauuuugaagaacugaauuuguaaaacuuuaugugaagaaacuuuaauagugcauacuguuuaauaucauagggugucauacuguauaguacagcuucccaagcgcccaaacgcuggaaacgcagucaugagccaccacgcauucugccacgucaucagacaugcucucgcucuguaguccaggcuagcuuggaacuuacuauucuagugcagguggccucaaacuugagaaccaccugggcaguuucccucaugcgaggauuacaggugugcaccaccauguccagacugcaaugcaacuguuaaugugguuuucaaguugcuuauuaaaaaauugaaacugucaaagcuaaaacuguuaucacaaccauaauuuuacaccuaaaacacuauggcuacuuggugcaagagucucucguuggugcaaguuuacucacacauugacuuagaaaguauaaagaauuuauacacucucaaguuucucucuaacgguuguccuccagucauccaguuccuuuccccagagacaauucacucagucagcuuuuauaaauauuuccagagacagaaaaguagaugccauuuggaacccucgcuuauucucuuuaaucagcuacugaagaugcugugcaccaagguccaugucuacgccuuucucagaacugcuuauguucccaaagccuguggucaauguuggugugggggaggguaaaguccaagccccuggccuuuaggacaucuguggugccacuauaauucuugaaagcacaacuuugcccaucuuguucccuguucuuuauuucaauacagauuucucuagagugagucacuuguagacaaauccccaccucaaaguguauuuguaaggaacuugacuaaacagacauuaggggucaauuuauguauauauguauacacauauacauacauauauauacacauacauacauauaugcauauacauacagaaguaccugcacauucuuccucuaugcaaauauuacacuguacuauaguuaauauagcuuuuguaauuuauuauauuuugauaacaaucccacaauuuucaaaaauacuugcuuccuuaucuuaauagcuacaugguguucuauuauauaauauuuuauuuuguucuugauaagcauuuacgugguggaucauauuuuguuauuguaaacaauauuauauauuaauaauuuucuaaguauguaaagucaagagucuagaaaacuaggucagauaugguugcacauaccuuaaucucagcacucaggccacagaggcagauagaucucugagucugaagcuagccuggucuauauagugaguuccaguccagccaaggcuacuuagugacaccuugucucaaaaacaaaaccuaaauaaauaaaccuacauuucuuuuccuucuuccuuuucuugcaguauugggaauugaacacagagccuacaagcacucuaugauugaacuauauaucccaagcuccaaauguucauuuuuuuccuuccuuuucuuuuuuguuuugguugugugugguguuguuuuuugcuuuuucugagacagggugucacuauguauccuuggcuagccugaaacucagagauucacccaccugucucugccuaagcgcacacacgcaugcaugcacacacgcacgcacacacauugccaaguguagcccaaacuuguuuucaacuugcuacguagcagaggauggcuuauccugccucuaccucccaaauacugggguuacaggcaugcacuaacaugcccaggucuuugugcgcauauuucauuuuuuguggcugauuaccuauuaucuugcauaaguuuuuauauauuggagguaugacuccuuugugcacguuccuuuuaaaggaaguuugcucugcagaaagauauacagcagaggacugccuggucuggccucaacgagagaggaaguaccuagcccuugagaaacuugaggucccagggaauggggaggccuggcaggguguguggggacaaccucuuggagacaggggaggaggaaugggaugaggaacuguuggagggcagaacaggaagggaauaaugacuagacuguaaaaaagaucaaagauaacaaaaaaaucaauaaaaauauauuacauguagauauauuuaugaaacugucaaaaaauaaaaauuauuuuuaaaugcuuuuuuaaaaaaacccuuuauaucauuccaauuaauuaagaauccauauaauauccauggaaaauccucuaguaagcuauaguucauaaauaguccuuuaucuuuuuuuuuuuaauguaugaauacacugucucugucuucagacacccagaagaaggcaucagauccuauuacagauaguugugagcuaccaugugggugcugggauuugaacucuugacucuggaugagcagccaguacucuuaacaacuaagccaucucuccagcacuauccuuuuguucuuaaagguugucugcaccaggagcauggcucauagguaacagcauguacuuacuaugugugaagacuguguuugacccuuaguacuaaaaacaaaacacauccgggcagugguggcgcacaccuuuaaucccagcacuggggaggcagaggcagguggauuucugaguucgaggccagccuggucuacagagugaguuccaggacagccagggcuacacagagaaacucugucucaaaaaacaaaacaaaacaaaucaauaauuuaauaauucuguaauuuaauaauucuguaaagauaaguaagacuggaugugguggcacaucuauauaugggaaguagaagcaggaugcaauuuuuuuuuuaaauuauacacauagcccucuggguaaacauuuaguugaggggaggagaggggcugaauaugaucaaaauacauuauaugaaauacucaaagaauaaaaauuugacuaaacuuuucuuuaaaaguucaacauuaggcuggaaagauggcucaguggguaaagaccaaccccaagucugaguccaaucucagaacccaaaugauggaaagaaaaaaccaacaacaaaagcugaccccugaccucagcacaugcaaaccacagcuacacaacagguaaaguagaaagaagaacacaaguucaaggucacgcugggcuacagcacccuguucaaggccaggcuagcuacaugagauacugucuccaaguuuuucaacuagaacuacuuauacuuacuuuuuuaguucugggaucucugccggcuuuacaaguuuuauuaacccuuuaagucgcuguuguucuuuucuuaguucaaaaguccucaggugaaguuucuuccgggacaccccaucuaaugugcugccugauuucauuucugacaugaaugcaucuaaagaguccugagaugauggcucugacagaacuguccaagggaaggagacauguuacacaggcagcccaaagacuuuuaacuucaguccaacaaagggcucacaaaugcaaagcugagcagccaucgccacugauaccaggaaaaaaccaaaaagcuauagcugugugagaccuugggaagugauuuaggcuucauucccgucagcuauuucuuuuuuaaaggugcugcaaagggcagagauuuacugagguuguuugaacaguaucacuugauacuccaggcagaccugaacacaccaugaagccaagggugacuuugaacucuuuuuuuuuuuuuucuuccuucuugcgccaggcccacuugcucuggcccaaagauugauugauugauugauucauugauuauaugugaguacaguguagcugcuuuuagacacaccagaagaggacaucagaucucauuacagaugguugcuaggaauugaacucaggacaucuggaagagcagucaguggucuuaaccacugagccaucucuccagcccucacaucaacuauuaaauaaaagaaauuaaaccaaacauuuaaaagaauauuuuucuagcucuacaauguuacauugugggagaaguggcucagcacuuguugcucuugcagaggaucucaguucaguuuccagcauucauauggcagcucacaauauucuguaacuccaguuccaggggacccagagcccucuucuggccuucaugaguaccacacaugcauugguacacagacauauaugaaggcaaaacacucauaaaaacacguguaaaauuaaaaagcuauauugcuccuugaaaguaccuccaaagccugaauguuccaguguaucccaaugccuaacacgaugcagcacuuuguuuguuuguuuguuuguuuauuuauuuaaaguaugauuuauuuauuuauuuauuuauuuauuuauuuauuuauuuauuuaaaguaugugagcacacuguugcugacacaccagaagagggcaucagagaucccauuacaguugguugugagccaccaugugguugcuaggaauugaacucacagccucuggaagaucagucagugcucuuaaccccugagccaucucuccaguccccccuucuucuucuucuucuucuuuuuuuuuuuuuuuuuuuuuuuugaugcaguacauacuuauaugacagguacucgguaacuauugacugacagucucaccuuugcuugaagccuugagccuuucagaaauuucggcgaguucccuuucggcaucauuuaacuuugcaaccuauaacacccaaaucgacagggucagcagauguuuuccuccccaucaccuucccacugucaauacuauuauagguuuuauuaagaugacugauucaggaguccaucuaaguuggcuccugauggagaugauauuucauuuguuuacuuuauucuaguggaacuaauuuuagaauuaaaaaacucaaauagaaugagugacugaaaaguuacugguagacguugaauguuuuaagcuaggaaauugcuaaauauuauauuaaaugcaugucaccuuagggcaagcuccugaaugguugugccacuccagacuaagguaauaccauucuuccgacuucucuuaaaugucggggccuaacaucagucucauugugaacacccaaacuuggagcuuuuucuuuucuuuuuucggggugggggagaaucuggggaguaacaccauauucaaagacugcucauugccugaucaaugcgaaccuggggaaagugaguggcagcgagcaaacgcuuuucuccacuaacuggaauaaaacuagucauuuucuuaccacugaauuuagaccacaaaaguuguaagucaguauuagauuucuauguugcuguuuguaaaagcuauaaugacauaaaaguagcugcuucuaugaacaacuugccagugacucaaaaguuucuggcuucucaucaagcuucccagccuucuucauccgguucaggcgcuucuucucuaccaggccaguccgaucgaggaauguaucaucgucacuaucauaaaaauccucaucuucccaguucuuggcuuuccuuuuccgagauacuaaaaauaaaacaguucauaacaaaggguuuguuuguuuguuuaauuuagagauugagaaagaaaaagggcgggaaaauuggaggcugguauguagcucaguuagcaguguguaugcaggccccuggcuugguccucagcagcaccuaacaaggugcaagggaacaaaucuguaaucuagcacugggagguaaagguagaggaagguuggaaguucuuggcuauauaacaggauugaggccagccugggauacaaacucugccuaaaaaaggaggaggaggaggaggaagaagaggaggaggaggaggaagaagaggaggagaggagagggaaauaaguuacauguacaaggugccugugcugagaagacagacagcuuaauacacaaaguacuugucucacaagugcgagggccagguucagagccucaguacccaaugcacacugggcagggagccuaccuguaauccccgacacagaaaacauugaucaagagcaagcuggucagacaaacaauccuaggucuugggguucauuauugauucuaccucaaaauaaaggguaaggagggacugaagaagauaccuaacaccagccucugaucuccacacgcuuuauaaagaagugaaauuagagacagaaacagaacaucagacauaugggaugguaggaaggagaauggaauuaauguucaugggcuacaauugcgccaggaauaacgaaaaguucugagccggguagugaugauuacauaaauauaccucauauuacuaaauugcagcauguuuuaugcaccauauauuuuacaacaauuaacaguaaaaacaaagcugggcauguugguuguaugccuuuaaucccagcacuucacaggcaaaggccagccuggguuacagagcaaguuccagaacagacagggcuacacagagaaacccugucucagaaaaacaaaaagaaaucagucaauaaaaagauaaugauaagaaaaagaccacuaaacauagaaauaaaccaagaaauuugaacuugaauacaugagccaggaugacuuugaaucgcaacuacccuguaucugguuugucaacuacagaugugcaccaccaugucuggcucaggagccagggguuuugguuuuuuguuucuguuuuugagacaggguuucugaggcagaucucuggaacucagagagaucugcuugacucugccuccuaagugcugggauuaaaggugugcaccaccagccccaguuuuaggguuuaguuuuaaauguacacucaccuacauacagaaaaugucuaagacaauauaacuaacugucuuaggauguugagagggaaugcuugucucugcuucaggaaguucuguacaguuuacacacuauccacguagagagauuaugcagcuuuugcaguacauuucccuucuuuguuuuguaaaagaaaaggguuuuuaauacugaccugcuuccugccguagcaagcccaguguaucaaggacccggcaggcuuccagcgagcacuguaccauugcuuccuuuuucuuuccugagugaauggccucagccaccagcuguuucccaguugaaucaucuacagguaaccugcauugguuuacaggggguggagcucagcaggaugcucugacucucaugaaaacagcuaucaagaguguccaugaugacugcauuucaugcuuucagguaacuucacucuuucuugccucaguuggacuucaagucauuuacacccgcuuucauucauuucaccccagcucccagugcuauuaagcuaccaaggcccacacuuggaacuagccuaaagugcagagugaaguuacucuugggcuauucucugcaaccauauguuaacuugaaacuggcuacuuucaaacauacacauuagcaaggaaagagcacaugaacccaguacucaguaggcaaaagagggaagacugccacaaaacaagacccggucucaaaucacagcuagaauacaaacgagaagaacauaccucacccugcagagccaagugcuguguccuugcucaucaaauucauauucuaacucuucuccugcaggaaaagaacagucucagucaggucuaaaauuacuacuugauccaguaaggacuguaucagaucaaagaucucagugucuaacaucacagcgagcacugccagggaucaccuccuggaaaucaaucuuggcuguguauacuuauacauacagcuuauaauacuaggcauucagaaacugaggcaagaagcucauaccuacaaggccuaccuggucuccaggagaugggggucacagguuguugcuuagugacagaaugcuugccuagcaugagcaagguccuggauuugaucucagcacaaucagaacaaaacauccaaaccaaucaucucuccauacauacuuuuauuuaucaauugugaguguguguguaugugugugugguuguacgugucuguccauaugugugaagacuggguaccuucaaagaauaucuacugaaacaauucucccugagaacacgucuuaucacaugaagguaaaaucuacacuaagaacuguaaagacagggcuguggggagggcucagugggagccuugccuagagagcauaagcauccaggcccaauguccuggaaaucauggaagaaagcugggcacgguggccuaugccugcaaucccagccuagggaggcagacacaagaggauucccagggcucagaggcuagccaguccagcaauuagggagcugcaggacaaagagagaccuugucucaaagaaaguauaugguguuccugacaauuacaccuaagguuuuucuagaacacauacauuaaaaaguacugauuaugaaagaccaugugaauuaggaauaauaaauucuaaggcuuuguuuuauuucccuaccacuaaauccaagaucuuuugagaagaauguguuaaguuaggagaaaaguauuuaagacagaaagaaagacaaacgagaauuuuauuauuuucaacauaaaccugugacuggugaucaagaucucucucucggugauagagaaagcacuuuccuagcacacccagugucugggccucagaaaccaacaaaaaauaaaaacagagccaaagaaagcuauugaaacugaucacagaacaagaaauaaugaggaagacaacagacaaauuaugugcaaguauuaggcaaaagucacagcuuuaggaagcagcacugcugugagcgugagcagcuuacugucacagccagaaccacagucacacacacaccuucucggucaaagaagccuugaagagccuucuuuggauccuuuauauaaaacgcuucccgguccugcugaaaaucuaaggcaaugggguucucuucagcuucauccuccacagcaucuucuccugcaggagucaggagacagaagaaagaacacauaagacgagggugugugaaugacacuuaugaaccuucuaagccgaaucaggacauaguuagaugagcuggcagaggggcacacaccuguagucauaacucaggagguggaggaaggaggauugccugacuguauggagacaauguuucaagaaacacacacacuuauuuaucuguaucugaaagugacuaacagaaagauaucugugggcagaaguuggaacaaucacaaagucaccauuaugaauaucuauguuuucuaagcuguguaacagacaagacuucuuuccauggcuuuuucuucuuuucaucacuuuagagacauuuacccaccacacuuugaaaaaaacuacugagccgggcguugguggugcacgccuuugaucccagcacuugggaggcagaggcaggcggauuucugaguucaaggucagccuggucuacagagugaguuccaggacagccagggcuacacagagaaacccugucucgggaaaaaaagaaaagaaagaaagaaaaaaaccacugagcucucuagccuagccuagucucuuucuuuccucucaagcuucauugauucgaauauugauuauuaguaauucuccagucuaacagaaagacaggucaacacaacacucccuuaaagccaaccgccuccgcccugaacgccagugccagugugcagcuuccucaggacuacuuuuccuuuccuucagguucuagcuugaaacucuuuucuucucucuuuucuuuuucuuuuuccaagaaaggguuucucuguagcuuuggcuguccuggaacucacagagaucugccugccucugccuccccagcgcugggacuaaaguugcauacugccaccacaauccuggcuucagcuugaaacucuuauuuaaaaucuauaaaguaaaggguccugcugccaagcuugacaaccugcuuuugaucccuggggccagaaagucaaaggagagaaaugacuccugcaaguaguccucugaccuccacagaccaugcccccuaacacaaacacacaagaguuaaauaauucauaguuuccaagagaucuaaauuaguacugugcaauagaaauguaaguguuaugaguauaauucugaguucccuauuagcuacuuuaaaaugucaucuuaccauaauaauuacaagacuaugguaauauuuucuuuucuuuuuuucauuuugucauugaaauccuaugugugguuugcacuuagaagacaagccuguggaugagccacauugggcaugcagauaacagcuacuguacugaauagcacagcucuaaguccccagugacacaucccuuuucugacacuagcucaagcaugcuaaugguuucuggcuuauucuuuacacuuagcacaaguguuucugcauuuguucuguccugacaucuacagccauacacauacaagugccauagugcacacggagggagccuauucucuuccuccaucaugugcuucucagggcucacacucagcucaucacaacuggcagcacacaccuuuaccugcuaagcaaucucacugggccacaacuucuuucuuucauucauucucucauucacucaagucaggauuucucuacaauguaacucuggcuauccugaaauucaauaaauagaucaugcuggccugaaacuaacagagaucuaccugccucugccucccaagugcuaagauuaaaggccugcaucacaaugccuuauuagccccaacuaucuuuuucuuuaaaaguuuuauuuuauguaaagggguacucuaucuguauguacaauuacaugccagaagagggcaucagaugacauuauagaucauuaugagccaccacgugguugcugagggcugagcuuucucugaaagagcagauagugcucuuacuacugagccaucucucggcccucaccaacuaucuuuuuauaagccugaauaucuaucauccaaaauguggagcuauacaauaaccucuugaauguuuuguacuuugugaaaauagccugagaggugaaaaaauaucaaauacugauuucucagccaaagaaaugaaguaaauuuuuccaugcccuccaggugauaauuagcacucagaaagcucucucucucucucucucucucucucuuucuguguguguguguguguguguuuaaaugauaaacgcaauaagcaaauuacacggugagaaagagguguauguauaaugcccauaauucaacacuuuuacucacuaaaguuaaugacccugggcuugcaaauuacauuuacccuacuucagcuguaggccuucugagcuguaugaucaaaagcacuugagggugccaccuucaguaguaguuucuuacccauuccccacgugcagcccagcucaucaucuugaccacuucuacugcucuucccuucagugguauuugcuucuucuucuucaucugagucuucaccuaacaucuucuucuccaauaauaucugcugcuguuuacgcaauuccuucaacuguguuacuguuaauucagauucugccucucggucuuccucuggucccuaaugaaucauggguaaaauauauacauauauggauucagaagugagaaaauuacuuucugagacacagcaacguacacagaccuguggguccagaaugaggccugugcuuuugucauugguuaccagaauccuuuuacucaacuaaaccuuaaagaaacucagaaucgccgggcguggcggugcacgccuuuaaucccagcacucgggaggcagaggcaggcggauuucugaguucgaggccagccuggucuacagagagaguuccaggacagccagggcuacauagagaagcccugucuugaaaaaccaaaaacagugaagucccaagauuuuuauuuuagauuuuucuaccuaccugaaggauaaagagccgagugcugccuccaaagcgcauuacaugcccgacguggacucuacaguaagugcggggugggaugcgaguuuuguugaggaacgugccguggguacuucccagaucguagagauaaaagcccugcucaugacccucagagucuccgcugggauccgccccccggugcuguaguacagcaugguaccgagacacggaaggaugcuccagacauaugucacaacuagcaagucucccgaaaaagcagcagcucgugucuuucaaggugcgggugccaaggauggugccacccuucaggguuucgagacuguagggggccguggcugggcugccccacgauggcucucgguacggaggagcccgggucggaccgccagacgcaggagcuacccgcggggagcggaguugcuccaccgguggacccccggucuccuggcuguccggcugcgguggcgggaccucgggcuccucacauccagaguccagcugcgccgcgagacauucuuucuucacauccucagaaacggagggacuggaggccggagccuuaccccguacugcggaaggcacugguaaaaccggcuucuuaaacucgcuacugacuuccuggggagcuggcgcaucuagcugagggguaggaucagccauccuuagccgggugcaaucucaaaaugug

SEQ ID NO: 12095 - RNA, 75826 nt, Mus musculus
agcgucccgggccggcugcgccgccgucgcugccuccuggcgccccgcgaccuggagguggagaagggagagggacccgcgggcguccaccucggccggccgccuucuccccgcggcgacccgugcgagugcggccggacucagguaagcucgcggcguggccucgcgacguaggcagcugacccggaccgggcagcucuaggccucggcauccacccuccugcucccgggcuucucgaggcgccgccgccccugccgcuguccgccuacuggucccggagucuggaaguugaggagaaacuucuccccucccgcggucuggcuggcgggcgugagugucucgucuccugggcucacuaccugcuugcccagugccucggucuccgcccuguccaguacuucccgauucugcgggaguccggauagugguccagccuauguggugccgccgcugcacccuccaccccaaaggacguggggucacucccgaaugaggaccagaggguagggcagcggccccuucucguccuagcggcuggaggucugugucgccggacgcccgcagcaacugucuggagcgaggaguggaacucguggagcgagcgggugagcggcggguuguacuugguuugauugcaaaccacgaccuguuuauaaaguuuuccuuuguuuggguuugaggguguugggacguguuacaaucagcggccacuuuuaagugccuugccacuccgccuccccgugaguucgguucucuguccuccugugucaacgaaaauuuuguuuguguuuugcuucuugauaauugcuuccagcuuuugcuuuauugggcuugagaaagaguuguuuuuaaaaagugggaauaucguuucugguauagggauugugaauggggcauagcguaguuuugauguaguuauucuuugcauaagugauuggaacagcaguggaaaugacaguuaucaaaguaaauaaacgaaaaguaugcaguugaaacauaacuuuguaccucucuuguguguuccacagcuguguuuuuuacaugugauuucacaggauauuucgguaugguauauucauguauuucguguaaaauuacugaccaaaauuggcaauugaaagugaguuuaaacauccuguuaaauuucuaaauuuaaauuacucacuaaugaaaauguuauuaagugugcaugugugacucaauuuaaggccaaaugugugcuaccucuauuaaccagcacaaugguguggacuagaaacauuuugagugggcagauagggaguguuaaauuaaaagccaaaguucuuauaugcaacauauaugagagagaauacaacuguaggaaaguuguucuucaggaauuuuuuccgcuugcuaaaugcauuuagcuauaucuuauuuuugaauaccagcaaaaccucagugaaaauguagaugcugguugacauuucaguagguccuaaauuuaggggagggagaagauugccuuugauugaaacuuagauacaagacuguuuauauuccauauuuccaggauaaaauaaaagcuuuuaaaaugugugcuuugccauaaaacuacgguaauguuauaccuuuaauuuuguagcuaguuuuugcugacuucacaaaccacaaaauugacuccuuucuguucaacugaaagugaaauuacagccuugaccugucuucuugggauaggugugaaauuuaucucauggccaaaggauaauauuaauauauagucaaaaauuguuuuuaguugaagaaauucucaaaaaaacccauugucuuugcaaauaaaauuuuauuucauugcauauauaaauaaaagaauaugcuaaaagaguagugaaauauuacuacuuguauacuuguuuaaauccuuguuuacuuacaguucaaauuugcauaguucuaacaguaauagcauacuacuguggguaauuuaaaaaaauauauuuuauuuauauaaguacacugucgcugucuucagacaccagaagagggcaucagaucccauuacagaugguugugagccaccaugugguugcugggaauugaacucaggaucuccggaagagcagucaaugcucuuaacugcugagccaacucuccagccuugguaauuuuuaaaaaaaauauauugagcuuccaauuuagugguucagguuggugugagcaucauuuauuagucuuauuacuuauuaccauuguuuaggaaagaaaccugagcagauuuuuuuuuuuuuuuuuuuuuuugaagagcauugcuagguucugaugucuagggaugcaaauuuaagugauaaaacuauuaaaaaaaaaacuacaaggaagugaugcuucuauccuuggggucuuggagguguuaguuuuaauuuaauuuaugagcucauacauuuguguguuuguuaccuggguuuuauauuuuacauaaaaauauuuuuaagaagccugaauguaaugcaguauagaaggugcuuagguuaaguuaauaauuuucaagauaaucugguuuccugucacauccuuuaaucuuuucccuguugauuaaaaauuuuagucauuggugucuagcuuaagggcacucccugggcucuucuuugcuaacagguuuagacuucuugcaucauaaauaucauauacuaguuugugugugaaaauaccacacacacacacacacacacacacacacucacacaaaaaaaucuaauaaaaaaaaguuaaaaaaaaagaaaauaccacacacuuccaaauguucuugauuuuuauguuauuuuaauguucugagagguguuauguguuauuaauuuuaaauauaaauaguaaauagaaaguaaucaaaauguuuauugaauggauagguguucuuuuaucagguaccuaccuuucagaaaaucagguaccaugacaaaacugacauagcaagaguugacuuucauucauuuuuuuuuccuuaaagcaauaaugcuucaaauaagaacaauucagugucaguuuuaacauaagauuuuucauuguguagugauuuucccuuuaauuacacuuuaugagguuuguagagucugaagcaauaauauacuuuuguuacagaaggaagcaaugacaaugguguuucagagacagagugguugccugaggccgcuuuaguuauucuguguaguugcuugcuguuuuagcuguugguuuuguuacuuuauguugauguaauggagcgcugaagaagagauugcaucugugccaaguucaugucacaggaacuuugccucauuguaaaggcaauguuugugauucuguccuugugugcauauuuacaggaaauuuuaguaagaucuuccauuguucagagagcuacauggcuaggucaccuuugguucacauuuaaacuuacuuauacuaaagauacaaguccucuagcaaaagcccuaacugcuucucuucagaggaaauaaucuguuccuauuaaaguguguuggugucuuaccagcacuguguacagccacuuauguaugacuacaaucggguauauauuuucuuuuuucuucucucagcugcuccagugccacaauuagcugaguauugcucagcugcagcugcugggugauuaugagccauccagcuccugucuaaacucagagacagauuuagcaaaggagcuauaguaacagccgagauagaaagggaagagccagugcugcugccaguaucauuugagcaagucugugccaagggauccuuggcugcugcagcacuacuguugucuuggaaccagccgacuugauggcagcgugucuguaucugaguggagguuuauaaccuuaagacugggaaacauacuccaagaaaaauggagaaugcuaugauuacaaaguagagugugauguacugauggcaugaauuacaagccucggugccucaucuccuugccuagcagugccuuucagauguuggguuuuaagaagcauguaacauauuucaaguuagagggguggcuggauugcugauguacauuaauuuggacucuccuacaaaaaguagaagaucccuugagagggguuaguucuagaacuagcuacccccuguugucugaacuuugaaaauagaaaccccaaauuccuuuuucuuacuguugguauuugagaagcuaagccucaacaaguacagguacuaguaauccaugguagucaguaagaggaggugggauggggggauugggaguucaaggccaguauuaccuugucucaaaaguaaaagggggaaaugcaaacacagugucagcuauguauggcaaaccagacuggaagagaccaggagacgauuuugcugccugugaaaugauaaugcaucguuuuauacuguucuuuuuacagcuaucuacugaaaauuagauggaacagauccuuuuaauaauccuggaaguacuggguggcucaggguuugggcuaauuugagguagggauuagaaauaguucaaauuagcauaacccuaaggaagagaugcggaagacugacugguugaacaugaucaagaauacauugucauuaggccacugaacaauagacugguaaaauauuuucuuccuuugugucuuacaaaguucauaugacuaagcacauuucucauaaaauuguaacuaauuucuuucuguggcucuuauaguugauaaaguguuccugagucaaggugcaguuuuauaguaauucacaguaaauauuuuuuuaaagauuuccuuauuuauuuauuuauagagugugucucucugugugugugugugugugugugugucugugugugucugugugugggggggaguaggugagaggacauagcuggagcaacugaggauagacucccuagaguagcauacuugugauuuagcauaaugaaucaagaccuuuauuccuugggaauaagaaacggugguagaaaagaagggucuuuuccuuuuucuucuauuuuaaaucauauauuugaauugggagcaaaaccaaccaaccaaccaacaaacaaaaaaacaaaaacaaaaaacaaagacaaauauucacuuacauuuuuguuguuauuuguuucuuugguuguguguaccguuuuacaggguaaccaaacuggccuugaacuggcucuguaacacaagcuggccucagauuuuuagucuucuggccuuugcuuucugcuuccuagggguggaguuagagacaucaaccacuaucuaacucuuacuuuuucuuuucuuuuccuuuucuuuucuuuguuuuuuguuguuguuguccuuguuuuuucgagacaggguuucucuguagcccuggcuguccuggaacucacuuuguagaccaggcuggccucgaacucagaaauccgccugcuucugccucccaagugcugggauuaaaggcgugcaccacuaccacccagcguguuccuguaaaucuuauugcuauacaaauucuucacuguuugaacaaaaguuuccguccagagcucuaaauggaaguuuuguuugcuacuuuggccauguauucuuauguuaacauuucuuccuucacuaccuuagaagucuucuuuggcuuccuuuuaugucuugaauuguaacugagauuauacuguuaguccucccucgguaaacuagaauguaaguuuucacaugaaaauugacaggcuuuauucuguuauagugccagcuauacacuagaauuuaagcuuccugggguggggaguuuuguuauacuccuaaaauuuuccaugaaucuaaaacugugacucuugugaaguguuuuugagucuaggggugugcagcuggcaguguuugcuuaucacagacccaucaacaaauaccucauuaaacucaugcaacaaccacagguuuuuguuuauacuuaauuuuuuuguguguggcagagcuaauguaauucagugacaguuuuuucaaguacauucaaauaagcauuuaacuugacugauguuugaacugucaaggagagguguuaaagaguuaucguggauagcccuggggcuaaugauauuugauguuaauuccauucuccuaugagggguggggaacuaagaaugagucugcacucaggugauuuccuguaaaccugcuucccaccuuaauuuauaaaauaaaggagagcugaugauugggcagauaaagggaagguggagcagaagguggagagagaaggagaaaauggaagagggagaggaugcagaagaggaggaagaagaagaaaagcggagcagaagcacauggccuggagaauccgcaaguuauaaggggucucauagauguggaagaugguauuguagugauagaucugcccaauccaggcgcacagccuguauucauauuaacugaguuguguuuuccuugcuugggcauauuuggguuggagaaaucuaccgcaacaaagaguaguacuuaauuaucccuaagcacaauuacuauuuucaaugaaagcauuccguuuaugucuagagaccaugcuucuuaaaaacuguagcauaugucaguuccugcuauauuaacauuaauguaaacaagucauauggauuuaccagauggcuauaagaagagcugagcaaauaauccuuguuaaggcacccuaguuucuuagaacaacuuuacacacaggaggagaaaaauuuuugguggauagauagauaucucugccacagaaaugacccaguaauuaaacaaguuggauaguguuagaucacagaaaccuaggacaugucucacucaauaccuguggcuccucccagcccuucucacacuacuaacuacccuaaaccucucucucccagggucugggcuuccacuucccuucccccagcuucagauuccacagccauuuugguuauguaccuucuagguuuccggacuagcucuuggaugcuugguccauggcuccccucuuggacuacuugcuacuccccuucucuucccuacuugcucccuuuccccaucccuccucucucauggccccauucagucugcuggcuauacuuagucuagaccauucuagaugcugucccuccccaauauaauauguauauguauauauaaaaauaaaauguauguauauuucuuucuuuuuuuuuuuuuacacucgagauuuuauuccccuccugguccacccuccccccuuucccgguccccuuucccucccaggcuccucccucccaagaaaguuuauuuucuaagcuagagagcaucuguuaaauuuaauuuggcauuugaucuuugaacuuaauuuaggagcacuaagaaggaaaaaugcuggccaucugcagauucuugacagaaucuuuggugguaagggcagugucauccuuaaaaguccuaggaaaaacaguuuuucauuuuaagaaguacccugacuuuaggaaacauuaaaaucuacauuuacuaauguguagcuuaagauucuaaugggcagcauggcagcauuuaauuuguugauauuuaaguuucaucuucuguauacaccucaguguaugugugugcccuuuugugagugcaugcacccuugggcaugagaagaggacauuauauccuccggaauuguaguuacaguuuugaaccacuguacaugcuuuagcggcaaguucuuucaaccacuggaucaucucuccagccucacccaacuuuuuauaggaaaaacuuaugaaacauucugguuauggugguaaaggagaguucagacuaaaccuaggauuguauuucuauccacacaguccuucuaguauuugaaaagugagcuuaaauaacaaugucaacgaauuugaugggagguaguagcugguagaaauuauaguggaauuccucacccucuucauugucucagaaaucucuuagucacuccuauuggaacucggugguaguuuuguguuguucuaauaauagaggggguuuugaacaucuuaggauauuaaccagagaacaagugagacuuuuagaaugucuuaggaacgugauaauacuaauaaauagcaagacacuguuucaacuuuuuaccuuuucucuucucuucuucucucucucucucuuucuuucuuuauuuuauuuuauuuuauuuuuugagacagaguuucucuguguagcccuggcuguccuggaacucacuuuguagacucugccucccaagugcugggauuaaaggcgugcaccaccacgccaaaacaaaucuuaugugaagguguaguuugagauauuuccugaccucuaucugagucaauggaaguaugcuuguucaucaaguguccauuguguacaucuaucaguugguuaaggcaaagaaaaaagaacugucagacaucauauuaguggacuuugaugaaauggaauagauauaaugcaguguauuuuaaagcguguaauaugugauauaauacuuaauaaaaaugaaaaauacuuuaaaauggaaaagagguuaucuagcuuuaaauaauaucaggucuuuaguuugagaagaauuucauaucuuauuuucuuuuuuuaaaauauuuuuauuacauauaaguacacuguagcugucuucagacacaccagaagagggugccagaucccauuacagaugguugugagccacuauguaguugcugggauuugaacucgggaccucuggaagagcagucggugcucuuaaccacugagacucacagaucagccugcuuuugucucugccuuugacucugccuccccccacccccaagugcugggauuaaaggugugcaacaucaccagguuuauuuuucucuuuucuauaauuaacucuuaaugaaaugauaaaaauugauuuaucuuuaaaaaauacucaaagcuagggauguugauagacuaaaaauuauuuuuaugucuuuccagguguguguuuaaagaaaaaugaacugaaauauguaggcauguuuuuuuaaauuuuuuauuagauauugucuucauuuaccuuucaaaugcuauccuuuugggucccuuauaccccccccccccgcccugcucccguaccaacacacucccacuucuguagguauguuuaauaucuaugaacauaaacauuuguuauuuuuuauauauauacauacauauauauauauauauauauacauacacauauaugagcaaagauacuuuaaguuauuuuuugaguuuuuuauuuguuuuauuuuggaguuuuuguuuuguuuuuguuucucguuucuuuguuuguuuuaaugguuuagcucuauugcccagucuagcuaagugauccccuugccucagucuccccaauuguugggacuacaggugugugccaccucauccaaccuuuuaaaguuacuuuaaauguguccucaauugaaggcucuuguacauuuuuguuuguuuguucaguugguugguugguuuaugucucuuugcuuguuuuugagaugggaucuuuguauauaguuuuggauggcauggaacuuucucuuuuuuuugguauuuuuuuguuguuguuuuucgagacaggguuucucuguauagcccuggcuguccuggaacucacucuguagaccaggcuagccucgaacucagaaauccaccugccucugccucccaaguauugggauuaaaggcaugugccaccaccgcccggccagcauggaacuuucuauguagaucauguaggccuugaacucacagauauccaagagccucugcucuuggaaauuccaugucugauugcuuuucaguuaauucccuuagcuuuugcuguuuaauuaaauuaugcagaaacaauaacuacagucuaaauucauuuccagcuugucaccaucuuauuuuguucuauuguuguaguuugcuuucuauuucugugagaaaacaccaugaccaauagcaacuuggggaggaaggguuuauuucaacuugaaugcauaucacaaucuaucacugagggaaggcagaguaguaagcuggaggcaggaacagaagcagaagccaugucugcuuacuaagguuugcuuuccacggcuuucauagcuugcuuucucguauaguccaggaccaccugucuagggguggcacuguccauuguggauugggcccucccacaucaaucauuaauuaaggaaauacaucacaggguugccuacaggccagucugauagaggcagucccucaagguuccuuuuucucagaugacuuuaguuuguauuaaguugacaaaauauuaaucagccuccugugggcaccauucacaggucggcugcuuucaugcauguguaguguguaucugaauccagaugaagguuuccuggaacugggacaugugggugcuauugaaugaaccaaggugcuaugggagcaaccagugcccucagccuccaaacaugaauaauaaagucuuguucucuugaaaaaaauaaaaauauuaaucagcacaguuguuagguagcuuuauuaguauuuucagauuggguuaaagaauuacuauaaguuuuaaugaaaguauuucuaauauuugucacuaaguagugauuccaaaauuucuuugagcuuuagauauagaaauaauguuauggaaggauucuucuguuucuguuccaugaaaguucuuauuuuauaaauggagugcuuaauuucuuuucuuggcuuuuuaaaaauaaaguaucucuuuccucuauccuuucguguguguguguucacauacacccagguaaaugugugaggcaaugagaggacaacuuucaggaguugguucuuuucuucuacuacauggacacauggaucccagggaaucaaacaaacuuagucauuagauuuggugucuucaccugugaagugauugccuucagauucgaucccuagcucugcaaaaauuaauuaaaacaacagcauuuagauuuuuccuuuacauaaauuuuuauuagagggaaauuugauauacauuacacuuaacauauuuggagcuaaggguauuauagcuggguguuaacaucguguguuuaucaugugaggcuccagguucaguccccagcuucaaacaaaauaaaacaucuaaccuauuuauaauaauauuuucuaucaaaauaaauuauauauacaaaauguucuaguuaauuuuuacuguuaacuugacacagcauacaucucucaagaagagagccucccuccacugaacuauugcacagaucauacuggccugaaaccauguauguuaaguauugucuugauuuuugauugaugugagagggccuaguccacuguggguggcaucauuccuuugacaggugguccugggcuauauuugaaagcuaacuaaccgugagccagagagugaaugaggcaaccaaguagcaguguuccuuaaugguuucugcuucagguucuuguuugaguuccugcucucacuucccagugacagacaaugaccugugagcugaaauaaugcccuuucaucccuuaaguugcuuuuggucagagugauuaucacagcagcagaacuuuagcuagagcacaaaauaauuauuucugguuauguucuauaaaaucucuuuaacauaaguuaccagcuacauccuuaggagaagccuagaguuaggaucauaggagcuuuugcaaauaaacuguaacugcuacuuguguuucagcuuaaacauaccuuaaauuauauuauugauuugguaacaucgaacucagaaaaauaauacuuuaguucaugcuaaguacagcucuuugacacuucuguuuucucuguaagguacagcuuagacuuuuacaucuguauauuuuuauuuuugaaaauaaauauacaucuguauauuuuuuugaaaauaaauauacaucuguauauuuuugaagcagggucucuuucacaacucagugauugacuagacagguaaguucuaaggauccuucuguuucuucuuccauauuguacagcaguuuccugagaucaaaaccuuccauuuuggagggaaccuucuuaagauacaggauguaaaaaggaaaauggaacaacaggauguucuaagaggagggaaaacacuccagccuguacagaaucuccuuagcuaugaaguaaaucaaaauagcuuuugggagucccugaaacugaccagauucuccaagaauguauaagcaguaaagacugagaauuauucucaagacaagccaauaccugaaagacucucagacucucuugaagagacucagaccagccuagcugccugaaagaagcauagaccagcacagcuguuuauaagagguguagaccaauggacuaccaggaaaggacacucugcuuguaggcugugcaauguggcucugguuuccagccuucaugcuugcaugggcucucggugauguagcugucuuuaagucauuuauggucuuauuacaaguaagcccucacccauauuccuauaagcaacccugguaaaacuuauucguucaucaaguugaacuuugguaguaucugaacuuggucugugucauugguucccugucugggguguguagauauuuguucucaucuuccuagggauagugucauucauacaguauuccccaacauugagauugcaagcauguucugccacucugguuuugauauggaugauggagaucagaacucagguuuuucaugcuuagucagcaaauaguuuacuaacugaguuauuuccauagccucuucuuucaucuaggcauacuucaccaugaacccuaaaucccaguggggacauuuaaauagcaaaauaaaauguacaaaaauggaaaaaaaaaacccacuaaagaccacauaaagggcacucaagaaagcaguaggucaccuuguuuugucuaugcuaggaauauaugcaucugucagcucaauuuuuguaaugccuucugaaaugccuugaacauucacugagucaaguaauuuuacuaagggaaugaaugaccacauguauguuaauaauaauauuucuaguaguaaauauuacagaucaauuucugggcuaaccauaauaauagacaaagauccuauuccaacuuuccguaguucuuuguaugcauugaucaaacuuagcacucauguagcaucuccucuccagugugggacaaaaaggaggaaaaaagacuuuaguguuuaguggugugggagagaaggaaaucacucaacucuuccaucuuuaaacccuggaaguuuugguaauugcuguauagagggccgcuucuugucaguauuaguaauccaaauuucaaagggggaagaugaagagacacugugucucuuauuggcuuauuuucuucuaugaccuaguaaaaagaguuaaauccuauugacuaauacucauugcuuuacuuugagaguuaaauuaauaaaugaaaacauccaaauugccuagcaugguaauacacaccuuuaaucucagugcucuagaggaagaaguagguggaucucugugaguuugaggccagcuuggucuacaaaguaaauuccaggacaucuaggaccauuauacagagaaacccugucucucuaaaaaacaaaacaaaacaaaagaaaaaaagaaagaaaagaaaaaaggaaaaaaagaagauagagaagggggagcagguuguauuacuuacuacagaguucaccuuauuuuauucaaaacaugguguuuggacuuuaacaauagcugucugucguuaucuuugugcucuauaaccucagauacagccaacaauaugacuuagggguuagggauauaguucaaugauagauugcuaacauuaccuaagacacuggguucaaccuuuaguaccacaggguggggagguguugaaauaagcuguaucuguacugagcgugaagacuuuccuugucauuauuaucauauuaccauauuaccuugcauauuaccagcuaauagaaagauaauuuuaaaguauaagugagaaaauaaguagguuacauguacauaguucacccuuuucuauaagagacuugagagcccauggauuuuggcauccugauuauauuuugaguauauugguauuguuccuccguggauacugagagacuauaugcuaauuugcuaguguaggcgcuaugaaagccuaagucaugacuccccaagaucacauccuaugaauuccaggaauucauuauuugucuuacauugucuauauuauaauauugucuauauuauauugucuuagucuguuuuguuauuaacaguacagggacugguagcuuauagaaacuaaagguuuauucaucuuacuguuuuaaaggcugggaaugucuaauaaugaggguuguaucugaugagagccuuguugacagagacacuauagaguccugguguggcgcugagcaucacauaggaagagauacaagagauaacuucaaacuggcucugacaagaaacccaaucuggaaacaaaccauuaguuuauuauugagaaacaguuuaauccacucaaaggaggagccuuucaugaucuucucaaacaccuuauggucauauguagucuguaucaccauaauuucucacaauuucaacaugaguuuuggaacauuuauuuauuuaaaagauuuauuuacuuauuauauguacguacacuguagcugucuucagacacaccagaggagggcaucugaucucauuaugggugguugugagccaccauaugguugcugugauuugaacucaggaccuccggaagaggagucagugcucuuaaccgcugagccaucuuuccagcccagcuuuggaacauuuuuuuuuuaagauuuauuaauugauuauauguaaguauacuguagaagucuucagacacuuuuucuucucacuccagucccaauugcucgcuguagcugucuucagacaccccagaagaggguaucagaucucauuauggaugguugugagccaccaugugguugcugggauuugaacucaugaccccuggaagagcugucagugcucuuaacccgcugagccaucucuccagcccuggaacauuuuugauaugcugucuuccccccccccuuugauuuaaguuuuauugcauuaugaugagaagagauacauaauuucugaauuuguuaacacuuaaaaacaguuuuugaguaauuagacuuacaucacauucuucuuucccuuuuguuccccaacuccuccuggagagccaccguccuucagaacuugcaaugucuuucauuuuuuuaucauauucuuuaaaauuuauaaaauauuguaacaauaaaaaugaguuauagccgggcgugguggugcacgucuuuaaucccagcacucggaaggcagaggcaggcggauuucugaguugaggccagccuagucuacagagugaguuccgggacagccaggacuacacagagaaacccugucucaaacaaacaaacaaacaaaaaaaagaguuauaaaaguuguuugauauaaaacaacaaucaauuaaacagucuuauguagauguuugucuacagcaauagugaaaaugcauucuuuuucucaguauaaauuucaaauaacuccaaauauauuaacugcaugauauuuuauaauaauauaucacuauuaggguuuuuuuuuuaaagauuuauuuauuuauuauauguaaguacacuguagcugucaucagacacaccagaggaggacgucagaucuuguuacggaugguugugagccaccaugugguugcugggacuugaacacuggaccuuuggaagagcagucggguacucuuacccacugagccaucucaccagcccuaggguuuuuuuaaugaacauaaauagauaaaguuuuuuguuuguuuuguuuuguuuuguuuuuaguagagcuuaaaaucuuggcucuuacugugguacaaacccaaaauaagaacaguuuuuggacauuggaauucauuguaauaaggcuguaugugaaugucccucacgucccaaaggauuuuaccuccauaguagauaagcuuagaauuggcaguucugcugcaccaagggaugaauuguaggcacgauuuuuggauacagauuuccugcuacagucaaagcuguuugacuugagggaacagguuacauucauuuaagaaauugugugucaagcagggcagguaccuggaggcgugaacugaagcaggggcuauugaggaguacugcuucauggcuucuucaugcuuucucagucugcuuucuuacacagguaagggccacauacucagugacagugguagcacccacaauggacugcacccuaccacaucaaccaaccaucaagaaaauucucacagacuugcccacgggacaauuugguagggcccuuuucucaauuuuacucuucccaaugacucuaacucuagcccaugucacaucaacauaaagacuauccaggauguuguguaagcacauuaaaucugaacagguauucuuaaaauaguagcacauuauagccagugguauauuuaaaaauacaaauaaaaaauaaaaaauuuaaaaauuaaaaacccaaacacccaaaaugguguguuuauuaagauguucuauccaugaagucauucaucaacuguuucauugaacaaugguucugcuuggaggguggcacagacauuaggugaggguaagauucuaguuccuuggcugugaugauuuugaaaagcauucauuucagaauaagaguaacuuauaaaguccucuucuucaaaauugauacacugauuauaaauaccaagcaaagccuucagucuuacucuuugcuguucucuuacaagccaccucccaaauuaauugucuacauuucuuuuggcuguauaaauaauuuugaaauguguaagcuguucugaaaaccauacuauaguguaaaaacaucaaauaaacaauccuacuaauagagaggcugagauaggagaagcaugauuucaagaccauuauguggcacacaccaagacccugucacguacaaacaagcagaaauuauauauggauuguacaauauuggaccuauuucucccauuaccaaauuagagagaccaugggaugacagcugacaauuuuuuuuguuggguuuuguuuuguuuuguuuguuuguuuuguuuuucgagacaggauuucgcuguauagcccuggcuguccuggaacucacucuguagaucaggcuggccucgaacucagaaaucugccugccucugccucccgagugcuggaauuaaaggcgugcgccaccacgcccggcuacagcugacaaauuucuaauuccucauauuuuugaaucucaaucgauuaggauauguugguaauauuaauuuucauauuaagagauauuaaggaaaagugauuguuucuuccuguuaauuuucuuguuagaaguggaauuauguuuguguggguuuguugaaagaauacuuucuugcuucuucuaggguguaguuucacuccuuguguugguguuuuccaucuauuauccuuuguagggcuggauuuguggaaagauauuguguaaauuugguuuugucauggaauaucuuuguuuucuccaucuaugaugauugagaguuuugcuggguguaguagacugggcuggcauuuguguucucuuagggucuguaugacaucugcaaaggaucuucuagcuuucauagucucuggugagaagucuuauguaauucuaauauguuacuugaccuuuuuccuuauugcuuuuaauauucuuucuuuguuuugugcauuugguguuuugauuauuaugugucgguaggaauuucuuuucuggucgagucuauuuagaguucuguaggcuucuuguauguucaugggcaucucuuucuuuagguuagggaaguuuucuccuauaauuuuauugaaguuauuuacuggcccuuuaaguugggaaucuucacucucuucuauaccuauuauccuuacauuuggucuucucauuguguucuggauucccuggauguuuuggguuaggaguuuuuugcuuuuugcguuuucuuucucuguuguguguuaauguuuucuaugguaucuucugcaucugugauucucucuucuaucucuuguauucuguuggugaugcuugcauguauggcuccugauuucuuuccuagguuuucuaacuccaggguugucucccuuugugauuucuuuauuguucuaguuccguuuuuagauccuggaugguuuuguuccuuuccuucaccuguuugguuguguuuuccuguaacucuuuaaggaauuuuuguuuccucuuuaagggcuucuagcuguuuaccuguguacuccugcauuucuuuaagggaauuauuuauguccuucuuaauguccucuaucaucauaagaagaagugauuuuagaucugaaucuugcuuuuccgguguguugagguaucuagaacuugcuauggugggagaauuggguucugaugauuccagguaaacuugguguauuggcuaguuuugugucaacuugacacagcuggaguuaucacagagaaaggagcuucaguugaggaaaugccuccaugagauccaacuguaaggcauuuucucaauuagugaucaagggggcaaggccccuugugggugggaccaucucugggcugguugucuuggguucuauaagagagcaggcugagcaagccagaaaagaacaucccuccauggccucugcaucagcuccugcuuucugaccugcuugaguuccaguccugcauccuuuggugaucaacagcaguauggaaauguaagccgaauaaacccuuuccuccccaacuugcuucuuggucaugauguuugugcaggaauagaaacccugacuaagacaaauugguaccagcagagugggguauuccugugacaaccugaccauguucuggggaggacuguggaaggacuuuggaacuuugggcuugaagauccauccauuguuaagagcucugucagauguuguguaggagcuuggaagauaauguugagaacacugcagaagauggaggucugguuugugaaauuucagagggaaaauuaaagacucuuuucagggccauugcuguuuugauugugaagauucuguaguucugguuagcuggggcugaagaaucagcugugauuaacaagauaccagaacuacuaaagcaaaaacuuugcauuacugggacuuuugaugcugguuagcuggagcuaagaaauuagcggugauuaagaagagaccagcaucauugaggugacaucuucugggaaguguuuucugagagcacaguggcugcguuccagauauagccaaaguuguaccuugugcucuggcuggacuugguaacguguaagggucacccaggugguacugguuuugaaggcaugaaggaguugagcagagcagcugaggcuuggcacugugagaggccauggaaggccauuggugaaagugcagccucaguugcaauugauggcccaggacugaaggggucaugcaguguuuuggagaugccaguaccaugagaugaccaccaagaggagcagcagcaguggaguagaggcaucuggagccuagaggaugacgcgugugcuacaaagggcauggcuggagaagugacccaagcccuuggaggagcccagaagaucgugaguuggaucccagacauuggacgguuggagauugauuuuugcuuuugauugugacugugcccugauauuuucccucuugaaggaagaaacuguuuuagugaugcccacaguuaagagacuuuuaauuuaaaaagacuuuggauuuuuaaaagagauggauauuuuaaagagauugaaauuuuaagaauauguaaagacugugggacauuuaaaguuauuuagaccuuggggaugaauaagaauguaaggguugaggcuuacuagugauguguuugugugucaaguugacaaggggucagcuguauuggcuaguuuugugucaacuugacacagcuggaguuaucacagagaaaggagcuucaguugaggaaaugccuccaugagauccaacuguaaggcauuuucucaauuagugaucaagggggcaaggccccuugugggugggaccaucucugggcugguugucuuggguucuauaagagagcaggcugagcaagccagaaaagaacaucccuccauggccucugcaucagcuccugcuuucugaccugcuugaguuccaguccugcauccuuuggugaucaacagcaguauggaaauguaagccgaauaaacccuuuccuccccaacuugcuucuuggucaugauguuugugcaggaauagaaacccugacuaagacacuugguuucuguugcuuauguucuuauacuugccucccgccaccugguuaucucuaguguuaccugcccuggcuaugucugacuggagccuguucuuccugugauccugguugugucagaacuccuccaagucaagcugucucugggauccugugauucugggauccugugauccugagaugauccuggugugaucaagcuccugugauccugugauccucugauccagggcauauuagagcgccugugaguggagcugccuauggguguuguggggcuggcugcagaguuugugcccaaggucuacucuauuuuuuuuuuuuucccgagacaggguuuuucuguguaacccuggcuguccuggaacucacucuguagaccaggcuguccuggaacucagaaauccaccugccucugccucccaugugcuggaauuaaaggcgugcgccaucaugguggaucuucuugccucaaccuaaucuaaauaauaugccaucugacaugccuagagacuaaccuaaucuagauaaucauuucacaaaagguuggguacagacaccuguguuugcacaugcuuuuaagguuucuaauaaacugagauuuugcuuaaaauuugaaauagugccuccuaggauaucuggauugaccuaauauauuuuaaaagauuuuuggguuuuuuuuuccucugugugugugugugugugugugugugugugugcauccccauccaaaucuaaggugggacuuaaguuucugguuuaaguuuuuuucuuuugaccgugaguuagauuuggucuggagucuuaaugaaaguaaacaccuucuuuuauuagguuacaugguggagucuuuguuguuguuguuguuuguuuuguuugagggauguuuuaauuuuuuuugccuauauuaguaggucuuacaacuucaagauagguacuauucuugcagguuuugggcucagucaggguuggaaguggggaagaaguuggguuuagaaaagauuaaagagcauaauaaguggccaaaccggaacugaacuguagauccaaacccaaaguuauuucuuauccguguacuauguacaaaguacuguguggaauagauauuaaaccaaccuacgagcuuuucuccuuggccucuuuguucccaguuaaacuacucugaaacuuaauuauuuaugaauaaauaccuaggccauaagcuuuggcuccuuccuugacuagcuuguaacuuauaugacccauuuauucuagucuguauuaccucuucucaguuucauuuguuggucuccuccaaguccagggcaaaaucuccugccucugacuaucuucccagaguuccagucuuccuacuagaacugccaccuucuuucuuuuuuuuuuuuucuuuuaaagauuuauuuauuuauuuauuuauuuauuuauuauacugucgcugucuucagacauaccagaagaggacaucagaucucauuacagaucguugugagccaccaugugguugcugggauuugaacucaagaccuucagaagaacagucugugcucuuaaccgcugaacuaucucuccagccccaagcugccaccuucuacuuccugccuuuuacuagcuggcagugcuuccacaaaguauacaagacauuaucccuaccuauccccgccaccaaaaauuuucuaaaguuuagaauauaaagagaauuuugguuucuuuaaaaaccuaguaugugaacauguuuuugcuuuaaucccaugugugggacaggagggugcuucacagcaggugauuauuauuugccuuguacucuagcaggggcaugucuuugccagcugcaaaaauaguuucugcaagugugugacauggcauucugagaacuuuugagaggguauaaaugccaucccccugagaagagccagaacaccccagaagugggaacuccugcugaacacaaagcuccuaaucagcaggaaguacucuaaauagaucuauggcccuuuccccucuuucuuuuucaccuacauaauauugggacauuggaagggauugguguggagaagggugguagauauaagaacccaauaaaguagcccaaaaaguaugcuuacguuagaauucagagaagguuggaggcauaaacagacagugauguaaguucacaaaguuaaaugcugugggggaaagaaugagcugugagaacacaagaguauuuagggaagauuucaugacuacacaagauaaggcuggaggagucauaaacuaacuauaaaauaaaagauugugccaaacagcuaagaaaacaauguggugcacuugagaaucuaaaagauacaucagaaagauaaaauacaagaauagacaugaaaaagccaggagagggaaguuguauauagcauaggagaguaaauuguguauagcauguuaaggaauagacuuuacagaaagggaaaggaucaagcuauccaugacuuguaaucaaaaagauuggagaacaaauuaacacuagagacacaaggauuuuggaaugaucuagacaguacgugaucaguaguagccaagggaaguaguaauuaauuaguugaggggagaaguuuuguuuuauuuuaacuagauuauagaguuguuugggcaggucuucgugacuaagugacuaaagaagcauggauggaugagaccaaagugccucucaagugucuaagguagaggggagugcuguucucacuauucauagaggauuugugacaaaaauagaguggucuguugugauaggaaaaaugacaagucuuacuuuggacaugauaaauuugaaaauauuggaaaagauuccaauggauguccuguagacaacuuuaccaguuuccaaagagccuuugggugucuggaaaagaguguaggcaucuguuguuaacuggacuugacuuucauaugucagaauaccuaagagaaaucaauuaaaggaagaaagguucauuuugacucacauuuucagagguuuuaguuccugguuagcugcacuagggucaaggugaggcauaacauuaugucauggagcauauggaagagcagagaugcuuacuuuauggcauccaggaaggagaaagaaagagggguguggauggagggaaggaggaaagaaugcagacccaggaacaagauaacuccuucacugacauuuuccuagugaugaccuugaauuaugaauccaucauugaauugauccaagaucuucaagauccagucacacagauuauuaaaaccaaagguaaaaucuuagaacuuugcugccaaguacuaggaggugcuauugauuccucagacuuuucgucuuucccccccacccuaugaagccuguaccugggaaguuuuccaaaugucagaagacugacugucuaagaauagagguaaacaggggcuccuagccauagugggaagagaugaggaaauaagcuagccaauauagaguaaccagaggaugaccuucaggagucuuggucucacugucugcaggguacauccacacuaauacaauacaacuaaaaaagacccacuaaagaaagggguaggauagauuaaaauagcaauaaaagcauccuaaaaaaaauaaguccaguuacuucugaaaacccugucaauuaguaaaugagccuuuugaaacauuucagauucaaaccuuguguuaguguugcaaguguaaaauacucugacagaaacaacuuggggugugaaaggguuuauuuuagcuuacaguuccagguuauaguccaccauagacaucugggugacaaaacuugaagcagcuggucacaucauggucgagagcagagaguggauuuguauguacucauuucccacuuuugccacucuuuaacucucucugcucuuauacuguuaugcucuagguccacaggaaacccacgggagcccaagaauuguaaagucugcugcaacuugcaaaagagucuuuuauuuacaaguucgaacucgguucgcccaccuagcacucacugcgugaaugcuggcaagcgacccugagcccagaaaacauuggguuuacauacgguauaggaauagugugaauacuuacagaaaaggggaguagaggguggaaugaacugaagugggaggggauaaugggugucuguucaaggacuaauuuuauggccagucauaacugucugugaccugaccucugcuuaccuuuuauuuuuccaaacagaaaauggucuucuugagcuuguuaucucucuaaggucucaaggacaggcaccuggaguucuuaucagcaggaguguugguuuuuggagacacagagucuccucauuaugauugauucuaacgcuuggggaggaggagguagcuugggcugcuuggaguggguuggggugggagggucaggggugguaguggaagaaaaugcuuccauaagauugggcuguacacaaaccuguagggaauuuucuuagugauucauggggucuagcccacugugagugguacucccuuggcugguggccuuggguucuauaagaacucuugccacucagagugaauaggucuucccacuucucuuaagauaauccucucacuuccacccccauccccauucccaacuugcuuuaaacauuauuuuauugaaauucacuucccagaugauucuagacgggucaaacuuacaacuaaaacuaaccaucauaagccauaacaacaccuaauauuuuagaugaucugggguuuugccuguuaauuuaaaaaguaaacuuauguuuuuuccaauaaauuauuggaaaaucauugcuugccuaugcaauucuaugaacuuuuaggaguaaacaagcuuauuuuaaaagcaaaauuagagcugggcgugguggcacacgccuuuaaucccagcacuugggaagcagaggcaggcagauuucugaguucgaggccagccuggucuacagagugaguuccaggacagccagggcuacacagagaaacccugucucaaaaaaaaaaacaaaaacaaaaaacaaagacacacacacaaaaaacaaaacaaaaaaagcaaaauuagaauuugcugugucuuuuuuuuaaauuaauuuauuuauuuuugagacauaguuucucuguguaacaguccuggcugcaaaggggugggugagacagauaacccaauuugggauuaaacauuccauggccauuuauuuucugcacuuugacugguugugagccucuauauuaacuguugucuacugcaguaagaaacaucuuuaaugaggcagauuagauacugguaaggguguuggguagcuggucuacagagugaguuccaggacagccagggcuacacagagaaacccugucucaaaaaaaaaaacaaaaacaaaaaacaaagacacacacacaaaaaacaaaacaaaaaaagcaaaauuagaauuugcugugucuuuuuuuuaaauuaauuuauuuauuuuugagacauaguuucucuguguaacaguccuggcugcaaaggggugggugagacagauaacccaauuugggauuaaacauuccauggccauuuauuuucugcacuuugacugguugugagccucuauauuaacuguugucuacugcaguaagaaacaucuuuaaugaggcagauuagauacugguaaggguguuggguagcuggcuacuuagguuaugaccacuguuucuaccacuaaauuauaacucagugguuaacuuguuaaccaauuaauuguuaacuuguuaggauuuaauaguuuuuuuuuuuuuuuuaguaaauguguuuuaacaucuacugggccaaaugcauuuuguguuguugguuuccuuuugauaucaaaaaggaaaagcuuucuaaguuuagugaaaugguaucuguauuauuagaucuaucuagacccauguaucuguaucauggcuuuuugagaaagaagugguaauguuaaauauguaaagcaacugggauucacaggaaugugaggcuuccuguagaacagauuaaaacagauaaauaaacagguucauagagcaaaagggucuuuaacuucaucucaugaccaaccaguuccauuccuagcuguugcugaggguggagagacuaguaaccagaauguuuauagcucaaagcuggacaaugccaauaaaauuuaaugagcuaauuauaauuguggagcuaucucauacacaguauuuaauuuuuaaaagacacaaaagacugcuuuugugauucccucuaugugaaauacuagaagagaugaaucuugaauuagaagcaacugguuagugguuaccuaggcucuaguugggaauugucugaggaaaggaugaucaaaacauuauaguguaaguuauaguguuagguguaaaguugugcacauuuaacaaaacacaacugaaccucuuaugaaaauggauucauuugaauguauuuaaguuauuccuugguuaaauggggggguaauauuuuauguaaaaacugugauaguaucugaaagaaaggauuucuauaauuuucauuuuaagauauguucauauucuacaagaaucuuacaauugcaguaccauccacuuccuucgcaaugcuuccuuuccucacuuaaacugcucuucuauuccugguauuuuguacuucccuccccucuauuacuuuucagauuucacaguauuuuguuucuuauacuuugugugggaucuuuuuuaaaaagagagaccagcuucucuugugcucuaauaauuuaugcuaacacaugccucuuaauaaggucugaguuuggaacucagagcaauccauaaaaaaaaaaaaucugguguuuugaaaaucuucauuuauuaugugugcacauguacaccaugguaugcauguaaaaaucagagaacaacuuucaaggguguucuuuaaaaaaaaagaaaaaggucaguuauauuuggcugaagagauacuucagugguaaagagcacucuuccaaaggaccuggguuugauucccaacauggcagcucacaauuccucuaacucaagucccagggcaucugacacacucuucuggcuucuguucguaccaggcacacacaugguacacaggcauacaugcauacaaaauacccuuauacaugaagugagugauuuaaaccauucucuuuaacugaaaaaagucaauccaugccucuuugccacuccuguuucuccuguguugauuauuucaugcuagcuggcucagaagguuucagccuguuguccgucucugcuucccauuuuacaguagagugcugagauuacagacacaugcugucacaucuggcuuuuuaugugaguuccuauggaauacaagcucuuugcuguuguuuuuguuuuucaauacaggauuucucuguguaauagaccuggcuggccuccucugccuuugucuccccgagggcugggauuaaagguguaugcuaccacacccagcuugaguggcaagaccuuuuacccacuaaaccagugguucuuaaccuugcuaaugcugugacucuacauuuccucauguuguggugacccccccccagccauaaaauuauuuuuguuguuacuguaauuuuacuacuguuauuaaucauaauuaaauauuuuggagauagagguuugccaaggaggucacaacuuguagguugagaaccauugcacuaaaucaucucacucccccacaccaccacuaccaccaccaaauaucucuaaacucuuguuuacaccuggugguuacuuaaaauaaaccacaccuuauauuuauaauaugugaaaugagauggacaucaguaguugcuucuauguguuaaugcaggggugcugauggaaccagacugccaauggugaucuguccugugcuauugaaaaggauauguggauaggugaaaagaggaggaaaaaaagagguauauaaaaauuagaguagucaggguuuagaugauuaaucugacuaaggaaaaggggacaugaagaaacguauuuauauucacuauauggaccaagagcguauuaaaaggaaggaguuggagaacggucaggaauggugauagaagacuuugcaguaauaguaagaguaguaggugggcagaugaagguugugcggcucuagaagcuagaagggagaggauguguaguuauuagaggagugguuuaggaggugauuaccaccuacugcaugaagaaaguaggaaaaugauuaaggaaacugccagaggaaauggguggucaguaauuacaguauccuuuuuuugaacugauaggacauuucaucaucauccugcuaucagauuuaaaauaauuaguguuuucuuucaaaucuuuaacucuuugauaugacuuauucuuuuacauuuuaguuaaguuauuaauauuuccuuaauacuuagacuuuguauuuagauacuuuuguaaauuuauuauacuauuuuugcaauuuaacauauuuugugaauauuaauaauuuuggauaaaauucagccuuaaguauugagguagaacuuuccaaagugauaaucaaaaaggauaauuuaaaguuuguauuggcugggagguugaacacauguuucuuucuguuauuuugugcuguuuucuuaaaacaucuuuugcaggguaagggaagaagauggggugccuuguucaaagcuguccuucagguugaucuguaacugcuauguagaccaggcugaccucaaacucacagagaucgccucccucugccuucugauugcuggaauuaaaagcauguagcauggaccaccacauuggacucaauuguaucuuucuaaaguucccuguacauuaacuaauucucaaauucuuaccuuauugccucugcagauuugauaaugggcugcauuaaaaguaaagaaaacaaaaguccagccauaaaauacacaccggaaaaucuuacagagccuguaagcccaagugccagucauuauggaguggaacaugcuacaguugccccgaccucuuccacaaagggagcaucaguuaauuuuaacagucuuuccaugacacccuuuggaggguccucaggggugacuccuuuuggaggagcgucuuccucauucucaguggugucaaguucauauccuacagguuuaacaggugagauuuaaauggauaguugcagaaaauauaaccuuggccuuuacauacuucagaucuggccacugcuagggaaaaaacaaucuuguuagcagacuucccaaaaugugugugagcaaauaaguucucuaacaaagggcaggcuuuaauuuuugagguaggaucccacuguguacccaccucauccucaaauuuuuaguuuuuucuuuuuuuucuuuuuuuuuuuuuuuuuuguagaacuggaaaucaaaagcaaggccucuaccauaacaugcuaguuaccauaacgugcuaguuaccauaacaugcuaguuaaguguugcccugaagcuuauuucuagcuccggagucuuaauguauauauaggauucugagaaauuugguaauaaugacuauuuaccgaaauucuaccauaaaguguuucauuaacucaguauccaaauaauuauugagcagcuacuauguggcggauacugggaaaacagauauuuaaaagaauccuuuuuuuuccucagcaauuuacuaguuuuugacaacuguaaagugcuaucgagugcucuauuauuuaauaaguguuaauuacacaucaguuuaguaacaguagcacacuguuucuaucagauaguggcuuuauuaauuuacuuauuuugugugcucuuccaugccucauaauauauauguggaagucagaggacaguuugcaggaaucuaccacauugguucugaggauuaucaguguugacagcaagcaccuuuaauaguugagccauuucacugguccagguauggauuuuaaaaaggaaaguccuacaguucauaguuaggguaguuuuccuccagagucacaguugauaagcaacagauuugguacccuaauccagaacuccauuuauaacauugucauuuucuuucagaggauggcaagaagugauaguugcuauggaaucaagaaguccuaaaaguauagacuuuaaaaagaaagaaaauaagauccuuugcccagcaucuuauauaguaggacucuuuucucuugaaauaacaaagcacagcuggcuuaggaaagaaugagcuuugggauucccggaugugagagagagguccgugaugucaggaaggcaugcaguuacuuucaucccuucuuuaaucuuggggugcccuucuuagccuuggguguaaacaacuaccaaggaauggaauggcucaugucuuuauuaaucauuaguggggacuuaagagacuuuuuuuauuggauauuuucuuuauuuacauuucaaauguuaucccucguaccuguaccugguuuccucuccaaaaacucccuucccccauauccucucccucccccugcucaccaacucacccacuccugcuuccuggccuuggcaagauauagcucucuccugaaaggcucugcuagugccuggcauauacagaaguggaugcucacagccguccauuggacugagccuagggucccauaugaaggagcuagagaaaguuuccaaggagcugaagggucugcagccccaaaggaggaacgucauuuuucuccaagcauagacuauaugaacauugcucuuucccagucugcaccucaggagcaguagccagaggacugccauacacugaaucaauuuagauagcauuugaaaagugguagacaucacagucaaucacaguccuaauuucagccucccagcuguaaauacuaaaaguaaucaaagaccaugguucuauuucugauaguuauuaacacaaaccuugaaauuacuugggaaagguaguaauucaaaauggcuagaguaaauaaauguugauauaaaaagacauuuuuuaguuacuuaaagcaauuuuuaaaaauacagcauuuuuauucauugcaaauuucaugcaugcauacaauguauuuugaucauuuucaccucucacaauccaccccacaacucuucccagauucacucccaauacuuaaagcaauuuucuuaugugaaauacuccaagcaguuuucuuaacaugaaguaccucauucauagaugucuauuuaauagcugaaaaaacccaacaacaacagugucuuauacaagguauagagcggugaguaacacaaacaaagcuucugaaccugguggaguuuacauuauaauaguugaauaauaauuagugaauaaacaacuaaacaguaaucaauacuggugcuuaaguauugugauggcaaaaacaagaugauuggugaaggcccuguaguuggcauagaaagccaccuuaggaagaaaucucuugaauugauauuugauugauagauaaaaccuauuuguagagcuaaggaaagaacaaaauaacaaaaauaacaaacacaaaguucaagaaguaaauagacuuggaacuuuugaagaccaguguacacagaugggagucuuguauaagacuagacagacaggacacaguaguuaguacuaaggaccauagacuguaggaaugaguuagaguguuauucaaagcuauaaagaagcuuuuagauuuaaagaaaggauuuuguucucuaaaagcacuauaggggcuauaaagaugggcucagcuauuaagagcacuugaugcucuucuagaggaccauaguuugguucuuaguauccacgucaggcagcucaaaacugcauguaacacccuccuuuggccuccucaguaaccugcauacacauggcuuauauucauauacauagauacuuaaauaaaaguaaaucuugagaaauauuuaaaccucccucuagcagcuuuguggagaauggaugauggugaaggugaguaggaacaguuagaggguaguuucugaugccagcauuccugugagagauggccacaguagaaguggggaaguaaguaaacuguccacuuuagagcuagaacuaauagucuucccuuugcuuagagggaaaugaguugggcaaauagagauuauagaagaaaauccaagagcuucauuuuuuaaaauaaauuuuaaauguucacuagacaguaaaguagacaugucaaauaagcaaguugauugaugacuaaaacugaggggagaagccagccaagugagcugaugcuguguauggauguguccuuacaccugugcuuuucuaucuacuacuugauauuuagaggcagcaaguuuuauaauucauuuuccaugucacaguauuuggacuuaucacuuauuuguaauuuuacuaccugcuuuuucugucucccauuccuuggaaggacugaugucuauaaacuaacaaugaauacaccaagucaguauugaguuguacuagauagaauuuauacauaauugaguuaagacuauguuguucaaaacuggauguaguagcaacacauuuuuaaucccaguacucaggagacaggugcaggcagaucucuaugagcuggauuuaggccuuguccacacagugaggcuuugucucauaaagaauauauucauugauggucaagucuagaaguauagcucacugauagacuaacuuugcauguaggaggcuaaggauuugaaccuuuccuauccuucucaggaaaaguugguaaaacaaauuuugagaggaaacaaauugaagaauucuauuguacaaccuugugacucugcuuaguaacaacaaauugugcugaaaguugguaaaaguagauuuuaaguuuccugcccccuuaaaaaagaugaauauuaugauguagguugauuuaaccauucuguaauuuauguuucaaaacauuuuauuauaauugauaaucucuaucuuuuaaaauugccauaaugaauuuuuaagacugcuuugaaguauuuuaaacagugcaguguuauuuuuauuuuauuuuuaucugcucuguuauucuaauugcaaauaauauauuagauguuaaauauguucaucuuuuaaguauauucacacauugcuagaucugacuauuuuuuugaguuuguaccauauaauucauacuagacauaccuuuaauguuuaagacaaauauaacauuuucaaguauaaagugaaccuuaagaaaaccuuaaugauugcuguuaaugguuauagacagaaguucccuccuguuguggauaaggaauugaagacaagugccaguagucugugugcuuucccuucgaaagaacugaucugcaguguggcugucuuuucaagccagaaauguugcuacuuaagugaaauuacauuuuuuucaguuuauggaauuuuagaacuuaugcaguacaauuguuucacuggaagccuuaagaaaacaucuacucauaucuaacuucuaaaagugaauacuagagcagggaggaaacugagcuuaagcuuuuacuggcaauaguuguuuauuucuucuaugcauucaucauuuaccuuggucuuuuuuccccaugccagguggugucacuauauuuguggccuuguaugauuaugaagcuagaacuacagaagaccuuuccuuuaagaagggugaacgauuucaaauaauuaacaauacguaaguuuuguguguauuuucuuuuuuuuuuuaagauuuauuauuuacuuauuauauguaaguacacuguagcuaucuucagacacuccagaagagggagucagaucucguuacggaugguugugagccacaugugguugcugggauuugaacuccggaccuuuggaagagaguugggugcucuuacccacugagccaucucaccagccccuuguguguauuuucuaagagagaaaccuggucucuacauuggaccacugauggaguugaugauacagagaugcgaguggugggguaugaaucuuugucccuguguuggaugaugcauuugccuugagauacauugcuauaggcagaaguuacuauuuugcaagucauacucauggaguuagucuguaaacaauugagauuuuagaacaaagaguugugggugugaugguauauaucuauaaccccaugacuggagaggcuaagacaagaagaucuucaguuugagguuagucuagguugcauagugaauuccaggucaucaugggcuacauauaugucaaguuccugucuccaaaaugaugcuccuuguaaaaagggaagagaaaucuguaguuauauaaauaucagaugacuuaaaauaccuuaugaggggugcuggauaugggaccuuuuuacucugaaacuuaccaaauugugcuuuuccuauguuacucuuagacuuugucauuuauuggucugccauagaaaauuugaugcuuguuaugcagcagauuuuguaauuucauuagcaagcauagcaaccacucuguaacuucucaaagcacacacuuauggccucucugcuucuagucaucuuucccuccauucuuguuuuaccauguauuaucacuuucuuacuguucuagaauauaaacaugagcugugauugugacucuuugccuuaagagccuucaauagcuaaugauggccauaaagauuuaaaaagagcaaugacaacaauaauaaucacugagaauuugcccuguguuucuauccuuucucauucugccauccagccauaaugaaguauuuacaauuugcaguauuuuguaccuuuuuuauaccucuaccuauacuaauucuuuuucuggaaugacuuuuccuuucuuuuugguggaguggaaggguugcuuguuuaugaugggauagaguccagagccaguguucugucucuaugcuguccugagcccuuguuucuuuccucuuuaaguuagaccuccucauccuuuagaagauaguucucugguuuguuuuuuccacgguuccucugcuugccuuuucucucuccugcugcuauaugcaguguuucucuuaggugguuuacacgauacucuacaaaccucagccauggcuguccucacauuguaaauuaucauuuuuaacuuacuugucauucuuuuagaccagugguucucaacuugaggcagaaugacacagaagguauuuagcagugucuagagauauuuuugguugucacagucagggugggagugugguuacugucaccaggguacaugccagagauauugguuaaauccugcuuaugaacauaauaaagauucaucaacuccaaagugucaguguuaauaccaucaaaauggccaaccacguuccagagucaguucuugagcuuagaacugcuguuggggcugaagagauggcucagcgauuacaagcagcgacuacucuuccagagguccugaguucaauucccagcaaccacauggugccucacaaccaucuguaaugaggauacgauacccucuucuggugugucugaagacaguaacaguguacccacauacauaaaauaaauaaaucuuaaaaaauaaagaacugcuguuuguauugcauuuaguaacagugggugauucagagauugcuaacgaagaucaaauacaaaauuuuaguuuaagucaggacugccacaaguucuauaagccagcaagggcuacagaguaagacuuuguaauuuaguuuucugccuuuauauaugaaaggauuuaacauauucuaggauacuaguaaucaaaguaucuguucgcaaauaguuuaauuaccaaaagcuuucuuaauucacuuuuuaaagagaauaaauucacguagaacauuuuaaaaaguuuuaguuuggacaaugcaugcaaauaguaaaucacauauauaucauuagagauacuuuuuuuguauuauuuuuuauuagguauuuauuucauuuacauuuccaaugcuaucccaaaagccccccacacgcucccccacccacccacucccacuucuuggcccuggcguuccccuguacugaggcagauaaaguuugcacgaccaaugggccucucuuuccaaagauggccgacuaggccaucuucugguacauauucagcuagagacacgagcucuggagggauacuggguaguucauauuguuguuccgccuauaggguugcagaucccuuuagcuccuugguuacuuucucuagcuccucuauugggggcccugugauccauccaauagcugacugacuguaagcauccacuucuguguuugcuaggccccggcauaguuucacaagagacagcuauaucuggguccuuucagcaaaaucuugcuaguguaugcaauggugucagcguuuggaagcugauuaugggauggauccccggauauggcagucucuagaugguccauccuuuugucucagcuccaaacugugucucuguaacuccuuccauggguguuuuguucccaauucuaagaaggggcaaaguguccacacuuuggucuuaguucuucuugaguuucauguguuuagcaaauuagaaauuuuggaaaagccaaggucaauauauuauaaacaauauauaguucucauguuuugaaucauaauauuaaacugauaccaguuuuuggauaacauuuuagaagcauacauguuuguuuuauuugaaucugggucuugcuauauggccgagucuaacuuuaaacucacuguuguccugcuuccaucuccugggugcuggaucauaggcuuaugucaccaccacuagaaacaucaucuuuuaaaaagaaauaguuguuuuacuuauugugagcgaaagaagcagacaaauauuuuuacuuacuauaagagaaaacaaauauacgauacauguguaccaugguauauacguggagaucagaggacaauuuuuggaaguagguuuucuguuuaucccguguaggccugggccuuuuacccacuaaaccauuucuccagcucucaaaauucaacuuugaauuguuauuauucacuguuaaguuuuuugcuuuaagaauguuaagaccuuuguuuuuuguuccuaaagugacuuaaaaaguuauacuuuuauaaguauuugguagcaacaacaaaaaaaccugauauaggcuaaaauauggaugaaccuuaauaauauucuaagacagcagucacaaaaauacuuuauaaauggccccaacuuccaugauaagcauauucauaaaggcuucuuaaagagaauguggggugaggguggggcugugagugacauguuggcaugggcuggcuuuuuucaacauuuauuuauuuauuaguguguauaugggcacauguggaggccagaagacaacuugguguacuugggucucaccuuccuccuuuauacugucucuggggguuaaauguaggguuuuagcuuacguggcaagugaauucuccugcugagcuaucuugcuagcccaggugucuuaguuaggguuuuacugcugugaacagacaccaugaccaaggcaagucaugguguccaaaggcugcuaguggaagacugacuuccaggcaacuagggugaggaucuuaagcccacgcccacagugacacaccuauuccaacaaggcuacaccuccaaauggugccacucccuggcccaagaauauacaaaccaucacauuccacucccuggcccccauagacuuguucaaacacaugagucuaugggagggccauacuuaaauauagcauagugcaaaauguauuuaguccaacuuuuaaaguccucauagucuauaccagucucaacaauguuaaaaguccaaaguucaaggucucuucuugagauucauccaaucacuaacuguaauccccaaagcaagacaggaaaccagcugugcaaacuccaaacucugcaucuccauggcucaugucaaagcagucuucagaucuccgcuccuuuuucaucuuuguugacugcaacaaacugcuuucuucugggcugguuccacucccuguuagcagcuuuccucagcauguauaccauggcucugccauauuuaacaucuuugagucuccaaagcaauuucaacgguaacagcuucuuguuucaaugucugggauuccacuugaucuuuuggacuccuccuaagggcuggcaucacuucuccagcucugcacucuguagcacucuaaacucagguugauccacuccacuauggcugcuguuuuugaucauuccaugguacugacaucuccaauacacuggggcauuccacuccaacuaggcuucaccaauaaccucucauaggcucucuucacagugccaagccucaaauucuuugcaagacccccuaaguccugggccaucaacuacaacugaggcugcaccuucaccaaugaccuuccacggccucucacaagugucagccucagcugcucuucauaaccccuucaugcuuucaaaaccaguaccaccugggugacucuuucccauuaccaaguacagcugcagugggagguccaaccuuggcuaucucuggaacacagcuucuaugugcucgcagaaaacacuucccagaagauuucaucucagugacacugaucucuuuuuaaucaccgcuaauuucuuagcucuagcuagccugcaucaauugucccaguaguuccuuccauucuuaacucuagagccagagccacauggcugaagcugccgaguucugcugcuugcaggaacuagaacaugacccccuuuuacuauuacauuaucacuggcuuuauguuuucaaaauccuuccgugccuaagcuuggcuauccugguacuugaucuggauauugaccuugaacgcagagaucagcaugccugucuuuugggauuaaagguguguaccaccaugccuggaucuaaauuuagcugaguaggaucuugccccaaagucccacucccuuaaucuguuaucuccuagaacacaggauuuugauccauuucacuuccugguacuccuuuaauacucgaaccauguauuuuauauuuuuccuuucuaagcuugcuaugcuuguucaaacuucucuucauaagacuuaaccagagaacaaagucucugcugggcuuuuuugaaacuuccuuugacaaugcaauuaaucugagucucuucaccuuagccuuaggcagacuuuucagacaagggcaaaaaguagccacauucuucaccaaaauaccacaaaaacagucuuuaugccacauucugaaauucuucuccuuugaaaucuccugggccaggucaacacaguucaaauuacucccagcaacaaagucuuccauauuccuacuaggaugacccaguaagccccauuuaaagcauuccacugcuuuccaaauccaaagucccaaaauccacauucuuucaaauaaaagcauggucaggccuaucagcaauaccccacucccugguaccaacuucugucuuaguuaggguuuuacugcugugaacagacaccaugaccaaggcaagucuuauaaaaacaacauuuaauuggggcuggcuuacagguucagagguuaaguccauuaucaucaaggugggagcauggcaguauccaggcaggcaugacgcaggaggagcugagaguucuacaucuucauccaaaggcggcuaguggaaggcugacuuccaggcaacuagggugaggaucuuaagaccacgcccacagugacacaccuacuccaacaaggccacaccuccaaauggcgccacucccuggcccaagaauauacaaaccaucacaccaggguuuuuaagauggugaaauguucuauaaugaauuauuuugaugacugcacaacucugaauauauuaaaauccuuaaauguuauccuuuaaaugggaggggguauuauauaugacaugcaaauaaauuuuauuuaaaauuuaauaaauguauuuauugaacauaguuuuacuaguuuuaguugaaagaacauaaagauaaguagaauucaaggugcaguauuuagggguuuuuuuuguuacuacuguugguuuagaacaguugugcuuugugugaacuuaauugccuuaauucauguaacuggcuuuuaaaaauauuguucauuuaaguucauuucuuagucugauuaauccauaaaaaauccagauuaaaaaauggaaaugguuucugaucuuugcuugagauaagaaauuacaccuuggauaagggucuacauuauggugauuguugguuuuuuguguguugcagggaaggagacuggugggaagcaagaucaauugcuaccggaaagagugguuauaucccuagcaauuacguagugccugcagauuccauucaggcagaagaguauguuauuacuucauauuuuauuaauuauuuugacuuuuaaaaugcuuuaaugcacauucuauguaaccaaacuuuacacacgguuauaugcuagucuuaaacagcuaauguaucauauuaauaaaugcucuuugaaaauuaauaauuaauauucuaucugcucagaaacacacaguaaguaaaucugcauuaaucauuccacauuauauuuaaucucuuuccuuuauuuuucugcuuauuuuaaaaauucauucuuuuguaugccacagacugucuuuucagcuccuugcacagaguauacaguugugcuguuuguuuuuacugauauaagucauaagagugcucuuuuucuccuauuaauuuuguuacucuuuguuuguuuguuuuguuuuguuuuguuuuguuuuugucuucuucaguauucugugaacuuucccacagcagugccugucauuuuugucacuaaacuuuguuaaacugacacagauuuggaauuaccuauaauuuugauaguacauacuugcaucuuacugaauacaggugaucacauuguuuccaaagaguuauuucccugucacugacagauuuuucuaccuguauuuucugucuuuccuuuucuguuuuacuguuuuuuuggcugguaacuagaauuuaagagacauguugaguagauaguacauggaaaaacuaucagaggauauuucccuaguuaauauaucuuuauauuugauuuaauauucauaucuauuuuuacuuuguuauuuuuauauuuauuguuauauuuaauuuacagcuauuccuugucauguuuucugucacacuccauucuuuuuuguuuuuuguuuugacaggguugguccuggcuguccuguaacucacuuuguagaccaggcuggcuguccucgaacucagaaaucugccugccucugcuucccaagugcugggauuaaaggcgugcgccaccaccacacagcuuguuuuuguuuucaagacaggguuucucuguguagccuuggcugucuuagaacuuucucuguagaccaggcuggccucgaacucagagaucuaccuguucugccucucaagugcuggaauuaaguugugcaccccacugccaaacaucauacaccauucuuauugauacauguauguaauuuuuuugacccucaucuuuccaaaucaaaauaucacuaauuuuuuuuagaugguauuuuggcaaaauggggagaaaagaugcggaaagauuacuucugaauccugggaaucagcgagguauuuucuuaguaagagaaagugaaacuacuaaagguaugacuauuauauuaucaugugccuagaauaccuuccccauaguuuggggaagcuggagugacagugccuaucccccucccuccccaggugcuuacucccucucaauccgugauugggaugaggugaggggugacaaugugaagcauuacaagaucagaaaacuugacaaugguggcuacuacaucacgaccagagcucaguuugauacacugcagaagcuggugaagcacuacacagguaagugagcacuucagaggaggaauuaaucccucauguucuguuucgugaagauaagccugucaagcuuuaaucucauuuauauuuacacacauauuuaccuugcacuauguggcuccuauggaugaaacuuaaguugucaggcuugaccacaagcaccagcuuccaaaugaggaacaagacuugcauguugcccaggcaguauagcaggacccugacucagaacaauaaagaaugauaauaccuggaaacuaaauuggauuauaagauugcaugcucauaucagacuauuauugaaauuguuaugucuugcugacacaguauuuacauuggaguuccagaucauaauauauaaaugcuaagauugauuguaacaguaaauuuaaaagugugacagcaaagacuuuauuuauuuauuaaguagcuaaaauuaacuuguaguaguauaaaaaagcuuucucagacccggaauuguagcucagugauaaagugcuuaauuauguguguggaaguucucccccccgcccccccagcacugcaaaaaggaaaaaagcccucagaugccuucuuugauuuucuucuguagacacugaaucuauuaagaccuccuaaaauauaaacccuaccaaauccaauuugaagaugccauuucuuacccaagaaaaaugaacuuauaguaacuauagacauucuugccuuucaaggacuuuugaaaaguguuuuauuuuggagucuuuguguuuuaaauuuuuucguugucauuuagauauguaaaugcaugugagagucuuuaaauaauuaguacuacaagaggggagguuuccauggcaguuauucugugacagcuagcagcaaacaaaauaucaagucagacaacacguuugaaauugauugacuguguuacugagcuggcauuacuuguaauugccuuuguuauaauggauuuaagugguugcuugaugagaaugggaggaaaugugucuugaaacagggagaaguuuuauauaagcaggauacacaaaccaagccauuauguauccugacuggcugucuucagucuccuguauuuaaaauucagucucauaucaacuucuuccgugauuuucagaguuuuacaaauuagucguuauuagaaaugacaacuaauaaugcaucucccuuggggauuacaugaaucuugguggucaaaagaagagcuuuaagcuguggugcaagucuguacucccagcacuuagaaggcuaagacaggaagaaucugaauugaacucucagauacccuauguaccugccaaaaaguagaguggaguuuugaagacagacagacuuguguuugaauguucucauuuaccagcugggaccuugggacaguucucuagcuuuuccaaucucaauuuauaugaaagauuuauauuacauaauaacauaggcauacauacucaguaaauauuagcauaaaauguauuucuaaaguguuucguuuguauauacuucaucauucuucuuauugaaagauucccaugcuauauaucuuuuuagaguaaaacugauaggagacugauuuuaauuuaaugacaagcuuuuuaaaagaacaaauaauaagccagguaugguggcauauaccuuuaauccuagaagcaggugaaucucucucugaguguaguccaggccagccaaggcuacauagugagaucuaucucaaagaucagucaaauaaauaaauaaucauaugauacacacacuaauauucuguuugacuuaaaaaguaauucauuuacaauauacccuguuuaucuaucuagaacaugcugauggauuaugccacaaguuaacaacuguguguccuacugugaaaccccagacucaaggucuggcaaaagaugcuugggaaaucccucgagaaucauugcgacuagaggugaaacuaggucaaggaugcuuuggggaaguguggauggguaagaagccugaacuuuguuguuacuucauuuuguuauggaaucauaaauuaaaauauguacaauauauauuuuauuauguaguauaacuuuuacuguugauugaauuuuggucuaauaguccuugaaauacagauugagaaaguaaaauaaauuguuuuccuaggaacauggaauggaacuacaaaaguagcaaucaaaacacuaaagccagguacaaugaugccagaagcauuccuucaagaagcucagauaaugaaaaagcuaagacacgauaaacuuguuccacucuaugcaguuguuucugaagagcccauuuauauugucaccgaguuuaugucaaaagguacgugcauuguuuguuaaaggauuguguuacgaugaaacaauuuagguuguuuuuuuuuucuuuuagauuuauuuauuuauuauauguaaaaguacacuguagcuguguucagacaccagaagagggcaucagaucucauuacagaugguugugggccaccaugugguugcugggauuugaacucaggaccucuggaagagcaaucaaugcucuuuaacugcugagccaucucuccagcccaguuuuauucuuacuuagauuaaaaaccauacaauauaucuuagucauaucauauucuuucucagauccccauucaauccacccacccaccaaacuuuauauucuuucuuugagaaagacagacagacaaacagacaaaaagucagaaaaaaaaacccacaaaauuaaaaacaaaaacaugaaguucauuuuguauuguucaacuguuccugagcaugcaaccuucccugggguguuuugauauacccagugucucuccguuggaaaagcugauuuuucccuuucucagcaguugucaauugcaaauaggcucuugcuuaggaguugaaccaugugcuuugccuucucugugcuaggauuuugucuaugugaacugugcagguauugugcaugcucucacagucuuugugaguucauauguguaucagauuugcuguuuucauggagucguccaccaccucuugcauagaucccuaagccuugggggaagcgguaugauccauuuagggugucuaacccugaucccauuuagagcucaauguuccaaaaucucuuauccugcacguuguucauuugugccucuuuguguuaauugccaucugcaaaaagucucucugauggugguuccgugaugcacuugucuagggauauagcaguauguugucagggguccuuguguugcuuuguucauuuaacagaauaauuguagauguucccuagggcccaugaucucagagguucauggccucauuaacacugucauauggguucugacuuuugaaaugggccuuuuaaguccaaccaaaagaugauugguuccuuccauaauauucaugucccgauuguaccaaugaguuaccuggcagguagauugcuacuguaacucacaauauucacaguucaaagagcuugauuacuuuucuccuuuaagauuacauuuauuuauguguuuugcauguauauauguaugguugcaugugugcugugacacguguagaagucaaaagacaguuuguauuuagucuugggaucaaagucagguuacuagucuuggcagcagacaccuuuaccuacugagcccucuuaccuccauuuuuauuuccucuauuuuuauacauucagaguuuugucuuucuaacaguacuuucuaacaugauuuuucuguagacguuugaaaagaggaaaugugauaguuuuuuaauagaacaguguuuauuccuaguuaucccacaggaucuuaugagacuugaaaggaaaauuaagcagcuugagucuuuugaaaguagauuuaacuaaaggaaauagauugcuagggcaguagaaaaguugaauuaaagugauaaaccuguaucuauagcacuaaggcaaagacauuagagggaaucauuuuugccucguuuuuauaaauacaguucuuacaggaugucuagaaacucuuuuucucugcugucauuugaaauuucucaucugcccuaacccaggcacaggugggcucuuaccuaacagcuaauuagagccaggggcaaagccaggcaagauugauacuauuucuaggucauuggugcuuuagaauaggagccagcaagugaugaaaugaugcugauuagccugaaucuauccuauuuggauuguaucuauuuuuaaauuuaaauuuuuuacuuuuuugaaucaaacuaguuaguauuuugucaucuucucuacuaguucaccuuagcugaugaaauaguucccucuaguggugauaggggcaucuacccacuauaaauuugcaacagggggcgaaaaucucucuaaaaggacuaaaaauaauugccuauuaauugauaaccaacauauaccuaaaguaccaaaguauaugucuuuuuuggaagguguuugggcugcaaacaacuuccaccuguggcauuugaaugagugcauuaaauaaaauaggacaggaagugauaaaaagacaagaaagacauuuaaaucaagauauuacuaguauaagaagucaaugaagguaaguauaauggaucaucuacauagcucaauuauugacuuuuuaaaauugggagaaaaugcuagaauucuguucuauaacuucauuaauuauuugcaggugagagauuuagaauauaagaaaacaaaaaccuuucugguuuuaaaaugaaguaauuccuuguuuuacuauuuaguuguuuagcaguagacccuuacaacccaucaaagcuuauugccuccugugcuuugucauuauauugcuucacgugcagacagauuuucuuguuguucuugauuucuuuguuguguuuucuccuacugauguggugacacucaaacccagggucuuguauauaauaagaacacgcucuaccacugagcgagccuggccccagcccugcccauaaguucugcucauguuguucucauuccugagaauuuguuucccucucuugaccaguucuaccaauuauacuucccugguccaguguggaauccaucuucaaacccaauauucaauugccauuucucuuuugagucuuuuaaucugaaaccuucuuaugaaaauguguguuuauuuuuuguuguuuuguuuuuauaaaagugugucuugauuuggguuuaucugauauuguaugaucuuaacuaacaguagagagagaacaaucaaaccuuugcugaguuugucauacuuugcuauuccuauagugccaucuccuaacacuaagagcuauauaucagaccaccucuuuguaauuauaacuaccccaggauauucccaguuggcugaaaaaaaaaauauauauauauuuauauauauacaaaacacaaauauacacacacaaaaacuuuuauacacacacuauauauuuuuuuucauauauauauauauauauauauauauauguauauagugugugugugugugugugugugguuugaugauuuauuuuauuuuauuuuauuuugguuuuucaagacaggauuucucuguguagcccuggcuguccuggaacucacucuguagaccaggcuggccucgaacuuagaaauccaccugccucugccucccaagugcuaggauuaaagguaugcaucaccacugccuggcugguuugaugauuuaagguuuuaaagaguauuuacuuccauuuuaauguaauguuugaauuuuucuagaauaucuuucuaucucuuacaggaagcuuguuagauuuccuuaaagaaggagauggaaaguauuugaagcuuccacagcugguugauauggcugcucagguaguugcauauauauguauauauacauacauacauacauacacacacacacacacacacacauauguauauaucaauuuuaauugaaagcauauguuuaaaaugcagaagaaucuuggcauaauguuaaaauuuuguguaaugaaauacuagaauuuuaggagaggaaggaacauuggagauaguuccgugugagcuccuuaguagcagagccaauauuagacugcuauagcucucucagucaggugcugcccugugucguauggccuuugacacauuucauccauaaaugcaaaguuuguauuuacauuucagcagauaaauuuaagaaaauuaagaugggcuggguggaggugacagcacgugcuuuuaauccuagcacucaggaggcagaagcaggccaaacucugacuccaaggccagcauggucugcagaaugaguuuuaggacuauacagagaaacugucuugaaaaaccaaacaaaaagaagaaagagagggaaagacaagaaaacuaagguggaugaagguuauucagaaagaaaaggaaggaaggaaggaaggaaggaaggaaggaaggcagacagacagacagacagacagacuaagguagaggaagguuauuccaaauauuaaaaccugaaagugugcugaaauuuuuuuguuuauucuagucuaagacaagaauucagauaauauacagguaagaauuagucuuuuauacuucugaauuuugguugcaaaguuucuguuaagauggaugcaaguacugcaggcacuuuuauuggcuacaguugaugaacuugcuucugcagcucuuaccuaucaguaagaauccacauauccauaacaucugauaauguagaguaacuucagaggagacaggcauguacaaggcucuuuguucaaggcuauuaggcacuuucucuuggaaaaauggcagaccuuuuuuauuacaagaaacaaacaaaaaaaccuuaaguaaaugacaugggcuuuaugagccacauacaaacucuauuggaccucauuaguuuucacagcccuuuaaaaaaauguuaaagccuuauuuguuuuuuuuuaacuccuuaaggcauaugaaaaugggcuguuggcacaucugacugacgagcuauaauauguugguacuucagcaccuuagauuuguguugguuuuuguuuugucuuaugaugcacuucuucuaaccauugaccagaaaauaggucauagugauauguuggguuuuguuuuuuuuuucuugcaguguuaggauauaaaaauuuagcuuuuuuuugcucuuguucuuuugguuuuuuguuugucuguuuguuuuuucgagacaggguuucucuguguagcccuggcuguccuggaacucacuuuguagaccaggcuggccucgaacucagaaaucugccugacucugccucccgagugcugggauuaaaggcgugcgccaccacacccaguuuuguugcucuuguucuuguugcagagauuuuuguuguuuuuauuguuguguucuagacuauuacugucauuguuuuugagcuacccaguuuuucaacagucucuuuaguuuaacaguaagugucuuuuccccuuugcaucauauauuuugcauuuuuuccucuccuaagaucgcugauggcauggcguauauugaaagaaugaacuauauucaccgagaucuccgagcugcuaauauucuuguaggagaaaaucuuauaugcaaaauagcagauuuuggcuuagcaagauuaauugaagacaaugaauacacggcaagacaagguaaaguaacauacauagaugcuuauaaucuaauguccuaugcuugucuuaauacuacuuugaauacccagagccuuguggaauacaaaaaguucuaguggauagccaggucccugccugcuccugccugugggcugucagguaggaugcagcuucaaaaguccuuuguugugaggcugccuuuuuguccuuuuuguccagcauguaacaugcauguucauguagaccugacacaaaacuaucuguagacuaaaugccucugaguggguguuucucauguagcaaagcagcucucuauguuugaccccuagaaucccugucaucuguaauccuaacauuucuguaggaggggauggaaggugaagguaggagagccauucagaagcuggcaggccagcuaaccugcaguaaguagauuagcaucagaaaugagagacccugucuugacaagguagaaaaaagaaacaacucccuaaaauaguccugucugccguacccaugcuguggcaugaauagccugcacucaaaugcauguacaaaugcacauauauaugcaaaaaaauuuuuuuugaagcuuaaaaauaaaacaauuaaaaauaaguuacaauaaaaacgaauaguucuagauuuuuccagagggcucaaacauugauauuauacauaaaauuauaucugguaacaacacuucagcuuucuaauaguuaauuccugcaaagaacuugacaagauacuuuugcauuauaaauauagcagauaaaaauccuuguuacuuucuuuaggauguuagcaguagauuuuauuuauccuuuaugugugcauguguguuuguguguaugaguauagauacacacaauaagcauuuaaaggucagaagacaaccuugggcaucuucccaucauguuugaaauuuaauuucuuguuucccaguauaaggccaggacuagcugucugcaaacuuccugacauuuucuuguuuccacuuucccucacuguaaaagacuaggauugcaaacacuaguuauagcuuuacaugguucuaggaagccauauucaugcccucaagugcacaagcaccugacccacugagcuggcgccucugucucauuuggcgaguuguuauuuaaacuguugucucagauugaaggugauucccaaucaagcauuauuucuuccuacuccaaggugacagcagcagugucuagaaacaguuuugguuguuccaguuuggggacuacuaucaacaucugauagauaugcugaaacauacagacuaauaaucaaacacagaagauaauuacaugcccagaauagucagcauugccaagguagaaaaaccaugauuuagcuccagguuuggcguuuuuuguuuuuguuuuuuaagacaggcuuucucucuguaaccuugacugucuggaauccacucuauagagcaggcuggcccccaacucuuuuuuuuuuuuuuaagauguauuuauuauauguaaguacacuguagcugucuucagacgcaccagaagagggaaucagaucucguuacggaugguugugagccaccaugugguugcugggauuugaacucaggaucuucagaagagcagucgggugcucuuaccugcugagccaucucaccagcccuggcccccaacucuugagugcugugauuaaauaugccugccaucaucacccaguuagcuccuguuuuuaaaaaguauuuauuuuuauuuuauguguggguguuuugcuugcauguuaugucugugcacagcaugcaugcuguggaagccagaagagggugucagauccucuggaacuggagccacaaauggaaguuagcuguuagguaggugcugaggaucaagccauucccucuagaaaagcagcuagugcucuuaacuucugagucauuucacuuucuccucuacuucuuugcugucucuaccccuauguauacuuaccuccaaguagucauagguuccuguaauccuuacuuagaaaauccuaaccauuuguuuaaggcuaauuuagcugccacucucuaaugaaaccucuucuuauugugacaaaugaaaauugaaugauauuuuccuaauaucuaaaaucuauuuauuuauguuguaaauauauguguguauauauaaucaccucaagcauagacauuaccaauaauuuuauuagcauaaguacacaauuuucuggcagcuuuauuguuuguguacccauaauauaauuaugcuuguguauuauguuugugcacccauaaugcuuguguauuaaaaucauacauuaaauauuuguguaaauuaacaugguguuuuuaaaaugguaauacaaggaagggcuggugagauuguucagcggcaaaugugcuugcuucucaagccuggugaccugaguuugauuuuuggagcccauguaaagguagaaagguagagccaacuccacagcguuguccucugaccuucacacaaguuccauggcacaugcacacaaccaaacacacaacaaagaauaugauagcacaauagaaacuuauccaaagacagcacaaaauacagaaaugauuaugagcaaaagccaguagcuauuagaucuaacagaauaugccuucagacauaauuagguauagccacuggaugucaggugacccugaaguuguugauuuuacaauagaauauauaguaucucaugucucuaaaccuagcacuugugagugagagguggaaggaucaguauucacagucauucuccaauagauagcauguuagagaccagcugacccuuccucaaaaagcucaacaaggagagagagacuuguacaugaaguuuuaauuuuugcucaccucauaucacacacacacacagccgugcaugugagcacaaauaaacaagcaaaaauuaguuacagauuuaguuugauuuagcuaacaauuguaaucccagcuuucaggaggcugagacaggauugugaaaauuuaaggccagccuaagguagguguguguguguguguguguguguguguguguguagauagauacauagauagauagagauagaucaagaucccaugugccuccccccaaaacuugcagauuuuauaaucuacauuucugucuuauuaaaaccucuacuacuguuuuauugaaucauuuucuguucccaccagcaacuuuuuauaucauuaaauaaaagaaaaaaaccagauuuaguguaaaaauuuuaaguuagugcuguuuuccguauauuuuucugcguuugaagacuuaaacacauagaauugggauagugauaaagauuaggccuguguaccuuacauuuacacaaguauucuuuaaaaacacuucaacugucaauauuguuuguaggugcaaaauuuccaaucaaguggacagcuccugaggcugcucuguauggucgauuuacaauaaagucagauguguggucauuuggaauucuacagacagagcugguaacaaaaggaagagugccauauccaggugagcuuguguuuuucuuuaucucuuuaguaucucagcauagguuuuaaugagggauacacucagcaaaaaugugaggaagaaagacuuucuuuuuccccauccccuuuaauuggguguauaguagcucaugagagcuagaauccuuuagcaagcacaagaaguauacccuguauucuucuuuaagauguuuucccaaaaaguccuuuuauauguuguguuccucagaucagaagcauaucuuaaauaucuagguuauauuugcucccccaccccaaguaauauucuuuucuagaagugugacauucuagacucaaaagauuguuuugagaagaaauguuuucucuuuaauaagagggcagggggaaacuacgcuaaaaauuuccucuuuuuuaugucuauauaggugugggagagcaagaagaaauuuuagcuuaguugaaauucagcuauaauugaauauuccugcaaccuguuaccucucaaacauuuccucugaagguagccuaguaguugaggacugugaggauguagaaaaugcagucuucaagaagaauugcuguacugaccuucuguuucaugccauuccuuaacacuugagcuguaguuguagugcuguuguagucucugguccacauccuuucauugugugcugacacauacagcucacuuaauggucacugcucaucacccuguccaauaagauucugcuucugucuuaauccauggucaacuuuuuucuuauuaauuuuuuuucauacaauauauuuuuaacauuuuuccucccauuuuccucaccucucuacccacccaucuuugguuuuuucaccuccauuucaaaaaacaaaaccccacaaaaugaaagucaaaacaaauaaguaaaagaccaauaagaccaaaaaaggaaauacaugccacaccaggccuggcguauaccuuuaauccuagcacucauagagguaggugaaucucuuuaaguucuaggcuagcccaguguacagagcuaguuccagggcagccagagcuacacagaggaacaugucuuggaaaacaauaagaacaacaacaaaagucugcagauauacuaaguucauuuuuguugaguagcuaccccuaaguauauggucauaccccauauaggaaugugguuaauacaccacgugacacuuccuuagggaaaacuaauguuucucguugauaggcuauaaguugcaaauacauaaaugauuagggauuggacaucaugccuaauuuccccuuucagugcuggaaccccauuggguuugaaccuguacagaucuuguguguuacaaaagacugggaguguguacgcacaguccuauuguaucuagaagauaguguuucuuuggcaucaacgaucaccucuaccuuuuacaaucuuucugcuuccacauaggggcugaacguuggggggcuuugaugaagacauccugccuuaguuaugguuuaaauugcugcagugaaacaccauaacuaaaaagcaagcgagggaggauaggguuuauucaacuaacuuccacauugcuguuuaucacuguuaggaacucaaacagagcaggaaccuggaggcaggagcugaugcagaggccaucgaaggguccugcuuacuggcuuguuucacauggcuuguucagccugcuuguuuuuguuuguuuguuuguuuguuuguuuguuuguuuuuuauagaacccaggacuacuaguccaggaauagcaucacccaccauggauuagacucuccccaucuaucacuaauugagaaaaucccuuacagcuggaucuuacagaggcauuuccuccacuaaggcuucuuccucucugaugauuccagcuuguaucaaguugacacacaaaaccagccaguacacaucucauuuaggacuuuuuuuuuuuuaaucucucaaucucugcacauuuucuaguugugggacucuguguuaauucccaucuucugcaagaagaaacuucucugauggcuuaagugaguucucugucugauaugacuuaagacacugaacuauggguauagcaauaugucguuaggaguuuuuacuaugcuccuuuagccaaauaauaauacuuguuucauccaaagguccauuggucaucuaucuuaguuucuuggccacuuuagcagugucagguauagguuccaucucuuagaguaugccuuaaauccuuucagaaagugauugauuauccccauaaccuuuguggcacuauugcaccagucugucuugcaggcagaaugcugcuguagguagcugggugauaacugaugauuucucuuccagugcgugcagaauaccaggaacgcccaucaguagucauaaaucuuuguaucaggcaccagcucaccuuuaaaacuguggucugugucauuaguaaauguugccuuuagcaauagguccuuaccaucagguuguggagaacaaccaauaaccuuggcaguagccugugauguuugacagugggguuuucacugggaccccuuuagcaaacaucaacaagacauuucugacacugguaguuuuucuuggcaguacaccaugucuaguugagacauggucuccccuaauauuuggugacuaaauucuuaacauauaugaaaacuuuauuuccacauauguaaagaaauaugauuuuuuuaaaaauccaaaaauauacacuggagaaaaaacagcaucuucaggcuaaugguacuguucagaccagauggcuccauguagaagaauccaaauauauauacacacacacacacacacagagauauauuucccugcacaaaauuucucaugggucaaggaccucaacagacauaugaagcaguaauuaugaaggacuugcuuacccugucuugcuagaauuuggcagucaacuucccuguauuuguuuguccuuucuggacaguauuuugucuauauuugaagcauaagcauuuucuuagcccaguggcuagcuuaccacaauugaagcaacuccauaugaaaguuauucauaccuaccaucuucuuugaaguggaguggggguacugucaggagcagaccugucucauugucgaaaagauauuuaauuaacaaaacaucuuuaaaugucauauucgguggaucucugagguuuuaaaaacuaauuaucuauagcauaucugaauuguccaaacacuguuuauuuuuaacuauuuacugucugaauaaccuugcaaacaucucacuauaauuaacuaaacuaguaucuaauaugaacauaaguuuggcugacuauuguaguuuuauuucucucaguuuguaauagcagcuuuaaaaggucuaaaacuugacauuguaucuucaaggcacaauuuuucacauaaaaauugaaaacauauauaccuauauguaucaaauucaccuuaaauuuguaucacuauacaauaaccuauaccaauguaucaaaaauaacuuaggaauuuuauguaucuauacaaaauucugugucaguauaccaaguauagccucaauucugcauccaauuauaaagacuauaccaauguaagauaauggcuauaaaaugauucaaaauuccaacccuuuuuuuucuuuguuauuccuauaaucuuauguuccccccaccccucuuucuucuuaaccuccuuucccuuaccuaagaaagaagaaugaaggaaagugucuuaguuaggguuuuacugcugugaacagacaccaugaccaaggcaagucuuauaaaaaacaacauuuacuuggggcuggcuuacagguucagagguucaguccauuaucaucagggugggagcauggcaguauccaggcaggcauggcgcaggaggagcugagaguucuaugucuucauccaaaggcugcuaguggaagacugacuuccaggcaacuagggugaggauuuuauacccacacccacagugacacacccauuccaaccaggucacaccuauuccaauaaggccacaccuucagauggugccacucccugguccaaggauauacaaaccaucacagaaagggaagaaagaaauccuugaguuuaaguucuuaaacuuuacuuucaccugucuaagacuauaacuauuuguaaccugccccuauugaaagacaagaaaaugggcgggagggacugcucagcaguuaaucccagcacacgggaggcagaggcaggcggauuucugaguucgaggccagccuggucuacagagugaguuccaggacagccagagcuacacagagaaacccugucuugaaaaacaaauaaacaaacaaacaaaaaagacuacucuuuugaagguccugaguucaaaucccagaaaccacaugguggcucacaaccaucuguaaugggaucugauguguuuuucuggugugucugaagacagcuacaguguacauacauaaaauaaauaaaaucuuuuuuaaaaguaacaaaauuuccaauaccuugguuaggcuuuucucucaacuagcucauaccuuaaaauaacccauuuagucuaauauacauucugccacauggcuguuuaccugucacaucuuuccgagcaaaucucccaugucuggcaccaucucagaauccuuccugccucucagaugacccagcuccuauuaccugccuaagcuauaggccaucagauuuuuauugacaguugccacauccauauagacacgauauucuuucuacagauacccugaaucugauagaauaaaaaguagugaaaaggcuugaacucauuaguacagaaaaagacuuugugagcagggcaccaguagcauaggcccuaagaacaacuguuaauacgugcagacuugugaaucugaaaagcuucuguacagcaaggacacagcagucauuuuaauacauauaucaaagggucuucugaucucucauggcuugagcacuuuccguuugugauccugucauuuuucauaccuucaaccuuaacaauaccaauaccauuaccacaguuucaugugccccuuaucugacuccuaccuugaaucuuuccagccuucucugcuccagccuuagcaauuucuugauacuacuaagcucuuuaaugcauuggcagcaacuuugccagacccucaucuucuucacaaaacccccucaguuccuuaaacugcacagucaagcaguaugaucacccccugaguuuauuuuguccugucauucuuuauuuuuuauuguaguuuuacaugucuuuauauuuuccuuuuuugaauaucauaauuuuuuauuagauauuuucuucauuuacauuucuaaugcuauccccaaagcccccuauaccuuccccacucccugcuuaccaacccgcccacuucugcuuccuggcccuggcauuccccuguacuggggcauaugaacuucggaauacaaaggagccucucuucccagugauggccgacauaugcauaugcuacauaugcagcuagagacacagcucuggggguacugguuaguucauauuguuguuccuccuauaggguugcagaccccuuuagcuucuuggguacuuucucuagcuccuucauuaggggcccuguguucuauccaauagaugacugugagcauccacuucgguauuugccaggcacuggcauagccucacaagagaacuauaucaggguccugucagcaaaaucuuucugguauaugcaauagugucuggguuuggugauuguauaugggauggauccccagguggggcagucucuggauggucuuuccuuccgucuuugucucuguaacuccuuccauggguauuuuguuccccauucuaagaaggagcgaaaguauccacacuuuggucuuccuuccugaguuucauguguuuugcaaauuguaucuuggauauucuaaguuucugggcuaauauccgcuuaucagugagugcauaucauguguguucuuuugugaucagguuaccucacucaggaugguauccuccagauccauccacuugccgaggaauuucauaaauucauucuuuuuaauagcugaguaguacuccauuguguaaaugugccacauuuucuguauccauuccucuguugaggggcaucuggguucuuuucagcuuguggcuauuauaaauaaggcugcuaugaacauaguggagcauguguccuuauuacaaguuggaacaucuucuggguauaugcccaggagagguauugcuggacuuauguccaauuuucugaggaaccgccagacugauuuccagagugguugucccagcuugcaauccuaccaacaauggaagaguauccuucuuucucuacauccucgccagcaucugcugucacaugaauuuuuuauuuuagccauucugacuagugugagguggaaucucaguguuguuuugauuugcauuucccugaugauuaaggauguugaacauuuuuucaggugcuucucagccauucgguauuccuugguuaaaaauuccuuguuuagcucuguaccccauuuuuuaauagggcuauuugauauuucuagaguccaucuucuugaguucuuuauauauauuggauauuaguccccuaucugauuuaggauugguaaagaucuuuucccaaucuguugguggccuuuuugucuuauugacagugucuuuugccuuacagaagcuuugcaauuuuaugaggucucauuugucaauucucgaucuuacagcacaagccauugcuguucugaucaggaauuuucccuugugcccauaucuucgaggcuuuuccccacuuucaccucuauaaguuucagugucucugguuuuauguggaauuccuugauccacuuagacuugaccucaguacaaggagauaagaaugcaucaauuugcauucuucuaugaauuguugugccagcaccauuuguugaaaaugcugucuuuuuuccacuggaugguuuuugcucccuugucaaagaucaagugaccauagguguguggguucauuucugggucuucaauucuauucccuugaucuaccugucuguggcuguaccaguaccaugcaguuuuuaucacaauugcucuguagcacagcuuuaggucagggauggugauuccaccagagauucuuuuauccuugagaagaguuuuugcuauccuagguuuuuuguuauuccaaacguauuugcaaauugcccauucuaauucguugaagaauugagcuggaauuuugauggggauugcauugaaucuguagauugcuuucggcaagauagccauuuugacaauauugauccugccaauccaugagaaugggagaucuuuccaucuucugacaucuucuuugauuucuuucuucagagacuugaaauucuuauaauacagaucuuuaacuugcuuaguuagagucacaccaagguauuuuauauuauuuuugacuauuguggaggguguuguuucccuaauuucuuucucagccuguuuauccuuuguguagagaaaggccacugauuuguuugaguuaauuuuauauccagcuacuucauugaagcuguuuaucaggcuuaggaguucucugguagaauuuuuaggaucacuuauauauacuaucauaugaucugcaaauagugauauuuugacuucuuccuuuccaauuuguauccccuugaccuccuuuuguugucuaauugcucugacuaggacuucaaguacuauauugaauagguauggaaaaacagaacagccuugucuagucccugauuuuagugggauugcuuccagcuucucuccauuuacuuugauguuugcuacugguuuucuguagauugcuuugauuauguuuagguaugggccuugaauuccugaucuuuccaauacuuuuaucaugaauggguguuggauuuugucaaaugcuuucucagcaucuaaugagaugaucaugugguuuuugucuuugaguuuguuuauauaguggauuaaguugauggauuuccauauauuaaaccaucccugcauccuuggaaugaagccuacuugaucaugauggaugaucauuuugauguguucuuagauuugguuagcgagaauuuuauugaguauuuuugcaucgauauucauaagggaaauuggucugaaguucccuauugucuuagucaggguuucuauuccugcacaaacaucaugaccaagaagcaaguuggggaggaaaggguuuauucagcuuacacuuccauacugcuguucaucaccaaagaagucaggacuggaacucaagcagguaggaaagcaggagcugaugcagaggccauggagggauguucuuuacuggcuugccuccccuggauugcacagccaggacuaccagcccagagauggucccacccacaaggggccuuucccccuugaucacuaauuggaaagugccuuacaguuggaucucauggaggcauuuccucaacugaagcuccuuucucugugauaacuccaacugugacaaguugacacaaaacuagccaguacaccuaucuuuguugggucuuuaugugguuuagguaucagaguaauuguggcuucauagaaugaauuggguagauaccuucuguuucuauuuuguggaauaguuugaggagaacuauuggaaggucugauagaacucugcacuaaacccaugugguccugggcuuuuuuguuuugguugggagacuauuaaugacugcuucuauuucuuuuagggauaugggacuguuuaggucauuaaucugauccugauuuaacuuugguacgugguaucugucuagaaaguugucuauuucauccagguuuuccaguuuuguugaauauagccuuuuguaguaggaucuggugguguuuuggauuuccucagguucuguuguuaugucucccuuuucuguuuucauuucugauuuuguuaauuaggauacucucccugugcccucuagugaguuuggcuaaggguuuaucuauccuguugauuuucucaaaggaccagcuucugguuugguugauucuuugaauaguucuuuuuguuuccacuugguugauuucagcccugaguaugauuauuuccugcugucuacuccucuugggugaauuugcuuccuuuuguucuagggcuuucaggugugcugucaagcugcuaguguauguucucucuaguuucucuuuggaggcacuccagagcuaugaguuuuccucuuaggaaugcuuucauugugucucauaaguuuggguauguuguggcuucauuuucauuaaacucuaaaaagucuuuaauuucuuucuuuauuucuuccuugaccaagguaucauugaguagaguguucuucagcuuccaugugaauguugacuuucuauuauuuauguuguuauugaagaucagcuuuaguccauggugaucagauaggaugcaugggauaauuuccauauuuuuguaucuguugaggccuguuuugugaccaauuauauggucgauuuuggagaagguaccaugaggugcugagaagaagguauauccuuuuguuuuaggauaaaguguucuguagauaucuguuaaauccauuucuuucauaacuucuguuaguuucaaugugucucuguuuaguuucuguuuccaggaucuguccauugaugagugugggguguugaagucucccacuauuauuguaugaagugcagugugcgcuuugagcuuuacuauaguuuccuuaaugaauguggaugcccuugcauuugaagcauagauauucagaauugagaguucaucuuggaagauuuuaucuuugaugaguaugaagugccccuccuuaucuuuuuugauaacuuuggguuaggagucgauuauuugauauuagaauggcuacuccagcuuguuucuucggaccauuugcuuggaaaauuguuuuccagccuuuuacacugagguaguaucugucuuugucccugagguggguucccaguaugcagcaaaauguuggguccuguuuguguagccagucuguuaguguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaaguccggauuguaguucauuccaaauauugucaaguugacaaccaggaauagccacuacaauccaccccuugucaacuugacacaaauaauaucucauguucacaugaaacaauaacaagguuguaaauacgccuaacaugauauaacuaucccucguacaaucgcaaacgcauuaguaaauuuacaaugggcauucauauuacuuuauaauccucguuucugcaacugguuacguggccuuaauugguauuuauaacuaccuuccucuacuacccauucuguauuuccuucaccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccugcacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaaugaaauguuuguuguagcuccugguaggagcacuccccucucuggagccaaaacuucuaagccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauauacugccuucugaagaacucugccccagccuuccaagcuguuaccagcuaauuggcacuguaacugcgucuucaaaaggccauuccaucuuucuaucagcccagcugcuucaggaugauggggaaugugguaagaccagugaauuccaugaucgugagcccacugucguacuucucuggcugugaaaugaguuccuuggucagaagcaauacuguguggaauaccaugacgauagaugaggcauucugucaguccgugaauggugguuuuagcagaggcauuacgugcaggaaaggcagauccauaaccagaauaaguaucuacuccaguaagaacaaaacgcuguccuuuccacgaaggaagugguccaauguagucaaccugccaccagguugcuggcuggucaccucgaggaauggugccauaucuggggcucaguguugguuucugcuguuggcagaucuggcaaucagcagcagcuguagccaggucagccuuggugaguggaagcccauguugcugagcccaagcauaaccuccaucucgaccaccauggccacuuuguucaugugcccauugagcaaugacagggauggcuggggagagaggcugauuguccacagaacgggucaucuuauccacuugauuauugaacuccuccucagcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugagucaguguauaaucguacaucuggccauuucuucuugcaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucagucgaucauagggaacaccccaugaggcuauaggcacauguuuggcagcagauggcauuguaacaggaauagaaaccauaggcauuugagcaacuucuucauguaacuugcuugugccuucaggaccugcucuggcccgaucacguauauaccacuuccauuugauaauagacugcugcugugcacgucccacuuuaugacuugcagggucugauaguacccagcucaugauggguaguucaggucgcauagugacuugguguccuauugucagacguucaguuuccacuaaggcccaauagcaggccaagagcuguuuuucaaagggagaauaguugucugcagaugaugguagagcuuugcuccaaaaucccaaaggccuuuucugugauucaccuacaggggccugccagaggcuccaaacagcaucucuaucagccacagacaccucaaguaccaucggaucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauagacccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaaggaaacuacaucugguacagcagcugcaauuggaguuacuaccugauuuaguuuucgguaaucaacugucauucuccaugauccaucuguuuucugcacuggccagauaggagaguuaaauggagauguggugggaaccaccaccccugcaucuuucaaguccuugauaguggcaguaauuucugcaauuccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucagaggaaccuggccaccccuucauucaagggguuccggaucugcaaacugucucaagucuggaaauugauucacuggccgagauugcuguuuaccacgaucuaauguagccuuucuuucauuuguuugagaauuuuucugcuuauacagaucaaacaaauaugcaguaggcuuccuauguauuucauuccuggaaacaccaugauugauuagccaguaccaaagguccaagcgagucaugccauuauaaauuucaccucuccugugcugaccauuacuggguauguuauuauaaacauucuuuugucuacgcuguccauuauaauaacuaggaucaccuugucuccggcgauucaaugcugccaccuggcccuuguuaccucgggauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccacggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagugaauuuccucauggacuauacuuucuaccuccccucuaggagccuguuuugcuuugagucugguuacaggucuagaagaaacuauuggugggccgugagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccgucccauguuguaggaucccauucuuugccaauuagagcccuuacuuuaacugucgacacacucugaggcugagacuugaauuuucucuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauauuugaaagugcugguggaucaacaagccaauuccaguauuuuaaaagauucauccuuguacuucuguuacucuagaaccacuccugguaccaacuucuguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaaguccggauuguaguucauuccaaauauugucaaguugacaaccaggaauagccacuacaguuagucuaugucuuuuuauuggggaauugaguccauugauauucagagauguuaaggaaaaguaauuguugcuuccuguuauuuuuauuguuagaguugggauucuguucuuguggcugucuuuuuuuuuuagguuuguugaaggauuacuuucuugcuuuggaugguuuuguacaauuccauuaccuauuugguuguguuuucuuguaauucuuuaagggauuuuuguguuuccucuuuaaggucuucuacauguuuagcaguguuuuccucuaauuccuugagggauuuuugugcuuccucuuuaagggcuccuaccuguuuagcaguguucuccuguauuuuuuuaagugaguuauuaaugcccuucuuaaaauccucuaccagcuucaugagauaugauuuuagaucugaaucuugcuuuugggguguguugggguauccagaacucgccguggugggcauacugguuucugauggugaccaguagucuugguuucuuuuagcaagauucuuucguuugccuuuugccaucuaguaaucuucaguguuagauguucuagcugucucugacuggagcuuguuccugcugugauucuuuagccucugucagcucuccugggaguccaacucucuccugagucccaguggucagagcacucucugcaggcaagcucuccucuugcagggaaggugcacagaagucaggagcucagauccaccuccugauuccuggggucagagcccucgcuggaggccgacucuccucugacagagaagguguccuggggucugggucucagcucugucuccugacugaggaugaaagcccgaagggacccuguccaagaagcucuguugcuucugcugcccaugugcucuccugcauagacuggucucagugaucccaagauucugggugugcuagagccugccuuuguccuuuaucccuguuccugcaccagaccuucugcguuuugggaauggauguguguuucacucaccagugaucucaagaccccagaugugcuauggugccugcagcauggagaguccucuggggaccuuggggcccucugccgagauugugccuaagauccuauuuuauugcuaccuaacacaaucauaaugcuggauaaaaucuacuucugcccucaauauacuaguaaauauagccagaggggggaaaacacuuaaauuaaggaauuucacuuugcgguuuuagucauggucuacuuuccauuuuggccacaauagacaaucuaaaaucugcuaucuugcuacaaacaacuagagauuuaaacagauccauaauccaguuuuguuuggguuuuuuuuuuuauuucauggugaucaaggaagcuuccuuuuuuuaaaaaaugaguccuauauuuauauaacauuucuccccaauauuuucuaagugagcauacugauggaagucaaaacaaagacaucaguuuuuguuuucuucaauguuuuuuuuuuauuuguuuuaacugaccaaaggagaaagaagucuaaggaggaaucugugagaauggagcugauaaauaaggagacuaaacucucauuaaauagccaaccuuauucagcaccucaaacaguuuguacucugaggguuaagaaaggucacaugaguaaaguucucaugaguucaagcuguguaaaauucccauagaggcauaaagaggauaguuuuagcaucuaauugauuuacaaccacaaacuaaugaacuaucugaaguaaacucaaguccuaugcuacaccuaggaggagcacaaaaacacauuccaauaauaauuucauguuuuucaagaaacuuaggucacaagacuuguuuucuuagaauguucucauaagcacucagaauucuccucacaugacacuauuccuggacuauguuucucaacagugcucuaguagaagaggcaaaauuaaacaaaaccugaagccaggucuugccaaggaagaaccaggugauuugacaguacauuuacuguuaaaaccgaauguccuguagaaaaacaaauccacuguguguaauucagaaugucaacguugucagaaauaguaucugcucaggacccccacaaucagguucucagcacaaaggagauuuguuugccuccgugggagagggcagugaauaagagacagacgagagauagaggacaaggagaaggggaggggagagggagagaggcguauuugcccuggaggacaaaggacugccucuggauagagacagauguggccccuuaggcaaauggaggcuuauaaagguagagggggaaauuccauguaagaauaagguauuuaauuuuaauuggguguauucauuaggugagccaaaggaagcuuuuuuuuuuuguuuuuuuuuuuuuuguuuuguggcuuuuucgagacaggguuucucuguauaguccuggcuguccuggaacucacuuuguagaccaggcuggccucaaacucagaaauccgccuaccucugccuccugagucaaaggagacuuuugauugcuagacuucaauacuuugauagcugggccuuaguggucagcuucaggaggaggaaguggccaaauaaaggaagagaccuuaguggccagcuuuagguauguagucuaaugguuuuuagagaaagacaaagccuaccagagccaugcccaccaugcucaagcuggucagagucccuucaaacauaaaauaggucuauuggugcaaaauuuuauauucuguagaagaaaaauaaagucacaauuauuuauugcggugguucucaacuuuccuaaugacccuuuaauacagaauucucauguugaggugacccuaaaccauaaaauuauuuuuguugcuacuucauaacucuaaguuugcuauuguuaugaauuguaauauaaauauuugauauggaggaucucuugguauaugacccuugugaaagagcuguuuaacccuccaaagagguuguagcccacagguugaaaaccgcugauuuagugggaggaggaaagagccguuuuaguuacugugaaaugacagugugaccaaggcaacucuuaaaagggaagcacuuaacuggggaguugcuuucaguuuuagaggguuaguccaggguccccagggcagggagcauacagaccuggcaaggaagcaguaguugagagcauuauauccugaugagcaagcaucaagcagagaaagagaaagaaacauuaguccuggcauugccuuuaaaaccucaaagcauaguccuagugacacaccuccaacaaugccuaauccuaaggccacacaauucaguuaacuggugacuaagcauauuugaggucauucucauucaaaugcccauaaaccugguauaguuuugugugcuuuaaucccaguacuugagaaggaaaaacagguggaucuuugugaguuccaaaccaacagacaacaaaguaagaccauaucuccucuaggagacccuaaagccugccuacauggugacacacuuccuccaacaagaccacacauauuccaacaaggccacaccuccuaauagugccacuucccaugggccaagcauauucaaaccaccacagucauauuaaaauacagauuauuauuuaacauuucuuuauauuaauugauaugccuuuuuacaagauaaacuugauguuucuucagcuacuagcuaggauguuuacucucuuuugguauuuauggccaagacuguuguuuuuaauauuugaaucuuaacauuagguaugguaaaccgugaaguauuggaacaaguagagcggggauacagaaugccuugcccccagggcugucccgaaucccuccaugaauugaugaaucuuugcuggaagaaggauccugaugaaagaccaacauuugaauauauucaguccuucuuggaagacuacuucacugcuacagagccacaguaccaaccaggagaaaauuuauaauccaaguaaccugugugcacagaucugccaaaacagagagaccuugugugaguucuuccugcacagaaaugagaagauaugcuucacucggcauguuucuuaugguaaacuggaauuccagauacgguuacucaaaaccacuuuuuuuuucuccaagcauuaaacucuaaaguaccaaugaugcaucuuacagcauacuucaggguccagagaaaguagagcuagagagugugauuguggguguagcaugguaagaaagagcaacaggacuacuggucauugccuuuucuuccccaaacuugccaagagaaaacuacuucuugguauguauaaaacuuggcuguuacuccacaggaaaauucuaagaucaaagaacuucaugggaccaaauaauuccauuccaguuuuuuaaauuuucuagaauuuuuuuucucaaaguuuuuuuuuguuuguuuuguucuguuuuuucccuguuuaauagucaacaugcacuccuaucagaggccuccuuuugugugaaaaugggccaagucuuccaaaugcaaaggaauggauuauaaacagcaucaaaaacauugauuuaaaaagccauggaaguuagaagcauaauacaguaugcucacacuuuguccagagaacuggaaagcaaaacaaauuuuucauaucagucaugucuuaaauuguucagcuuugaauaaugaagguaaccagaaaguggauuaaucuuuuuacaaggguguauuaauuuuuaaaggguuauauacaauugaaauuauucuauccaguccaagagaaaaaucuuuuaauauuugcauagcauaaaaauaaaaaacaaaccuaacauuuaagcagucaauuuuuaaacaauaaguggaguacuaugagguguugcuaguauguuuuuaugauuaugggcuccacaaauagaaaacaucacuagaucagggacuugaaugcacuuugcuuauauugaguauagaauaggagagaagaaaauguauuuaaagaaauaugagagacgacaugugaaaguucuacagguauugggauggggugggaugucuaauguugguguuguagagaaacaacauggcuuucuggcacucaaaacuccucauuagcuguuuucuuauaccuuaaaaguuuuaaaguaugauuguaaaacuaauuuucuuaucauauacacuguuuuaucuccucaaaauagugaggauaaggcucuacccuaauuucaguggcccagcuuuuauacagaaccucuuagaacaccaaguuucaaaucccuguuggaaacuuuacuuacauuacaacuauacuugaugguuaucauauuuuccuuuuauaauuaauuugaggaaaaauacuuacugaguaacuguaauauaaaggggggauuuugcccauuuaaaguacagguguaaagcauuuaaaaugagaguuuuucuaacucagaaauuaugaaauauuaauuugaacugaguaguauuaacaguuuaaggaucuagcaagaggaaaauggagucugcuaaaagucuaauauuuauguuuuaaaauauauuauuuuauaguuauacuuuaaggcauuauaucaaguucuuuuuauuuucagaauauaauuuugaacuaccaucaguaaauguaaaaaugugugccaugguaaacauguucaaauuuuaaaugugacaagugaacuucaugcaaauuggcaaaaguucugguacuaaaaguuguauuuguuuuucuuuuacuuaaccuauucaguacugacuccucugccaagagggucuccugagaagacuggguccucuugcccugaugucuacucugugacaugaguguuuuaaagggcuucaugugaacuaugguauuauaguguauguaagcauucauuaaaggguaauaaaauauguuuauguacuaaagcugaucagaaaaauaaggcagaaaaauugauggcauucuuuagauuuuaacuaaauggagcagcuccuuauaauacaaauuguauaguaaggauacaacacuaauuaauauguuuucaguuuaauuuguuauguauuuuuuaauuaucaagaaaaagaaacaguuuuguacauuugaggauuuuuuuuucaacagcuuucaucuguauugucuuaacguggaacuuuaacacaccagaaacgaaaguuguuaaaagcagccuucuagcacaaacacuuuuuuaaguaaauaaugguagccuaaaacuuaauauuuuuauaaaauauuguaauauuguuuuaugaauuauuaaaauaaaauucuuuguugaaugca

SEQ ID NO: 12096 - RNA, 37724 nt, Mus musculus
cccaagauggcggugcaggagucggcggcccagcuguccaugacccugaaggugcaggaguacccgacccucaaggugcguucuaggcgcggcuagggucgccaccgcaucuugggaggggucgugguggugcaggggcugggucgcugccggagucgcuucuggagggacugcacggccgggggcggggucgggggcgguggggcugcggcucuccagcgcgaugggcacgggccggggccucccgauggggccaagggggaccucucgguguacugugaccuagguggugcggggcgacagagucagagggcuuccgaggcccgggcggcggggccugagcccugccucccacccagccuucaaagccgagaggcugcgggccgugcgagugcgggcagcgaggccacggccggggcggcgggcacuaaagaaccaggggcccuggacgcggaggugggucgcggcggccccggggcguccuuccggaagcucggccuggggcguggcgggcaugccucuggugcuaauuagggggccaguggggagcacuggcgacccgguggcaccccgccucgcugggcguccccagaacuccagcgcagcuccugcccuugguuuccggggcgugaccuuggguggucgcugcgccagugcguuccuuuaggacaaacguucauccccgccggaagacugggaggcuucaguugcuagagggcuugaugguaccggauggacugcggugaaguaccugggaagaaaagccuuaagaggaagaaaaaaauucuuugguuccaaggaaggccggcagagccuucguguucuacauuccuuggcugaggucugggcagcuuuucuucuggagcucuuggcaccucauccaucucuuuggugacccagugguuguuugguggugggugggugggucguuuagcuaagguugaagacuacagguucuaggcgagaccgcuuuuucugugcuuagggagacccagauuguaugggaggcaccugacuucugcugguguucccuugucugauguaagcccuagggagcacuuguuuuccuccccgagggugaagugagcgagcuuauauugcacauggaagucuuggcauucccuggaaggcaucucuugucauugucccugugacaucugacugcucuggaguaguuugucuucacaggagggcagaagcaaggcccagcuggccuucuucuauaguuggugagcagccauauuugaucaauguuuuguauccugugcuuuauuugacuaaggaagggagcaaacaccaccagucuuuuuugucagauguucaaaauguauggcuugggggaguaggagguacuugugacagaccucggucuuguacgugcuaggccaaugcucugcuacugagcuacauccucaggccuuguuuucuuucuuucuuuucuuuucuuuucuuuucuuuucuuuuuuuuuuuuuuuuuuuuuuuuuuugaggcaggcuucuguaggccaugaauccgagugcugggauuacaggugacucuuaccaauccuguaguuuccuggcacucuuggauuucuguugauugacagauggaaacccugacucuuaacaguggucauacuuggggccuucuaucacuagaccuguaaccacugacgucugggccucgccaggacuuccagaccuguugcaaugagguugcuuugggagaacguggcuauuuguucuggcuggugaauuugggacccacagacaggaaagguuucagagcucccucccucucuggcuuacugaacgcauuaggcagugaaauggauggucaggguuccuccaguccguccucuggugaccaggaaugcacucugcauuccaaagcuauugcacagcucugacgaaaacgauucuguggaucucugugcagguacagagaggugguggugucauggaaacagaaucacaccuuuucuuuucuuuuuuucucuuugacgaaugauagaaagaaaaguuuuugugaguagaaaugcuacucccuccagguccugcagacccuugccuuauaacuucucugcuuuguugacaguguaucuuugcuuuguucacguuuuccccuuacauuguuguuguuuggcugguuuugacuuguuuuuuuuugagacaggucuguuguagccuuggcugggcuguaacucacugggauagcuaaggaugaccuugaguuucugauccuucuuacugucuccugaaugcugggauuccaggcagugcagugagagagaucagauccaggacaucugcaugaugggcaaacauccugccaacugagaugcauacuuagcugcacuucuguacuuuuucaacaguaauugauggugggcacuuuauacuuugauucagaaguguuugaugacagaaucaaucagaauaccaggagagagguguuuguggucaguccuuaggaggguccagaugcauguauggcauguggguugggaucccucccagaagugaagacugguggcuggagggcuccccaaaagcaguugggacugcaguauacuggacagacuuaaauuuuuuaagauuuauucuuugaacauuucauaacuuauguauguuuauugacagauuguucaccugcagagcaaggccucuucagaugugcagccuugggaucuggcggguggcuuaagcaguggaccuagaugucuguuuugcagucucaggcaccuggcagccaucuucuuuuccugugaggggcuaugguggcauccccugacccugggcauggcucuuuucuguuccuguguuuccuccauagugguggccuggcacaggcuucuuuauaagccuuggaaccuuccagcuucauuaucccagugguaucccuagccucuaccuaccagguguaggaguauccccagaauaccuccagacauugccagguugccuuggauacaaagucaccagcaugaggaccucuggacugaauguugcuuuagggaacuuguuucuguguuuuucagagcucugggaaugugguucaugagacauccucuuguauucugacuguagcuuuuuuuccuguugaagucugacuggugccagauugaaagugacaggucuuugaagcaaggggagacuaggauucguggcccagaaucauaaacuaagauccccuguuugaauuauuuuuuuaagcuuuuuguuguuguuauaaagggagauuuuucuucuuuagucuacugaagugaucaucauuccauuaauauuucuacucuuuuuuuuuuaacccccccuucagguagcuguagcauaguauugugucaccuuuucuacuugccaccuaaucagguggcaacuguccagugucaggaccugaagauauugggguagccagcccuggaccccagcuucuuucugaaucucacccuggugguguaccuugauccucuuuggagcccagucagguucccagcuuccacaguucucuuauacacagacacucaaguaugcacacacacacacacacacacacacagagcugcugcugcuuuacggaaaccuggguacaguauucucaagcauaaucuuucguguccuugaaguuuguucuuacagaaauacuuccuugccuuuccugccuugcauuugauaacagacugauugaccaaauacugcuuuggaaauucacagccugaauuaucacagagaaugugagugccuagugcauacccuggauuaaacuucuagagcaguuuuguaaaccugaucuuggcugcguugggaggaucaucaaguaugagagaugcuaauagccauaaaaguuugacuugggacaugcacuuacugcuaggugguggccauaguggaauccuagaguaggccagaccuuuucauauacaaauuugagccagcuguucucaguguucaggcuguuugauacuaaggaugcuugguccacucuuugcccuuaaguacuuagaaaacuguaauuuuauucauuugccaaacccugccacuuuucaacacucuguguucuagucuggagcagccuccuuuuacuuccuuuuagauccugccauuugucagugggccagucugaguuccuuuuguucuuaaggaccugugcccugaugcauguauccuacccccucaaucaccuugcuuuugauuugucggacauuugagugauuguguguccaauuggcauaccucuguccuucugaaaggcagaugucuacugagguuagaaagugcagucuugaauaccuugauagcugcuggguuuguuuuuuacauguuauugucuuaaacagauuuugugggguuuuuuuguuugguugguugguugguugguugguugguugguugguuuuuugagacaggguuucucuguauaguccuggcuguccuggaacucacucuguagaccaggcuguccucaaacucagaaauccgccugccucagccucccaaaugcugggaucaagggcgugcaccaccacugcccagccuuaaacagauuuugaguuaggaaaacaaagugcuuuguaaugccuaguucugugugguggguggaccaugccagaggcacugcuaaguugaggcacagaguggcaagggacuugaguaggccauauccaggacaagcccuuggccuuugcugugauagcaguuguugaugaauuuccuaucaggccuuucgagggcccucagguguuaugaaagguacuuaugcguguccucucggaauucauacccugccugaagauagcauuuaacaagggaguguuuaauauauagauagaucugguaaaagguaaccagaaugggcgauauggcgcagcagguaaaggcgccugcugacaaaccugugaccugauuuugaucccuggaagccuugugguagaagaaacccaauuccuaaaaguuguaaugugaccucuacuuacaugacaucugcauacacucuggcacucauguccucucacauguacagacauaaaaaauaacuuuugaaaaagauacuacugaagccaaagugaaguugaguaguggaaggggacugggcuccuuuggcugacauggucagcuagugagcauggaaauaauagcuggcgcucugaagccauggacuguguaaagucuuagcugacauugccuuagaaggcacauaggccagcaggaugauaauggcugguaaagaccuagacagugugugagacuguaggccuagaagaaaggagacugaccagcaucuauauccaguauguauccaucuguggaaguuccuugacuaccacuagucucauggggcucagugucacagaguucaggcucugccggugcugguguguauugcuacagaaucuuuagacauaggaaccauuccuuugaaaauuugaaaagaaguauucacuguuguaauaacuaguaaauaucugccagaaugugacuggcuggagaaaacacugggccuggcuuuacuuuucugauugugauccucuggugcuacccaguaccugccuccaucucaggcuaccuucccuccuauccuguuugcuugcuugcuuguuuguuuguuuguuuguuuguuuggaggcaaugucucuguaauccuggcuguccuguaacuugcuaugcagaccaggcuggcuuugaacucagagauccacuucugacucccaaguggugagguuuaaggcgugcaccaucacgcccagccucuuccugcuguccuuuuagauacucuuuccuacucgucugucgaccuuuaccaguucagcuguccaugccuaucaugaguuauggguuccacaugucccacuuuaaccuaacuuuagggcauccgcuuguuuuucugcuuuccuguuguguugcacuuccccagcucccgccuuacugggguggucugugaguauguagcuagcagcuguugcugcucuccccaucuucuccuuucucuaucauacugcucugccccacuuuucuccagguuuucuccauucuuuucuggguagucuauugguaccuuuacuguuucuccacaaucaggaaucauuuugcuugcucauuggugucaccaauuaaccuugagaggugagguagccuuagugcuugacgucaggcuucugccuccagcuaggcuucuccagcucucacucuacuagugacuacugcaguguauauguuucuuugguuaucugggagguaggucaggagugccacuugcaaaaugaacaauagauacuggccucaaagccucagaccuacugcuuaccauccuaguugaagacagugucuucuugacuuguuccauggcaggcuacaacuccuagguugucacucuauccuuucaacacacauggagucacaccuccaagucuccuguucucuuuaaaauccauaguuaauaguagcugcugggagacaggcuucaugucuagcugggaagguugagaacacugcuaugccacguggaccaguuuccuguggggcaucuuuccagaaucccuguggaacauuuauaaacauagacuggccacaucuaucucgacuuacagaaccuggaaauacauagcccauuuguagcuuacuauugccuaaauaaaagagagauuuguggucauuucuuagccuguuuuuguuuuuaaauucccauuuguuuguuuguuuugagauacuuucucuauauaucucuggcuguccuggaagucaccauguagaccaagcuggccucaaacucagagaucuguuuaccucugccuccugagugcugggauuaagggcauacaccucugcauccucccuauuuauauuuuuuaaaguuuauuuauuauuauaaauaaguacacuguuguugucuucagacauaccagaagagggcgccagaucucauuacgggugguugugagccaccaugugguugcugggauuugaacuccggaccuucagaagagcagucagugcucuuacccacugagccaccucuccaacccuauuuauuaauuuuuaaagguuuauuuuuaguuaaguguguguaucugcauguggguaugugcuuuugagugcagguuauuugagaaggccagaggagucaccucuggagcuagaguuguacuuugagcugccuggguugggugcugggaaccaaaccuuagguccucugggguaccaagugcucuuaacccuugaaccaucucucuagccucccacccccuucccuguuuugguuucuuuauaguauuaacaauucaacagaauuaccuacacuugugaccuuuuuucuccuucucuuucuauuagacaucuccuuuagaauauguguuggucacugcuguaucccugcacauccaaguuccuggcacagagucaugauaaacagcuauuggccaaaugaaauucuccacugucugguuggaaaauuccuuaaaacuuagugucacuuuuguucacuugaauuccagcaugcuuuucuaggcagacacaucccuucuuuguuuccuuuaaaucaguuuucuaaccuacuugugccugauugcaacaucaaccuccuguccauacaggucuggcauucuuacugauaaauuccagccuagagucagccaucugugugaauucugcauuagcccaguaguugcucacuucugggggcccuggaggcucacuuggagggucccuugcauccaagagcuguuucauguauugcucuuuucauucaccuuaagcuccuaugcuugugccauaccccaugggcuguguucauggcuugcuuuucauuugugaccuguuugccuauacucauugccuuguuccagugacuuagaaauaagucaucuguucucuaccccugcucaucuucaucccucacaguuaaaagaugugcaaauaauggcugccaguuauccagugaacaaagugucccguucucucuccuccuucccucccucucccugagaacugucuuuagaauagccucacuucuguucuugcucacauuguccauggucaugcuguugcuagggccacugggcaaccuuauagggcugcucagacccuuugaccacauguccauucacagcaaccugcuaacagguauccugguguucaucuugaccuuuucaggcuagugacuucucuguagucuugagguacauuccuguuuggcuuccacaguaguuauuugccuggcuuccccaggcucacagccaacucucauucuucauuauugaacuaucugcagaauacuggaacagcacccaagcuugauccuguuaguuguguucuuggugaucacaugagucuuguggacuuaaaggaauucucuauccacauggcugauaugcccuagaucccugcuccaggagccugaaaagcauuaccuuaaacucuguaaguugcuuaguuuagaauggcuaaaguggauuuuguaaaaaaucuuuuauuuuauuuuauuuuuaugugcauugguguuuugucugcauguaugucugugugagggugcugggaauggggccuggaagagcagccauucucuuaaccgcugagccaucucuccagccccaaaaguggaacuuguaaaucuguuugugggguuacuuuugaaacaggguuuugcaguauggauaagggagggacucuugaggucccauccccuuaccgaggaacuguuggcaguugauagcugcuacugggggacguagaaucauucuuuauagguguggcccaggcuggcccugaacucuucaaucuuacugccuuggaugccugagugcugaguucuguuaucuugguuuaggcuuuaacuuaauugccuucuccaaauccaucucccacuuuccuccuacaguaaaggacagccacuggggccagaaauuuggaggaagcuuugaccccacaccuauucuuggauguauuuuaugaacacccgagugggagccuaauucaguugcugcugcugagaaugggugugauuucagcucugcagaguggauguggcucccaggugguugcuuguucuaucucugcccgucauauccuuuugcagauagcuaacaguucacaggccauacaguuugacgcgugguuccuuaaguaaaggucaagaguuuuaagaggagucagccuagcucuucaugaugccuuuccucuacuaccacaacagccucucuucucagcccucuguccugucucuuggcuucucauucaugucaccuacugaaauggcaauucugcuucuuucugccuucuccuacagccaguacuucauccacugcacuguguuguucauggaaacucugcugaaggguaaagguaauucuaaguauuauucuggccauucuaccggugcaguggcauaaggcucagaggacaucaagaggcacucaucagcacacaccaguaugauugauuaccugcauaggaccugcagaagaucacagacucaaacuuccugcauggcuaggagaggaacucuugagguugucaguagcuccuggggaaguagaagaauucuucuuuguagguguggccauugauagguuccccaugcuccuuuggauggccccacgcccaugcacauagcuggauuuacuagguuaugagggaugaaggaagaagaaaaaauaaugaaauugggaugaguguauuagggugacuaucauauuucauguaugcauguaagaaguucuauaagaauaaucuuuaaagaguaguccagacaguagguagggggucauaugcugaaggacgagucuauauacucuaaguaugcucaauaugaguggaacaaaaagcaucuggagaagagcagacaaagcuagugagguaggcagcugugaaggaccugcaguagaugcugugcugaguuccugcauuccauaugggaagccagaacuccaaacacuccaaugcuugcuaauauucccaguccucauccccucuccagauagaagauagauuucuuugacucaucauagcugagcaggacccuguggcagguucuggccagugugcuaugacuugggaccaagucucauuuccagggccagggcguacaauggcaugcuucucaaagaccugcuaugaugucaggcuuuacagaccuugguugcaaaugagaaaacaaccagagguuaaaaagacagaaaguacauuaauauuugcccagacuagaagaaauagaauuauagcaaucuauucgcgagauuaaaagcauguuuuaaaaagagauuguaauaauaaaugcaguuuucuguaaacaagaaaaguuaaagaaucauagucgcuagaugaguguacuuugaaguaugaauaaugccucaguaaaguugcuggaaaaacaaaacaaacaaaaaaguaugaaguagaaguuaggaacaacuguuaggaagguuuaguggggagcuggggagaggguuuaacaggagcacuugguuuuagaggacuggauucaauucuugguacccauauggcagcuaaaaaccagcuguaccuccaguucuaggcagucugaugcccucuugugaccuccaagggcaagcacacauacuggcaggcagaacacccauauacauauaaaacaacaacaacacaaaacuuguaaaauaaaguuuaguggucagcuggccaugcaguaggcacugauaaaguuuaguggucagcuggccaugcaguaggcacugagccuagccacugcccucuguaccaucaguggccaguuguaucauauccugaggagaugucuauucacgacagcaugccaauuggaagaaguggccagggugaaucuuggacugacaguggugauacugaaggagcuugagaaagaacacagcugguggaagacaggcauuauuacauugagugucuugcuucugugggaguuaguaaugaugccuggugcauguugugcauaggacagugcuuuuuacuuagaacaagggaaacaccaacaagagcagaacgcuacugaccccgagaguccaggcuacuugggacugcuggugggcucugugcuaccuacagacugagaguaagccucacuagugugaggugucacuggugcguuaaggcuugcuguagguugguucacugaauuaugucaaggaugaagacuucugaccacaugagacuggcuguagugccuuuuggugucaugccaugccagcuuuagcagagcaugcuaugcugcauugugcgcugccuguguguugcucuguuuggguuuuucucaaauggacugcuggcauaaaacaggucugcaugugaccaguggguuaaaaauggacaugagccgggcaugguggcgcaccuuuaaucccagcacuuguggggcagaggcaggugaauuucugaauucgaggccagccuggucuacaaagugaguuccaggacagccagggcuauacagagaaacccugucuugaaaaaaaacaaaaacaaacaaacaaacaaaaaaauggacaugaaggugggccuaggaaaaaggagugaugauguugcaggcucucuuuccaucuugaucaucgucagccacauuguauuauggcuucuuagaauuagacuagaaacauguaguuguuuuuuaaagaaguccacuugaaauagggguuuaggcuguugcugucugucuucaugguauggccauacuuggaguaguagcuuuggguagcacagaacuucugugauuugcuagagaugcuauuguaugcucucuagggcacagaagguauggcuggcuucuuagcaaauacuugggaugcuuacgcuggggcuuuuuuuaagguuuauugauauuaugugaaugaguauuugccugcauacauguauauuccuauggaggucagaaaagggcaugggacccccuggaguugaaguuagagauggcugugagccaccaaaugagugauaggaacugaucucagguccucuggaagaauaguuaagugcuuuuaaccuuugagcuauugcuccaguaccuuugagguuucuuaauugugagcaguaaaugccucaugucaucaaaaaacaaaacaaaaacaaccccuuuccuuccuauacugcuggaaauggcuagaaacacaaugacaagcuaaagcaccuuuuuuuggccauggcaguggggaaggggaguauucagcagaugaugucagaaagcucaaagcagguaugggaggcagcuugaggaaaggaggcccugaaguagacgacagcacaagagagugcugcuuggcaggugggagugcagcugcuucucuccggccucagcaagucaugacugggcuucacugguggaaacaaggaugaggauguuuggugacuccaacagcagcuaacuagagagagccugaccuuaaauacgaguuaucauaugggggcuggagugauggcucagagguuaagaacagcuauucugacaggacaccugaguucagcuuucagcacccacaugguggcucacagccaucagugggaaugccccuggugcaggcaaaccacuacuguacauaaaucuuugauuguuguuugguugguuuugguuuagguuuuuuuuugacaguauuucucuguagcccuggcuguccuagaacuugcuauguagaccaggcuggcuuccaucucagauccuccugccucuaccucccaaaugcucagaauaaguaaauauuaaaaaaaaaaagaaagaaaaaaauauugucacugacuccugcuacugcccagacacauugagagauaucaaguauguuuacuaaguguaaaauuuuaaauauuggcacaagcagauaaaauaaggcuaaauugaaacucaaauacucuucuaaagaauccuccagacauaaacuaagaauugauucaaauguauaagaaaaaguaggaccuuuguuucuguacagaccugauggggguacaaacaauguguuaucaaaggaaaaauguauugaguugagcuauacaaagugcacuuuuacucguuaaaaagcaauaacuaaugacccuguaauaugcaacggcaguuguuuaaaacuucccaauugccuggaaaagcccaguacuggauagcuuuacuggugaauucuauuagacauuuuaaaagggaauacaucaacucuacacaaacuuuucuaagaaauaaggaagaaagggcauuuuuuuaaaccucauuuuugugagccuaguauuauucauagcaaagucagacagcaacacaugaaaacuacagaacaguguucuuuaugaauaaguacaagcuaaagcccuggcaguuucuacaucugagcuaggcugguaucccaagcacuuggaaaguagaaguaggaaaaucagauuaggaagucuauaguuagucugggcugacacuccucaaaauaccaaaugaauauuaccccagaaaugcaaaguuaguuuaacuuguggaaaucaguauaaugcacauauuauuggaauaaaggacagagaccacaugaccaacuaaagaaaugcagaaaaagcacuugacaaaguaacaccuauuaaagcuaaaaacaccaacuucuucaaccuuauaaagggcuucuaaaaaaccagcauauuaacauacuaauuguguuaacaguaaauuagcuuaauugugaacaguaaaugccucaugucaucaaaaaacaaaacaaaaacaacccccuuuccuuccuauacugguggaaauggcuagaaacacaaugacaagcuaaagcaccuuuuuuuggccaugacaguggggaaggggcuagggguauuaacauacuaccuagccgggcgguggcgcacgccuuuaaucccagcacuggggaggcagaggcaggcagauuucugaggucgaggccagccuggucuacagagugaguucaacauacuaccuaacaucagaguugaaagugccccugaggucagcaacagcacugacaccacuccuuaccacuuagauucuacccuuggucuguagguuguagccagugcagacagacaaggaggccaacacagccagagcagaaagaaagaaggaagaugacaugaucaugggugccuaaugcacguuaucacacaguuagacuuaauaauaaauaguucaucgguguugcagaguacaaaagcaguguauaaaaauaagcuauauuucuguacccuagaagugaccagccuaaaacaauuuuugauuuacuguagcacaaaaauaauacggcauguacgaauaagacaguauuguuagguuaacauuacuuccugaacuaaugcgcagaguuagugugagcugcaucaaacucucagcuggcuucccccccccccgcuagaaauuggcaagcugcuuguaaauccacaguaugagucaggaacccaaaccagccaagauaacuuguaaauagugguuauagaacuuggaguuuuggguuucaaaacuccuuauggaggugugaccaggugauauuugcaaaacaauaggcaaaucuacccaaauugaagguaggcauuuauuuauuuugcauugcugagguuugaucccaacacuguacaguuugaacucaacaccuugcugagacagcuggguuuucacauacaaaguaaaguugggucccuacaucaaucauacacaaaaacuaaaagucaaagaaccagaugaaagaucuaaaauuaaaaacuucuagaaagcuagaauaauaucagcgauagcgauagcucugaccuugagucuggauucucuaucccugagcacaagccuggguggaagacugcucuauggggagcugugaacaugagaagagauuauacaugcugaaggcccauauauggccuuugagagcugauuggauuugggacagagccccagugauaaaguuaggguucuuaggguuuguauuucugagagucuucugcaguucaggcugauccugaaguguaguuuauguccaaggaugaugaaguuucuacguuuugcauuuuuacuuuaaacauacuucuuucgagauuuauuuuaaccccuuguuccauuugccauuuguuuguuuaggauuuuuugacacaggguuucuuuguguggccuuagcuacccuggaaguaguaaguguaucacacaucugugccccaugucuguggagucuagaagagaguaggggauccucuacaacuggauacagacaguugugagcuaccacacauuggugcaguaagugcuuguaacuguugagccaucuccaguucuccuuuugaauauaaauauauuuguucauuuucacccacuacccuauccccucuuauccuaucaaaucuaucuucuuucaacaagucccccuagucccccuacuuauuuuguuuuauauuuuugugaacuaguaaguuuaauuuagaguugcuugcgugagcaugggagggaauuaucuacuggagcauaggcaguauaccacugaagaaagagauacccacuccugcagcaaccucuaauugccaguggcuccuuguggaguguagggcuuuaugaaccucuucucaauccaugaugggauacuaaugggccccaucuugugcagguagccacagcauucuuccccauccugugacucuuacauucuuucugcucccucuucaguguuccuuaagcuguggagggggugacacacagaugucccauuuagggcccaguacacaacagucauguacucucagcacuuuggucaguuaaaugagucuuugcauuaacuguugcuagcuacaaagagaagcuucucugaccaggacugagaacagugcuagucuauaguuauagauaguuagaaggcagcaugacagcauggccauuuagcaaagcagcuauaauaaguuucccacuagggaaccagccauaaacuuuugaccagguuuagaguaccgaaugucaauuccuccuauguugugggucuaaaacucagucagaaaaugguuaguuauccuagcuaacauuucacaccacuauugcaacaguggucaggucuuuccuggaagggugguaguguagcacauggguuccacagcugaguaaggcuaccaaugacuauuuuuccucucuagcaagcaggcuauguagcaccuuccagcacuguaugaaagcuagccagcaagaaggaagcuuccagcucaguucuaucuugauuuucuauuucugccaccagagugugcgguguuuucagcaauggggucuuaaccauccaauucugauucacaaaccaugagcaauggcaguagagccuguauuauuuuagggaccucuaggacuugccuggccaacaacuggggacaacuggggagggaucccacaucuggcacuggaauuuucauuuaauaaccuauggcuuugggagcaauauuauucaccagugcaaagugacuacauucaaaguguuuuuuuaaauuuuuauuucaguguuuaauuagcuuacaaaauggguuuucacaugacuuuuuaauacacccuuaguuuugguuaacccucccccaccccuucucuuccccaucucgccuuaaaccuuucugccugagucacuucccuauuuacugccauaucacauguguucuacuaucaagugaucuuggacuuucauucuccugcuugaguacaagcacucgggcauaugccaccuuacuugguucugugugcugcuggggauagagcauagggcuucaugcaugguugucaggcacugcauucuugugcagcacugguccuagccuggauuaacgugggcuuauguguggcaugcacgaguggagaugagaacagcauucaguucucuuucuguaacauggguccuagguaucaaacucggaugaucaggcuugggaacaaagccuuuaccacugagccgucuuccucugcgugcauaccaaaagaaugugaggucauaacuaaccaccaagagugucuuugccagacuuagcucagccagccgcucaaccgugcucagagacuugcaaccuuuuuaacuucauguaguaaagacuguuuguguaagcuuccugagaugaccaaaagagcugcuuacaaaauaggaagaaacauuugcaaaucaccucucucguaagagcuaguauuuagaguauaugaagaagucuuacuguugaguaauaauuuaaauuuuaaaaaugagcagacauaguagauaaagcaaagauuucaacaacgcaagcuggacgaccagaguucagauccccagcacccucccacaaaaagcuaugaugugggagcuuacuuguagccuaccuaguccuagaggcugagacagggcaucccaaggcaacuggcuauguagacuagccaaaugcccugauaaaauagagugauuaagaagacaccauuaauaccaguuucuagccuguacaugcuggcccuguguaccuacaugcauuccaaaaccuaaaacaauucaaaggcuuucuccagaaagccacugggacauacuauuuccuucugcuagaauggcuacagaagaaagauguggagaaauuauaaacccuuagacacuguugauaggagugaaaaacaguccugcuaccuuuuaaaacaaccuaggcauuuauuaaguaguugcuguccauacaaggaacaaaagccuuacucauaaccgccccaaaguacauguggucucaauuuguguacauaaacugagguauuaacacaggauuaugcauccagacagagagcagaacacuguucaucaugguuacauuguggaucgguuucugaaacaacauuaagccaaaggucagggaaagucucuauaaccuaagguuucaauugugugaaguuucaagaacagagacagucaugucugcgugcuugugucuugagggauggcuaugacaugauuaugaaaacacucuccgaguagauaguaguaaugauuucacaaccaugcaauuacacuaaaaccuuuuaagugguacguucuagggggaguuagagucugugaauuauauaaauaaaaauaacagcauacuccuuuuuuuaaaauuugguaaggauuagcuuuacugacaacagaaaaggugcagcauggcugauuggcugguguacacggcucugcauaaugagcaauuuucagaauaggucuguggauugauggggucaagaaaccaggcauggucugcggcucacaucacaucugcuccacuuguggcccuugcacaucaguaaugggaaucuuagacagugaagaguuacucuguguguguguguguguguguguguguguguguguguguguguguguaccauccucaaucagggaagcuaugaacacugggaauguuauaugcucugaguuaagaggacucugcuuuuaaagacauaguauaaagagggggaaaacacaauuugauuguauaucuaaauuaaaauaucuggauuccauugaauuaaaauauauuaagaacagauuucacucucccaccacgggguguuggcucacaccuuuaauaucagcacuugggaggcagagacagguugaugucugugaguucaaggccacccuggccuacaaagcaaguuccaagacagccagggcuacacagaaaacgccuguauggaaagaggagggcuucgcuucccugcccugcagacagccuugcuguguagcccaggguagccucaaauguaugauuucccugcccgagugcugugaguagcugggauaacagucauaaacugccuugccuggcuucauguaacuuguuauuaugauaaccaaagcugugggucucauggugccuugcuguuuauagaugucuuacuuuaugauggagguggggggucaaaccuggagcucaguucaugguagcuagugagcuuuuuuuuuuuuuuuuuauuucugauauccagcguuguuuauaaaaagaaagcaguaguugugguaguauaugccuacaauauaagcacuuaagaugccaaggcccaaggauuaugaguuuagggcaucuugggcuacaugaaauccugucucaaaaaaagggcaaguaggcacuuguucugaaguuucucuuuuuccugucuggauuuauaauaaugguaaugccacaaacuuagccauacugucuaauuugucccauuuccugugucuuuuuuuccccucuccuucauuucuucccuuuugauacauugauagggauguucuuuuguguuuguuuguuuguuuguuuuuucuuacaaaaccauaguucauagccacauucaguugaggcaaaugaaugccucacacauugucagaugcagcugggugugcagugcccagaggaguccugcuguuaguuggucugugagagaagagcuucccagggagcuugcuucugggaacacagcugugagccuagucuccacuccuuuauacaacagugguuagucccuuugacugacaguuccuguggauggggcaccauggcuucuuuacuucaucccuguugaugagcauugaacugggccaucucuuccuuccucgaggaugggguuacugaaucaucuugugggagucucuuuccaugagaaacugcccaacuuugcagagaauuauucaagugccaacaggggucaacuguuucucagcuugauugaauugcucuuugaaccagaguucucuagagaaccagaaucaaugggauguguuuauagaaauauuaaaaauagugaauugucuugugggagucugaaggcagggagauuucaagauaccuggcaaaccagggcaugguguauucucagaaaaaagaagguccaugguagaguucuaauccaaagaugugcagaucugagaccuauguaugauaggccagaagacugacagcagcagcagcccagcugggugcacacgggguuugacuuaugcacucuguuuacuucuucaccugguugaacacaacccacaccuaagaagccaucagcucuacugaggacuggccuacuggcucauccagaaacaugcucaugaaaaugugauaccugggcuggugagauggcucaguggguuagagcacccgacugcucuuccgaaggugcagaguucggaucccagcaaccacaugguggcucacaaccauccguaacaagaucugacccccucuucuggagugucugaagacagcuacaauguacuuacauauaauaaauaaauaaauaaaucuuuaaaaaaagaaaacgugauaccuaagaguagccauuguccauuuucuuuuauauuuccuggugacaagcagcuauauagaucuuccguaugucauggaaggcauuucuuuugagcucucugacuuguuuugagaaugggguuuuugcuaucauaauuaaauuuuuuuuuuuuuuuuaggcauuccauauuuuccuuggaaggggucaugcuagauguguaaauuucuaauggcuucuuuccggugucugauucuguucucuuugcuuaggugguugucugucugcagggcagaagcuuggcuuuggugaagacuguuaaugaugaguuuucauuuauaguuugugugguuagugucauuuacaaggcuugugaccucuucaaggucaugacagugacuuguuucuuccuuagaugauuuacagggaguuucagcauuuauguuuagaucugugaucuguuucaggauggucuugguagauagacuaggcauggcuugguuuucacugcucucagggaguaccuaguccuaguauuguugcaaaaacuacuauuuccuuugccuugugguuggacauguauggguggauguggggcucuauuuguguguuuuccaccuucauuugacccauagcuaaucucagaccagcacauugcuaaggggauagaccaacuauugcaaagguuaauaguuauuucuuggccuuugagagaugagauggcucagcaguuaagaguacugacugcuugucugaagguccugaguucaaaucccaucaaccacaugguggcucacagccauccguaaugagaucugaugcccucuucugguguaucugaagacugcuacaguauacuuagauaaaauaauaaauaauuaaaaaaaaauuaguuauuuccuuaugcugucuguggcuuggcuugguguggugugguggugauauugagauggaauuacuuuuaugcagcccaagcucaaauacaguauccuccugccuuugacuccugagugcugggaucacaaagguauguaugcaccgugcucagguauaauaguguugauaucaggucccagucuaucagguuguauucuaucaaaguguuaguugguuucuuuugccucagacucauuauauagucagcaaggaucugaucuugaacuucugaucccccugccuccaccuuuugagugcugggauuacagguguacagcaccacuaugcacaaucuguuuuuguaaugagcagggaucaaagucagagcuuaauauugugcuggacaagcgcugucagcaccaacugagccacaugucugucugucuaucuaccuaucauccaucucucuaucaucugucuaccuaccugucuaucuguagugaaagcacagcuuagaauuguuaccuguacaguuugugcuguuccuugcgugugcccucauggucucuggaacauucuauuuuguagaacugaaauucugccguuagagaguuucacuaugcacccuacuuuuguucucucagagcuugaucuuuuuaggaaucuuguucaguggacugaaacacuugucauguuguggccaguucauuagcaugauacccuuagguuucaccuguaucuugguguauggcaggcuuuuccauugucaagccgaauuaugugucuaugcugcguuuucuugguucguuuguuggugaacacucagauggggauguugcagugaacauguaugccaacaucuuguagagaugugcuccuaguugcauaccaagagugggccugcuacuaaauacaguugucuguucauaguaauccucuagugguucagcagcguuccauccuugccagcaagacacuuuguggauacauucugugguuugggugugauuuuguuguugcugcuuugagauaggaucagugucuggaacuuucuguguagaucagacuggguguacagcacaguuaauacuagccauacuugacaguagagauaugagcuguggcuguagcuuagccugucacagagguggggcaugguguucaggcauaguuuacuuguguugugcucacaguuggccaggaaaugagugaaaaguguggagagagguguggcagugauucucuggaaaggcagaaaauaccuuauuccucacauucucuucuuuauguaggaaauggguugguuuuguuuguuucuugcaaucgcaauaaaaacauucucauggaagagaaauguuaauguucauauguacuuccacaugaaauaggaugacuucacauuaacccugaaugaugugaagcuuuuggacucauccugacuguccuguccagugugauccucaccuccaguuccccacuugccaaauggggagaagccuccuucucuuaccuccucuuuggucacuuuuuaaacugcuuuucuagaugaacuuuggaguuauuuuugcccauaaaggagcggggggggggggggugugugucugucugucugucuguguaaagacuguggccuagcacugcucaagggcuagggcgucgugugccugucuuaggucagccuccccuccaggcucuggacugccucuagucaucauacuuuguggggccuggucagggugcugugaguuguaggcugccugugccagaugugaaggaggcccaugugcagggcuguaucuauauauugaaggucagggcugagguucuuugugccuuuucuugucuaggugcccuaugagacacugaacaaacgcuuccgagcugcucagaaaaacaucgaucgagagacuagccacgucaccauggugguagcugagcuugagaagaccuugaguaguugcccagcuguggacucuguggucagccuauuggauggugugguggagaagcugaguguccucaagaggaagguuuguccucugggagugggcccuggcuaggagaucugagacaggcaaacugugggcaggauguccuggccucaugcugcuagaaagagaacugaaaguguccuaagccugaccuaugaggaagcuaggacuugcagagacuacugguguuucacccuagaauuuccuagaacugucaaaaugaccuagcucugaggaugaagacaugaauaguccuuuaaaacuucuucccaaagggguuagagaacucagacagcagaagagaauuagcagucagucacagauaggagucagauauaggaaaaggccagaggacugcagcuagcugccuuggagcauuaucugaacaugugacgugacuugacagaugacuuugagcacccaggagagugggccagaaaacaacuugaaaaccuauaggaaacagaaaguauaaaaguuuauuuagaguuuuaaaaagaaugagugaaaaugccagauuaaaaaaccaguuaaccagggcugaauacuguggcacacaccuuuaaucccagcaucugggaagaagagacgaucuguuugacuuuaaggcuagcuggucuacguacuaagcuccaggcuagcuagggccacauagugagacucugucacaagcaaauaauaaccagccuuaaaguauuagcucaauaccaagacuuggaaagugguuccaaagagauuguguagaauacaguguaaauagaagagcaaaauauauuagagaucauggacuucugaugugguugcccagagaaggguagagacaggacagggugaaugauagggcuacuaaagucauuggcucauagaccugaacaacaggugaagauaaacuuaccuaguguguuacacaaugaggcgaagagcucagacugagcaaccucaacaauagccaaggaaagggcagaaagugaugguuugggaggaaagaaagccaguaggggccugccuuguggucucuugcauuuagcuauuagcuauaugacuauaaaaaguuucccuuaaugacaugagaccugguuccuuggugacacuggccuuucagaaauucagugacacacaggguuaugacagccauguugggcaacagcgcacauugagaacauuuuuaccuaggauuuacuuagaaccaaguugacuuuuuaauaaacauauaugauuaaaaaccaggcuccgcacgaugacacaugcuuuuaauccuaguauucaggggacagagcccgaaggauuuuuugaguuugacgacagccugguuuacauagcaaguuccagguugccuagggcuacagaguugaguccuaucgcaaaaugaaugaaugaagaaucacuuuauaguaaauaauaagagaggaaguacacaaauuucagauucuaagcaucugacaaugcagcuuaaaccaaaacaaaauagauauuuaugguaaaccuuuuugagugaaaugaggccucccaugugcuugacaagcacgugaaguggucgauggugugucauacuucucucggucaucacugucucauacaaauucaccccaaagaaagguagaauccgauuucuuuuauuucuguaucuaguccuacaacguccccagcuuuuacuuuuccuugcuuaucuuuuugugagcauucagaggagaggcgcauacauacguuuucaugguugguagugugguucaugggacaaaccaucucaacugugucugcuaugacuuaggcaguagaguccauccaggccgaggaugagagcgccaagcucugcaaacguaggaucgagcaccucaaggagcacagcagugaccagccagcagcagccagcauguggaagcggaagcgcauggaccggaugaugguggagcaucugcuacgcuguggcuacuacaacacagcugugaagcuggcucgccagaguggcaucgaggugggcuuuuccaacucccgggccccucccggggugugagcacuauugcauuccuuucuguuccuaccuguagugggugcccaacagucagcgacagucacaggauacaauugacuugacaacuugaacuuguuagccuuguggugccugaggaggccaggagguuggugcucuagacagagcucucuggagucaaugacauggacauagccagggaaagguacugcuugcugccuuugccccugaccagaccacuauuagggccacugcugcuagacacugaaaacccagccugugcuuggccaccacagagugcaucacugggcccauggguuacccuauuuuuuuuucuuguaauccauuuuuuuuuaauuuuuauugaauuuauuaugucaugaugaauuucuugggaaauuugcauaucuuugggcaaucaugaauaucuuuugggagucaguuuaauccuaccauggaaguuguggggcuugaacucagguagucaugcuugguggcaagugucuuuacccaacugagcuaucucauaccaucacucaagucugcuuauuaaaauuguuuaucuugacaugggaaaaaauaggagauuuuuauuaugauuccuuuuacuuaaaggcuguuucuacaccauguucagcaaauggaucugcaugcccugccuagccauccucuggaaggagcggcccauaacuucagcucccuccccuccccuggucauugucaugcauguauaguguccaguggugggauaugauaguaacaucaggucucuguagauccuagccagagcauacugccuauggcucagcuagaaauuaucaguuuucuugugcugguauucuccuuguuaguugagaaacguuuuuguuagaguacaccucagaaagaaauuuugcuuuugaaaugauguuuucaggcugguaacauggucuaggagguaagacacuuguugccaaaaaguaacugcuuuugagcccuauggacuacaugguagaaagagagaacugacucuugcaagugguccuccgugugucugcccacuaauagauaaaucagugugauuuuuaaaaaucugaaggcauguccauuuucuucagauaacuuuucugcuuuuccuguaaugugcauauaucucauuagcccagccccucauuuuuugcuaaucuugaugggacccuuuuccugaccuuggaugaauccuccagagcucagcagaugauccgucuuuggcccucuucaaagagcauagccacuagggagaguguuguaucacacacacacacacacacacacacacacacacacacacacacacacacacucuuucaaauguguucagaauagacaaagcaaaacauuaguguguaggcuguagaagcauuguacaccuugcugaggacuuggaggagguuauaccuuauguuggggaccugguggggguguuaguuauuuuuguuguugcuacaacaaugccugacaaaagcagguuagugaaggaaggguuaacagaguuccaggagauaguacauccugucagagaaggcguggcagcagaaucaggaggcagcugguuauguguauacauagucaggaaauggagguaauuauuagggcucagccugcuuucucccuuuuuagucuugagacucauagcccuuggaaugguacaaaccacauuuuaagaugaauuuucccaucucaguuuaccuaaucuacauaaucccuuaaagauaugugcagagauuaauuuccauggugauucuagaucucaucaaguugacaagauuaaccauagagagccugaagccugcugggagccaguccuggugugcauaaugcuuguguuccuuguugguccuuuacuaaggcaggaugguucugguuccucuagccaguaggcaucugccauaugucagcuucccaguccucguggaccauuuuucuucccuggaaucuuacugccuugucuaugagcagugcccuagacaguuugggccaaauguagggaguacuacggcugagccuaaacucagggugggaggcuggggugaagacgguagaaacuaguugccccugcuuguaggccacaggcacguugugaccugaacugccccuuccucuaaggaccuugugaauaucgagauguuccugacagccaaagaaguggaggaguccuuggagaggcgugagacagccaccugccuugccuggugccaugauaacaagucccgacuccggaagaugaaggugugugagcuuucugggcugggccuggugggaauggacgggucucuauuggaggaggccgagguuggguggaagcaguguuaccuacccagaacuaccauggcuucaccugcuguggucuuuugggucgguuuuaguuugugaggcagagguguuggguuuggaauggggacggugccuccucaggaggagccucuuguauugcuuuggucagcagugaaguauggagcccuguuagguguacagcauguuuacuccgcugcacuuaaaguugaggcagccuguggauuccccacacagucagauaagggcugcagaacucuggacuguggugucuaccaaauauacacuuaaagcacagagccacagaaccuaaaccugcucuguuuuguagcagaaauguguuagcuuuaauuaguaggccugcuucccccagaggagcuauguuucuuguguucuaucuaagcuaagcgcugcuuuaacccaucugguuaagguuuuuggggugcauagaguuaccagccaagaaugccacugccacucagggcuccauaaagaaaggaucuugguacagaauuccuaaaagaaaugccagaauugacacauaagucuggccugcucgguucugcccgcccaccugcccacccucuugugugagugaucuuccuaagcuuuguucucuucagggagcagucuacaagcuugccaaaguuacuguagguguuucaugugggccagggauaagcaaauugaggugcugaaugagugcugagagaaggggugagcacugcuuuggugucgagaggcagguauacgggaaugcuaccaguuguccagaaacaucugugauggugccuagggacaggccugcccaucacaacugccuguaugaucggaaugugcacaugcacguaugcucuccucucccaucagucaggguagagagccacacuguauguacuaaggucuuacagaucagacacugauggaugggacgaggagcaucucagacucaguuucacuaaguugggaauaccauauaacagggcaccaagagaugaucucuaauuuagcuuagaacucuagauuuggcaggacacuaaagaacaaccuggccgggcagugguggcacacaccuuuaaucccagcacucaggaggcagaggcaggcggauuucugaguucgaggacagccagggcuacacagagaaacccugucucaaaacaaaacaaaacaaaacaaaacaaaaaucugcuuuuccuuuaauaccuuuguuuuuaaacaucgcacuggugcccaccaacuauagaaggaacaguguuacucuguagcuuacagggcucuaaugugcaggcuuguguggcuuuaaagugaacagagagccacgagcacuucuccacacaucaguggggccagacuggcccuguggagucuugggauacccugucuuuuccugaucauuucaagcuugcuacccaccacucaggacaguuccugcucuggguuagacugugcugugcuuccagccugcuuugccuucagccucggugcagaggguacagugcagggaucagaaggagucgacauuccccuucaucuugguauccccaugcagagcaauguagguacgguuacauuguauugauggaauacagugucgaagcagcugccuuguguagcuguguggaguauguucugcugggcuuacacugaaaugggccaugggaguugggcacacagaggcagcuagaugggaaaggaugcagcacugggggauugaauuuaagucuuauaugcggucaaggacaugauaauuagucuuagaugaguuuuuauguccucauuccuguuucuggcaggaaguauuuuaugugugcugaagguuuugaguggcuuuuaggggacauugcccaggcuaaccucaaauuuccugaggccuuaccucuggccuccuaggugcuggauugauaugugguuuuguauaugcugggcaagugcucugcugccuguaccugaagaucuuuagauucuugcuugcuucugugugagguggucgcagcugaucuuucugcugguuggcuucuuuguuaaggaacuugugcugcacuggauuguagcacugcugucagagucagcucagcucugggcuucuauauaaacugcgucuaccagugcacccuguacugucuauccuuaagagucacuucagugcugaccuuagagcuuccucacaacugcaaaucguggagcuucugccauucacaggacccaccuauucuggagcagccaccagcucaggcaguuacaggacagacaagaaaugugcugaguagaagccuggugguaaugguagggagggcacuuuauuuuuauuuauuuauuugaacaaguccucuuuacacagccgcggcuguccuggagcuaacuacucacuauauaaaacaaucuggccuugaaaucacaaggcucugccugccucugccucuccugagugcugugauuaaagaugugcaccaccgugccagcugaaguauguuuagaggagcagugcucuguaguauuugugcacuaugggaccuggaagaccucugcccuuuggggaguuggcaggguuuccuuauacagucacucaccuuaucugauguacucugggaacugaugacagucccugucggcugcccauuuggaugcagcauggcugccucgggggacuaggcucaccaucugcauaaugcauuggccugccagaagaaaacuuuugccacuucugucagaauagaagcugugguaaucccacuucuucccgcacccggagcuucaaugguagaaauugugagaccuguggauccuaggccauggcaaugcugacagguggcaccuucuaacucuugucuuuucccucagagcugccuagaguucagccucaggauucaggaguucauugaacuuguccggcagaacaagcgccuggaugcugugagguagguaggauaugccauauacaagguuucuaugguaaggcaggacacuccgugccauugccucuucuccacccucauggcuggagugcuggacagggaaacacaugauaugcacuuccaguuugauggccucagucgugcaugccuacuaaaucucuguguucccaagccagagauuagguugagguccccugcucaucgggcaguuucauguggcacuguagaccccaauagcugccaagugagagcuaggcuggcaucccaaccacccauguaaaccugugugauccuguggguuagaauaguguccugcgucuggcccaccauggggcuagagcugcucauggagguggacuuaggaaguuugcaugcacuccaugccauuguaggguagccauugugcugugaaaagccguaggacacugcuccagggguggggauacgcagucugagguccccugggaacugcugguguugggcuuggauucucgggcaccacagacacugcugggugccuugaaagauccagcucugggguccccaaguugcacggaggccagggacagcagguucucacucucagacacugcuggaugcuguagaaaugcugagaacagagugggggccugcgagcaggcucuagcccaggacugaagggaaaagggugggagaagagaacucuggcugauccccucagggaggagagaguguacugggcuugcuucggugggcugcuuggcuugguggagacagugucugggaacacagggaggccugggggguugggggguggagauuagauacauggcucuuuagaggaagaccuucuccauugcuccagcacaguggucccaaugggaagaggcaguccaugguuuuaaggcauuuauuguccuggugggaaggagagcuaagagggaaguagaggcugaccauggucacauggaaagaggggaggaagggcauguggagagagggggagcaagagggcaagagagagagagaagaguaagagagggaggaggggacaagcagccucuuuuauagugggucaggccuaccuggcuguuggcagguaacugucgggauagaguccagacagaacaccgggggcuugggguguugcccuaugggacugauggccacagaauuauggagcugaagccucaugucaggagccuagugucugggagcauggcaaacuuucuuccaucccuugcagaguuaucuucugggucucugggguuuaaaccuagcucagccagaaaacaggcugccuuucacggucccacaugaucuaggcacugugucccaucuuuuccacuugggaaauaguccucagcuuuaaguaacaaguaugcuccaagggaaacugaacuggucaguucaaaguuucuguucugauguuuucuacaugaccauuugagagcaugcucacaauaggaagauuaucugagggcuuucugcaggcauaucugagcuucugaggucuauuucugcccuaaagguacaggaaagaguggcuggcugcccauguggccucuacccucacagauagucucuacccucacaugggucucuagcagucaagcauaagggccagccgucauuccugcuuacucuuguuugauugaaauguugcagagaguaccaugcaccaguuuccauguggcaguuuccuucuccugacccacuugcauuuagucagcuuuguaaagccuuccuggugucucuaccaggugucuagucaguacaugccaaagcuggagcagugacuucuguaguugggguucuucaauucuagcuuucccaaggcuucugaucaguccuggagugugagcagggaagaacauucagguggccgugaguaaaacgucagaccaagcaacugaauuggugggccuacuuguuacuuaaagcugauaacuauuccucagguggaaaagaugggacauagccugaucacaugguuuacaugguuugguugggaugccagccuagcucacuugacagcuauuaguguuuagacugccacaugaaacugugugaggagcaggggaccucaugugguagaccuuggacuugugcugagccggugacauuuccacugugauugcugagacucagcaguaacgugucccaccagagaguccugcaggcccagcccagguguagcuuuuaguaaacccaggacugggauuaaaggugugugccaccacugcccagugagauuuuauuuuuauuuaauguaugugaguacacuugcuguuguugccuucaggcacaccaggagagggcaucagaucccauuacagaugguugugagccaccaugugguugcugggaauugaacuuaggaccucuggaagagcagccagugcucuuaaccacugagccaucucuccagccuaacaacuuucuauggaaaauacuggacuagaagucccuggacaugaaggguaagcacucagggcacuuggaauaacucaaggcucaagcaguaauucuagcccuaagugaaccuaucuccugauaucuugaccacacacacacacacagccccauccucaucccccagcacaugggauuccuuugugucacucugaaagaccuguuaguccagauccuuaaaauuggagguuugggccuuagagagagucuucagcagcagauaaaaguacuugccuccaagccugacacccugagguuaaccucugagaacuacaugguagaaggaaaguucuaacucuugacaaguugucuucugaccugaauuguuuguuucauuauuaaaaaguugggaauauaaaccuaaaugugccaaaauguugauuuuuagacaugcaagaaagcacuucagucaggcugaagggagccagcuggaugagguccgccaggucaugggcauguuggccuucccaccagacacacauaucuccccauacaagguaaugcucaugucccuauucaucuguguucuugcugguccuuggaggcaggaguccugugggguggguuagagagugcuggccagcuccuggggcuggcccaucugcugccauagcuuguucuacucagcugugcugcucucgcuuccuucccaucuagcuggugagaacguugaggcagaggccagaggcuucggccugaaagggucugggucuccucccccugccagccuuccuugguguucucuuccuguagucuuucugucaugucagcagccuggccuucuugcuuuuucuauaaguccagaguuguaggucuacagagcacuagagggucacaguggugaucuugcccuccuuuggcugcuccuggucucuuuccuuggugcaggucuguugcuuucagccccuguugucuggcccgugguggaagagguacaaaccucagcccgagugaaugaugucucaccaagccgagaccucagaaggcguuaaguacgggauuugcucauagaguuacauacucuguucccugagccuugagacuggccucugucaaagaccuuugugucugcccuacagccucauccacaguuggcccaacucuaguagccagcagaggagagcuauuuguuccuuccccagauaauccaguuaauacugcuagguuggcucugggcccuaguaaacccauauaacuuugugaugugggacaucuuguauggaaauaucaucaggccagagagugucagaaauaucuaaauucguauuuuaaauuaaugucuuaaauuucucuucacugcauugguguuugauuugggccugaggcauccgaguuggaagaugaaccaucucucagaugcaagguguuaugguucagggaggauuacagcagguacaugguacauagauaggcacauggaacuuauaccugcugucccaccagugagcacaaggagaagccugcucauggggucaaagcuagcaggguaacaggcuuagcccaucaaguccugucagugacagauuuuuggugacaugaaagagaaagaccaagaucacaccagaaacccuagucuuaggggcagacaggaaauuuagggugcagagagcuagaagagaacugaaagaauggcuuugauaaauuagggagggaagaaccagggcaguagugagggaggcagagaggaagcuuccuuuagaagaaaguugggguugaaccucagaaggacccugaaggcugaugcugucccuuuuauuuagagcuugucaaacugggcaccguccuccacugacugcgucuauagaaguaaugcugaacagugcauuuaugagaaagguggaggugaaguguguugcuacccuaaugaucuggaggcuuuaucucuugcuuuuguacaugugcauaccguaucugccuaaaucacaacauuaaccagggauaguucugagcugagguuguuuguuauugucugucuagcauuucuucucuggagugaccucucuuucagcuuuaauucucugcaauucuguuucauuguuucaagaccacaggauacaaaccagggaguguucuccaagugucaccaccaagugucuuguauggcuguuggggcaucuguacuggcugggccuccuaguaacugccaggggagggucccagcaccucugcuuugucuuucaggaccuccuggacccagcccgguggcgaaugcugauccagcaguuucgauaugauaacuaccggcugcaccagcugggaaacagcucagucuucacccucacccugcaggcugggcucucagcaauaaagacaccguauccuucuugcucuaccuuauucucugggguaaagguugagagggccugaggccuagcagcuuggucuuucuuuggucuguguguccucuguggcuuuuccauuucaaauguugcugguaccugauacuggcuucccaagaguccugcagacuuguccagccaguuugacuucucagcuugacucauaauggucaggacuccagaaagguggcagccuuccucugcaggaaagacaagaaaggcugaccucuccuuguuuauauuuggccuacuauaccaugaaggugacugacccaucccuuguaugacuccccauugcauagcugaccuauuccuuccugagauggacaccucccaauccuccaaccccccacuuugacccucccccccaugguagauauucaucuucgguguggcugaucuuguuccuuguaugguugcuucuugcucauauguuugauuccaucccuugguauggucccuauagucagaacucaggcuaaccucuugggucagacaccaccaccaccaccaagggcgacucuccuuuguauggcuaaaccucucugacugaaccugucccuuaagugccuggccugguugcuacauguagccaaauccauucuguaugauugccccagguaaagguagugacuuuucuggcaucacagcugguaccuguuaaugcucugcuccaagcucaggcucagggaccauccuuuucuccaucucugguggacuggagaguaagcaugugcuugccugccaccuucuggcaauccaccagaacaucccugucucacacuuugccugcucucugaagaaacuucaguugggugugagggugccacugggugacaaaaccaauggcucucugugaacauugauagugaaugacuaugcauucuuuuaauuuggagguuagcucugucuguuuuucugcuuggugucccuguggucauaaggaugcccuguggcuagagucacagcauuccugccuuauugcugaucuuguugguacagccuuuccuuaauccuguguacagacagugcuacaaggaggauggcagcucuaagagcccugacugcccugugugcagccgcucucugaacaaacuggcacagccccugcccauggcucacugugccaacucccgccuggucugcaagaucucuggugacgugaugaaugagaauaacccacccaugaugcugccuaauggcuaugucuauggcuacaaugugaggggcccgaauaucagggcugggcugggcugggcugggcuggacugggcagggcagggcagggcagaugugugugaggguaagggcaccaggguggggccaugccacaugugacagaagugacuuuguaggauuagauggcuccauaguuaagagaguuuguagcucuugcagaggaccuggguuugguuucaaauaccugcuugguggcucacaaccaucuacagcuaucuaguuccaggagugacuugaguuucauggggucugaccugcuguucugauuuucacaggcaucagacacacacaugcacacaugcagacaaaauacucagaaguaaauaccauuaguugguuuauucuaugguagcuuacuuuuuggaaugaaccuuaauucagaucuuaguuugcauggcauuuucucauuuuaaugcguaacucugcucuuguuuuccagucucugcuuucuauucgucaagaugauaaaguuguuugcccaagaaccaaagaagucuuccacuucucccaagcugagaaaguauacaucauguaggccccgaguugcuaugggcacgcccuuggccagaggcgguggugggugggagccaugcccuccugcccugaccccugaccccagaccccagccugcaucgacauuuguuucuugcgaccaaagaucagugagcaacgacaaauacucuuagaaaaagaggaagugagauuuaauaagucugugcuugagaacagcguuugauugguaggauuuguaacauaagucgacgaugccucugcagggucuugcaccucucaaaggaaacuuucucuacagugugaccuggagguucacccaggaaauccagagcaucucagaaguaggaauugguucaucgguuauuucccuguguuucuccguuuccuuccuuuugcuagugaugggacucaggggagcuugaggagcaggcuggcccuuugccaacuccuguuggucacagcuugggcaaggugcuggccacaccagguuggcugcagugacuugugacguggugccgaggccuuuccugacuucacugucuagcugcugccaaagcgccgugcaccacaugcaccugggcugcuacuugaggaggcucugcccacguggccagugucuggggcugugucugcacagguucagcaucucaccuuccagcaccgccuuaucuccugcuuugagaauguauucacgggaaagccacuggacugaguuucugcagaggccuugccaggugguuccguaguccuagaguguacaugcuuuucauuacagaaacugauaguucagcuaaaauaaguacugacggguuuucaaaacaaaugaaccauuguaauucacacacacccauauuguagagguuuguaucuagcgcuuauuuuugcauguugauguugauuagcuaaugaacuguaaauguaaaguguguuaauaaaauagcuuucuauuucuca

SEQ ID NO: 12097 - RNA, 58798 nt, Mus musculus
cuguugugauaagaauuuuauuuguuuuguuuaaagcuacaugugcuuuuuucuguaaauaauaaauuuuuguagauagucuugauguguuaucuuugauuucucuguguaaaaccagcuggcuguaauaaaguguuaguggguuagguuaagagaagugugucaggcaagagcaggguuauagcugucggcugucugagagcaccuuuagcuacagaggcucauggauucgcagguuauaacugagcaccuucaccuguuucagaagaaagaaagaaaaauuagucacacauauucacaugguauggcagauugucaguuucuaaauuagugagaaugauaaauuauauggcuaacagggaggggcaugguaaugugcuuauagacccaguguucaggcugggacaggaggauuguuuaaacuugggaguuaaaggcuugggcaacuuaagaucucucucucucucucucucucccccccucccucccucccucccucccugccucccucccucucccucucccucucccucucccucucccucucccucucccucucccucucccucucccucucccucucccucucccucucccucucccucuccccccccaccccacccccaacuauguagcccaggcuaaucuugaacgcauggcuugccugccucagccucccaagugcugagauuacaugcaugugccugagugagaccucauucuuuaaaggaaaccucuagagagguagcugugcaauuaagagcucuggcugcucuuuuagaggacuuggguuugagucccagcacccacguggcagcucucagcuguaacuccaguccugagggaucugaugcccucuuccggccucugggggcacuacaugcauguggugcagccgugcaaguaaaccacucauacacauaacaggugagguuguggggauucagaaaccuggggauaaaggauguaugaguggucacgcacaugacaugcuggagugccccguggagggugagcuaugcacuuucaaguaugagagccagugcuacauucuuccaaggugagauccagagaagcuaagcauccuugcagcccagcgcccgcccguucagagcuuaagguagaagagugcuguuccagacugagguuccgacaggugacccugucggacuccccacacgucuugguggagagggagaauuucugaccaccaacacuugugcuugguaaugccuuucgccgcacagcugaguggucuggccagcggcaugaccugcaccucagcaugugggagaagcuuuguuuggucugaggagggucuggucaggugucacugacuacauguaaggcagcccugcugggccacuguagcguggcuucuuuggaagaaacauuuuagcagugguugggacacaccugaguauuugccaaccucuucucuuuuucuagcuuguugucuuuguguguguguguguguguguguguguguguguguguguaugugugugaaugugugucaugagugugugccugccuauggaggccagaagaagagcacauaggagccccuggaacuggaguuacagguaauugugaccugccccauauggggccugggaacugaacucagucaguuccccuggaagagcaaugagugucuaguuuuuguuuuuuguuuuuuccuucuuaaaagcuccaaaugaaggaccaaauugaccaugaccacuuccuuuuaaaugaugaauauaauagucaaaccacaaaggggaaaugacauauagaagucacaggaauucuguucaagaugaggugaaagcuaaguccugguagcccuccgccaucuugaggcaugcaaucuggcuguaauuacauaugcuuaaugcuuuucuggacuuccugcuuuucagaauuguauuaauaguucugugugcuacuugauuauuaaaagaccgcuuguuuuuaaauggcgagcuggcuuacauaccuuuuuucagugguauuucauggagggcaucaaccacuguaauuuuggcugccgcggaagccugcccuugggaguuggaugcguggcacucauacucuccagcguccuccuuacuuagaggagauaccugcgaaagauaaaggcucuuuaguucucuguggaggucuccucgcuuucaguggcuuccauuacaccuaguaggaucccugugacgagcaggggcuugggagcggagcugcuaugagaaguagugaaguccuaugcuagcagcccguggagccgcuguauuccaauggccuggguggcuuuugaucacaaugugaauguuaaaaucuggguaggcgcacauacaugcuggagggagagccuugcuuaggggcugugaucaaauacagaaucaaagguuaagcaaaaucgcauacuugcuaaccauuaacgauaauuaauucaguucuguguaagaauucugcuuugaacuuaggcaagcaggauucucuuaauucuuuuuuuuuuuuuuuuuuuuaaacaaaguaacuucaguucuuccauuaguuccuguagcuguaucuguacgaccacagcagggcugcuucgaagaaaugggaggagaauaauuucaggcaggcgaccuuugccaagccuggguguucugagaaugaaacgguugccagcucuugcuacuuaccagcacccagcccguuacuucaugcuuuucuggaccaccccgggucugaauggccagauuuucccggucaccaggcaagaguucuguccgcugaacuccagagugaucccuuuuuaccugagaaaucagaaggggagagucuuaguucucguauaaaaacaucaagguuggaaaugccccauucccagaauugcacaagguguucaccagacuucauaauaagauuaaaucuagcaauuuacucaaucuguuccuuuucugaauacugagcaagcagaaugguuucuuccugccaauuuuaccuaagcaaccuggguuuuguuuuauuuuguuuuguucugagacaggguuucacuauguagcccuuggcuggcccggaacucacuauauagaccuaggagaucagucugccucugucacucaagugcugggauuaaugguguguaccacuccaucugguuuuuaagcaacaugauuuaagcuuuuuuuuuuuuuuuuuuuuuuuuuuucuggaaaacuuguggaguaugcauggucacccugcuucacucacugguguccgacgacaguuugauccuugguacugggccuucuuugccugccuugcuguguuugacuggcaagcugucaugcaguguaguuugauguuugggaccuugugggcacuuccuguaacaaccucaucaaagagaagcagcagcuggaguccagagcugagucuagugcuugcucugggggcuaagggagcaugaaacaguucccgcugucuaugugugauaaacccugccuguuucuguccgugcuauggagagagagauuccgaaggccguguacgaaggggaaauucaucucccucgguuuacagccaauccuuacuucgugucucuccuucccuaccuauuuuaaagguuaaaguauguuaauaagaacuuuggaaaagaugugaaaagaacacagggaaaagucuuuuucuguuguuguugaacacauuuaguuccucaguuucaguacauauguuuuaaguuauaauaaccaaauuaaaaaaaaugacacgaaacaguuuucuuuaauucuaccaaggccucuuuaagagccaagccaguguuuacuucgauugucuuugucacgagaaagucaggaguuuccuucuguaauuaagcaaaugcuaaguucagguuugucccacgucucccccaauucggagagaaaaaccugguacuuaggguuucaaauggaagcuaugaagacguguauaaauaagcauuuuuuuuccuugaauuucccaagcagcuggugcaaccgucuauguuaauaaaauagguaauguucugggaggaguguuugacucaaaggcuagagacucugcuaagucucccacacaucacuagcaccuguaaucucagagcaggguagguggagacccgaggauccuccaggcuagcuggcuagcucaaaucagugagcucuaggucaaaaaguaggguggagagcaauagaagaucccccacacccugacaaaaaggaucuuuuuuuggggaggggggguucgagacaggguuucucuguguagcccuggcuguccuggaacucacuuuguagaccuggcuggccucgaacucagaaauccaccugccucugccucccaggugcugggauuaaugaaccaccacugcccugugacaaaaagaaucuucaaaacaaaacaaacaaauaaaaaagcaaacccaacccugcuauccacaaauggccagcuggggcugggggaggcucaaggggagaccaagaagucguuuaggugucuagcuauuuuauuuuaaucuuuuugcaagaucucuuuauauauagucaggauggcuucaaacucaccauccugucucagccugcccagaacacgcggcaccugaugccuagcucuagaguacuuugguugcagcagauucuuccaaaaaucuugcuauuguaaauaaggaauaaauaagaaaaagcgccaauaacuaccgaaugcuauacaucucugggugcuguuucuuguuagcaccauuacuuaauguuaauccucauuaaugugcauaucugaguuugggucugcccucagaggccagaagagggcuuuggauguccuggagugggugggagucagaggcaguugugagcuuuuucuuuuaguccccuuucuccaagccccuagguccccaccucugucuggugucuggugucugguguucuaagggaagccauauaacuucaaagccucccgaggccgacucauuuccccugggacccauguguauuuugccggggugccacagaccuuauucucugcaaguuucggcaaugaggcuuauaaacuuaaguaccucgagucacccuggcuucucauuuuguaaauuccauggagaccccuugagaagcaacaaagcuucuugccgguuuuccuugaaaacuaucggccaugcucuucacaagccacuaaccgcaaauaagcauuggggaacuucagcugccagggggaagguuuaaaugaacacguagccgaccacguuauugacaugccugacuccccguccacaucucuuuccgaagcacaauuuagaggcaacaucccauuauucccuuuaacgaaaguuucagcugcgagggauagcuguacuagaacugggucaucggucugcuguacuagaacugggucaccucugcccacaccgugguccaggcguuuccugguaaccacacucaagccagguaguuuccucaguggccgcauucuucuggccacacgggggcgccagaggcugccaggaaccaugaucuagacuaagguuucucacucggcagcugggaaagcuuugcugcuucggaggucugugaggauaauucugcccucugcggaggaagcuuucugaaggagaaagugaggccgagagauugauaacagagaucaagaauuccagucccgaucacauuugggugcccggacgcuggaacugccuucucuuucuuuuugccccucggcuauaugaacuggaaucuguuaggauucuucugacaauggggccgaaacccccucccagagccccagaggucuccccucugaccagacaacaagcacacaaaauaauugagacuauccuccauuucugagcuugcugaggaagcaaacuagcuaaagaggggugucuggcuuugcuguuuuauuagcacgaguuugaagauucuuccuuacuucauagcuuccugccaccacagacugagugauagcaccaugucuucccugcuguguaagggacuauaagccucugaaccuggaagcuaaagcgaaccaccuuucuuccucccuugaaaguuucugucggguaaccuuuggucacaguaaccaaaagcaacgaaaacaguggguuuagauauucaccacgguucuuugaguuucccaagcucccugcuuggacacugcuacccaaagcagaacugggcugauggaggucaggaaagauccgugccaguguagagugauaccagcugccacaggcuucaugguuguggggcagccggcaguggaugcagacugagcugugccauucccaccgcccugggccaugcaaaaaacgauuuccggcuugcacgaugcuuucccgaggccugcacuacugaccuuguuccagaugaggacagggguugggaucccgaugaccucacagcucaagaacaccuuggcaccagugacguuccagauguccuuggggggcgucacuauggaaggaccuacaagagaagccagaaagccaaguccaucuuuuuagcugcccaucaccagucaggaucuuacaaggcaaauccuuguuuaugagccucucuccucuguggauuaucugacgugcaucucaaaggccagacagacaggccucuuccugucgccagcgugauacugcaaucuuucuaaggaaggcaagggcugauauaagcaaaccagcaaacacaacaacaaaugcaauuaguaggaaaaaaggucuguuuaucuaacaaaaaucuagcaaaauugccuucuuuuccccagccgagcuuaaaugagguuuauuucgccagcuguuuugcauuagcugggauuucuuucuuucuuuuuuucuuuuuuuccauuaacgccaagaaauuucaguucugaaaugcugaauguuucacuuccuuuguggaccggcaucuucacuuggaggucagugcuaacaaccauuccuuguauaacaaaagaaaaaaaaaaucuaagaaguuauuuucaagugugcugagagcacucaggcaggcuugcugggguaagauucaagugggcuguccuggggaucggcugguggcacagaaggggccuggcugucaccgaagguggggacagggucuuucugcuaguggagaaggcaaaugcucaaagcaguggcugccuucuguugggaccaagcccccaaagaaagggcaggagggggcuaguuucaggguccucgguggcuggguucccagcagugagcauugguuaaagggacugugagcagaucugaggaagccaagagaggccagaagauaccuccccauucuugguguucuggaacccaguaauuucccuuccuccugugaguaaaaaugcuauuauuacucagauccacccguagugggcaucccuuuugcuguaagcuucuuuggcucucuguuccuggaguugguaaaccauggacugugacccaaauuugccuuccuaguuaugucuguauggccuccaaagaucagucaguucaaauguuuggggaaaauuaagagaauacuauuauuuuguggcaugugagaacuagaagauauucucauuuacuguccauaaaugucaguggaacagcuucauucacgcguucacagagugucucugucacccuggugggaccacgugguuuguauuccagacugugugaccuaaauauuguagaucugggccuucacagaaggaaauggcugauuccagcuuuaauccacagaagaaagagacuaauguguaagcaaggaccaggagaaagacucagaacuacaagccugcucaguuucucuugagcccggaugagcaaagucagcaggugauuucugcuuuggcccugaaacucccacuucucacaucaacagauauggaaagagucauggcccuguuugcacugcagcaucgaccaacauugccuggauguuaauuaccuuucauuaauuaaguugcucuaaaauacuaauuuuaaaaauuacauuuauuuccucuuuuuuuguaguucuuuuuuuuccuuuuucuuuuuuauuggauauuuuauuuaucuauauuucaaauguuauccccuuuccugguuaccccucugggaacccccuagcucucccacccacccacucaccuacccaucccggcccaggcauuccccuacacuggggcaucuagccuucccaggaccaagggccucuucucccacugaugucugacaaggccauccucugcuacauaugcggcuggagucaguacacgugcucauacagguagagauggauuuugaguaucauucucuauugcucuccaccuuuuuuuugagagagguucucuuggugaacuggaagcucacuuguuugcccuugaucuccgaggcgcugagaccggcugguguuacgccaacagcugcauuccaucacaccggcuuguauguggguggcagaggucucaacucaacucaauuaaccacggagccaucucuccagcccacacaccccucuuuuuuaguggagcaauuacuauuuuccaucuacuaauuuggaaugccagguuucagcccccugggcccuccagagagacuugggacaguguaccucggaggggagauagaccugggagccuggguucccacagagagacugagcagcugaagagcuagacuccgcccuccgggggugcuuugcccuagacuccgcccuccggggugcuuugcccuagacuccgcccuccgggaugcuuugccccgauucuggaaugaguaaguuaauuauucccucugucuggggucuucaagccuaguuaaauauccaaccacagggucaucuuguaccgggggccugggaaaggcccaaccuuccccucuuggccuggaaaacuuucuugcacaauccguauucacaggccacggagucuuccccucccaacaucuauuuucagugcguacuaacgucuggagacggcaaggaaaugaccccacuaugcaacguucucccacucaucucaaggauuagagaagcuuuuaaaacaaaucucuuggggcgguuuuauuuauuuuuuucucccuuuguaagaauacacaaaacaaucaguuucgaaagcucuaaauauauuuuauguuuccuucucuguggaucgugggucccagaaggaagcacacaccgugacuuggaguacuggcuauuuuuuuuuugcaaagcuggacacggggaagcagagcgaggcuguguuuauauguauguuucuggccuugucuccgacauuuccuaguuugaacgcccugauauagaaugcggggcucgcccucucccuagcuuccucuuggcugcugagaccccaaggcuuugacgucacacaaccggaucuggcuggccuuugaacuccuuucucccaccccugugagggccccccacugcucuguccuucccaacaagggcuggggcagccugacucagaccccaagggauuucaagagguuguucugggaagaauauaccaguaugccaaagcucugaagagcucggcugcggggcaggguggagcaaggggggucuggggaaaagcugcugcucucguagcaaaggaguaaagcuucaugggaaugguucaauugugaggaucugaguguccccuaugcaaccugcauucgucuucccagacgcacccgccuucaucaggagcaggaacaguccuugccugguacugcuucgggggucuaggagcaggccacagaccuccuucagccuucuucaagcaguuaggguuaguccuguuuuacugagacaugaucucccuuaguaguccaguuuggucuggaacucaugaucaugauccuccugccucagccuuuccaguguuauuaauacaaguagaaguucuaugcuugagcuuuuuaauacgauucacuguagcgaguaguuuuuuuuuuuuaccccccccccccccccccgccccaaagagucucauuauguagcccuggcuguccuggaacucauuuuguagaccacacuggccuugcaucauagagauccaccugccucugucucaugaguguugggauuaaaggcgugcccuaggcuuuacauuuuuugagcccgguuauuaaacuuugaugcaaugcucuaaagggcccuguucucuuccucaaucuuuauguucaacuccucuccaaguagguuuuuguuuaaucuugaauuaauuuuugccucuauuaugauguacaggccaucuccccaaaggccaucuauugcuucaguagauuuugagagggccguauuucuccuacugaaucauuaauaauaccuucuggucugucccucagccgaaugugugggucugcaucugggcucuguucugauccaccagucugucuguccauguacuuguaucaguaguacacuccaggaacccauuaugcuaagauucgaguacuaaaggcagggcagguuuaugauaaugggucucucucgggguuucuugcuauuccaagaaaagagacuuucuggagaaguaagaguuccugaaaaacaucugagccuaugaauacccugaaugagugcuaucaagggagugggagugggagggugagaugggggauggagauggggauggggggugagggugggggaugggguggggagugaguucacaauucgaaccaauuauguggugagcucccauugagauacauaaaacgacuugacuugagugagcugagucuacuugcagauuauugaaaacaaaugauuauuguucauuuugcuaccaggcuauauguagaauccuacaaguucuagauaauaaaagcgagccucauucaugcucugggugggugggcaggcaguucccggcaagacacugaaagaaaaccuuggucauuaugaaugaccuuguuguaccuaaggcuaaacucaggaacacaaugaagaguuuaaccaacagcaucuacauugaaaacuaccacccuacaaaagggcuuucagaccuggcauguagacuugugcagaggaaagcccuaucaaucaaucaaugacuaacugaugaggucaucgguagaccucagaguaggcgggacagguuguuccccaugguuuuugucaugguagaauccacagguguucagaauucuccucauucaccuugcucagagcugauacccacccagugucuucucuaccucucaggcugccuggaucuuugccgucucccacucugggaacuuccugcuaacaagcaggagagauaaagaggcuuuucccauucccuccuccacuaguggagacugaauuuagggucuuauacaugcuagggcaagcacucuaccaacgggcucuaccccugacaucuuuuuaacuuugaauuuugugucagggucugauucagauguccugacuagccucagacucacugcauaacccaggcaugccuugaacuuggaauccuccugccucaaccuccuccacagcugggacuacagaccugcguuaccaacgugggcugggagacucuuggcaaaggcagaaugugggucuuacaggaagauaguggaggggugaggagagacacagaaaggacuuccuaaugacucggggacaccaacaggguccugguccuacgugcaagcagaagaugagcugcugguggaugugacagccccuccccccagccacaaaggcccucucugcacaucuucugcuggaaaguggcacugcugccaacucuguaucccagaguucaguucgaaaagguccugcucugcuucagcucaaugucuuuauuaucuuuaucaaagaacuccucuuucuacccuuucuuccaagaaagucaaagaaaauccagaaugcauuucuguuccaaacgauaaagacauaagaaagaaggaaagaaggaaggaaggaaggaaggaaggaaggaaggaaggaaaaaaagaaagacuuuaauucacccagagcagauuuuuuuuuuugauguaaaauucugaaaauugaaucucaaggccaguugaugagucaugauauuggcgccuuaaguuaucuucugugucuggauuccaacuaaagaggaaaaucccagauuuguuuucagugcauagggacaaacccaaaauaaaucuaauuauuugcuuacccaugcucuugccccacgagggauuucagggugguaaacgucugucuagcaagcauccugccuauaggaugucugacucuccacugcucuucucuucccucacucaugcaggcagcuccagcaaagagccacacugccacagugaugcaggcaugggggaaauguccgccaccaggcucuccggaccccagucuccuauuucaacucucccagaugucugugccccacccacacugcaccucuuugcuuucuuaccugcacaacucagcuaacucucauucaauccccauugcuuccaauaauacacguuuaucucccaaguucauuuccuuacuuuaaaacauuauuauucccuucaaaucuuaggugguuuuuuuuucccauuuuuugaagagaaagaagagggauggcugagguggaggacaaggagaagaaaagaaaugaaaaugaaaacaaauaacgagauccugggugaaucggcagugaggaauaauauuccauauauucacuggaagaaagcuaaaauucaaugaaugaaucgaugucacccuaaaaguacccagaaacaguuagaagccuccugcaaauccuguuugcauguguauuguccccucuaauagugucccagacagaugacucagacuacuuuaggaguagucucuuaugacccaaaaguuacaguguccccaaaaauauagagagggaauaauuacagaugggcgaaucuacauuuguaacaucgcaacuugguugugaagagugagaaaaggcaauucucacaagucacacagaugccaaggaaauauaauauaaauuaaucucaaaucugaccagcaguucauguaagcugauuuuauauaaagcuguaaaagagaagauggaguuaaaacucauccuaugaacacacacacacacacacacacacacacacacacacacacacacgggaaaugcuuaagagguauguaaacaaugucucagccuccugcagaacacaaagcacuacacaugaccugagcuguccccgccacaccaagcucuccugggaauagaacacuuggaucuggauccuuugccuaaugacuuuagacuaacugccgagccauuucuauaguacaagaaguuagggccucuuuggggguuuugaagugagucuaccuaauaugaauguugcagagcacagccaacauacaucaaauuuuuugggucuagugucuggcucuggauauuaauggaacacaggcaggucaauuagaguucuguaucugccuaaccauauuuugcaugauuuguuaauccagguaacucucccagggaugaauaaaauggaacacacuuaagugucaccucuucccuaguugacuaauuuuuaaagucuaaaauggcagaguagaagaugucaaaagucauguuuuuaggcugaauauuuaguucaccuaaccuaaucuagaagauggccaaaaauaaaguucuccccuacaggaucugucuucuaacgucacauuuggcugcaugauuuuagcuucauugcauuucucauccuucccaccaucccugauucucccuucuaacaaccauucuuccucauucucuucaagcccacucucagccgucauguccgcccuccaggaccugccucacccuacacagcuuagcauagcauuuuugucuggggcuguccuggcuggacucaugaggaugcuaguguucugaugacaucugaacagccagcaacugucaagucaggugcucuucauuguucacaagaaggaggaggcucaaugugcuagcaaucucagaguucccugguuaagaauugagaagaucuacacugucacgaaaugaacccaugugccaucgcuauguuacuuaccuaaagugaugucauagcuaccguuuaccagcuggcugagcacccauuacaauuuuguuuaaccuuccacuugacuuucuguugcggcaugcuaugcuguuuuggcuccugcccaccaaccagucaauuaguauaugccaccagaagauagaauuaauuugaacauccaucacucagagcaaauuccauggggaagggcagcucuauugaugagaaagcuucgacagucauucccgcauacaaaauaaagcauucuguaucccagugguuaauauuaucaccucaugccauccacugaguauguuaacauggcauacacagccgaguauaaggacuucucuaagccaggguagucugcaaaccacauucauacugacucuuaaugacuccuggcccuagaauaauagcucauaggguauggauauuuauaccaaauaagggcaaaguagggcuuaaggaagauuucguacuccgcauauggaagaguucagacaucuuggcagaagucccuagauugagaugagauucugauaacacauccaaggggaaaagaugaaacaaaaggucaaaaacgggagaagaauaguaggaaggcacugugggcaagaaggggaaggggaugaagcgaggagaagcuuccuggcacuaagcaaugggaagcagcaacugugcagcucauuaaagagcagcgccaucugccaaggccagccauuuugggaacuuccagaggugggcgauacagaagcugaacacugguaugggaaucuagcccauguucucagggggucaucuuaggucagcaaaggaaggagaccgagacgacaguacuaaaucuuaagcagcacaggccauggguaauucagaguuucagucuaaggaaaauucuuaugguuaaauaauagcuccuauuagucauuaacacuauaguauaaauaaagcgccaggauuucagagugauggggcccugacaaaauaccgcuuggugggaaaaguguguagaaguguuucuuuuuuuuuuguuuuuuguuucccuagaaauagucuauuggggguggaucuauugcggacagcucagcacacuuagacgagaaacgaaaugauauaagaaaacagagugaucacuccauauguauuaguguuagcugcuguuugugauuugggcucugacaguccugcacgccuccaaaugaggagucacgugacucauggggcauuucuaggcaugauuauggaggucuuugugcgacccagacacucucgaggguuaagggucugggggugggguaaaaaaagaugaagauguacucagaauaugcaaugcaaccuaguaacuaggucuuggggacaagggaaauuguuacaagcuggggacauaaaauguuagaggagaucacuagucuccaaacuaaaauggugucagucuggacuggagccaggaaacuggucugugcuucuuuacugcauugacauauuaaacaguuguuuucaguaacugugcaacaaaaagaauuucuucaaaccaauugcauaugugguuaucacagccccuuuuccacacacauacacccugucccccccuucgcgccccaccaccucucucagaucuguuggauaugggcucauggguucagaacaaauucagaguguugagcugcaaaggcagggcaagccccaccuaguuuccauuuuagccugggaaaggaaugugggcuccucccuagggaaggaaucagucuucacucucccucccuauggggaaucuuagguagcuguggcucacugggcccaucuccccugcccagaucggauggagaaauggaagcaucccagccuuguauuugcagggcugguccuuuugagcccacauuauccaauacagcaaaucuuggugacgguguacagagaccugauaaugacauuucuugguugauuucugauagccucuggguuagugagacacuccguuuucggcuccaauauuugaugcuaagacucuucuuugaguguagugcggccuauuuuuuuuuuuucuucuucucaaugauaggcaccguguucagaugucuuucuucagacugagcaucuuauaauaacuucacauccuuuccugggguuugcacugaccauggaaugugaacagaaaauugcuucuugcgauuuguugcuuaugaacagacuguacguggcucacaaacaggcauuuucuuuucuuuuuuuuaaaaauauuuuuauuagguauuuuccucauuuaucccauguuaucccaagagucccccauacccuccccccccaacuccccuacccacccacucccacuucuuggcccuggcguuccccuguacugaggcauauaaaguuugcuugaccaaugggccucucuuuccacugauggccgacuaggccaucuuuugauacauaugcagcuagagucaagagcucugguguuacugguuaguucauauuguuguuccaccuauaggguugcagaccccuuuagcuccuugaguacuuucucuagcuccuccauugggggcccugugauccauccaauagcugacugugagcauccacuuuuguguuugcuaggccccggcauagucucaggcauuuucuuauuaucuuccccuuucuuguguggauucagcacaagaacaagguccagucugaauaaaaggucucaauucggagucuguccccucaaccuacugcagaauguucuagaugggucugagcccacccuaaggaugcuucugucacaugcggucugaggguuaagucaaacaaggcauguucagguaagugaggcaugaagucccucugggaggguggaugagccccaacaggccucuguugcaaccucgccaaguggugaguuaaacuauucagcacagaccccaucaagucggaguccuuaacuaccggccuaacccguggcugacuaauguccguacacguucauuuaggcuggguguuauuugauguacacagaugaagaacugacuuuaaagugugucuuucugaggggaaacucccuaguuaccuggguguuucuuacucauauuaacauagccuuggaaaucacaggccuggccugccuggacgaugacugaccauaaauccaaggugcuaagauaucauuuuuuccuauuccgcaagcacagaacugcuuaggggaaauuuccacaggaaggccaagccaggcagacaguccuucccaauucucggaugucuaaaggcuagcuagcuagggagcucccagaacuccacauccacaagucuauggcagccccauucuccaaaugaacauccgcaggcauccgggaacccucuggcaccuggacggacuuccucaucccgcuguggagggggaacucucugcucuggaggcuugcccauuucagaacaggcucugcucugcccaauaaaggcugcaggcugguuacaaauagauguccucccuggggggaaauacguacgggccucccagagggcucucagcaucaucagguugaacuguuuaaguggcuggaagauuuucaaagacugaagaagggcaaagucugaauuuacaggaaucucacagagcugagaacaaugggccuucaggaaaggaugaagguuuuuggcauucugaggauuggaucagccaggagagagaucuguacuuuaggaacacccguggguuccuaagcuuacaggcuaacagcucuagaagcagcccucagaguuggagugugcaauagaaucuguuagcagaguuuguguggccucuggaagggcccacaggggaagcuccaaccauaaacaucccacuguaucuucaccagugggcgacaauucaguugcacauuggacucucuuccaggcauccagaauacaugggaacuuaggccacaugccccguucucguugguucugacccuggaagauuguaauugagggcagggcaggcaguaacuggagaggaagacagguaggaagauggaagggaggagggaagggaugacugagaguaagaaugguccuugcugcagcuuugggcaagaagcacuaaguaccacuuaguacuuaguaccacuaaguagucccuggggugauggggauaccucagggagccagcucugugucaaugguauggaaacuuggccacagccccaaggcccuuucuggcugguuuauuuaaccuguccaggcacagcggacaguggcucacugccccuccuuauuacaagcagugaacucacugauauuucugagucuccuucuugaccauuuuuucuuuuucuaguuuugugaguuagagucacugguucucuggcuaucccacucugccccacugcugcucucuugacucccacucuggauuccaucucuagaugggguuucucccuugcgaguauauggguguuacucaugguauccccgcuccccucucuguuccuuccuugucagguggccugccaggacaccuucuggcuuugaaaggagcaaggugugcugcagaggggggucaggcuccugggggcacggugguuuacagcccuugcuaaaccggcguucagccacugcacuggcugaugguuuuacccggcaggccuuagccucugucucagcuaggaccuccaugcuuacaacugcuuggcagacaaccccagacaugaaucagccgcgcauaacugagcccucccuguucucugugguuuuccaccccagccccaugcccucugguuacuuucugugucgucguucugucaugaccacagacccagaagcucucaguuauccgccccaagucacccuuguuuucuacucuuugcugaaguguucugggcuuuucucccaguuuccuagcgggauuuagcauuucuucuuccgcguucuguauuuucuacuguuguuucugaggcuuaacuuggaagagaaaguuuuguuuuucuuuugaggcuaacucuucuuggauaggucuuggggacaaaugaagaaugcugcugugcacuugucuugugcgccacugucaucuccuuauguguuuugucacaaugaggaaaaaguuuuuccgagcgccuugaauuuaguuuguagcccagggcgguccuaaaccuucaaucuucuugucucagccuccagagagugugugagcuuacaggccugcaucaccaggccuagcuggaugcuguacuuuuagaaggaccgggaacaacaaaaugcaaauuagcccaaaugccaggugugccugagguuccucuuggcggccggcccuuucucugcaggguuuccugcuacagcaaacaccaucauuaaccuuggagcauuuuugcuuuguuuaaguaaaauaauuuccucauuagacagagggauuucacgugucuuucuccuuuuuuuuagaacagccacacagauaaggggaaacucuguuauaaacacaggggauucaaauauucuccaaacucuugaaguuguagcuucaguucucuuggguacauucucagggaaucucuucaguaagauaugugguccuuuuaggaaucucggggcacggggacaaagaacagauagaucugugaguucagguaagcuggccagcuuuaaguaucaagaugauauugaucacagcuuuacguguaggugaaucuuggaauuggaggggagccugguuuauguagcaaguuccagaucagccagaguuacagaguaaacccuggagauagagacauagagacagcagacacacacacacacacacacacacacacacacacacacacacacacagacacacacacacacagacacacacacacacacagacacacacacacagagcacagagagacagaaacacagggaguuaaggaaugcagagagggggggagggaggagggagagagagggagacaucuauagaaaaugaugugacaguggagggagugccaugugcuaugguuuggggacagccauccccucagguucauaggugaaggucuguaggugguguauauuagaagaaggagacguuauugggaccugguugaaacaugucuuaacccuggcuccuuccuauagaaggaaugauaaguucuauuaggaaacuagaagaaaacccaagaauacuccacaaaggauaaaagauaaagggagcuuucuggccacuauaugggggacagauucccucuacagugcccuuucugcacgaugcacugccucaccauggcccagaaacaaggaaccagcuaacgaaagauugauaucagagcccaaacaaguuuuucuucuuuaaacugugucucuuagguguuugucacagcaaauaaaaagucugguuagcacacugaguaaaucaaauuucaguacuguguggucuuaggcaauuaaaucuaugugggaggcgaagaguccaucugggucugccaugaaccaagugguguguugacacaacgggguaggaggguguuggcuucuaccuaggacugaaauccaggaagcauggauagacaaguguacaggcaacuguaauacagacagacugucuggggcuccucuacaguagauguaaaaacauucgacuguguguggucguacaugcuuguagccacagcacuccaggaggcuaaagcagaaaggucaugaguugguggccaauuuggucucaaaaaagcaaaaaaaaaaaaaaacgaaacaagcaagaauguuuuugguauagcugucuggcuuacacugucaccugucugaccacuaggaaaggggcaguucuguucuccugaacuacuuauuuaccuacaaagugcagaucagucugaucugaucccgaggacccuccugaccuccugccuugucacgcccgucccccacuaugagcucagccacagcgaacuccccugguuucuuacacaugucuugcucuucccagccccugaauuuugcacauuccagucuuuuucuagaacauucaccuccuuuuuccaagguuaauuucuacauacccuuucaguuucgccuugauuuuuguuugacaccaaaaccguuaucucccucgacgcuuccacuuugcguuucuauaccaaccuugcucagaaccggggccuccuuccuguccucccacuagauuggagccccagugcugguggcacaggcaauuuguucucucuaguuucuuccugagucucaucccugcacaccagggauaaccaccaaaccccugagcaucagaaaagcagcuucuaccagaaugcgcacuuggcuuaguucauggaagguuuaaacaguaugaguucaggagucacuccaagaagcagguuuuccuggcuguuccuuauuaaaaacgaccuuguagggcuccagguuauauaaaaccagcuagcggccacuaugauauucuguaguuucugcaccggcauguuuuagcauuugggagaguuucaagugcagagauuuugauuaauugugaccuacuuaugaacugguccucaacuguuuguagguacaauaugugaauguuggggcuugcccuucccgggcugcugagucagcucucaaggagagcccugaaaugguuagaacugcugaaucuuuguuuuuaugcuuauacuaacaggucauccauuaaggaaaaaacauguguuuuagaaaaguagcaaucucaaaaaaaaaaaaaaaagaaagaaaaaaaaagaaaaaaaaguagcaaucucauuuuaaaaguuuagauacaacccagaagacaaagcuaaagacuugcucuauagcagauuguuccuauuuuagucaacauguaagaugugaacauuggaggucacugguuagucggucugguaguggagacuagaaaggagucuggagcaucgacugaauaaagugcagaagugcacaucuggaaaagauggauuuggggauacaacuggcaagacaaguuauacaaagcugucaacaagacagcaaguuuuuuugagacaggguuucucugaauagcugugaccauccuggaacucacuauguagaccaggcuggucuugaacucagaaauccaccugccucugccucccaaguacuaggauuuuuaagcgaagcccgucuacuucaggcucccaacaccagagacuccucuguggaugaucuaacacgggggaagcuugcucuaaaggagcaggccuugcugguggaguaggugaugaaagaaagaaagauucucugcucgugggaaagcagcaauuuccuguuuauacuuuaauuuucacuuguuuguguuggcuuuucaaacaggguuucucucuguagcccuggcuguccucaaacucacuguguuagaccaggcugaccucagagauccaccugcgucugccuccugagugcugggauuaaacgcaugcaccgccgugccuagcuguugaucuguuuuuaacugggcuggagauugaacccagggcuacaugcaugcaaggaaaacacaauaucacucacccauacacuaagcuuugucuucauguucuuuaaauugccauggugucagggcgggagagauaggucagcaauuaaaaguguuuguuguuugcagaaaaaaaaaaguagcaaucucauuuuaaaaguuuagauacaacccagaagacaaagcuaaagacuugcucuauagcagauuguuccuauuuuagucaacauguaagaugugaacauuagaggucaccuggguucaacccauauggcaggucacaaucauccucggcucuagggggucuggugaccucgucugaccacugccaacaacaggaacacacauggugcccagauauacaucugagugagacacucauauacgcaaaauaaauaaaucucaguaagaaaguaccaugaagucaaugaacuuuagauuuggaggggcccucaacuccauccugcccaaaccuucuuuggccagaugagggucaaaggcucacacauuugccuaagcucaucugaagaugauggagaaaaggaaccagugggcuauaugaacucgucuccuugauuugauuaacaaccccgcaggaaccucaccuaucuuuacucugaggccguccagacagcauagcgacugggagagcagaaaugugcuggggauagccaugaagcaucccacccugugcuccuaggcggauggucagcugccagacucagcuuggaaagaauuccaguuugcauggaugaaacacggacaaauaagauaacugagggucugggugagugauuuccccaauucuccugagcuucggguuggaaaagugcagccugcucuggaauucgagaacaucacaaacaguccugaguagaaacuucccaagugaccucagcccauacuuccgggcuugucucagucccguuuccaguugcuggcuugcccacaugugucugagauagaaaaaacaaagaggaaaagcuuuccaaaaaacgcacacuaagcaaaacauaucuuccuguguucucuggcaagagagcuggaaagcaggugauggguucaaggacagggaucccccagcaagauaacucaguuuacugcggugagaagggcaguugaggaaacugcggugagaagggcaguugaggaaacugcggugagaaggguaguugaggaagcuugggaaagaggcucuggagagaacacaguuaacucuccucaucccgagaccaaaaauacuagagaggacaauuuaagggaggaaggguuuauguuggcauauugugcagcccgugguugcuccgccccuugguugcaagcagaucaccaugguaacggggucacaugauggaggcuucuuggugaacaguaaguagaggaaaggacauaaagacaguggccuggggaagauuccaucucauuaagcuacuuccuccaaaggcccccgaagaugaaucaccuucuagcaaugcugucaucuuagaacucuaucaagggauuagcccugauugggccaccgcuugcaugaucuaaugguuucuggaaaugcccagauggagcugcaaacaugcuuuaucaaccucccaggucugucugucugucugucuuucucucuuucuuucucucuuucucucucucucucuuucuuucucucuuucuuucucucuuucuuucuuucuuucucucuuucuuucucucuuucuuucgguuuuucgagacaggguuucucuguguagcccuggcuguccuggaacucacucuguagaccaggcuggccucgaacucagaaauccgccugccucugccucccgagugcugggauuaaaggcgugcgccaccacgcccggcucucucagguguuuucuaauccaguaagguaggcaguugagaacaaucuucacaccaucccuggacugaccccacaacaaggaugaggcucacucuuuauuguagaguccuggagugccaccaggcaagcauuuucuaauuggcagguccauccggagauagauguaccaagaggucagccuccuccccgugccagaagcgugcagcuggauucugagcagcuccccacagaguugguaaugguuccauugggaaaggguguucagcaacugcaagugaagaucugccugggaaagaucacuuuuagaggccuggcucucaccggucaaugccacuccuucaacgucgcuccucucuggcuaacuccugggugcaggaaaucucugacauaucuuugaaugauuuccuuccuuccugugggugcaugcuuuaacugcaacuugacaaauuauagcuguauguacuuacgggauaaaugugauauuauaauuuaugaguaaaaccaagccaagccaaugaguauuuuuaucacuucaaauucuuaucccaucagucugucuaucuacuaucuaucuaucuaucuaucuaucuaucuaucuaucuaucuaucuaucaucuaucuaucuaucuaucuacauaucauguaucucucuauccaucaucucuaucaccuaucuaucuaucuaucuaucuaucuaucuaucuaucuaucuaucuauccaucuaucuaucuaucuaucuaucuaucauguaucucuauccauccaucaucucuaucaucuaucuaucuaucuaucuaucuaucuaucuaucuaucuaucuaucuaucuaucuaucuaucuaucuaccuaucuaucuaccuaccuaccuaccuaccuaccuaccuaccuaccuaccuaccuaccuaccuaguguggugaggacauuugaagucuagucucuuccuaguggugaaguauacaauacacuauuauuuguuugcuauauccgccacauugcacaguuugcuaaaacaaaucacuccuguuuaauugagcuucugugcccuugagccuccuucaucccuuuccacagcauccccaccuggccacagguuccacuauucuuugcacucugcuucuuugguuuugaugguuuuggauccuacauagaacugagaacaugccacauuuuucugggcuuggcuuauuccacucuccacuguggucuauaauucuauacaugcuguuaaaaauagaaauuucccuucccuuuaaaacuugaauacuauucccuugugcauauauaccuuuuuuuuuuuuuaaacaaagccucuuuuaucugcugauuaaaacugagacuguuuccauaauuuggcucuugugauagauauaugaagaauguaagacugcucacauuuuuugggcauacuuauuucaguguguguguguguguguguguguaaaugcuuagaaggggccaugguaaaucccuucuugauuucucucucugcuccagugucuugguuaauagcucucgaguguuagaaagucaguuguuagccugguuuccugcuaugacuccaucagccccugcacugacacagaugugaguuuguguugacacucugugaacuuucuuccccaguaccacuacagcaucugacccaagucccauuugucccaucugccguguugguuucccaucugauugucaacugacuuccuuuuuagguagaaucuauuucuguuccccuugacuauggggacuuauucuagugacucacuugaacagaaugugugugaguggcgaugugugacuucugagacuaggucauaaauggugcugcagcuucccuguugcuuuaugugggaucccaugauccaggaggaggcugccacccuguaccaauucuuaggaaugacaagugagaagucuauuuggcaagggacuaaguacucacgacagcaccaugccagcaauccaagacuuaggcugaaaucaauaaaucaaccaaucagucagcuaaucaaucaaucucucuauguauguauguauguauguauguauguauguauguauguauauguauguguauguguauguauggugugcauacaugugaaggugcaaguauaugugcaugcaggggagccacauguauggaugccagagaaugauuuuagguauaucccuugguauuauuccauugcauuuugagguagagucuaccagugagcuuacagcucuucgaaaggcuagacugacugccccaggggcuuuaggaaucugcuugucucuuccccuccccuccuggcucugggauccuagcugccacgggagagcaguguggauccaaacucaggcuguguggcaggcucugcacugacucagccaacucucuagcucccuggcugacauuuugaccauuucauuagacaaccacugccaggacggugaagcugagcuauuccaaaguuuaggcccaccgggaggaaaagccugagauaaugaauauuuauuguuguuuuaggcuucuaaaguuugaacuaauuuguuauguaguaguaaauaacuaauacaucuuugaacuuuccccaccacagcuggaggucugucucccuuaauuaauaacuguaaucucuuuaggaauaauggagauuuuuuucuuuuguuuuuugaucauaaaguucuccuccagacucaccauaaaaucaagagcaacacaaaaaggagauuaugccuaucacacauuaucaugagguccccacagaugggcaguuagcauuuugugacuaugauggucuagcuccaacgagcugugugcacugaucauaaugauauacauuucuaggauguucuugacauguuuguacucuucauuccacaaugcuuuaaguuauauaauucauuauauuaaaaagaacugaagggggcaugagagauggcucagugguuaagagcacugacuguucuuccagagguccugaguucaauucccagucaaccacaugguggcucacaaccaucuguaauggggaucccaugcccucuucuggugugucugaagacagcgacaguguacucacaugaauggaauaaauaaaucuuaaaaaagaaaaaaagaaagagcugaaacauacugcccaggauucacaaagcacaagccuuggucaugagcauccauaaguuuaagcagcccacagaaauggaaggggcauuggugucuugcuagucuuguauuuguacuuuaaggaauagugggauuaaucuguuacacgauaccaugucugaauauguauagaaucauuuuguuuuuguucaagacaagguuuuucuauacagcucugacuggccugaaacuagaucuuguagacaagauguccuugaacuuucaaugaucuugcaucugacuccuggauguuggcuggggucgugggcagaccccaccacaucuggcuuaugcuuguugacuuugaaucucaaaccauauaguauaccuacucuuuguacaauuuagaucaugauaggguaaguaaacuauagaugauauaaacugcagggauguauaaauaauaccauuuuauaaaagcgcccugagcaucuuucgcauugauauucugauuccugugggggcugagggacaucuguauuaagauuucuuauuucuaggcuguuuacagucccucacaacaaagcccaucaggagauacuuagcagcagugcucugacaccagcucacagcagcuugucuacagggacuuuacgacauuaugccauggucucucucaaaaagcugacuggacucucauagaaaguauuuucagggaaguaguucuggggagaguguuggccugcuguaugaacauaaggaccugagguugagguuucucagcacccacacacaaagcuagguguggaugcaugugucugugaugccaauccuggggugguagagacaaaacaaaccaagggccuuacuagccagacaguuuagucaaucagggagcucaagguuuaaugagagacccuguuucaggggugauuauggucgugagcaacagaggaagacauccuauaucaaucuccggccuccauauguguguauguauaugaguguguauauagacacuggccuccauauguggcuguauauguguguguguauagacacucaucuguauauguguauguauaugugugaguguauagacacuggucuccauauguauguguauauauguguguguguguauagacauuucucucucucucuuucugugugugugugugugugugugcguguguguguagacacacagagacacacgagguuucauaaagaggcuggcuuaaauuuaaaaaaaaaggacucaugcuacauuugaugauucuaccauugccuccuccaucuaaucaagaaauaauaauaauaauaaaaaagauuuaaaagucagauuguucauuagcauaacagauucuguuuaucugugcacuuccacuccgucuaacaaaucggagaaagcacauuuucccgcugaagauagcauuuagcaaaucucuuuggggacagaaauaagugcaaaccauuaaaaaaauauuaauuguaggagacauguguuccaaaucacucuucuacauuuuccucuggcuagacaugaugggugccccaggcuaccuucccagugcaggcuugaaccauaaugcuuuucaagucaaacauguaaaauaaaaaaccaagcacuuacguaagaaaacuucuguuuucuguuuagaauguauaagucagcucaccaguugggggaaccgggggugagcacugacucaugggaccaucagguauuuuuccaucuggccaggagugugggcgggguggggggaguguaugugggggugugcuauaaugguaaagugcuugcauagugugcaugagggagggaggauuaaccuugaaagacaaaugccaucaaucuggugauggagaguugaagauacuacucuuccauuucaagaaagcuaccacggggccagcucauugaagauggauucucccaacucgggucauuuuacaacucuugauaggucuucugcucugaauacaccuuguaccucauguugauaaagcccccaggaccugugagcacgugcucuacaucugaauguacaucaguuuaaggaauagcaagagaauauuuugguccaaagugacagacagccuuuccucuagguucaaugaaaaacacacacacacauauaugagggagggaggauuaaccuugaaagacaaaugucaucaaucuggugauggagaguugaagacacuacucuuccauuucaagaaagcuaccacggggccagcucauugaagauggauucucuucacauauguguguguguguguguguguguguguguguguguguauguguuuuaccauacuuggggagcauacaacacuaacuuuugcaaagaacacucuuccugauguggccuuugggaagcugauucugacccaacccuuuacuccuugcugcuauggugaccauucauccaucaagagcauccuaucugugucaggagagcaggcugguccaucaagcagagccuuccaccccagcuugcaugucuaccccaucugugcuaaugaaaguuugcuugaccacuguaggcuuagauuaagcaacucuggcccccucaacacugugcaagggaagcuggacucuucauguuuccccugggugguccccuguguggguuggggcucucaaacccacgugcugagccauuaugucccuggcccauaagcucuguguucaacucaguagaaagguuggcucuggucacccuacaguagauuucagggggccacaaugauuuucaaaauuuugcuugugaugguuaguauggaacagguuuuuaccuuuuuaucauccuguuuaccucuuuguaaacugcacuucuaguccagagcaaacccgguguauuauucucgccucugcuucacugaaauaugguuuguucucuccaaagcucaagcugaaguucaauccccauuuugaguuacuaagugagaagggcugggaccucuaugaagcaauuugaguuuugcccccacgaguggucugacccauucaugcccuauggauuaguggguuaauggguuauuuuaagcgggucagcuauaaaagccaggcuggcuagaucucugguggcucacauaccucuccaugcgaugcguagugccacuuugggacguggccggccagaaggucaccauuaaauguggucccuugaccuugcuccauaaccacgagcgaaaacagaucuguuuucuuuauaacuuacugcuugguaguaaugugcuauuagcaacagaaagcggauuaagucacccuccuuccauccucucugcucccucugagaguguggggaaagcacaugugggcucuguuucucaucuaggcaagccgcacugcacuccagaccugguccucuccccggcguggaacacacagcccaucaccagggacugacgucacccuugcccagcucagcccugggcuuaguucuuuuuuuaccauucaaacaagcgugcauaucccagccccucauucagagaaggcuucaccugguagcccaggcugucuuugaacucaagaucugacagcuucaaccucccaugugcuggaacuaggggugugucauauaccucacacucagugcuauaaacuccuuuucagcagcuuacuuauuuuggaauauuucaacuuaaaaaaaaaaaagccaaccaaccaaacgaccaauuaaccaaacaaacagauuucaugguggggagauauuuacacgaaacccacuuaccagcacccaaauaccaucaugcuucaacauuuugaauuauauuuaauuugauaucacaucuauuaaaacaacagaccauuaucuagcucaagugcaggcgucuucagagucgugucacguuuugugugacagacauugaaucugauuggaacgcaaugggaaacaauguucaguggggaacaucgagcugaccggaugcuugacuaaucacguuucaaagcccggugcuuugcccgcagacaucuuccuuuaaaaauaagcaauccugcuauucauagccuucucuguacaccgcggcguugaaggaauuugagaguuugcaaauucaaaguugcaaguuaaaggcccauggauaagacuugaauccauuuauccacagugagaugaacauggcuuugaggaguccaaccucauuaggaucaucagaacggggucugugaucugguagaggcuguuuaacuaaccuccugcccggcgcaggagaccguguguuaacaugagcucugucuucaaaagauggggaugauaaccacagaaucacagaaccccaaguuucucagucaggguuauuuuuauuuugcaaaaaguuuaggauaccugcuucuccuccccuaacacgcuuuaaaguaaacccugaacccugcaggcaugaucaaagcccccccauccacagcagaaagccugguccuccaagccugcggagguuuuccagacuaaugaacuaaaacacggucagaugccuaguugccaaguauuauguuaaagugcguaucuaaugagauuucugcaugcuaaccauaaaaccuuaaaaagagcacaaggcuuccgugaagcaaauacauuaaaaaaaaaaaaaaaaaaaaagcccaacagcaaacaaaugccucuaagggaguggagaggucaguauggcagcugaagaaguuaacggacauuugaugaauggaaaaacaaaaaaaguccaaaccaugcccacaucugauauaguggguggacaugacaguaaugaggggacgauaaaggagcccucggauucccacagcugacuuaacuguugcucgucccacacaccuguguguaucuguaauggaucguccaaaugggcuuguucccacacagauggaauuccauuuccagacguccuaccggacuacuuaggaauggcacaugaaaaucuucggccaaaggucuugcuuuaguuagccuuggcaucuaugccaucaacuacacagaagaaguuugccagaguucuggaggcucagagguacaaggucacugugcaggaaauggcugacuuacuggcaagagcuuuaccucugaugcagauggccauccuccugcuguagccucauauggcaugacauggauauuaaucccaucccugaaggcucugcucuuauaauuaaucaccuccccaaaucuucaccugcaaacaccacaaaaaaaccaagacuuggcauacaaaauuuggaggaacaaaacuccucaguauauaccacagaucucuuuguuuauauagugaagguuucuguggcauuugaaugagaacauccccucccccaccccguagacucauacauuugaaugcuuggucccuaguugguagaauggcuugggaagaauuaguaggcguggucucguuagaggcaggcuuucagguuucaaacccacaugccauuccuaguuggcucucucugcucugugcuuguagagccagacaugagcucucagcuacuguuccagcgccaugccugucugcugccaugauucccacaaccaugcugcucauggacgcuaauccccuggagcagugagccucaaauucauuaguuucuuaugccuugcccugguuuugaugcguuguaacagcaguagauacacagagacuugaacuacucugaaagagcuuugcaaguucuuuccuuggcccauacccgucacuccaucuuuauucccugauaucagugaggcugaacaaagacuccugccaucuugguccaugucaacauggcuagccucuaucuguucuacacugauaugucuggucuuauagcuccuguccugugcaagacuaggcagagugagguugcacaugccugugaucccaggacugaaguagaagaacugggagaucaagguugucagcagagguuacagugguuguccgcagcagagguuacaaaugaacaaagaaugaggcgaagaccggaaacggcaggcuagaggaugacaaguacaacggaagcagcacagguguuuagcuucaggcaaggcaccugggggagacgugugcgaaguaccuuauauaccugaaaugaugcuguuucaauaugaacaugacacaccccuugagggcuugugucuucuagcagcuggugcugcuguuugggaaggcugugggaccuuuaggggaugaaaccucucuggaagggggguugacauggguaggccuuggguuuuuauagccccacccugauccuuaccugcuucaucuuuccuguuggcugcagagggacaagccagcucaugugucugccuccaugugaccccaccuugauagccucuauccccccucaaagcugcaggcugagauaaauccccugaucccuucaaucccuuccugucauguaacuggucacagcaagaagacaaguaaccagggcagagaugcagauccucucuuagggaugaagucuuaauuuuuacuuuucucagaugaaaacaacuucaaaaacuuuauucauaaucucaugaaaaauccaaucaaagauggguugauaccaaaaaggaguuauuacuugauauuuuaaggucauuuucacuaguaucugaaaugauuuuuuaaaaagauuuauuuauuuuauuuguaugacuacacuguacuagcuaucuucagacacacuagaagagggcaucagaucccauuacagaugguugugagccaccauaugguugcuggcaauugaacucaggaccucuggaagagcagcuggugcucuuaaccucugaaccaucucuccagccccaugaaaugauuuauuuaagaucaacagaacucaaauaaucuucuaaccaugccacucuagauuaauuuuuauuuuuuauuuuuguuuguuuuuuugugagacaggguuucucuguguagcccuggcugugcuagaacucacucuguagaccagguuggccuugaacucagggauccaccugucugugcuuccugagugcugggauuaaagacaugaaccaccacuucccagagucauuuuagauuuaaacagaggaaacaaggcagaauaagacacacagucguaauguaauaugccuuaugaggccacggaacacauuuaagcagcccuuucuugguggagggacuucaugguaaguacacagguaacacaccugacacugacucuggaaccagccugagggugaauucuauacagaagcuucaugccuugguaacggaagaugagaugcuaaggggaacaaaugccuuguuccaaggcaagccagcaccggucuguaaucccagcucuuagauaaaggcaggagggucagcagcucagauuauccuuggcuacauaaaagaguucaaagccagccugggauuuaugggauucugucuuaacaguaagaacaacaagggcaacaauaauuaaaauuagguaacaggcucuuggaacccaggcuucuaaccacuauguuguaacacuuccuaaauagucaaaagcucugccucugcacuaaccaacaugcaaacagacuuugagguccacagaaaccaugacaaaagauccauuuccugcccccagucuucaagacaguucuaaauucuaggaacuucauucugaauuauugauaucucuuccucaccuuuuacaaggcaccuuugaugagccagugauauaaauacguguuuugcacucaaggauuuuuuuuuauuaagccaacaauaccacauuccuuugagcuuugcuuugaacauugaccuuguccagggagggcuggcuaacccacauccugcagggccccugacacagucaagcauuucagaaaugcacuuggaugguagcugggaguuuccccuagcaauggaaaguuccagucacacugugcagaggaccaguuaugccaucuaccucccucccccuauugaccugggaaaccuacccacaaguagagcuggcuccugcccauggagucacagaugcuuguggaccaacggaaagcuuucuaccgaagacgcucauguuugcgagugcauccuaaauguggguuuccauugcugccuuccacuugggagaagaaacugaccuugaggucuuuuaaacugaggugcacaccuuccaucuacaaaacccaacacccagcuacucagcucuucuuugaugcuuguucaauaccaucaccucucuaagcugguuugugcgauggauugaaaaaaaaggaaaaacaaacugcaggugauucauuguggccuguguuguuaaaacuucccaugcucaucauuagcaaaaacccuuucucccccgucuuucaacggagcuugaugagaugcaaacagaaccauuuucgguuuuccaacugaacgggcauggaaaaaaaacaggacaauaaaaagagcggugcuuugcuuaucucgguguuacacauuaacacaguccuccguagcagagguucuucaggguaggcacacuucagaaagucaaauaauugacagaguaagcaccauggcacugggaggcuggagccagcacugggacagacugcagaucaauuuuguacugaauccccagucuuccgaagcgcaacagaaaauacauacaaagagaagagauuugcccucuuucuccacuaaggaaauauuaauauaaaaaccaaaacagaguuaacgggaagacagccagaaggcgaaguucuaugugaucuuuccagguggcuucugcucaguggggacucugguacugacaugcuuuuucugugaccacgauuuuccucacuaauaguaagugaacaauaaaacuuaccacugcugugaauaauaccguccccagcaccauguaauaaauuuacgauauggcaggcguuaguucaugcucuugcacacacaccucuguggaugcccacgagaaccuaauagguguauuuacaggcaagggcucugguuaagcaacagccacagacucacagaacuucagcaccagggccaggauuccagaauagcuuugccucuagaaccugcaucuuaucaagaugcccauugcuuucugagcaauggcucuuugacauagcuuucucauccccucacagcugaccaagggcuuggugggcaucugaacuaauuccuagcuacgagaacgaaagaaccaucaacucgauuucuuccccuguacaacgggaagaaacacugaccuuccaggguuguaguccugaugaccaaguuuucaaaauauucuguaugccaacagcaaaagugaggggugcugcugcaguuagauauugaggguccccucaaagcccauauguuaaauauguauguggucccaggucagguuucuuuuggagaccguggaacccuuuaagguggagcuuagcuggaauucuuugggucacugggaguguugaguuaaggguaugaugagacacaagacaauuuguuuucaccuuuuuuuuuucuagaaaaaauauuuauuuuuuuuuaauaugugugugugcuugugugaguuuacacacaccguguguaugcagaaacccuugcagcagagaagaacaucagauucccccuccgaaacuugagucacagaugguuacagcuguccaaaacucugugagaacagaaagccccucuuaaccacugagccaucugucccuuuagcuccugguuuauaucccuaacccccaauuccuagucaugagguaaacaguuuuucucuaccucauauccccagccacgaugccucaccauaggcucccaagcaucagagucaacaaaucguggauggaaaccucacaaacuacgaaggaaaguggucuuuccugccagugaucacauuagcacagguguugcuauggugacaggagauugaguaacacagugcaugaaauggggauguggauaugaggauggagauaagaugaaaucuuuaccccacauccuccauguccauccuucuaccuggccuagcccugugcacucugggauaugggugacagcugaaaccacugaagccaccauacuaaaguuuauagcaaaaacuuaucucccagccccaccccuguccagccguuuagagggagcuuccucugugaaauguucacauucuauuuauaacugaccaggggaagcucuggucucacccacaccauuucccuacaacauacacuggacugggaaguucgagaagaugguaagaaaagugcugaaacacuuuuuuugaaagacaggaguggauaggaccugccgauaauaugcuuuuccuuacagaauuaucugcugcaucccuucccuguccaggggauggcagugucaaccccauauucuucagccccucgucaugcccuuguuuggugcuucuggaaucuaccggucuaugaagaaugccaagagaugccauauagucuacuuggguguuuucucuuccaggagucaacacccgcuuccucuacggggcuucccccuuuugucaguacaggaaguaagaaucccaauggguauuuaaagugggccuugguggauacuuucuagaacauuguuggcuacaggguggaagcugccuucaaugcugucaagguuaaacuugccuggucgucauuuuggaauuacccauaugucacacguguauuccucuucucuccuggcuuagacccagcuauguccuaaagccugggggguggaggugaggugcggugggggugagggugagggugcagggaugggcaguugaacuugacugcugcugacaugcugagaaauuaugugggagggaacuagcauuuagaucucuccuguuccacuccucccacuuacaccauggaacacauauuuccccccccccccccacaaaggaaaacauuccugaccucguuuuaaacauuuaucagaagcugucuagacuugcaguaaagucacauuucuuauuagucacauccuacuccguguguggugugacccuccgaucgggacaguaaugccuagacccugagcacaaaaacauuuggugauggaagcgguaaccacugcccagggacucucaccgagccuaaaugcaagcagaggcugcaauaugaucuuaggauuccugguagagccaaggguuuugguuaccuuucucacuauugccacaaaugcuucccagaggcaacguaaaagggaggaaggugggcaagccggagagacuccucuauggucgugagaguuuggaacacggcuugcugcccugcaaugucagcagguuagaaagggagaguguguggguugcgaagguggcagguuauaaccuucaaagucuuuucccaguuuuuuccuucuagcuaugcccccuauccuaaagauuccacagccauccaaaccaguaccgaccaguaggugcuuaaacagcccaaguggacauuucacacaugagccauaacagcucuuggaucuaugggacccugauguuugcauacuuauuuauguauuaguuuauuuauuuauuuauuuauugugugcuuaaauaugcaugcauguaugcacaggcacaugugugucaccgcaugcguguggaaauagaagacaacuuccaggaguugguucucuucuuccuucauguuuaacucaggcuuaaacucaggcugcaaggcuugguagcaagccuuuaccagcugagcuaucucacucgcucuagaagacugauuuuuaaaaacaaaaugcuaguauccucuauucguaaagggagaaaagaacuagugauucuagguuuucaacacaaauaaaggaacuugcagaguuuuuaaugguggcucacaacuguuucuacuuugggcuuauaaucaaaccauuuugccucccugguccuuugacauugauagauucgaucacacuagguauuuuauguaaguaauuagcacccgacagauuuuuggaugcacagguaaaaggcaaugcauacuaggccaacugggccaguggcacuggugugugucggacagagguagagcaaagugagaggagaggauaugugcauaggcaagcugagugggacuuggcuccaguucccaccacauccuguuggccuugugcuguuguggauugaaccgagggggcccucuguuuuuaaccgauuaaagggaaggacgaagccauguuggaagaaguacuuuugggaccuuggauccucucugauucuuuguuucuccaugugaaacggaaggaaaaagaagcacucagugacuugaggacucaguuccaguaagaaagcccuucugagagucagccuuccuuccugagagucccaccccccaccccaccccgcccccgaguuccuaaggaugccuuauaauuuuucuuuucacaucaccacugguccugggcugugaucugggauggucucauagacccaggagagaugcccugugugggcucccuuagacugaucuuugagucuaacuccaauuugaauuuugcuuuuugcuaauuaaaagaaggcugucaaaauggcucagcaaguugaggggcuugcggcacaaacccggcagccugaauuugaucccuggaacucacauaaauaugggagagaauugacuccauaaaguuguccucugccuuccacacaugcaugcaucggcauauacacccccucccccaacuuacaacuaaacaucuuucuuuaaauuaaaaaaaaauuuuaaaaaaaucuuuaaaagggagagaaaauucccuuagauguauagcaguguuuacauuccaaaaccaaugauacaguauccuucucaaaucauuucauugguauuaaaagauguaacaauacaugcuuaggaugccaauucaaacaauaggcaagcacgagaaaagacaguaaaggguccucuuuaauccuaugauaacccacccccaguaaccuauauucauuguauauaguuuuccauuuccauuuuuaaaaugaaaaaaaaagucagucauauuaccccgcaggucuacccuuuucccuaaacaauguaucaaagcucgaucuuugcuaguaaaguaggaacuucacuguauucuguagcuguacaacguuccacugcauggauauacuuaagagaagccuggaagguuuuucuucugcauaugaacuaugagugaguccauaccuguucuuauauguuuauccugcuguucuugugucugcgugauggguccccaguacugagacugcuggcucagaggacauguggacuuuuaaauuaaacagguauuccuagauuacuugggcaauucacagcccuagcaauaucgagagaaugcucacuuucucacacauuucccgguagugagaguugagaguuuugcaaaaguggggcaaccugaaggggcaaugcuacugaugauuguucuuuuaauugcguguggggacucugugugaggucuaguggaucuucguguguuugccuggccagcuguggcugcucuuccuuuccucacuguuuauaguuuuuguuaauuuucuuagauuuaaguuuuacagauguacacacacaauauauauacacacacauauuccccagcucugauauauauauauguauauauauauauauauaugcacauauauccauacauacauaugcauauauaugcguguguguaugucugauauauauauagucugauauauagauauaguauguguguguuaugaaccuacagagacaagaagaguguguuaggcauccuccucuauaguucugucuuaguuaggguuuuacuucugugaacagacaccaugaccagacaaccaugaccaaggcaacucaacauuuaauuggggcugacuuacagguucagagguucaguccauuaucaucaaggcaggaacacggcagcaucuaggcugaacuccuggcaucugucugucucucccuccuucccccagugccagugucacaggaauauguggcuacaccuggcuuuuucacacuguugcuaggggcucauacucaggucuuuaugcuugcacagcaacugcuccuacccacugccccucccgcugcucucaagguucuucuauugcuugcucuugccuuucuuuggacuuugcuucuauuucagaaauaugucacuuauuucuaauuauuagccauucacuccaauacugaguucuaauucuuacuuucaacagucuuuauuauuauuauuauuauaagacaaaaaacuauagauuuuauguuuguagacacauuuuuuagauaugcuuuuagagaugguguugguuggcccuuucacaugccacucuccccccucccccccagugcugaggauuaaaaccagggucacccacacacuaggcacgugccccacaacugagcugcaccgugucuuagaguuuuacugcugugaacagacagcaugaucaaggcaggucuuauaaacaacauuuaauugggguguuuuacagguucagggguucaguucaguauuaucaggggggugggguggggagcagggcagcaucuaggcaggcauguugcaggaggagcugagaguuucuacaucugaaggccucuaguggaagacuugacuuccaggcagcuagggucaaggucuuaugcccaugcccacagugagacaccuacuccaacaaggccacaccuccaaauagugccacucccugggccaagcauauucaaaccaugaccacccccuaccccccuuauucuuucugguaugagaccugauuuugaucuuacucaguguuuauuuuuaugucagauccacaccagagugccauuuugaauguuuucagugauaaaaaugugaugacuuucugucuguggcuuccugguuuuguuucccucgacagccuuuaucugccuucauugucucugugucgccugcccaguuuugaacucuucauggcagcucuuuguaggugaaaggccccugcaacugcagcuccuuuagcacuuuccuuggguccccgguaccuacucaaggguggguuucacggugagcaucuguugagaguuucuguagucagagcugucauuauggccuuccuuugcucugguuccuuccucauggcggcugacuucccaaagccuuguggcacagguuccaacucacuugcacuguggcauuuuucagggacagaucgucaccuaauguuuugguaucuagugguucugugccuuaaauuuuuuuuuaagcuuugguaaaacacauacaacacgaaaugucagcaauaucagcaucuuaacucuucuuucuuucccaccacugaggagaggauaugcuaggaaaacgcucuacacgugagccauccacccaacuccaccucaccuauuuaugugcacaggucagcagaguugguacccacuuacgauggcucagacugugugccuaaaagguugccgugguacaagagugguaacauacagcagaggcuguacaugaagauuuggaggguuuguuuuuccccaggcuggcacugugagggugugacauucucagagguugggugccaucaaagagccgcagugaucagccagccccuccaucacaaggggaugcagcggccaauucgagcgcacugugcucugaugccaugauggaacagguugugagugacuacaguuacaguucguggauggcuuuuagcaccacaugacuccucaugagcuaacgugcaucuaucuauccacucacguuguugugagagcaaucuucagaauucguuucaucuuguaaaacuggaacucuguauccauuaaacaccuuccuauccaccucugucuuuugguucuggcggcuccaucuauuuugcccagggaacagaguucagggagauggagaaacucugcuguugccauuucuccaucaacacagauccccugcaaacuggagucuguucuagagcccucagcuacaguauggcauggaacucaguaagcuuuccuguucuuaacugaggacugagucguuccuaauugcuauaguguuuggcagggugacaaggugcucucuuguacuuauuaaagugauugauggauaacauaagaguugccauccuuauagcuuuccaggucaauaugcaacacgagcgucuagagggcagaugcagcuaacucuucauuaccuggcuaaugacuggcaggaagaaggaucagaugucuucaaaugaaugccaaguguaaguacuuuauauuucaugccauaggaacuaguagcagguuucuuuacuaauugguugguccaugauaacuugauaauauaguagucccuggacacugcuugugaguauuugaagagaaagggguggcccagaugcacauggaguggcuuaauuagaagcacacauuugacauaggugcacccaagguagcuaagcgaauuggguaugcaaucagaguuguggcuaucgucacuggcagaauccaaaggaacaaaaaucuugcauucauccguggcuucacagucuuaugauuucaaauuugucacuucauuaauuucucuaaugguggccauggccaucggaagcaggaggucaugguauuccuuuguaaugcuacuuauauaaucugaagagggagauuggaagagggcacguguaaaugacgaauguacaaaaacagagaggcauaagcuggcaguuuuuauaaaccgaaacucuacauccagaaaauguugcuaagcaucauuucagugcuuuguucacacacaaacucauaaaucuaaaauaaacgucaccuuuccaugagaaacuacuguguaccacuuucucugcugauguccaaagggcaucugugugcuccucaguacaaaggcaugcuggguuuuauggguucaguggaucacauucuuauccugcggauuugacaugcgcgugugcaauggugagaucuccgcagaggacucaauuguauucaagcagauugaaaaguaauuuguccgcaggcuuccacucuucaguggcgagguguuauuuuuagagacacagggauuuaucugauuaccucuucugauuuccuuuacuuuuuuugugcuccaccucgggaagugaaaugacccguugguuauuucauuucaugaagcaaacagauccaagccaucuuggaguuagaucacuugcaacuagccaagcugaucacaaggauuuggaggaucaucuuaucaagcuauaucagucaaugucacuggaaucauuuaaauaaauguaucaaaggacaucgguugauccucuggauacuuuucuugacaagcacacaugugaccuuacagaauaaggcuaugcacuuucuccugcuaguaguaaucuguuacuggagacugcaggggugagcagggaguuuucaugaaggaaacucacaguaggaacacaagcuggaacaaguagauuaagaacuauaaacagaaccaaggauggaggcacacaccugcaaucccagcacucuagaggcugaagcaaaggcucaugaguaccaccaaccugggcuccguaucaagacuuugccagaaagaaagauggcaggcaggcaagcuguaaaugaacgaggaagcaucuagcacauucaguaggcuccgacacucggguguggcagguuugggauugaguguggugcuuuaugccugcauucagagcaacucaucugaauucuugguuuagcuguaucuguuuccuggcaacaggagcagggcucgggcauccagauacacugcaucaugguggccuacuuuauaauauacauaccguacccuaucacacacagccuucuccuggggauuaaacaggugauaccacauacucacccacagggaaauucucauaaaucccacugugcuguuauguuaucucucggucaaaaaaugugaaaaauucugccggaagccacaggcagcuuccuccgcgcuguaaguaucuugucagcaguguuauuagcagggauaauggccucacagaugacugugcuggaggccaaagauccagaggaaaggaaggacagcccccaccccccaccccccccagccucuggaaggacucaaggucagcuccaaggacaggggcuaucuuugauuuuggcaaagcccucagauuucugcucuguuaaguuuguggggagugguugagccuuuuugguuguuuuguuuuguuuuguuuuguuuucagauaccaucuuccuauguugacucuucaucuuccugccacagauuuaugagugcuggggcaaaguuagcgucuuuuuuuuuuaaauaacaaaaagaucuuuaguaaaaauaaaaauuaaauuugccuauauucccaggacacgcagaagcugcggagcagcugaaguuaauuaacaaguauuuauaaacguagaauccaaauccauccugguuuguccacagggagaaacaggagacacugaguuguuggagacugacagagagacagcaucuucacugucccagcaggccacugcaccuauuuaaaacuucccuuuuauuuccuuugccaaggaacuagacagagugauauaaaucuacuguguauuuuuuuucuuagcauuuaucaagguuuuuaaacacaccucaaaaguuaaaaaaaauuauucuuauguguauggguguuuugacugaaggugugucugugcccuaccugcauguccggugccugguagaggcuagggaaggguguuagagccccuggaaguagaguuauagacguuugugagcugcuguaugggugcugagaaucaagcuuggguccucuggaagagcagccaguguucuugagugcugagccagcucuccagccccuagagaaauccugaagauucuuuugcauuaacauucuauuauuaguucaauuauaaacaaacaagaauaagauccguuccuuuccacccccauaugauauuuugggugaaggaauaauaaauucauuuauauacuaugcaccaaggcaguuauauuacuuauaaguaccuaguaugcaaucagguuaaaauguguuuguucauuauauguacagguuacaaguaugacuguacccucguucauuucuccaucugaggaaaauaugcuuuuggugauuacuaauaaaguuacauguaugcaugcauguguguacuucccucauguccguguguuuuuuuacugacugggcuuacacaggggcuacccuacuuugagucuuaccaucuauucugccuuucuguacucuccaaccaaucagagcauuagcuuuguaggauccauacagagauguccauaucuuucuugugcauaaauuccuuuuggcacacaacacaacauacacaaaaagcaagaacugaaugggaaccaaagggcuaauuuuccacuaucuuguaggaaggcaggaaaaagaaacgggggaacaaucucccauauaaccuuccugcugcucuaugaaauuaagagcggaaguccuauuugcagggaguuaauggucagaaggucaagggucaggacaaaaauccagcuugcuauggaacaauaaaggcaagggcagaauguguuuguuggaucaagccccgagccccaaaugcuuccuugaacaucuguucuugcccaccauucuauuauggugggauauggaaaggaggcccaccucacaaaagaguucugcauucaacguccuugcaaggucccuacgccugaaaaauccaccuucacgguucaugcauuugcucauucggugccuaccacaucccaaggcuuugcaaggcuagagauucagugaugaggguagcagaugaaaaccugaggcucaaggaaggcaugcucucgagaaacauccaacaggcuggaucauguggguuuagguaaauucuuacguacugugauaccgacagaggcgaacacauuuccacuuuguccaaacaggcaagagcauugaacuagccaggaggaaagacagaggccagcucugagcugccugcaaugugagaggccauccugcaguucaagagcuuccauuugcuauggaggacaaaccugaaaaguuccuuggcuguaaaacacugaauucugggcaggcagagcauauacuaccccauuguauaagaauuucucuaagaaugagcauccccuauagaaaugggaaaucacguuaaaaauaauaauauuccuaggcucaggcaggacaugaagucaucuggaaaguguuuaugaguucccuggcgcagcucacguccagagcaauuaaaucagacucuugggaguggagcucagguauagccuucugugacuugcccuggcgaucagaccagcugaggacgacugcuccaaaaggugagguggccuugaaccugcaaaguggcagguaauaaugcucugccacguucauucagcucacaggugcugggucugcaaagcuagucauuuucuuagcccuccucucugcagccucauuucuaguccacacuugacaguaaguguuaucaccucucagacacaggcagccaaccuaagugggcgccuccugagucuaaauuugcucauuuacaguugaguguuuugauuuuuuuuuucaaacguguuccugccaagcugaggcuacacgcguaggucaaagaacagaaacacagagaaggaacuauuauauauauauauauauuuuuuuuaaucagcaagauucuaagagccaaagauaaugcccagcgugugugcccccuggcacugauggcacucuucauguuucagaaugugauuuuuauucacuguccucuaugaagccgagaguuuaacacacacacacacacacacacacacacacacacacacacacacacaauucaaacaacuuauuagugagcauuccuaugucaaagaugcuggaagaacacauacggaagagacaggccagugauuauugcauugaaugcccccugaacccaaagcugugggcuaaagccaguaagggacaccacuagaagucaauacaugugacacugagcuggaagauggacacuugcuaugcucuaaagcacuguauacaugcuagccauggaguccaagcacaggugccagccacuagacccucuuuauggagucugagaucccacagggacaggugggauuccuugucuuuguagaacaagguagaaguuuuuagagguuggucucuauuacuauuauccuacuacauuaucauguagccauaaacaaaguuuucccauuuaaccugggggacauauaaagcaguguugcguuugcauuggucagaguaagacagcaucacgccauagaaaugacacuuauuuuuuaaauaaaucuuugagaacagguuuugcuagauagccuaagccgguuuggaacuuccaaaccuccugucccagccugcuaaguguugguacuacaagugugucccccuguaucuggcuuuuguugcuauuucaauggugcuuagaaacucacucaggcuucauaauucuaguaacaauaagaauggacaugaaucgaaacggggccucucugugugcuagaugcuaauauuguuuucccacauuaucucaccuuuaagcggaagauacaaucauagcugcucuucagcuaaggaaacaacgaauggaguaaguuugguucagacgccagggaagagacguaaaggaccugacugacuccagugugcacacgcagaagcuccgugcuuuauuucuucacacauaccaugcagaucuugccugcuguagcacacuacaagcauaccacaagaaguaaaggcuagcuagagacagccggguaucagcccugaagucccauuguaccuacagucaccaggggcugggagcugucucccccaacuuugggcguauccugauugaggccauagguuccaguucacggagugcauaaagauccuaagauauccaaaaaaccaccuucuucaggguggugcuaagaaaaggggacauaacccucacuucuggauauuguguaccgaggggccucgugcuuguccaggagagaggcaugcugagugaguguuugcugacugucguucuuacaggggcgggucagguguggcucuggaaucuggugacuuaugccaggagcugagcagagcucaccacuuaaagcacuacugcagaucuguaacucauaauggccaggggggacugggaaagaaaagcuauuucuuugagcucagcuagacaggaaaagggggcagccugcagugaugggccaggcagaauggauaaaaagaaaaaggccucggaggagagagcauuugggugguagcgagggagugggagguucucuuugcugaguuuagaaagaccugcccugcccugccuugccaguuaccgucuagugaaccaaaggcuccaugguacacaaagccaagucagauccacucuacuccaccacucugagccucugauccgagacacaccugagcccacaggggccucuagcucugaagcccaggcuugucagacauugggcagcaucuuuaucucugccccggcuugcccucuccagccgggcuuagcaucuuuaauaaggggccacacugcaggacccggcuccuugaugucaaugcucacagagaagcgugcauuucauuuuccaucaaaagcuggcggcuuccugagggguuccuuuuggaagccaagguugccaucuaacugccgaaggccccauugaaauuccccuuuggagcccugaguucugaaaacucccacggagaaugaaccagcuuggaguccugcaggccuugggccacccugacacauuccugaagcuucauugcuguguggucccuuucaaaaccuuuggaaaguuccaggagauccauuucuugaucaauguuuucaucuuugccuggaguggagccagaagagagcagagcagaugucagauccaaagccuuucugacuccaccacuugaccgcuuggugguuaauuugugcggauguaaaugaaaugccugggaaauguuucucauucaagggaagacaugcugugauaaaacucaucacuuaugugcugacuuuaaaaaaaaagagagagagaggcaagcaagcuccuguagaagcuggaggugucccaucucccccaaaauacugugagaaacagggcaacaacagucagcugcaccagugccugguagaauauuaaagcacuagguuuuuuguuuuuuguuuuuuucuucuucuagugucgaaauggaauaugaugaauugaguucucaaauucuuccaugaauuuccccuuaaccuugucaagagucuaacuggugccggagagguggcucagcaguuaagagcacugggcugcucuucuguagaaagguucaacuccuaguaccacguggcagcuugaaacuguugguaauuccaguuccaggguaucuaaaacccucacucagacaaacaugcgggcaaaccaccaaugcacaugaaauaaaaauaaauuaagagucuaauggcaccacuaccaacaaauaggcuucaguaccaacgaaugcaaauugaugcacaacuacccacgaaccacccuaaggugugcaguagaaucucacguugaggaaguagagauucgcugggaucacaguacacaggccugugaaggaggaagccuaaaugguaccacuaugcacuguuacacugaaguugugacagccaccuuuuuacaguagccagcucugugaacuugucagcucggcuuggccuuggucucaugcacugugcuguggcuugaugaggaucaaccucaugaacgggccuuugucaacgcuagguuacucagccuguuuuaccuggcuugaaccguucuuaguuuucagaggcaagacuucuguguuacucuggccugcuucugggaacagcaggauuucuucccuggauuuccuggacagcuaugcugccucccccugcaccccccucuccccaccccugccuccuucccagcauucugcuggguuggagaugcuaaguggguggggccugcuguaagcccagcuguggcuaguuaaucuuguccucugugaacccagaaagcaauucggcacacuagcuuuuucaaaaggguccgaucguuuggccauuaauugaauuugggauagaacacgauucaacaauuuaacacauauacauuucaagugaaaaggaggcacgcuuccccccauuacuguggcuuucuuuuccugcuacaccagagucuuaguguauaguguguauaggggugcuccucaccaugggcauuuugagccccucuacccugacuccacuccuaaggagugaaggauaucuggggacaucuuuacuauuaccuuaagugaacaggcacaugaacuacuggguauaucucauuuuccaucauuuucaaaacuuucugaucuugucacucauaaacucccaaagggagggacauucgugggucccccugguuuaacucuuuugacaagaauucagucuuuccuuucuacugguuccuaagauguuugugcuauaguuaaaggcguagaggcaaagucagaacccacacggggcagcuggaggcagagaaagcucacaguccaauccccugggaggcccacugcccuuggacccuacccagacuuagagaagccagcugcccuuggacuccaaccaagggcacugugucggcgagcuguccaaaagaacaccccguauaaggcaguuucuucuagaaggcaagucucuagugaacccuucuagggauaggacagaaaucacacuaaggaugccaguuacugccugcucagcuccaucauuccaucucagagcugaccagugugagggaggggaaaauggugacggucucuucuacucugcccuccuaacugaggucccuucucagcucuaauggggggcuuucucgacucccacacaacugcgcuacaguuuucaugccacagguuuuuucccccugguguguaaccugaaugugcccguggcuauuucauuuaggcuuuuaaauucgcuuuccuugaagaacucuggaacgggcacuugccauuuaauaaccaauucccaaacuagguagacuguuacuguaccuuguucucuggagugcuugucucuaaaacagcgguucucaaccuguggguugugacuccuuugggcugguugggugucccauaucagagacccugcauaucacauacauacauuaugauuaauaacaguagcaaaauuacgguuaugaaguagugaugaagugacuaugccuggggaucaccacaacaugaggaacuguauuagagagucacagcauuaggaaggccgagaaccgcugcucuaaagggacccugccugagucccuuacccccucuucaaaguugccuguccccuuucuaaagcuacuccaggagcucagagcuucccuacaacuuggugacugagacaggaucaaucaauaaggaagaauuagugaucugcucacuguucuagaagcgucuauguuuaacaagggcaaacagggccaagaaaguuauaaaacuauagaggcauuauuauuggguuggggcagguuuuuuccaacauaauauuuuuuaucgauuauuugggaauuaccgacaccuggaucacacucacuuuccaguucucucaggucugcucccccaccauugcugcucccccuaacucccacaaaggaggaggaagaagaggagaagaggaagaagaggaggaggaggaggaggaagaugaggagaagacaagcccaguuuauguugcccauauauguacuggagcacgggcaaacucccaguggucagccacuuaaagaaaacuggguccuucccuccugcauccccaccagaagccacgaguuguggagagcuucacgucagcauccuugucacaguuugaaaguguucucuuccuggcuuucugccuaggcgguuacuaggggguggggaaggggcugucauagaagucuuguguaugucucuuucucaacugugagucugcagucguugacucucuuggaggcaacuuucccccuucucucuguuucucugaucugacagcaaggacagagaguaaugguggggcuguaauucaggggcuguacuggcugauaugcaagcaaucuaagacugaacuuaguaagacaguguucagaaguauaaggaacaccgggcacagguaaacacagccuggccuggcaaguuagggucuugggacugucaguucuuagacuuuuuucuaauugucuuuuguguucuuugacuaaccucucuucaauucuuccuauaccaacgucaccuuccaccucuguagaagaccuucugcucucugcuccugugaguuugacauuuuuaaguuuccauguaggaacaagaucaugugauauuugucucuuugaauauaacuuauuuaacauagucuuccaaguucauccaugcugucacaaaugacaagauucccuucuuuuguaaggcuaaauaauguuccauguccucucccuucugacuccauucccgcucccguauucgaucuucuuuagcuguuuuauuuauuuaucuauuuauuuacuucucugucucaaccaggauaucacucccccaagaagucauuauuggcucuuucucccuacaucuggacaccauucccccagcauaaaucugcucuuuuugcaagacagagcuaucuuaacaaaacauuacauggacauguccggucucaagauaaaccagucgccugacaaguucauuggcuguuggaccuccucuguuucagcuuccaguggaguuccuggguucauucaaggacaggaauggcacaguagcauuuacaugacauguuaccaaccugaaaauaaguuuaaaaugaacuccuuaaagaaaggguuuuaaaugugcuaaauaaacuucacugaaguuuuguuuuguuucuaacuuacaacacagcuccuggaccugacuauagcuagcaacaugcugugagucugaggauuugguggaaagugaccauaguaucagaacucaagauggcugagugcagagagucagauaaauucccugcuuagacgucaggaaggcagaagaauaaaucagaggcaugugugugucugugugugugucucucucucucucucucuguguguguaaggacacacagcaaggagcccacugucuacauucccagaggaaggcacuuccccuagggucuccucugucugacuaacaaacauauaccaagcuuuguuagccagacacugcguuugaaaggcacuauaagacagaggcugcccuuuauucuaggagaaacacagacauuuaaggagauggcgggaugguucauacagcacagcuuauacagccccgcucccccucacaucugugcucucuggcucauggaagugccccacccaccccacucauucacugccucacucaccccuagccucgauaccauuuccccguuguacauucuucaggguacacacaacuauguaaaaauauuguuuauuucugucuaaagcuuacaccgaacucugcaaguaagaacuugugucuauucauucaaaguugcuuacccugaggcuaaaugaguguuaggggaagucuuucauucaucaguccauucaaguacugaucugggcccuuggagauuugggcucuuugggcaacaaagauucucuucucaucuaaagccaacuuuuugauugagcaaggacaccaaucuucauccaguagucuccucaguuaauuggcaugucauucaaucaucauaaaacccugugauauaacuguaaccccaugcuacaggugaggaacucuauggacagagaggccaugagggaacaaagcuggugguucaugguagaguuaacauucauauuccgggagucaggucuacagcugacugucagcuacaggaccuuuguauaaacacacagcauggauccgguaagacuuucuugauguugaacaguacuaggagaauaguaacaucauaauggagcaggggaaagucaggucucacugagaaagugacaagaauuccaaggaaggcuguaugucugucucucugugugucccuguguauguaucuuugugugcauguccaugucuguguccguguguccguguccguguccaugugugugugugugugugugugugugugugugugugugcaggauguaggcaggaggcacucuaggcagaagguaguuccaaaggcauguagaacagcagccauauagucuagcaggaauacaggaagacuggagggaagagaucugauggaaucgcacugugaagacccuccuauugccugaguggcaguuugaacugagccauggaaggacuaagaagagagacugaguggugguauucuaggguccacaaguaacauuucugaagggugagaaaaugguacucaaauauaucagaguaacuacauggguaccaaggaacucagauguaaaggacuguaagcgaaaggucugagaacugggauagaagagcaacaucuucuguccuggcgccauggcuauucaucacgacccucaucaucuuuguccugauucuuuuuauuaaacugaauugucagucauccccgcccccccccccccccccguccaguuagccaaggaccucagugaauucuacuggcacucaguucacagugacggcuccaagacuugagauuauuagcucuuucacugcaggaauauagaaccaagcagggcaaggucucucgcuggaaggcauuaaaugguaaucucagugaagagcaacaccaggaggggcuccagggauccagggaaagugcucgguaauuuguaaccaauacacacuuccuucaucgucaagcccagauuugcuccgugcguccccggcuauacacagcugaagcuggcuagcugcucaauaaauauuaugcuuaaugaaaacagaggaacagaauguagauggcuuauuucaccugggcugaguucugcaaaaauacaccuucucucccucaaugcaaacacaaugcaaguuucuuuuggggggaaaggaauggccagaagagggaggaaauacauuuuuacucucuacaaagacccagugcuaaaugguacauaaggaagcaguacugucuauuuagcuuuuaucgcuguuagacugucccuaggaccccagaugaguacaugaucacccacucuccucugcuuuggaaagguauucuggaggcucucugucggcucccuagccccuccuguucuuccuggcacccuccuaccagagccuuagaagccgguccccaugugugucagggugagauggagagaugacagacugacuuaugucaagguuuccaauuuuagaugcuauuuaucuccaucuuccugagcauaaagaggaagccaggccauacccuuaaaguggauugcagccuagagagggaccaaagagcugggugucccuggcaacgaggcagaccagaccggugccuucuuauuucuucaucauacugugugagugucaagagaaggaaguagcaagagagaaacugauaaaacucuauaucuccaaaaaaagacaggagaauggaggggcacaacuugggaugaagaaguagccugggaagaggaguggagaggauaaugaugaggcuaaauauaauaaaaguacauuuaugaaauaucauaacaaaagcuaucauuuuguauaauuaauaaauuauuuuuauucauuauaaaauaauauaaauuauccuguuuuauaaauauguaauacauaaauaauauacaacacauacaaguauauaguauuauauauguaauaaguauauaucaaaauauaaaauaguauaaacauauaaaaugauaaaaauuaacaaaauaaacucgccacagaugaggaaacaccacuugggaagucaccaggcuaaucugcucugauaggggaaagaugucugccucugagacucugggaaagaaguuuccccuugggauguuuauaagaaacucucaauauuuguaaugaauuuguaauguucauuuccccucaugaugugacuguugugcaagagcuaaagggggaaaauggagguuucuguuggaaacagggauauuuggucugugauuuuauaaacggugguaauauccuacauggguaacugugaguuauaccacuuaaggcuuucaauggugaacuuugaagcgaauggcacacagccuauuugcauagggauuucugggaaaaacugucaagaaagaacuguuccuuggaaaggcuggagaaagccugaacuguguucaagaugcaacagcugacauuccuccccuccccuccuaccuuggcugaagccggggcagcagcugccagagcaggacucuaacuuucccucgaaacgacugcucauggaaaauguuauuucaggcacuaggaguuaaaguuucugauuucuuucuuccccccaaccucagacuuuuuuccaacuucauuugugcaaguuuggauuaguaugggauacaauagacaaacccaaugucaaagccauuccagcggaaccuugcauccuguggacaaauuaugaaaaaacauaaccaaggcccgagaagaaaaacaacauggucagaggauucacaacaucaaagcguuuguguuucuuuuaacccucaaguauaauguucuagcuagguuaccgcuugagaauuggaaacgccaguacuugaauauuaauaugaacuucaacuuaaagaauuaucuuguuaguaaaucgacuuucugaacaucuuuccuuugcauuuuucugcuaacccugucuacccaucuuucuguacacacccaaaagaaagaaagaacgacgagaaagguuuuuaagaguguggaggcguuugaaacuugcccugcaggcuaguuggguaaacugugccucggagucucggaaaaucuuuucuauauuuacacccguuacugcgauuucucacuuucuuggcgcacacaggcaacuccaaauaaaaccaugccaagagaaccagggaggcguuucuccuggcucgggacaccggguuagccaucaacuccucccucccgcgggucuccaggaaugcucugcggcggcgggggaggaggaaggagugggcggggaaggcgcuggugcccaccuugcucgcaggugcccuugcugaccugggugauggccuucuccccgcggcucucggcgcgcaggcuggcagcgcgcagcuggcagccgcugggguaggugaugccguugcugccgcacaccggguagcggcucuugcacacgcacacggcgagggucgcgggaccgccggcugcugccccggcuuuacccuuccgccucuugcggcucuucacgcacuccaugcccggcgcgcagugcccccugccggccgcgccgcccccgcacggcucacccucgccgcgagcacacaccgggcagcacccgcacgcgucgcgggucucacccagcgggcagccgagccggggcagcgcggggcaggaggccggcacgcacgggccgcaggcauccgaagaggaggaagaggagaggggcaggagcaggagcagcaguccggcugcacccagcagcagggcgcgcggcggccgcuccaucauaagguggcuggaugcgagcgcgcgagu

SEQ ID NO: 12098 - RNA, 58798 nt, Mus musculus
acucgcgcgcucgcauccagccaccuuaugauggagcggccgccgcgcgcccugcugcugggugcagccggacugcugcuccugcuccugccccucuccucuuccuccucuucggaugccugcggcccgugcgugccggccuccugccccgcgcugccccggcucggcugcccgcugggugagacccgcgacgcgugcgggugcugcccggugugugcucgcggcgagggugagccgugcgggggcggcgcggccggcagggggcacugcgcgccgggcauggagugcgugaagagccgcaagaggcggaaggguaaagccggggcagcagccggcggucccgcgacccucgccgugugcgugugcaagagccgcuacccggugugcggcagcaacggcaucaccuaccccagcggcugccagcugcgcgcugccagccugcgcgccgagagccgcggggagaaggccaucacccaggucagcaagggcaccugcgagcaaggugggcaccagcgccuuccccgcccacuccuuccuccucccccgccgccgcagagcauuccuggagacccgcgggagggaggaguugauggcuaacccggugucccgagccaggagaaacgccucccugguucucuuggcaugguuuuauuuggaguugccugugugcgccaagaaagugagaaaucgcaguaacggguguaaauauagaaaagauuuuccgagacuccgaggcacaguuuacccaacuagccugcagggcaaguuucaaacgccuccacacucuuaaaaaccuuucucgucguucuuucuuucuuuuggguguguacagaaagauggguagacaggguuagcagaaaaaugcaaaggaaagauguucagaaagucgauuuacuaacaagauaauucuuuaaguugaaguucauauuaauauucaaguacuggcguuuccaauucucaagcgguaaccuagcuagaacauuauacuugaggguuaaaagaaacacaaacgcuuugauguugugaauccucugaccauguuguuuuucuucucgggccuugguuauguuuuuucauaauuuguccacaggaugcaagguuccgcuggaauggcuuugacauuggguuugucuauuguaucccauacuaauccaaacuugcacaaaugaaguuggaaaaaagucugagguuggggggaagaaagaaaucagaaacuuuaacuccuagugccugaaauaacauuuuccaugagcagucguuucgagggaaaguuagaguccugcucuggcagcugcugccccggcuucagccaagguaggaggggaggggaggaaugucagcuguugcaucuugaacacaguucaggcuuucuccagccuuuccaaggaacaguucuuucuugacaguuuuucccagaaaucccuaugcaaauaggcugugugccauucgcuucaaaguucaccauugaaagccuuaagugguauaacucacaguuacccauguaggauauuaccaccguuuauaaaaucacagaccaaauaucccuguuuccaacagaaaccuccauuuucccccuuuagcucuugcacaacagucacaucaugaggggaaaugaacauuacaaauucauuacaaauauugagaguuucuuauaaacaucccaaggggaaacuucuuucccagagucucagaggcagacaucuuuccccuaucagagcagauuagccuggugacuucccaagugguguuuccucaucuguggcgaguuuauuuuguuaauuuuuaucauuuuauauguuuauacuauuuuauauuuugauauauacuuauuacauauauaauacuauauacuuguauguguuguauauuauuuauguauuacauauuuauaaaacaggauaauuuauauuauuuuauaaugaauaaaaauaauuuauuaauuauacaaaaugauagcuuuuguuaugauauuucauaaauguacuuuuauuauauuuagccucaucauuauccucuccacuccucuucccaggcuacuucuucaucccaaguugugccccuccauucuccugucuuuuuuuggagauauagaguuuuaucaguuucucucuugcuacuuccuucucuugacacucacacaguaugaugaagaaauaagaaggcaccggucuggucugccucguugccagggacacccagcucuuuggucccucucuaggcugcaauccacuuuaaggguauggccuggcuuccucuuuaugcucaggaagauggagauaaauagcaucuaaaauuggaaaccuugacauaagucagucugucaucucuccaucucacccugacacacauggggaccggcuucuaaggcucugguaggagggugccaggaagaacaggaggggcuagggagccgacagagagccuccagaauaccuuuccaaagcagaggagagugggugaucauguacucaucugggguccuagggacagucuaacagcgauaaaagcuaaauagacaguacugcuuccuuauguaccauuuagcacugggucuuuguagagaguaaaaauguauuuccucccucuucuggccauuccuuuccccccaaaagaaacuugcauuguguuugcauugagggagagaagguguauuuuugcagaacucagcccaggugaaauaagccaucuacauucuguuccucuguuuucauuaagcauaauauuuauugagcagcuagccagcuucagcuguguauagccggggacgcacggagcaaaucugggcuugacgaugaaggaaguguguauugguuacaaauuaccgagcacuuucccuggaucccuggagccccuccugguguugcucuucacugagauuaccauuuaaugccuuccagcgagagaccuugcccugcuugguucuauauuccugcagugaaagagcuaauaaucucaagucuuggagccgucacugugaacugagugccaguagaauucacugagguccuuggcuaacuggacgggggggggggggggggcggggaugacugacaauucaguuuaauaaaaagaaucaggacaaagaugaugagggucgugaugaauagccauggcgccaggacagaagauguugcucuucuaucccaguucucagaccuuucgcuuacaguccuuuacaucugaguuccuugguacccauguaguuacucugauauauuugaguaccauuuucucacccuucagaaauguuacuuguggacccuagaauaccaccacucagucucucuucuuaguccuuccauggcucaguucaaacugccacucaggcaauaggagggucuucacagugcgauuccaucagaucucuucccuccagucuuccuguauuccugcuagacuauauggcugcuguucuacaugccuuuggaacuaccuucugccuagagugccuccugccuacauccugcacacacacacacacacacacacacacacacacacacauggacacggacacggacacacggacacagacauggacaugcacacaaagauacauacacagggacacacagagagacagacauacagccuuccuuggaauucuugucacuuucucagugagaccugacuuuccccugcuccauuaugauguuacuauucuccuaguacuguucaacaucaagaaagucuuaccggauccaugcuguguguuuauacaaagguccuguagcugacagucagcuguagaccugacucccggaauaugaauguuaacucuaccaugaaccaccagcuuuguucccucauggccucucuguccauagaguuccucaccuguagcaugggguuacaguuauaucacaggguuuuaugaugauugaaugacaugccaauuaacugaggagacuacuggaugaagauugguguccuugcucaaucaaaaaguuggcuuuagaugagaagagaaucuuuguugcccaaagagcccaaaucuccaagggcccagaucaguacuugaauggacugaugaaugaaagacuuccccuaacacucauuuagccucaggguaagcaacuuugaaugaauagacacaaguucuuacuugcagaguucgguguaagcuuuagacagaaauaaacaauauuuuuacauaguuguguguacccugaagaauguacaacggggaaaugguaucgaggcuaggggugagugaggcagugaaugagugggguggguggggcacuuccaugagccagagagcacagaugugagggggagcggggcuguauaagcugugcuguaugaaccaucccgccaucuccuuaaaugucuguguuucuccuagaauaaagggcagccucugucuuauagugccuuucaaacgcagugucuggcuaacaaagcuugguauauguuuguuagucagacagaggagacccuaggggaagugccuuccucugggaauguagacagugggcuccuugcuguguguccuuacacacacagagagagagagagagagacacacacacagacacacacaugccucugauuuauucuucugccuuccugacgucuaagcagggaauuuaucugacucucugcacucagccaucuugaguucugauacuauggucacuuuccaccaaauccucagacucacagcauguugcuagcuauagucagguccaggagcuguguuguaaguuagaaacaaaacaaaacuucagugaaguuuauuuagcacauuuaaaacccuuucuuuaaggaguucauuuuaaacuuauuuucagguugguaacaugucauguaaaugcuacugugccauuccuguccuugaaugaacccaggaacuccacuggaagcugaaacagaggagguccaacagccaaugaacuugucaggcgacugguuuaucuugagaccggacauguccauguaauguuuuguuaagauagcucugucuugcaaaaagagcagauuuaugcugggggaaugguguccagauguagggagaaagagccaauaaugacuucuugggggagugauauccugguugagacagagaaguaaauaaauagauaaauaaauaaaacagcuaaagaagaucgaauacgggagcgggaauggagucagaagggagaggacauggaacauuauuuagccuuacaaaagaagggaaucuugucauuugugacagcauggaugaacuuggaagacuauguuaaauaaguuauauucaaagagacaaauaucacaugaucuuguuccuacauggaaacuuaaaaaugucaaacucacaggagcagagagcagaaggucuucuacagagguggaaggugacguugguauaggaagaauugaagagagguuagucaaagaacacaaaagacaauuagaaaaaagucuaagaacugacagucccaagacccuaacuugccaggccaggcuguguuuaccugugcccgguguuccuuauacuucugaacacugucuuacuaaguucagucuuagauugcuugcauaucagccaguacagccccugaauuacagccccaccauuacucucuguccuugcugucagaucagagaaacagagagaagggggaaaguugccuccaagagagucaacgacugcagacucacaguugagaaagagacauacacaagacuucuaugacagccccuuccccacccccuaguaaccgccuaggcagaaagccaggaagagaacacuuucaaacugugacaaggaugcugacgugaagcucuccacaacucguggcuucugguggggaugcaggagggaaggacccaguuuucuuuaaguggcugaccacugggaguuugcccgugcuccaguacauauaugggcaacauaaacugggcuugucuucuccucaucuuccuccuccuccuccuccucuucuuccucuucuccucuucuuccuccuccuuugugggaguuagggggagcagcaauggugggggagcagaccugagagaacuggaaagugagugugauccaggugucgguaauucccaaauaaucgauaaaaaauauuauguuggaaaaaaccugccccaacccaauaauaaugccucuauaguuuuauaacuuucuuggcccuguuugcccuuguuaaacauagacgcuucuagaacagugagcagaucacuaauucuuccuuauugauugauccugucucagucaccaaguuguagggaagcucugagcuccuggaguagcuuuagaaaggggacaggcaacuuugaagaggggguaagggacucaggcagggucccuuuagagcagcgguucucggccuuccuaaugcugugacucucuaauacaguuccucauguuguggugauccccaggcauagucacuucaucacuacuucauaaccguaauuuugcuacuguuauuaaucauaauguauguaugugauaugcagggucucugauaugggacacccaaccagcccaaaggagucacaacccacagguugagaaccgcuguuuuagagacaagcacuccagagaacaagguacaguaacagucuaccuaguuugggaauugguuauuaaauggcaagugcccguuccagaguucuucaaggaaagcgaauuuaaaagccuaaaugaaauagccacgggcacauucagguuacacaccagggggaaaaaaccuguggcaugaaaacuguagcgcaguugugugggagucgagaaagccccccauuagagcugagaagggaccucaguuaggagggcagaguagaagagaccgucaccauuuuccccucccucacacuggucagcucugagauggaaugauggagcugagcaggcaguaacuggcauccuuagugugauuucuguccuaucccuagaaggguucacuagagacuugccuucuagaagaaacugccuuauacgggguguucuuuuggacagcucgccgacacagugcccuugguuggaguccaagggcagcuggcuucucuaagucuggguaggguccaagggcagugggccucccaggggauuggacugugagcuuucucugccuccagcugccccguguggguucugacuuugccucuacgccuuuaacuauagcacaaacaucuuaggaaccaguagaaaggaaagacugaauucuugucaaaagaguuaaaccagggggacccacgaaugucccucccuuugggaguuuaugagugacaagaucagaaaguuuugaaaaugauggaaaaugagauauacccaguaguucaugugccuguucacuuaagguaauaguaaagauguccccagauauccuucacuccuuaggaguggagucaggguagaggggcucaaaaugcccauggugaggagcaccccuauacacacuauacacuaagacucugguguagcaggaaaagaaagccacaguaauggggggaagcgugccuccuuuucacuugaaauguauauguguuaaauuguugaaucguguucuaucccaaauucaauuaauggccaaacgaucggacccuuuugaaaaagcuagugugccgaauugcuuucuggguucacagaggacaagauuaacuagccacagcugggcuuacagcaggccccacccacuuagcaucuccaacccagcagaaugcugggaaggaggcagggguggggagaggggggugcagggggaggcagcauagcuguccaggaaauccagggaagaaauccugcuguucccagaagcaggccagaguaacacagaagucuugccucugaaaacuaagaacgguucaagccagguaaaacaggcugaguaaccuagcguugacaaaggcccguucaugagguugauccucaucaagccacagcacagugcaugagaccaaggccaagccgagcugacaaguucacagagcuggcuacuguaaaaagguggcugucacaacuucaguguaacagugcauagugguaccauuuaggcuuccuccuucacaggccuguguacugugaucccagcgaaucucuacuuccucaacgugagauucuacugcacaccuuagggugguucguggguaguugugcaucaauuugcauucguugguacugaagccuauuuguugguaguggugccauuagacucuuaauuuauuuuuauuucaugugcauuggugguuugcccgcauguuugucugagugaggguuuuagauacccuggaacuggaauuaccaacaguuucaagcugccacgugguacuaggaguugaaccuuucuacagaagagcagcccagugcucuuaacugcugagccaccucuccggcaccaguuagacucuugacaagguuaaggggaaauucauggaagaauuugagaacucaauucaucauauuccauuucgacacuagaagaagaaaaaaacaaaaaacaaaaaaccuagugcuuuaauauucuaccaggcacuggugcagcugacuguuguugcccuguuucucacaguauuuugggggagaugggacaccuccagcuucuacaggagcuugcuugccucucucucucuuuuuuuuuaaagucagcacauaagugaugaguuuuaucacagcaugucuucccuugaaugagaaacauuucccaggcauuucauuuacauccgcacaaauuaaccaccaagcggucaagugguggagucagaaaggcuuuggaucugacaucugcucugcucucuucuggcuccacuccaggcaaagaugaaaacauugaucaagaaauggaucuccuggaacuuuccaaagguuuugaaagggaccacacagcaaugaagcuucaggaaugugucaggguggcccaaggccugcaggacuccaagcugguucauucuccgugggaguuuucagaacucagggcuccaaaggggaauuucaauggggccuucggcaguuagauggcaaccuuggcuuccaaaaggaaccccucaggaagccgccagcuuuugauggaaaaugaaaugcacgcuucucugugagcauugacaucaaggagccggguccugcaguguggccccuuauuaaagaugcuaagcccggcuggagagggcaagccggggcagagauaaagaugcugcccaaugucugacaagccugggcuucagagcuagaggccccugugggcucaggugugucucggaucagaggcucagagugguggaguagaguggaucugacuuggcuuuguguaccauggagccuuugguucacuagacgguaacuggcaaggcagggcagggcaggucuuucuaaacucagcaaagagaaccucccacucccucgcuaccacccaaaugcucucuccuccgaggccuuuuucuuuuuauccauucugccuggcccaucacugcaggcugcccccuuuuccugucuagcugagcucaaagaaauagcuuuucuuucccaguccccccuggccauuaugaguuacagaucugcaguagugcuuuaaguggugagcucugcucagcuccuggcauaagucaccagauuccagagccacaccugacccgccccuguaagaacgacagucagcaaacacucacucagcaugccucucuccuggacaagcacgaggccccucgguacacaauauccagaagugaggguuauguccccuuuucuuagcaccacccugaagaaggugguuuuuuggauaucuuaggaucuuuaugcacuccgugaacuggaaccuauggccucaaucaggauacgcccaaaguugggggagacagcucccagccccuggugacuguagguacaaugggacuucagggcugauacccggcugucucuagcuagccuuuacuucuugugguaugcuuguagugugcuacagcaggcaagaucugcaugguaugugugaagaaauaaagcacggagcuucugcgugugcacacuggagucagucagguccuuuacgucucuucccuggcgucugaaccaaacuuacuccauucguuguuuccuuagcugaagagcagcuaugauuguaucuuccgcuuaaaggugagauaaugugggaaaacaauauuagcaucuagcacacagagaggccccguuucgauucauguccauucuuauuguuacuagaauuaugaagccugagugaguuucuaagcaccauugaaauagcaacaaaagccagauacagggggacacacuuguaguaccaacacuuagcaggcugggacaggagguuuggaaguuccaaaccggcuuaggcuaucuagcaaaaccuguucucaaagauuuauuuaaaaaauaagugucauuucuauggcgugaugcugucuuacucugaccaaugcaaacgcaacacugcuuuauaugucccccagguuaaaugggaaaacuuuguuuauggcuacaugauaauguaguaggauaauaguaauagagaccaaccucuaaaaacuucuaccuuguucuacaaagacaaggaaucccaccugucccugugggaucucagacuccauaaagagggucuaguggcuggcaccugugcuuggacuccauggcuagcauguauacagugcuuuagagcauagcaaguguccaucuuccagcucagugucacauguauugacuucuaguggugucccuuacuggcuuuagcccacagcuuuggguucagggggcauucaaugcaauaaucacuggccugucucuuccguauguguucuuccagcaucuuugacauaggaaugcucacuaauaaguuguuugaauuguguguguguguguguguguguguguguguguguguguguguguguuaaacucucggcuucauagaggacagugaauaaaaaucacauucugaaacaugaagagugccaucagugccagggggcacacacgcugggcauuaucuuuggcucuuagaaucuugcugauuaaaaaaaauauauauauauauauaauaguuccuucucuguguuucuguucuuugaccuacgcguguagccucagcuuggcaggaacacguuugaaaaaaaaaaucaaaacacucaacuguaaaugagcaaauuuagacucaggaggcgcccacuuagguuggcugccugugucugagaggugauaacacuuacugucaaguguggacuagaaaugaggcugcagagaggagggcuaagaaaaugacuagcuuugcagacccagcaccugugagcugaaugaacguggcagagcauuauuaccugccacuuugcagguucaaggccaccucaccuuuuggagcagucguccucagcuggucugaucgccagggcaagucacagaaggcuauaccugagcuccacucccaagagucugauuuaauugcucuggacgugagcugcgccagggaacucauaaacacuuuccagaugacuucauguccugccugagccuaggaauauuauuauuuuuaacgugauuucccauuucuauaggggaugcucauucuuagagaaauucuuauacaaugggguaguauaugcucugccugcccagaauucaguguuuuacagccaaggaacuuuucagguuuguccuccauagcaaauggaagcucuugaacugcaggauggccucucacauugcaggcagcucagagcuggccucugucuuuccuccuggcuaguucaaugcucuugccuguuuggacaaaguggaaauguguucgccucugucgguaucacaguacguaagaauuuaccuaaacccacaugauccagccuguuggauguuucucgagagcaugccuuccuugagccucagguuuucaucugcuacccucaucacugaaucucuagccuugcaaagccuugggaugugguaggcaccgaaugagcaaaugcaugaaccgugaagguggauuuuucaggcguagggaccuugcaaggacguugaaugcagaacucuuuugugaggugggccuccuuuccauaucccaccauaauagaauggugggcaagaacagauguucaaggaagcauuuggggcucggggcuugauccaacaaacacauucugcccuugccuuuauuguuccauagcaagcuggauuuuuguccugacccuugaccuucugaccauuaacucccugcaaauaggacuuccgcucuuaauuucauagagcagcaggaagguuauaugggagauuguucccccguuucuuuuuccugccuuccuacaagauaguggaaaauuagcccuuugguucccauucaguucuugcuuuuuguguauguuguguugugugccaaaaggaauuuaugcacaagaaagauauggacaucucuguauggauccuacaaagcuaaugcucugauugguuggagaguacagaaaggcagaauagaugguaagacucaaaguaggguagccccuguguaagcccagucaguaaaaaaacacacggacaugagggaaguacacacaugcaugcauacauguaacuuuauuaguaaucaccaaaagcauauuuuccucagauggagaaaugaacgaggguacagucauacuuguaaccuguacauauaaugaacaaacacauuuuaaccugauugcauacuagguacuuauaaguaauauaacugccuuggugcauaguauauaaaugaauuuauuauuccuucacccaaaauaucauauggggguggaaaggaacggaucuuauucuuguuuguuuauaauugaacuaauaauagaauguuaaugcaaaagaaucuucaggauuucucuaggggcuggagagcuggcucagcacucaagaacacuggcugcucuuccagaggacccaagcuugauucucagcacccauacagcagcucacaaacgucuauaacucuacuuccaggggcucuaacacccuucccuagccucuaccaggcaccggacaugcagguagggcacagacacaccuucagucaaaacacccauacacauaagaauaauuuuuuuuaacuuuugagguguguuuaaaaaccuugauaaaugcuaagaaaaaaaauacacaguagauuuauaucacucugucuaguuccuuggcaaaggaaauaaaagggaaguuuuaaauaggugcaguggccugcugggacagugaagaugcugucucucugucagucuccaacaacucagugucuccuguuucucccuguggacaaaccaggauggauuuggauucuacguuuauaaauacuuguuaauuaacuucagcugcuccgcagcuucugcguguccugggaauauaggcaaauuuaauuuuuauuuuuacuaaagaucuuuuuguuauuuaaaaaaaaaagacgcuaacuuugccccagcacucauaaaucuguggcaggaagaugaagagucaacauaggaagaugguaucugaaaacaaaacaaaacaaaacaaaacaaccaaaaaggcucaaccacuccccacaaacuuaacagagcagaaaucugagggcuuugccaaaaucaaagauagccccuguccuuggagcugaccuugaguccuuccagaggcugggggggguggggggugggggcuguccuuccuuuccucuggaucuuuggccuccagcacagucaucugugaggccauuaucccugcuaauaacacugcugacaagauacuuacagcgcggaggaagcugccuguggcuuccggcagaauuuuucacauuuuuugaccgagagauaacauaacagcacagugggauuuaugagaauuucccugugggugaguaugugguaucaccuguuuaauccccaggagaaggcugugugugauaggguacgguauguauauuauaaaguaggccaccaugaugcaguguaucuggaugcccgagcccugcuccuguugccaggaaacagauacagcuaaaccaagaauucagaugaguugcucugaaugcaggcauaaagcaccacacucaaucccaaaccugccacacccgagugucggagccuacugaaugugcuagaugcuuccucguucauuuacagcuugccugccugccaucuuucuuucuggcaaagucuugauacggagcccagguuggugguacucaugagccuuugcuucagccucuagagugcugggauugcaggugugugccuccauccuugguucuguuuauaguucuuaaucuacuuguuccagcuuguguuccuacugugaguuuccuucaugaaaacucccugcucaccccugcagucuccaguaacagauuacuacuagcaggagaaagugcauagccuuauucuguaaggucacaugugugcuugucaagaaaaguauccagaggaucaaccgauguccuuugauacauuuauuuaaaugauuccagugacauugacugauauagcuugauaagaugauccuccaaauccuugugaucagcuuggcuaguugcaagugaucuaacuccaagauggcuuggaucuguuugcuucaugaaaugaaauaaccaacgggucauuucacuucccgagguggagcacaaaaaaaguaaaggaaaucagaagagguaaucagauaaaucccugugucucuaaaaauaacaccucgccacugaagaguggaagccugcggacaaauuacuuuucaaucugcuugaauacaauugaguccucugcggagaucucaccauugcacacgcgcaugucaaauccgcaggauaagaaugugauccacugaacccauaaaacccagcaugccuuuguacugaggagcacacagaugcccuuuggacaucagcagagaaagugguacacaguaguuucucauggaaaggugacguuuauuuuagauuuaugaguuugugugugaacaaagcacugaaaugaugcuuagcaacauuuucuggauguagaguuucgguuuauaaaaacugccagcuuaugccucucuguuuuuguacauucgucauuuacacgugcccucuuccaaucucccucuucagauuauauaaguagcauuacaaaggaauaccaugaccuccugcuuccgauggccauggccaccauuagagaaauuaaugaagugacaaauuugaaaucauaagacugugaagccacggaugaaugcaagauuuuuguuccuuuggauucugccagugacgauagccacaacucugauugcauacccaauucgcuuagcuaccuugggugcaccuaugucaaaugugugcuucuaauuaagccacuccaugugcaucugggccaccccuuucucuucaaauacucacaagcaguguccagggacuacuauauuaucaaguuaucauggaccaaccaauuaguaaagaaaccugcuacuaguuccuauggcaugaaauauaaaguacuuacacuuggcauucauuugaagacaucugauccuucuuccugccagucauuagccagguaaugaagaguuagcugcaucugcccucuagacgcucguguugcauauugaccuggaaagcuauaaggauggcaacucuuauguuauccaucaaucacuuuaauaaguacaagagagcaccuugucacccugccaaacacuauagcaauuaggaacgacucaguccucaguuaagaacaggaaagcuuacugaguuccaugccauacuguagcugagggcucuagaacagacuccaguuugcaggggaucuguguugauggagaaauggcaacagcagaguuucuccaucucccugaacucuguucccugggcaaaauagauggagccgccagaaccaaaagacagagguggauaggaagguguuuaauggauacagaguuccaguuuuacaagaugaaacgaauucugaagauugcucucacaacaacgugaguggauagauagaugcacguuagcucaugaggagucauguggugcuaaaagccauccacgaacuguaacuguagucacucacaaccuguuccaucauggcaucagagcacagugcgcucgaauuggccgcugcauccccuugugauggaggggcuggcugaucacugcggcucuuugauggcacccaaccucugagaaugucacacccucacagugccagccuggggaaaaacaaacccuccaaaucuucauguacagccucugcuguauguuaccacucuuguaccacggcaaccuuuuaggcacacagucugagccaucguaaguggguaccaacucugcugaccugugcacauaaauaggugagguggaguuggguggauggcucacguguagagcguuuuccuagcauauccucuccucaguggugggaaagaaagaagaguuaagaugcugauauugcugacauuucguguuguauguguuuuaccaaagcuuaaaaaaaaauuuaaggcacagaaccacuagauaccaaaacauuaggugacgaucugucccugaaaaaugccacagugcaagugaguuggaaccugugccacaaggcuuugggaagucagccgccaugaggaaggaaccagagcaaaggaaggccauaaugacagcucugacuacagaaacucucaacagaugcucaccgugaaacccacccuugaguagguaccggggacccaaggaaagugcuaaaggagcugcaguugcaggggccuuucaccuacaaagagcugccaugaagaguucaaaacugggcaggcgacacagagacaaugaaggcagauaaaggcugucgagggaaacaaaaccaggaagccacagacagaaagucaucacauuuuuaucacugaaaacauucaaaauggcacucugguguggaucugacauaaaaauaaacacugaguaagaucaaaaucaggucucauaccagaaagaauaagggggguaggggguggucaugguuugaauaugcuuggcccagggaguggcacuauuuggagguguggccuuguuggaguaggugucucacugugggcaugggcauaagaccuugacccuagcugccuggaagucaagucuuccacuagaggccuucagauguagaaacucucagcuccuccugcaacaugccugccuagaugcugcccugcuccccaccccaccccccugauaauacugaacugaaccccugaaccuguaaaacaccccaauuaaauguuguuuauaagaccugccuugaucaugcugucuguucacagcaguaaaacucuaagacacggugcagcucaguuguggggcacgugccuagugugugggugacccugguuuuaauccucagcacugggggggaggggggagaguggcaugugaaagggccaaccaacaccaucucuaaaagcauaucuaaaaaaugugucuacaaacauaaaaucuauaguuuuuugucuuauaauaauaauaauaauaaagacuguugaaaguaagaauuagaacucaguauuggagugaauggcuaauaauuagaaauaagugacauauuucugaaauagaagcaaaguccaaagaaaggcaagagcaagcaauagaagaaccuugagagcagcgggaggggcaguggguaggagcaguugcugugcaagcauaaagaccugaguaugagccccuagcaacagugugaaaaagccagguguagccacauauuccugugacacuggcacugggggaaggagggagagacagacagaugccaggaguucagccuagaugcugccguguuccugccuugaugauaauggacugaaccucugaaccuguaagucagccccaauuaaauguugaguugccuuggucaugguugucuggucauggugucuguucacagaaguaaaacccuaacuaagacagaacuauagaggaggaugccuaacacacucuucuugucucuguagguucauaacacacacauacuauaucuauauaucagacuauauauauaucagacauacacacacgcauauauaugcauauguauguauggauauaugugcauauauauauauauauauacauauauauauaucagagcuggggaauauguguguguauauauauuguguguguacaucuguaaaacuuaaaucuaagaaaauuaacaaaaacuauaaacagugaggaaaggaagagcagccacagcuggccaggcaaacacacgaagauccacuagaccucacacagaguccccacacgcaauuaaaagaacaaucaucaguagcauugccccuucagguugccccacuuuugcaaaacucucaacucucacuaccgggaaaugugugagaaagugagcauucucucgauauugcuagggcugugaauugcccaaguaaucuaggaauaccuguuuaauuuaaaaguccacauguccucugagccagcagucucaguacuggggacccaucacgcagacacaagaacagcaggauaaacauauaagaacagguauggacucacucauaguucauaugcagaagaaaaaccuuccaggcuucucuuaaguauauccaugcaguggaacguuguacagcuacagaauacagugaaguuccuacuuuacuagcaaagaucgagcuuugauacauuguuuagggaaaaggguagaccugcgggguaauaugacugacuuuuuuuuucauuuuaaaaauggaaauggaaaacuauauacaaugaauauagguuacuggggguggguuaucauaggauuaaagaggacccuuuacugucuuuucucgugcuugccuauuguuugaauuggcauccuaagcauguauuguuacaucuuuuaauaccaaugaaaugauuugagaaggauacuguaucauugguuuuggaauguaaacacugcuauacaucuaagggaauuuucucucccuuuuaaagauuuuuuuaaaauuuuuuuuuaauuuaaagaaagauguuuaguuguaaguugggggaggggguguauaugccgaugcaugcauguguggaaggcagaggacaacuuuauggagucaauucucucccauauuuaugugaguuccagggaucaaauucaggcugccggguuugugccgcaagccccucaacuugcugagccauuuugacagccuucuuuuaauuagcaaaaagcaaaauucaaauuggaguuagacucaaagaucagucuaagggagcccacacagggcaucucuccugggucuaugagaccaucccagaucacagcccaggaccaguggugaugugaaaagaaaaauuauaaggcauccuuaggaacucgggggcggggugggguggggggugggacucucaggaaggaaggcugacucucagaagggcuuucuuacuggaacugaguccucaagucacugagugcuucuuuuuccuuccguuucacauggagaaacaaagaaucagagaggauccaaggucccaaaaguacuucuuccaacauggcuucguccuucccuuuaaucgguuaaaaacagagggcccccucgguucaauccacaacagcacaaggccaacaggauguggugggaacuggagccaagucccacucagcuugccuaugcacauauccucuccucucacuuugcucuaccucuguccgacacacaccagugccacuggcccaguuggccuaguaugcauugccuuuuaccugugcauccaaaaaucugucgggugcuaauuacuuacauaaaauaccuagugugaucgaaucuaucaaugucaaaggaccagggaggcaaaaugguuugauuauaagcccaaaguagaaacaguugugagccaccauuaaaaacucugcaaguuccuuuauuuguguugaaaaccuagaaucacuaguucuuuucucccuuuacgaauagaggauacuagcauuuuguuuuuaaaaaucagucuucuagagcgagugagauagcucagcugguaaaggcuugcuaccaagccuugcagccugaguuuaagccugaguuaaacaugaaggaagaagagaaccaacuccuggaaguugucuucuauuuccacacgcaugcggugacacacaugugccugugcauacaugcaugcauauuuaagcacacaauaaauaaauaaauaaauaaacuaauacauaaauaaguaugcaaacaucagggucccauagauccaagagcuguuauggcucaugugugaaauguccacuugggcuguuuaagcaccuacuggucgguacugguuuggauggcuguggaaucuuuaggauagggggcauagcuagaaggaaaaaacugggaaaagacuuugaagguuauaaccugccaccuucgcaacccacacacucucccuuucuaaccugcugacauugcagggcagcaagccguguuccaaacucucacgaccauagaggagucucuccggcuugcccaccuuccucccuuuuacguugccucugggaagcauuuguggcaauagugagaaagguaaccaaaacccuuggcucuaccaggaauccuaagaucauauugcagccucugcuugcauuuaggcucggugagagucccugggcagugguuaccgcuuccaucaccaaauguuuuugugcucagggucuaggcauuacugucccgaucggagggucacaccacacacggaguaggaugugacuaauaagaaaugugacuuuacugcaagucuagacagcuucugauaaauguuuaaaacgaggucaggaauguuuuccuuuguggggggggggggggaaauauguguuccaugguguaagugggaggaguggaacaggagagaucuaaaugcuaguucccucccacauaauuucucagcaugucagcagcagucaaguucaacugcccaucccugcacccucacccucacccccaccgcaccucaccuccaccccccaggcuuuaggacauagcugggucuaagccaggagagaagaggaauacacgugugacauauggguaauuccaaaaugacgaccaggcaaguuuaaccuugacagcauugaaggcagcuuccacccuguagccaacaauguucuagaaaguauccaccaaggcccacuuuaaauacccauugggauucuuacuuccuguacugacaaaagggggaagccccguagaggaagcggguguugacuccuggaagagaaaacacccaaguagacuauauggcaucucuuggcauucuucauagaccgguagauuccagaagcaccaaacaagggcaugacgaggggcugaagaauaugggguugacacugccauccccuggacagggaagggaugcagcagauaauucuguaaggaaaagcauauuaucggcagguccuauccacuccugucuuucaaaaaaaguguuucagcacuuuucuuaccaucuucucgaacuucccaguccaguguauguuguagggaaauggugugggugagaccagagcuuccccuggucaguuauaaauagaaugugaacauuucacagaggaagcucccucuaaacggcuggacagggguggggcugggagauaaguuuuugcuauaaacuuuaguaugguggcuucagugguuucagcugucacccauaucccagagugcacagggcuaggccagguagaaggauggacauggaggaugugggguaaagauuucaucuuaucuccauccucauauccacauccccauuucaugcacuguguuacucaaucuccugucaccauagcaacaccugugcuaaugugaucacuggcaggaaagaccacuuuccuucguaguuugugagguuuccauccacgauuuguugacucugaugcuugggagccuauggugaggcaucguggcuggggauaugagguagagaaaaacuguuuaccucaugacuaggaauuggggguuagggauauaaaccaggagcuaaagggacagauggcucagugguuaagaggggcuuucuguucucacagaguuuuggacagcuguaaccaucugugacucaaguuucggagggggaaucugauguucuucucugcugcaaggguuucugcauacacacgguguguguaaacucacacaagcacacacacauauuaaaaaaaaauaaauauuuuuucuagaaaaaaaaaaggugaaaacaaauugucuugugucucaucauacccuuaacucaacacucccagugacccaaagaauuccagcuaagcuccaccuuaaaggguuccacggucuccaaaagaaaccugaccugggaccacauacauauuuaacauaugggcuuugaggggacccucaauaucuaacugcagcagcaccccucacuuuugcuguuggcauacagaauauuuugaaaacuuggucaucaggacuacaacccuggaaggucaguguuucuucccguuguacaggggaagaaaucgaguugaugguucuuucguucucguagcuaggaauuaguucagaugcccaccaagcccuuggucagcugugaggggaugagaaagcuaugucaaagagccauugcucagaaagcaaugggcaucuugauaagaugcagguucuagaggcaaagcuauucuggaauccuggcccuggugcugaaguucugugagucuguggcuguugcuuaaccagagcccuugccuguaaauacaccuauuagguucucgugggcauccacagaggugugugugcaagagcaugaacuaacgccugccauaucguaaauuuauuacauggugcuggggacgguauuauucacagcagugguaaguuuuauuguucacuuacuauuagugaggaaaaucguggucacagaaaaagcaugucaguaccagaguccccacugagcagaagccaccuggaaagaucacauagaacuucgccuucuggcugucuucccguuaacucuguuuugguuuuuauauuaauauuuccuuaguggagaaagagggcaaaucucuucucuuuguauguauuuucuguugcgcuucggaagacuggggauucaguacaaaauugaucugcagucugucccagugcuggcuccagccucccagugccauggugcuuacucugucaauuauuugacuuucugaagugugccuacccugaagaaccucugcuacggaggacuguguuaauguguaacaccgagauaagcaaagcaccgcucuuuuuauuguccuguuuuuuuuccaugcccguucaguuggaaaaccgaaaaugguucuguuugcaucucaucaagcuccguugaaagacgggggagaaaggguuuuugcuaaugaugagcaugggaaguuuuaacaacacaggccacaaugaaucaccugcaguuuguuuuuccuuuuuuuucaauccaucgcacaaaccagcuuagagaggugaugguauugaacaagcaucaaagaagagcugaguagcuggguguuggguuuuguagauggaaggugugcaccucaguuuaaaagaccucaaggucaguuucuucucccaaguggaaggcagcaauggaaacccacauuuaggaugcacucgcaaacaugagcgucuucgguagaaagcuuuccguugguccacaagcaucugugacuccaugggcaggagccagcucuacuuguggguagguuucccaggucaauagggggagggagguagauggcauaacugguccucugcacagugugacuggaacuuuccauugcuaggggaaacucccagcuaccauccaagugcauuucugaaaugcuugacugugucaggggcccugcaggauguggguuagccagcccucccuggacaaggucaauguucaaagcaaagcucaaaggaaugugguauuguuggcuuaauaaaaaaaaauccuugagugcaaaacacguauuuauaucacuggcucaucaaaggugccuuguaaaaggugaggaagagauaucaauaauucagaaugaaguuccuagaauuuagaacugucuugaagacugggggcaggaaauggaucuuuugucaugguuucuguggaccucaaagucuguuugcauguugguuagugcagaggcagagcuuuugacuauuuaggaaguguuacaacauagugguuagaagccuggguuccaagagccuguuaccuaauuuuaauuauuguugcccuuguuguucuuacuguuaagacagaaucccauaaaucccaggcuggcuuugaacucuuuuauguagccaaggauaaucugagcugcugacccuccugccuuuaucuaagagcugggauuacagaccggugcuggcuugccuuggaacaaggcauuuguuccccuuagcaucucaucuuccguuaccaaggcaugaagcuucuguauagaauucacccucaggcugguuccagagucagugucagguguguuaccuguguacuuaccaugaagucccuccaccaagaaagggcugcuuaaauguguuccguggccucauaaggcauauuacauuacgacugugugucuuauucugccuuguuuccucuguuuaaaucuaaaaugacucugggaaguggugguucaugucuuuaaucccagcacucaggaagcacagacagguggaucccugaguucaaggccaaccuggucuacagagugaguucuagcacagccagggcuacacagagaaacccugucucacaaaaaaacaaacaaaaauaaaaaauaaaaauuaaucuagaguggcaugguuagaagauuauuugaguucuguugaucuuaaauaaaucauuucauggggcuggagagaugguucagagguuaagagcaccagcugcucuuccagagguccugaguucaauugccagcaaccauaugguggcucacaaccaucuguaaugggaucugaugcccucuucuagugugucugaagauagcuaguacaguguagucauacaaauaaaauaaauaaaucuuuuuaaaaaaucauuucagauacuagugaaaaugaccuuaaaauaucaaguaauaacuccuuuuugguaucaacccaucuuugauuggauuuuucaugagauuaugaauaaaguuuuugaaguuguuuucaucugagaaaaguaaaaauuaagacuucaucccuaagagaggaucugcaucucugcccugguuacuugucuucuugcugugaccaguuacaugacaggaagggauugaagggaucaggggauuuaucucagccugcagcuuugaggggggauagaggcuaucaagguggggucacauggaggcagacacaugagcuggcuugucccucugcagccaacaggaaagaugaagcagguaaggaucaggguggggcuauaaaaacccaaggccuacccaugucaaccccccuuccagagagguuucauccccuaaaggucccacagccuucccaaacagcagcaccagcugcuagaagacacaagcccucaaggggugugucauguucauauugaaacagcaucauuucagguauauaagguacuucgcacacgucucccccaggugccuugccugaagcuaaacaccugugcugcuuccguuguacuugucauccucuagccugccguuuccggucuucgccucauucuuuguucauuuguaaccucugcugcggacaaccacuguaaccucugcugacaaccuugaucucccaguucuucuacuucaguccugggaucacaggcaugugcaaccucacucugccuagucuugcacaggacaggagcuauaagaccagacauaucaguguagaacagauagaggcuagccauguugacauggaccaagauggcaggagucuuuguucagccucacugauaucagggaauaaagauggagugacggguaugggccaaggaaagaacuugcaaagcucuuucagaguaguucaagucucuguguaucuacugcuguuacaacgcaucaaaaccagggcaaggcauaagaaacuaaugaauuugaggcucacugcuccaggggauuagcguccaugagcagcaugguugugggaaucauggcagcagacaggcauggcgcuggaacaguagcugagagcucaugucuggcucuacaagcacagagcagagagagccaacuaggaauggcauguggguuugaaaccugaaagccugccucuaacgagaccacgccuacuaauucuucccaagccauucuaccaacuagggaccaagcauucaaauguaugagucuacggggugggggaggggauguucucauucaaaugccacagaaaccuucacuauauaaacaaagagaucugugguauauacugaggaguuuuguuccuccaaauuuuguaugccaagucuugguuuuuuugugguguuugcaggugaagauuuggggaggugauuaauuauaagagcagagccuucagggaugggauuaauauccaugucaugccauaugaggcuacagcaggaggauggccaucugcaucagagguaaagcucuugccaguaagucagccauuuccugcacagugaccuuguaccucugagccuccagaacucuggcaaacuucuucuguguaguugauggcauagaugccaaggcuaacuaaagcaagaccuuuggccgaagauuuucaugugccauuccuaaguaguccgguaggacgucuggaaauggaauuccaucugugugggaacaagcccauuuggacgauccauuacagauacacacaggugugugggacgagcaacaguuaagucagcugugggaauccgagggcuccuuuaucguccccucauuacugucauguccacccacuauaucagaugugggcaugguuuggacuuuuuuuguuuuuccauucaucaaauguccguuaacuucuucagcugccauacugaccucuccacucccuuagaggcauuuguuugcuguugggcuuuuuuuuuuuuuuuuuuuuuaauguauuugcuucacggaagccuugugcucuuuuuaagguuuuaugguuagcaugcagaaaucucauuagauacgcacuuuaacauaauacuuggcaacuaggcaucugaccguguuuuaguucauuagucuggaaaaccuccgcaggcuuggaggaccaggcuuucugcuguggaugggggggcuuugaucaugccugcaggguucaggguuuacuuuaaagcguguuaggggaggagaagcagguauccuaaacuuuuugcaaaauaaaaauaacccugacugagaaacuugggguucugugauucugugguuaucauccccaucuuuugaagacagagcucauguuaacacacggucuccugcgccgggcaggagguuaguuaaacagccucuaccagaucacagaccccguucugaugauccuaaugagguuggacuccucaaagccauguucaucucacuguggauaaauggauucaagucuuauccaugggccuuuaacuugcaacuuugaauuugcaaacucucaaauuccuucaacgccgcgguguacagagaaggcuaugaauagcaggauugcuuauuuuuaaaggaagaugucugcgggcaaagcaccgggcuuugaaacgugauuagucaagcauccggucagcucgauguuccccacugaacauuguuucccauugcguuccaaucagauucaaugucugucacacaaaacgugacacgacucugaagacgccugcacuugagcuagauaauggucuguuguuuuaauagaugugauaucaaauuaaauauaauucaaaauguugaagcaugaugguauuugggugcugguaaguggguuucguguaaauaucuccccaccaugaaaucuguuuguuugguuaauuggucguuugguugguuggcuuuuuuuuuuuuaaguugaaauauuccaaaauaaguaagcugcugaaaaggaguuuauagcacugagugugagguauaugacacaccccuaguuccagcacaugggagguugaagcugucagaucuugaguucaaagacagccugggcuaccaggugaagccuucucugaaugaggggcugggauaugcacgcuuguuugaaugguaaaaaaagaacuaagcccagggcugagcugggcaagggugacgucagucccuggugaugggcuguguguuccacgccggggagaggaccaggucuggagugcagugcggcuugccuagaugagaaacagagcccacaugugcuuuccccacacucucagagggagcagagaggauggaaggagggugacuuaauccgcuuucuguugcuaauagcacauuacuaccaagcaguaaguuauaaagaaaacagaucuguuuucgcucgugguuauggagcaaggucaagggaccacauuuaauggugaccuucuggccggccacgucccaaaguggcacuacgcaucgcauggagagguaugugagccaccagagaucuagccagccuggcuuuuauagcugacccgcuuaaaauaacccauuaacccacuaauccauagggcaugaaugggucagaccacucgugggggcaaaacucaaauugcuucauagaggucccagcccuucucacuuaguaacucaaaauggggauugaacuucagcuugagcuuuggagagaacaaaccauauuucagugaagcagaggcgagaauaauacaccggguuugcucuggacuagaagugcaguuuacaaagagguaaacaggaugauaaaaagguaaaaaccuguuccauacuaaccaucacaagcaaaauuuugaaaaucauuguggcccccugaaaucuacuguagggugaccagagccaaccuuucuacugaguugaacacagagcuuaugggccagggacauaauggcucagcacguggguuugagagccccaacccacacaggggaccacccaggggaaacaugaagaguccagcuucccuugcacaguguugagggggccagaguugcuuaaucuaagccuacaguggucaagcaaacuuucauuagcacagaugggguagacaugcaagcugggguggaaggcucugcuugauggaccagccugcucuccugacacagauaggaugcucuugauggaugaauggucaccauagcagcaaggaguaaaggguugggucagaaucagcuucccaaaggccacaucaggaagaguguucuuugcaaaaguuaguguuguaugcuccccaaguaugguaaaacacauacacacacacacacacacacacacacacacacacacauaugugaagagaauccaucuucaaugagcuggccccgugguagcuuucuugaaauggaagaguagugucuucaacucuccaucaccagauugaugacauuugucuuucaagguuaauccucccucccucauauauguguguguguguuuuucauugaaccuagaggaaaggcugucugucacuuuggaccaaaauauucucuugcuauuccuuaaacugauguacauucagauguagagcacgugcucacagguccugggggcuuuaucaacaugagguacaagguguauucagagcagaagaccuaucaagaguuguaaaaugacccgaguugggagaauccaucuucaaugagcuggccccgugguagcuuucuugaaauggaagaguaguaucuucaacucuccaucaccagauugauggcauuugucuuucaagguuaauccucccucccucaugcacacuaugcaagcacuuuaccauuauagcacacccccacauacacuccccccaccccgcccacacuccuggccagauggaaaaauaccugauggucccaugagucagugcucacccccgguucccccaacuggugagcugacuuauacauucuaaacagaaaacagaaguuuucuuacguaagugcuugguuuuuuauuuuacauguuugacuugaaaagcauuaugguucaagccugcacugggaagguagccuggggcacccaucaugucuagccagaggaaaauguagaagagugauuuggaacacaugucuccuacaauuaauauuuuuuuaaugguuugcacuuauuucuguccccaaagagauuugcuaaaugcuaucuucagcgggaaaaugugcuuucuccgauuuguuagacggaguggaagugcacagauaaacagaaucuguuaugcuaaugaacaaucugacuuuuaaaucuuuuuuauuauuauuauuauuucuugauuagauggaggaggcaaugguagaaucaucaaauguagcaugaguccuuuuuuuuuaaauuuaagccagccucuuuaugaaaccucgugugucucugugugucuacacacacacgcacacacacacacacacacacagaaagagagagagagaaaugucuauacacacacacacauauauacacauacauauggagaccagugucuauacacucacacauauacauacacauauacagaugagugucuauacacacacacauauacagccacauauggaggccagugucuauauacacacucauauacauacacacauauggaggccggagauugauauaggaugucuuccucuguugcucacgaccauaaucaccccugaaacagggucucucauuaaaccuugagcucccugauugacuaaacugucuggcuaguaaggcccuugguuuguuuugucucuaccaccccaggauuggcaucacagacacaugcauccacaccuagcuuugugugugggugcugagaaaccucaaccucagguccuuauguucauacagcaggccaacacucuccccagaacuacuucccugaaaauacuuucuaugagaguccagucagcuuuuugagagagaccauggcauaaugucguaaagucccuguagacaagcugcugugagcuggugucagagcacugcugcuaaguaucuccugaugggcuuuguugugagggacuguaaacagccuagaaauaagaaaucuuaauacagaugucccucagcccccacaggaaucagaauaucaaugcgaaagaugcucagggcgcuuuuauaaaaugguauuauuuauacaucccugcaguuuauaucaucuauaguuuacuuacccuaucaugaucuaaauuguacaaagaguagguauacuauaugguuugagauucaaagucaacaagcauaagccagaugugguggggucugcccacgaccccagccaacauccaggagucagaugcaagaucauugaaaguucaaggacaucuugucuacaagaucuaguuucaggccagucagagcuguauagaaaaaccuugucuugaacaaaaacaaaaugauucuauacauauucagacaugguaucguguaacagauuaaucccacuauuccuuaaaguacaaauacaagacuagcaagacaccaaugccccuuccauuucugugggcugcuuaaacuuauggaugcucaugaccaaggcuugugcuuugugaauccugggcaguauguuucagcucuuucuuuuuuucuuuuuuaagauuuauuuauuccauucaugugaguacacugucgcugucuucagacacaccagaagagggcaugggauccccauuacagaugguugugagccaccaugugguugacugggaauugaacucaggaccucuggaagaacagucagugcucuuaaccacugagccaucucucaugcccccuucaguucuuuuuaauauaaugaauuauauaacuuaaagcauuguggaaugaagaguacaaacaugucaagaacauccuagaaauguauaucauuaugaucagugcacacagcucguuggagcuagaccaucauagucacaaaaugcuaacugcccaucuguggggaccucaugauaaugugugauaggcauaaucuccuuuuuguguugcucuugauuuuauggugagucuggaggagaacuuuaugaucaaaaaacaaaagaaaaaaaucuccauuauuccuaaagagauuacaguuauuaauuaagggagacagaccuccagcugugguggggaaaguucaaagauguauuaguuauuuacuacuacauaacaaauuaguucaaacuuuagaagccuaaaacaacaauaaauauucauuaucucaggcuuuuccucccggugggccuaaacuuuggaauagcucagcuucaccguccuggcagugguugucuaaugaaauggucaaaaugucagccagggagcuagagaguuggcugagucagugcagagccugccacacagccugaguuuggauccacacugcucucccguggcagcuaggaucccagagccaggaggggaggggaagagacaagcagauuccuaaagccccuggggcagucagucuagccuuucgaagagcuguaagcucacugguagacucuaccucaaaaugcaauggaauaauaccaagggauauaccuaaaaucauucucuggcauccauacauguggcuccccugcaugcacauauacuugcaccuucacauguaugcacaccauacauacacauacacauacauauacauacauacauacauacauacauacauacauacauacauagagagauugauugauuagcugacugauugguugauuuauugauuucagccuaagucuuggauugcuggcauggugcugucgugaguacuuagucccuugccaaauagacuucucacuugucauuccuaagaauugguacaggguggcagccuccuccuggaucaugggaucccacauaaagcaacagggaagcugcagcaccauuuaugaccuagucucagaagucacacaucgccacucacacacauucuguucaagugagucacuagaauaaguccccauagucaaggggaacagaaauagauucuaccuaaaaaggaagucaguugacaaucagaugggaaaccaacacggcagaugggacaaaugggacuugggucagaugcuguagugguacuggggaagaaaguucacagagugucaacacaaacucacaucugugucagugcaggggcugauggagucauagcaggaaaccaggcuaacaacugacuuucuaacacucgagagcuauuaaccaagacacuggagcagagagagaaaucaagaagggauuuaccauggccccuucuaagcauuuacacacacacacacacacacacacugaaauaaguaugcccaaaaaaugugagcagucuuacauucuucauauaucuaucacaagagccaaauuauggaaacagucucaguuuuaaucagcagauaaaagaggcuuuguuuaaaaaaaaaaaaagguauauaugcacaagggaauaguauucaaguuuuaaagggaagggaaauuucuauuuuuaacagcauguauagaauuauagaccacaguggagaguggaauaagccaagcccagaaaaauguggcauguucucaguucuauguaggauccaaaaccaucaaaaccaaagaagcagagugcaaagaauaguggaaccuguggccagguggggaugcuguggaaagggaugaaggaggcucaagggcacagaagcucaauuaaacaggagugauuuguuuuagcaaacugugcaauguggcggauauagcaaacaaauaauaguguauuguauacuucaccacuaggaagagacuagacuucaaauguccucaccacacuagguagguagguagguagguagguagguagguagguagguagguagguagguagauagauagguagauagauagauagauagauagauagauagauagauagauagauagauagauagauagauagauagaugauagagaugauggauggauagagauacaugauagauagauagauagauagauagauggauagauagauagauagauagauagauagauagauagauagauagauaggugauagagaugauggauagagagauacaugauauguagauagauagauagauagaugauagauagauagauagauagauagauagauagauagauagauagauaguagauagacagacugaugggauaagaauuugaagugauaaaaauacucauuggcuuggcuugguuuuacucauaaauuauaauaucacauuuaucccguaaguacauacagcuauaauuugucaaguugcaguuaaagcaugcacccacaggaaggaaggaaaucauucaaagauaugucagagauuuccugcacccaggaguuagccagagaggagcgacguugaaggaguggcauugaccggugagagccaggccucuaaaagugaucuuucccaggcagaucuucacuugcaguugcugaacacccuuucccaauggaaccauuaccaacucuguggggagcugcucagaauccagcugcacgcuucuggcacggggaggaggcugaccucuugguacaucuaucuccggauggaccugccaauuagaaaaugcuugccugguggcacuccaggacucuacaauaaagagugagccucauccuuguuguggggucaguccagggauggugugaagauuguucucaacugccuaccuuacuggauuagaaaacaccugagagagccgggcgugguggcgcacgccuuuaaucccagcacucgggaggcagaggcaggcggauuucugaguucgaggccagccuggucuacagagugaguuccaggacagccagggcuacacagagaaacccugucucgaaaaaccgaaagaaagagagaaagaaagagagaaagaaagaaagaaagagagaaagaaagagagaaagaaagagagagagagagaaagagagaaagaaagagagaaagacagacagacagacagaccugggagguugauaaagcauguuugcagcuccaucugggcauuuccagaaaccauuagaucaugcaagcgguggcccaaucagggcuaaucccuugauagaguucuaagaugacagcauugcuagaaggugauucaucuucgggggccuuuggaggaaguagcuuaaugagauggaaucuuccccaggccacugucuuuauguccuuuccucuacuuacuguucaccaagaagccuccaucaugugaccccguuaccauggugaucugcuugcaaccaaggggcggagcaaccacgggcugcacaauaugccaacauaaacccuuccucccuuaaauuguccucucuaguauuuuuggucucgggaugaggagaguuaacuguguucucuccagagccucuuucccaagcuuccucaacuacccuucucaccgcaguuuccucaacugcccuucucaccgcaguuuccucaacugcccuucucaccgcaguaaacugaguuaucuugcugggggaucccuguccuugaacccaucaccugcuuuccagcucucuugccagagaacacaggaagauauguuuugcuuagugugcguuuuuuggaaagcuuuuccucuuuguuuuuucuaucucagacacaugugggcaagccagcaacuggaaacgggacugagacaagcccggaaguaugggcugaggucacuugggaaguuucuacucaggacuguuugugauguucucgaauuccagagcaggcugcacuuuuccaacccgaagcucaggagaauuggggaaaucacucacccagacccucaguuaucuuauuuguccguguuucauccaugcaaacuggaauucuuuccaagcugagucuggcagcugaccauccgccuaggagcacagggugggaugcuucauggcuauccccagcacauuucugcucucccagucgcuaugcugucuggacggccucagaguaaagauaggugagguuccugcgggguuguuaaucaaaucaaggagacgaguucauauagcccacugguuccuuuucuccaucaucuucagaugagcuuaggcaaaugugugagccuuugacccucaucuggccaaagaagguuugggcaggauggaguugagggccccuccaaaucuaaaguucauugacuucaugguacuuucuuacugagauuuauuuauuuugcguauaugagugucucacucagauguauaucugggcaccauguguguuccuguuguuggcaguggucagacgaggucaccagacccccuagagccgaggaugauugugaccugccauauggguugaacccaggugaccucuaauguucacaucuuacauguugacuaaaauaggaacaaucugcuauagagcaagucuuuagcuuugucuucuggguuguaucuaaacuuuuaaaaugagauugcuacuuuuuuuuuucugcaaacaacaaacacuuuuaauugcugaccuaucucucccgcccugacaccauggcaauuuaaagaacaugaagacaaagcuuaguguaugggugagugauauuguguuuuccuugcaugcauguagcccuggguucaaucuccagcccaguuaaaaacagaucaacagcuaggcacggcggugcaugcguuuaaucccagcacucaggaggcagacgcagguggaucucugaggucagccuggucuaacacagugaguuugaggacagccagggcuacagagagaaacccuguuugaaaagccaacacaaacaagugaaaauuaaaguauaaacaggaaauugcugcuuucccacgagcagagaaucuuucuuucuuucaucaccuacuccaccagcaaggccugcuccuuuagagcaagcuucccccguguuagaucauccacagaggagucucugguguugggagccugaaguagacgggcuucgcuuaaaaauccuaguacuugggaggcagaggcagguggauuucugaguucaagaccagccuggucuacauagugaguuccaggauggucacagcuauucagagaaacccugucucaaaaaaacuugcugucuuguugacagcuuuguauaacuugucuugccaguuguauccccaaauccaucuuuuccagaugugcacuucugcacuuuauucagucgaugcuccagacuccuuucuagucuccacuaccagaccgacuaaccagugaccuccaauguucacaucuuacauguugacuaaaauaggaacaaucugcuauagagcaagucuuuagcuuugucuucuggguuguaucuaaacuuuuaaaaugagauugcuacuuuuuuuucuuuuuuuuucuuucuuuuuuuuuuuuuuuugagauugcuacuuuucuaaaacacauguuuuuuccuuaauggaugaccuguuaguauaagcauaaaaacaaagauucagcaguucuaaccauuucagggcucuccuugagagcugacucagcagcccgggaagggcaagccccaacauucacauauuguaccuacaaacaguugaggaccaguucauaaguaggucacaauuaaucaaaaucucugcacuugaaacucucccaaaugcuaaaacaugccggugcagaaacuacagaauaucauaguggccgcuagcugguuuuauauaaccuggagcccuacaaggucguuuuuaauaaggaacagccaggaaaaccugcuucuuggagugacuccugaacucauacuguuuaaaccuuccaugaacuaagccaagugcgcauucugguagaagcugcuuuucugaugcucagggguuuggugguuaucccuggugugcagggaugagacucaggaagaaacuagagagaacaaauugccugugccaccagcacuggggcuccaaucuagugggaggacaggaaggaggccccgguucugagcaagguugguauagaaacgcaaaguggaagcgucgagggagauaacgguuuuggugucaaacaaaaaucaaggcgaaacugaaaggguauguagaaauuaaccuuggaaaaaggaggugaauguucuagaaaaagacuggaaugugcaaaauucaggggcugggaagagcaagacauguguaagaaaccaggggaguucgcuguggcugagcucauagugggggacgggcgugacaaggcaggaggucaggaggguccucgggaucagaucagacugaucugcacuuuguagguaaauaaguaguucaggagaacagaacugccccuuuccuaguggucagacaggugacaguguaagccagacagcuauaccaaaaacauucuugcuuguuucguuuuuuuuuuuuuuugcuuuuuugagaccaaauuggccaccaacucaugaccuuucugcuuuagccuccuggagugcuguggcuacaagcauguacgaccacacacagucgaauguuuuuacaucuacuguagaggagccccagacagucugucuguauuacaguugccuguacacuugucuauccaugcuuccuggauuucaguccuagguagaagccaacacccuccuaccccguugugucaacacaccacuugguucauggcagacccagauggacucuucgccucccacauagauuuaauugccuaagaccacacaguacugaaauuugauuuacucagugugcuaaccagacuuuuuauuugcugugacaaacaccuaagagacacaguuuaaagaagaaaaacuuguuugggcucugauaucaaucuuucguuagcugguuccuuguuucugggccauggugaggcagugcaucgugcagaaagggcacuguagagggaaucugucccccauauaguggccagaaagcucccuuuaucuuuuauccuuuguggaguauucuuggguuuucuucuaguuuccuaauagaacuuaucauuccuucuauaggaaggagccaggguuaagacauguuucaaccaggucccaauaacgucuccuucuucuaauauacaccaccuacagaccuucaccuaugaaccugaggggauggcuguccccaaaccauagcacauggcacucccuccacugucacaucauuuucuauagaugucucccucucucucccuccucccucccccccucucugcauuccuuaacucccuguguuucugucucucugugcucugugugugugugucugugugugugugugugucugugugugugugugucugugugugugugugugugugugugugugugugugugugugugugugucugcugucucuaugucucuaucuccaggguuuacucuguaacucuggcugaucuggaacuugcuacauaaaccaggcuccccuccaauuccaagauucaccuacacguaaagcugugaucaauaucaucuugauacuuaaagcuggccagcuuaccugaacucacagaucuaucuguucuuuguccccgugccccgagauuccuaaaaggaccacauaucuuacugaagagauucccugagaauguacccaagagaacugaagcuacaacuucaagaguuuggagaauauuugaauccccuguguuuauaacagaguuuccccuuaucuguguggcuguucuaaaaaaaaggagaaagacacgugaaaucccucugucuaaugaggaaauuauuuuacuuaaacaaagcaaaaaugcuccaagguuaaugaugguguuugcuguagcaggaaacccugcagagaaagggccggccgccaagaggaaccucaggcacaccuggcauuugggcuaauuugcauuuuguuguucccgguccuucuaaaaguacagcauccagcuaggccuggugaugcaggccuguaagcucacacacucucuggaggcugagacaagaagauugaagguuuaggaccgcccugggcuacaaacuaaauucaaggcgcucggaaaaacuuuuuccucauugugacaaaacacauaaggagaugacaguggcgcacaagacaagugcacagcagcauucuucauuuguccccaagaccuauccaagaagaguuagccucaaaagaaaaacaaaacuuucucuuccaaguuaagccucagaaacaacaguagaaaauacagaacgcggaagaagaaaugcuaaaucccgcuaggaaacugggagaaaagcccagaacacuucagcaaagaguagaaaacaagggugacuuggggcggauaacugagagcuucugggucuguggucaugacagaacgacgacacagaaaguaaccagagggcauggggcugggguggaaaaccacagagaacagggagggcucaguuaugcgcggcugauucaugucugggguugucugccaagcaguuguaagcauggagguccuagcugagacagaggcuaaggccugccggguaaaaccaucagccagugcaguggcugaacgccgguuuagcaagggcuguaaaccaccgugcccccaggagccugaccccccucugcagcacaccuugcuccuuucaaagccagaagguguccuggcaggccaccugacaaggaaggaacagagaggggagcggggauaccaugaguaacacccauauacucgcaagggagaaaccccaucuagagauggaauccagagugggagucaagagagcagcaguggggcagagugggauagccagagaaccagugacucuaacucacaaaacuagaaaaagaaaaaauggucaagaaggagacucagaaauaucagugaguucacugcuuguaauaaggaggggcagugagccacuguccgcugugccuggacagguuaaauaaaccagccagaaagggccuuggggcuguggccaaguuuccauaccauugacacagagcuggcucccugagguauccccaucaccccagggacuacuuagugguacuaaguacuaagugguacuuagugcuucuugcccaaagcugcagcaaggaccauucuuacucucagucaucccuucccuccucccuuccaucuuccuaccugucuuccucuccaguuacugccugcccugcccucaauuacaaucuuccagggucagaaccaacgagaacggggcauguggccuaaguucccauguauucuggaugccuggaagagaguccaaugugcaacugaauugucgcccacuggugaagauacagugggauguuuaugguuggagcuuccccugugggcccuuccagaggccacacaaacucugcuaacagauucuauugcacacuccaacucugagggcugcuucuagagcuguuagccuguaagcuuaggaacccacggguguuccuaaaguacagaucucucuccuggcugauccaauccucagaaugccaaaaaccuucauccuuuccugaaggcccauuguucucagcucugugagauuccuguaaauucagacuuugcccuucuucagucuuugaaaaucuuccagccacuuaaacaguucaaccugaugaugcugagagcccucugggaggcccguacguauuuccccccagggaggacaucuauuuguaaccagccugcagccuuuauugggcagagcagagccuguucugaaaugggcaagccuccagagcagagaguucccccuccacagcgggaugaggaaguccguccaggugccagaggguucccggaugccugcggauguucauuuggagaauggggcugccauagacuuguggauguggaguucugggagcucccuagcuagcuagccuuuagacauccgagaauugggaaggacugucugccuggcuuggccuuccuguggaaauuuccccuaagcaguucugugcuugcggaauaggaaaaaaugauaucuuagcaccuuggauuuauggucagucaucguccaggcaggccaggccugugauuuccaaggcuauguuaauaugaguaagaaacacccagguaacuagggaguuuccccucagaaagacacacuuuaaagucaguucuucaucuguguacaucaaauaacacccagccuaaaugaacguguacggacauuagucagccacggguuaggccgguaguuaaggacuccgacuugauggggucugugcugaauaguuuaacucaccacuuggcgagguugcaacagaggccuguuggggcucauccacccucccagagggacuucaugccucacuuaccugaacaugccuuguuugacuuaacccucagaccgcaugugacagaagcauccuuagggugggcucagacccaucuagaacauucugcaguagguugaggggacagacuccgaauugagaccuuuuauucagacuggaccuuguucuugugcugaauccacacaagaaaggggaagauaauaagaaaaugccugagacuaugccggggccuagcaaacacaaaaguggaugcucacagucagcuauuggauggaucacagggcccccaauggaggagcuagagaaaguacucaaggagcuaaaggggucugcaacccuauagguggaacaacaauaugaacuaaccaguaacaccagagcucuugacucuagcugcauauguaucaaaagauggccuagucggccaucaguggaaagagaggcccauuggucaagcaaacuuuauaugccucaguacaggggaacgccagggccaagaagugggaguggguggguaggggaguuggggggggaggguaugggggacucuugggauaacaugggauaaaugaggaaaauaccuaauaaaaauauuuuuaaaaaaaagaaaagaaaaugccuguuugugagccacguacagucuguucauaagcaacaaaucgcaagaagcaauuuucuguucacauuccauggucagugcaaaccccaggaaaggaugugaaguuauuauaagaugcucagucugaagaaagacaucugaacacggugccuaucauugagaagaagaaaaaaaaaaaauaggccgcacuacacucaaagaagagucuuagcaucaaauauuggagccgaaaacggagugucucacuaacccagaggcuaucagaaaucaaccaagaaaugucauuaucaggucucuguacaccgucaccaagauuugcuguauuggauaaugugggcucaaaaggaccagcccugcaaauacaaggcugggaugcuuccauuucuccauccgaucugggcaggggagaugggcccagugagccacagcuaccuaagauuccccauagggagggagagugaagacugauuccuucccuagggaggagcccacauuccuuucccaggcuaaaauggaaacuagguggggcuugcccugccuuugcagcucaacacucugaauuuguucugaacccaugagcccauauccaacagaucugagagaggugguggggcgcgaagggggggacaggguguauguguguggaaaaggggcugugauaaccacauaugcaauugguuugaagaaauucuuuuuguugcacaguuacugaaaacaacuguuuaauaugucaaugcaguaaagaagcacagaccaguuuccuggcuccaguccagacugacaccauuuuaguuuggagacuagugaucuccucuaacauuuuauguccccagcuuguaacaauuucccuuguccccaagaccuaguuacuagguugcauugcauauucugaguacaucuucaucuuuuuuuaccccacccccagacccuuaacccucgagagugucugggucgcacaaagaccuccauaaucaugccuagaaaugccccaugagucacgugacuccucauuuggaggcgugcaggacugucagagcccaaaucacaaacagcagcuaacacuaauacauauggagugaucacucuguuuucuuauaucauuucguuucucgucuaagugugcugagcuguccgcaauagauccacccccaauagacuauuucuagggaaacaaaaaacaaaaaaaaaagaaacacuucuacacacuuuucccaccaagcgguauuuugucagggccccaucacucugaaauccuggcgcuuuauuuauacuauaguguuaaugacuaauaggagcuauuauuuaaccauaagaauuuuccuuagacugaaacucugaauuacccauggccugugcugcuuaagauuuaguacugucgucucggucuccuuccuuugcugaccuaagaugacccccugagaacaugggcuagauucccauaccaguguucagcuucuguaucgcccaccucuggaaguucccaaaauggcuggccuuggcagauggcgcugcucuuuaaugagcugcacaguugcugcuucccauugcuuagugccaggaagcuucuccucgcuucauccccuuccccuucuugcccacagugccuuccuacuauucuucucccguuuuugaccuuuuguuucaucuuuuccccuuggauguguuaucagaaucucaucucaaucuagggacuucugccaagaugucugaacucuuccauaugcggaguacgaaaucuuccuuaagcccuacuuugcccuuauuugguauaaauauccauacccuaugagcuauuauucuagggccaggagucauuaagagucaguaugaaugugguuugcagacuacccuggcuuagagaaguccuuauacucggcuguguaugccauguuaacauacucaguggauggcaugaggugauaauauuaaccacugggauacagaaugcuuuauuuuguaugcgggaaugacugucgaagcuuucucaucaauagagcugcccuuccccauggaauuugcucugagugauggauguucaaauuaauucuaucuucugguggcauauacuaauugacugguuggugggcaggagccaaaacagcauagcaugccgcaacagaaagucaaguggaagguuaaacaaaauuguaaugggugcucagccagcugguaaacgguagcuaugacaucacuuuagguaaguaacauagcgauggcacauggguucauuucgugacaguguagaucuucucaauucuuaaccagggaacucugagauugcuagcacauugagccuccuccuucuugugaacaaugaagagcaccugacuugacaguugcuggcuguucagaugucaucagaacacuagcauccucaugaguccagccaggacagccccagacaaaaaugcuaugcuaagcuguguagggugaggcagguccuggagggcggacaugacggcugagagugggcuugaagagaaugaggaagaaugguuguuagaagggagaaucagggauggugggaaggaugagaaaugcaaugaagcuaaaaucaugcagccaaaugugacguuagaagacagauccuguaggggagaacuuuauuuuuggccaucuucuagauuagguuaggugaacuaaauauucagccuaaaaacaugacuuuugacaucuucuacucugccauuuuagacuuuaaaaauuagucaacuagggaagaggugacacuuaaguguguuccauuuuauucaucccugggagaguuaccuggauuaacaaaucaugcaaaauaugguuaggcagauacagaacucuaauugaccugccuguguuccauuaauauccagagccagacacuagacccaaaaaauuugauguauguuggcugugcucugcaacauucauauuagguagacucacuucaaaacccccaaagaggcccuaacuucuuguacuauagaaauggcucggcaguuagucuaaagucauuaggcaaaggauccagauccaaguguucuauucccaggagagcuugguguggcggggacagcucaggucauguguagugcuuuguguucugcaggaggcugagacauuguuuacauaccucuuaagcauuucccguguguguguguguguguguguguguguguguguguguguguguucauaggaugaguuuuaacuccaucuucucuuuuacagcuuuauauaaaaucagcuuacaugaacugcuggucagauuugagauuaauuuauauuauauuuccuuggcaucugugugacuugugagaauugccuuuucucacucuucacaaccaaguugcgauguuacaaauguagauucgcccaucuguaauuauucccucucuauauuuuuggggacacuguaacuuuugggucauaagagacuacuccuaaaguagucugagucaucugucugggacacuauuagaggggacaauacacaugcaaacaggauuugcaggaggcuucuaacuguuucuggguacuuuuagggugacaucgauucauucauugaauuuuagcuuucuuccagugaauauauggaauauuauuccucacugccgauucacccaggaucucguuauuuguuuucauuuucauuucuuuucuucuccuuguccuccaccucagccaucccucuucuuucucuucaaaaaaugggaaaaaaaaaccaccuaagauuugaagggaauaauaauguuuuaaaguaaggaaaugaacuugggagauaaacguguauuauuggaagcaauggggauugaaugagaguuagcugaguugugcagguaagaaagcaaagaggugcaguguggguggggcacagacaucugggagaguugaaauaggagacugggguccggagagccugguggcggacauuucccccaugccugcaucacuguggcaguguggcucuuugcuggagcugccugcaugagugagggaagagaagagcaguggagagucagacauccuauaggcaggaugcuugcuagacagacguuuaccacccugaaaucccucguggggcaagagcauggguaagcaaauaauuagauuuauuuuggguuugucccuaugcacugaaaacaaaucugggauuuuccucuuuaguuggaauccagacacagaagauaacuuaaggcgccaauaucaugacucaucaacuggccuugagauucaauuuucagaauuuuacaucaaaaaaaaaaaucugcucugggugaauuaaagucuuucuuuuuuuccuuccuuccuuccuuccuuccuuccuuccuuccuucuuuccuucuuucuuaugucuuuaucguuuggaacagaaaugcauucuggauuuucuuugacuuucuuggaagaaaggguagaaagaggaguucuuugauaaagauaauaaagacauugagcugaagcagagcaggaccuuuucgaacugaacucugggauacagaguuggcagcagugccacuuuccagcagaagaugugcagagagggccuuuguggcuggggggaggggcugucacauccaccagcagcucaucuucugcuugcacguaggaccaggacccuguugguguccccgagucauuaggaaguccuuucugugucucuccucaccccuccacuaucuuccuguaagacccacauucugccuuugccaagagucucccagcccacguugguaacgcaggucuguagucccagcuguggaggagguugaggcaggaggauuccaaguucaaggcaugccuggguuaugcagugagucugaggcuagucaggacaucugaaucagacccugacacaaaauucaaaguuaaaaagaugucagggguagagcccguugguagagugcuugcccuagcauguauaagacccuaaauucagucuccacuaguggaggagggaaugggaaaagccucuuuaucucuccugcuuguuagcaggaaguucccagagugggagacggcaaagauccaggcagccugagagguagagaagacacuggguggguaucagcucugagcaaggugaaugaggagaauucugaacaccuguggauucuaccaugacaaaaaccauggggaacaaccugucccgccuacucugaggucuaccgaugaccucaucaguuagucauugauugauugauagggcuuuccucugcacaagucuacaugccaggucugaaagcccuuuuguagggugguaguuuucaauguagaugcuguugguuaaacucuucauuguguuccugaguuuagccuuagguacaacaaggucauucauaaugaccaagguuuucuuucagugucuugccgggaacugccugcccacccacccagagcaugaaugaggcucgcuuuuauuaucuagaacuuguaggauucuacauauagccugguagcaaaaugaacaauaaucauuuguuuucaauaaucugcaaguagacucagcucacucaagucaagucguuuuauguaucucaaugggagcucaccacauaauugguucgaauugugaacucacuccccaccccaucccccacccucaccccccauccccaucuccaucccccaucucacccucccacucccacucccuugauagcacucauucaggguauucauaggcucagauguuuuucaggaacucuuacuucuccagaaagucucuuuucuuggaauagcaagaaaccccgagagagacccauuaucauaaaccugcccugccuuuaguacucgaaucuuagcauaauggguuccuggaguguacuacugauacaaguacauggacagacagacugguggaucagaacagagcccagaugcagacccacacauucggcugagggacagaccagaagguauuauuaaugauucaguaggagaaauacggcccucucaaaaucuacugaagcaauagauggccuuuggggagauggccuguacaucauaauagaggcaaaaauuaauucaagauuaaacaaaaaccuacuuggagaggaguugaacauaaagauugaggaagagaacagggcccuuuagagcauugcaucaaaguuuaauaaccgggcucaaaaaauguaaagccuagggcacgccuuuaaucccaacacucaugagacagaggcagguggaucucuaugaugcaaggccaguguggucuacaaaaugaguuccaggacagccagggcuacauaaugagacucuuuggggcgggggggggggggggggguaaaaaaaaaaaacuacucgcuacagugaaucguauuaaaaagcucaagcauagaacuucuacuuguauuaauaacacuggaaaggcugaggcaggaggaucaugaucaugaguuccagaccaaacuggacuacuaagggagaucaugucucaguaaaacaggacuaacccuaacugcuugaagaaggcugaaggaggucuguggccugcuccuagacccccgaagcaguaccaggcaaggacuguuccugcuccugaugaaggcgggugcgucugggaagacgaaugcagguugcauaggggacacucagauccucacaauugaaccauucccaugaagcuuuacuccuuugcuacgagagcagcagcuuuuccccagaccccccuugcuccacccugccccgcagccgagcucuucagagcuuuggcauacugguauauucuucccagaacaaccucuugaaaucccuuggggucugagucaggcugccccagcccuuguugggaaggacagagcaguggggggcccucacaggggugggagaaaggaguucaaaggccagccagauccgguugugugacgucaaagccuuggggucucagcagccaagaggaagcuagggagagggcgagccccgcauucuauaucagggcguucaaacuaggaaaugucggagacaaggccagaaacauacauauaaacacagccucgcucugcuuccccguguccagcuuugcaaaaaaaaaauagccaguacuccaagucacggugugugcuuccuucugggacccacgauccacagagaaggaaacauaaaauauauuuagagcuuucgaaacugauuguuuuguguauucuuacaaagggagaaaaaaauaaauaaaaccgccccaagagauuuguuuuaaaagcuucucuaauccuugagaugagugggagaacguugcauaguggggucauuuccuugccgucuccagacguuaguacgcacugaaaauagauguugggaggggaagacuccguggccugugaauacggauugugcaagaaaguuuuccaggccaagaggggaagguugggccuuucccaggcccccgguacaagaugacccugugguuggauauuuaacuaggcuugaagaccccagacagagggaauaauuaacuuacucauuccagaaucggggcaaagcaucccggagggcggagucuagggcaaagcaccccggagggcggagucuagggcaaagcacccccggagggcggagucuagcucuucagcugcucagucucucugugggaacccaggcucccaggucuaucuccccuccgagguacacugucccaagucucucuggagggcccagggggcugaaaccuggcauuccaaauuaguagauggaaaauaguaauugcuccacuaaaaaagaggggugugugggcuggagagauggcuccgugguuaauugaguugaguugagaccucugccacccacauacaagccggugugauggaaugcagcuguuggcguaacaccagccggucucagcgccucggagaucaagggcaaacaagugagcuuccaguucaccaagagaaccucucucaaaaaaaagguggagagcaauagagaaugauacucaaaauccaucucuaccuguaugagcacguguacugacuccagccgcauauguagcagaggauggccuugucagacaucagugggagaagaggcccuugguccugggaaggcuagaugccccaguguaggggaaugccugggccgggauggguaggugagugggugggugggagagcuaggggguucccagagggguaaccaggaaaggggauaacauuugaaauauagauaaauaaaauauccaauaaaaaagaaaaaggaaaaaaaagaacuacaaaaaaagaggaaauaaauguaauuuuuaaaauuaguauuuuagagcaacuuaauuaaugaaagguaauuaacauccaggcaauguuggucgaugcugcagugcaaacagggccaugacucuuuccauaucuguugaugugagaagugggaguuucagggccaaagcagaaaucaccugcugacuuugcucauccgggcucaagagaaacugagcaggcuuguaguucugagucuuucuccugguccuugcuuacacauuagucucuuucuucuguggauuaaagcuggaaucagccauuuccuucugugaaggcccagaucuacaauauuuaggucacacagucuggaauacaaaccacguggucccaccagggugacagagacacucugugaacgcgugaaugaagcuguuccacugacauuuauggacaguaaaugagaauaucuucuaguucucacaugccacaaaauaauaguauucucuuaauuuuccccaaacauuugaacugacugaucuuuggaggccauacagacauaacuaggaaggcaaauuugggucacaguccaugguuuaccaacuccaggaacagagagccaaagaagcuuacagcaaaagggaugcccacuacggguggaucugaguaauaauagcauuuuuacucacaggaggaagggaaauuacuggguuccagaacaccaagaauggggagguaucuucuggccucucuuggcuuccucagaucugcucacagucccuuuaaccaaugcucacugcugggaacccagccaccgaggacccugaaacuagcccccuccugcccuuucuuugggggcuuggucccaacagaaggcagccacugcuuugagcauuugccuucuccacuagcagaaagacccuguccccaccuucggugacagccaggccccuucugugccaccagccgauccccaggacagcccacuugaaucuuaccccagcaagccugccugagugcucucagcacacuugaaaauaacuucuuagauuuuuuuuuucuuuuguuauacaaggaaugguuguuagcacugaccuccaagugaagaugccgguccacaaaggaagugaaacauucagcauuucagaacugaaauuucuuggcguuaauggaaaaaaagaaaaaaagaaagaaagaaaucccagcuaaugcaaaacagcuggcgaaauaaaccucauuuaagcucggcuggggaaaagaaggcaauuuugcuagauuuuuguuagauaaacagaccuuuuuuccuacuaauugcauuuguuguuguguuugcugguuugcuuauaucagcccuugccuuccuuagaaagauugcaguaucacgcuggcgacaggaagaggccugucugucuggccuuugagaugcacgucagauaauccacagaggagagaggcucauaaacaaggauuugccuuguaagauccugacuggugaugggcagcuaaaaagauggacuuggcuuucuggcuucucuuguagguccuuccauagugacgccccccaaggacaucuggaacgucacuggugccaagguguucuugagcugugaggucaucgggaucccaaccccuguccucaucuggaacaaggucaguagugcaggccucgggaaagcaucgugcaagccggaaaucguuuuuugcauggcccagggcggugggaauggcacagcucagucugcauccacugccggcugccccacaaccaugaagccuguggcagcugguaucacucuacacuggcacggaucuuuccugaccuccaucagcccaguucugcuuuggguagcaguguccaagcagggagcuugggaaacucaaagaaccguggugaauaucuaaacccacuguuuucguugcuuuugguuacugugaccaaagguuacccgacagaaacuuucaagggaggaagaaaggugguucgcuuuagcuuccagguucagaggcuuauagucccuuacacagcagggaagacauggugcuaucacucagucugugguggcaggaagcuaugaaguaaggaagaaucuucaaacucgugcuaauaaaacagcaaagccagacaccccucuuuagcuaguuugcuuccucagcaagcucagaaauggaggauagucucaauuauuuugugugcuuguugucuggucagaggggagaccucuggggcucugggaggggguuucggccccauugucagaagaauccuaacagauuccaguucauauagccgaggggcaaaaagaaagagaaggcaguuccagcguccgggcacccaaaugugaucgggacuggaauucuugaucucuguuaucaaucucucggccucacuuucuccuucagaaagcuuccuccgcagagggcagaauuauccucacagaccuccgaagcagcaaagcuuucccagcugccgagugagaaaccuuagucuagaucaugguuccuggcagccucuggcgcccccguguggccagaagaaugcggccacugaggaaacuaccuggcuugagugugguuaccaggaaacgccuggaccacggugugggcagaggugacccaguucuaguacagcagaccgaugacccaguucuaguacagcuaucccucgcagcugaaacuuucguuaaagggaauaaugggauguugccucuaaauugugcuucggaaagagauguggacggggagucaggcaugucaauaacguggucggcuacguguucauuuaaaccuucccccuggcagcugaaguuccccaaugcuuauuugcgguuaguggcuugugaagagcauggccgauaguuuucaaggaaaaccggcaagaagcuuuguugcuucucaaggggucuccauggaauuuacaaaaugagaagccagggugacucgagguacuuaaguuuauaagccucauugccgaaacuugcagagaauaaggucuguggcaccccggcaaaauacacaugggucccaggggaaaugagucggccucgggaggcuuugaaguuauauggcuucccuuagaacaccagacaccagacaccagacagagguggggaccuaggggcuuggagaaaggggacuaaaagaaaaagcucacaacugccucugacucccacccacuccaggacauccaaagcccucuucuggccucugagggcagacccaaacucagauaugcacauuaaugaggauuaacauuaaguaauggugcuaacaagaaacagcacccagagauguauagcauucgguaguuauuggcgcuuuuucuuauuuauuccuuauuuacaauagcaagauuuuuggaagaaucugcugcaaccaaaguacucuagagcuaggcaucaggugccgcguguucugggcaggcugagacaggauggugaguuugaagccauccugacuauauauaaagagaucuugcaaaaagauuaaaauaaaauagcuagacaccuaaacgacuucuuggucuccccuugagccucccccagccccagcuggccauuuguggauagcaggguuggguuugcuuuuuuauuuguuuguuuuguuuugaagauucuuuuugucacagggcaguggugguucauuaaucccagcaccugggaggcagaggcagguggauuucugaguucgaggccagccaggucuacaaagugaguuccaggacagccagggcuacacagagaaacccugucucgaacccccccuccccaaaaaaagauccuuuuugucagggugugggggaucuucuauugcucuccacccuacuuuuugaccuagagcucacugauuugagcuagccagcuagccuggaggauccucgggucuccaccuacccugcucugagauuacaggugcuagugaugugugggagacuuagcagagucucuagccuuugagucaaacacuccucccagaacauuaccuauuuuauuaacauagacgguugcaccagcugcuugggaaauucaaggaaaaaaaaugcuuauuuauacacgucuucauagcuuccauuugaaacccuaaguaccagguuuuucucuccgaauugggggagacgugggacaaaccugaacuuagcauuugcuuaauuacagaaggaaacuccugacuuucucgugacaaagacaaucgaaguaaacacuggcuuggcucuuaaagaggccuugguagaauuaaagaaaacuguuucgugucauuuuuuuuaauuugguuauuauaacuuaaaacauauguacugaaacugaggaacuaaauguguucaacaacaacagaaaaagacuuuucccuguguucuuuucacaucuuuuccaaaguucuuauuaacauacuuuaaccuuuaaaauagguagggaaggagagacacgaaguaaggauuggcuguaaaccgagggagaugaauuuccccuucguacacggccuucggaaucucucucuccauagcacggacagaaacaggcaggguuuaucacacauagacagcgggaacuguuucaugcucccuuagcccccagagcaagcacuagacucagcucuggacuccagcugcugcuucucuuugaugagguuguuacaggaagugcccacaaggucccaaacaucaaacuacacugcaugacagcuugccagucaaacacagcaaggcaggcaaagaaggcccaguaccaaggaucaaacugucgucggacaccagugagugaagcagggugaccaugcauacuccacaaguuuuccagaaaaaaaaaaaaaaaaaaaaaaaaaaagcuuaaaucauguugcuuaaaaaccagauggagugguacacaccauuaaucccagcacuugagugacagaggcagacugaucuccuaggucuauauagugaguuccgggccagccaagggcuacauagugaaacccugucucagaacaaaacaaaauaaaacaaaacccagguugcuuagguaaaauuggcaggaagaaaccauucugcuugcucaguauucagaaaaggaacagauugaguaaauugcuagauuuaaucuuauuaugaagucuggugaacaccuugugcaauucugggaauggggcauuuccaaccuugauguuuuuauacgagaacuaagacucuccccuucugauuucucagguaaaaagggaucacucuggaguucagcggacagaacucuugccuggugaccgggaaaaucuggccauucagacccggggugguccagaaaagcaugaaguaacgggcugggugcugguaaguagcaagagcuggcaaccguuucauucucagaacacccaggcuuggcaaaggucgccugccugaaauuauucuccucccauuucuucgaagcagcccugcuguggucguacagauacagcuacaggaacuaauggaagaacugaaguuacuuuguuuaaaaaaaaaaaaaaaaaaaagaauuaagagaauccugcuugccuaaguucaaagcagaauucuuacacagaacugaauuaauuaucguuaaugguuagcaaguaugcgauuuugcuuaaccuuugauucuguauuugaucacagccccuaagcaaggcucucccuccagcauguaugugcgccuacccagauuuuaacauucacauugugaucaaaagccacccaggccauuggaauacagcggcuccacgggcugcuagcauaggacuucacuacuucucauagcagcuccgcucccaagccccugcucgucacagggauccuacuagguguaauggaagccacugaaagcgaggagaccuccacagagaacuaaagagccuuuaucuuucgcagguaucuccucuaaguaaggaggacgcuggagaguaugagugccacgcauccaacucccaagggcaggcuuccgcggcagccaaaauuacagugguugaugcccuccaugaaauaccacugaaaaaagguauguaagccagcucgccauuuaaaaacaagcggucuuuuaauaaucaaguagcacacagaacuauuaauacaauucugaaaagcaggaaguccagaaaagcauuaagcauauguaauuacagccagauugcaugccucaagauggcggagggcuaccaggacuuagcuuucaccucaucuugaacagaauuccugugacuucuauaugucauuuccccuuugugguuugacuauuauauucaucauuuaaaaggaaguggucauggucaauuugguccuucauuuggagcuuuuaagaaggaaaaaacaaaaaacaaaaacuagacacucauugcucuuccaggggaacugacugaguucaguucccaggccccauauggggcaggucacaauuaccuguaacuccaguuccaggggcuccuaugugcucuucuucuggccuccauaggcaggcacacacucaugacacacauucacacacauacacacacacacacacacacacacacacacacacacacaaagacaacaagcuagaaaaagagaagagguuggcaaauacucaggugugucccaaccacugcuaaaauguuucuuccaaagaagccacgcuacaguggcccagcagggcugccuuacauguagucagugacaccugaccagacccuccucagaccaaacaaagcuucucccacaugcugaggugcaggucaugccgcuggccagaccacucagcugugcggcgaaaggcauuaccaagcacaaguguugguggucagaaauucucccucuccaccaagacguguggggaguccgacagggucaccugucggaaccucagucuggaacagcacucuucuaccuuaagcucugaacgggcgggcgcugggcugcaaggaugcuuagcuucucuggaucucaccuuggaagaauguagcacuggcucucauacuugaaagugcauagcucacccuccacggggcacuccagcaugucaugugcgugaccacucauacauccuuuauccccagguuucugaauccccacaaccucaccuguuauguguaugagugguuuacuugcacggcugcaccacaugcauguagugcccccagaggccggaagagggcaucagaucccucaggacuggaguuacagcugagagcugccacgugggugcugggacucaaacccaaguccucuaaaagagcagccagagcucuuaauugcacagcuaccucucuagagguuuccuuuaaagaaugaggucucacucaggcacaugcauguaaucucagcacuugggaggcugaggcaggcaagccaugcguucaagauuagccugggcuacauaguugggggugggguggggggggagagggagagggagagggagagggagagggagagggagagggagagggagagggagagggagagggagagggagagggagagggagagggagagggagggaggcagggagggagggagggagggagggggggagagagagagagagagagagaucuuaaguugcccaagccuuuaacucccaaguuuaaacaauccuccugucccagccugaacacugggucuauaagcacauuaccaugccccucccuguuagccauauaauuuaucauucucacuaauuuagaaacugacaaucugccauaccaugugaauaugugugacuaauuuuucuuucuuucuucugaaacaggugaaggugcucaguuauaaccugcgaauccaugagccucuguagcuaaaggugcucucagacagccgacagcuauaacccugcucuugccugacacacuucucuuaaccuaacccacuaacacuuuauuacagccagcugguuuuacacagagaaaucaaagauaacacaucaagacuaucuacaaaaauuuauuauuuacagaaaaaagcacauguagcuuuaaacaaaacaaauaaaauucuuaucacaacag

SEQ ID NO: 12099 - RNA, 1989 nt, Mus musculus
cagaucucaccacagcccuucgcaccagcucccgcgcuccagacuccagccacacuccagccuagcgccauggccccucccaccugccggcuccucagugcugcacugguccugcugcugcugcuggccaccaaccaccaggcuacaggugggauucggauucgaggcugauguuucuggggaagccucaggugggcgcagccauccccagccccucugacccggugucuucuccuacaggggcuguuguggccagugagcugcgcugucagugccugaacacccuaccaaggguugauuuugagaccauccagagcuugacggugacgcccccaggaccccacugcacccagacagaagucaugugagugucucccuggauagccucuaccauggccagaauagcccagaugcuccugcggccccaagcucaccccagcagaaccucgagccuuaauaacgaucccuacuucucugugcagagccacucucaaggauggucaagaaguuugccucaacccccaaggccccaggcuucagauaaucaucaagaagauacugaagaggugaguggugcuuuguuugcacgugauaacccucaucagaguacuggcuucuaucucucgagaaucuuaucagggaaagucacagaacuacaauagugauuauuaucuuuacaauuauaauaauuguuuuugauaauuaauuagccuacuguggugccugaaggauuuuuccaggaucuuuuaucccuaccuggagccucuuucuaucgcauaagagggagauagcacugcuuuuuagaacauucucaucugccuuggccucccaauccuaguuaguucuaaaaagcagguccgugguguuuggaaacagguucuaauuuuuaauauuuagugaggaaaagcagagauuuugcaguggcucaguauauauauauauauauauauauauguguguguguguguguguguguguguguguguguguguguguguguaauaucaaaacuuugauuauauauaaucaaaacuuauuaucuauuucuuucuggaaauuuuaucuugaaacuuaauaaaaaaaaauaguagcgcuucauaaguuaagugagaccuggugugacagacaaucugcuucaacagcuuucguuuuuugagaccccagguccccuguucaucucuguccuguaggagagcauccgcaagccugagguguuugcucuguggcacaggcaucacaggccaggguccuuagggcaggcuguccucagaaaacccaggagaaugaaggaugcugugcaccuaauaaaaacaucuuacuucucacgacagcggcaaguccagcugagccgggaaaggaggaagccccucaccaugaugaaggaccugcauucuaaaucagagaaaagcgauccaucccaacggugucuggaugugucuuuaccugcuuguuuuuaacaacuccugagaguucauaccuauuuuauuucacauguaaaauaacuacggguauaauugcaucuacuugcaagauggcaucuuauuuaauguuuauuuaauaucaagucuaaguuuaaccaagccuauucuuaacuugaagguuagagauuuucagauucuguuagggaguuauauugcuauuucugaggcaguauuccuuggcuggccauuuugguggcagcugugauagucaaaaaacagacaaacaaggucaugccgguguaggaagaaugcaugugcacaucuaguuuuguaacuauacaagauuaucaguuguuauuuauugaaauggucuuacggugucacaugaaauaucaacuuuguguuaaagcuuuaagaauuauaaugcauuauauauuucuuagacauuuuaagugauuuuuuaaaaauaaggcacagugacuauuuaaugccuuuaugucuuagaauggagaaguuuaaauauuuauugguauuuuuacaaauaauuugaaaauaaaauauuuuaaaa

SEQ ID NO: 12100 - RNA, 1807 nt, Mus musculus
ccaugaucccagccacccgcucgcuucucugugcagcgcugcugcugcuggccaccagccgccuggccacagguaggucucgccacugccacugggggaggagggaccucuggugagcgcagccucccacagucccgcugaccaagagucuucucccauaggggcgccuaucgccaaugagcugcgcugucagugccugcagaccauggcugggauucaccucaagaacauccagagcuugaagguguugcccucagggccccacugcacccaaaccgaagucaugugaguaucuucccgguuagcuucugccacuuccagacucgcccaaacccucccgcgcccccacacuucuccuagugggaaugccuaacaugugggucuauccuucucucugcagagccacacucaagaauggucgcgaggcuugccuugacccugaagcucccuugguucagaaaauuguccaaaagaugcuaaagugaguugugacuuguguuuguacccgagacuagagucaagggugggaguacuggcauaugaccccugaacguuaauucuaucaaggaaagucuguguuuaucaggaggucggaaaguugugguuauuauuuugguaauugaccuuaauuugagaucauuaauugguucugaugcuagagaauuguguccucuuggacacaauuacuauuguauauuacacaauuacuauuguguauaauuauuaccacacucaaaaccccuaugcaaauggucaguggcaacaguuccuaaaagauggagaagucgccaauagccuuuaaaagucuccuuaggggcuggcaaagcaugcccgagccuucuuuugccagugagauuucccugaguucaaggcuaaggucucugugaauguuacauaauuuauugaauuuaagccaaguaggggagauaauagcagcuauaucacagaguugugagugagagaggauuaaagucacacuuguaaauuaacccaugcugaaguagguuuuuguuuguuuguuuuuguuuuuguuuguuuuuguuuuccaagucaagugauugacuccacaggaaccgacaguacagaacucugggugcaaguguagacauguagaaagcccaucuggagccucaggggcuggaauaaaagaagaaaggcuuugaugacuauuuguaacaaugacucuuuucugauugcagagguguccccaaguaacggagaaagaagacagacugcucugauggcaccugucuggugaacgcuggcuucugacaacacuauacaauuucuuuugaggguccuauuuauuuauguauuuauuuauuccacaaagugugugguuuuuauuuuacauuaauauuuaacaguguggauacauuucaucgaugguaguucaguucugcuuguucaguuuaaagauggguaggcuuaaaauauuucauuaaacuaauauuuauugggagaccacuaagugucaaccacugugcuaguagaaggguguugugcgaaaagaagugcagagagauagaguuuaguauuauguuuuguauguauuagggugaggacaugugugggaggcuguguuuguaugucuugaaaagaaugucaguuauuuauugaaagucgucuuucauauuguauggucaacacgcacguguugacgcuucccuuggacauuuugugucuaguugguagggcauaaugcccuuuuacauucuuuaacccuguuucuccuggucucgucucgcucgggacagagacguucaaaggacuguuacaaaugaaguaaaaauaaaaguuuuauuaa

SEQ ID NO: 12101 - RNA, 101162 nt, Mus musculus
ggaggcggugcugaggacacagagcugaggacgcggcugccgagagcgcagagucugcggggcaguaucgccgacggcugcggccgacgcugagagcggcgcgggcgagagagccugcggggcgagcgcgcagauggauuugggacgccaggcagugugagccgagccauggcagcccauuccaggugaggcuugcgcagggggcgucugggacccgggaguggccgcggagcccggggcaagggcggcgcgggugggagugccggggggggggggcggggaccgcaggaagccagcggcuggaucacugcuaucucaucccugagugucggguagaaaagugugugaaccgagugcaaagggaccgcccggaaaguuaagguuaaagauuccgcuucuggcccgaagaacuguuauuuucggaaagugaaguugguuucucuccugccggagccuggauuuucacugaggugccugugcacaauccuccggcucuacucguugcugguuuggcgucuuccaaagaaauuuggaagcgcacuuaauggaaacgaggauucucccacgagagagugguggagccuggugaguaauauaguuuuuuuuuuuuuuuuuuuuuuuuuuuuuuuuuuuuccugcuagaauguacgauuccacauaaaacggcacagucagagugaaucugcugaguaggcaaaggccggaaugcgcuggguuggugaaggggagccuggcuaaugacccgcaguugcugucaggggagugcccuguacugcaaggaccgagucuugccuucucccggguuugaagguuuugaaaggagccuuaaaacuuggccguacaccggugcccaagauugaggcuguugggugucaucgcgcuucggucucuacagcuguugguuacggaaaacaggacccgucgaaccuuuucaaaacuuaugccagaaggcagugugauugcacaaguuuacaauuauggaaauguucuuuagccuuaauacuugauuuaggauagugauuugguaacauaucuggacgcugagcugagguaauuuuaguaauuuuaggucuaaagaucauggagaacaguagauuuguaaacguuagagacugaguagauagaacuugaauuuuucuaagagauaaaacuuccuagaaggaacuucucuaaacagaaaaccuucuaagugugucuuacuuuaaaaacaaguuuaauccucucaacuuggcuuaguugugucuucaucuuauugaguguuggaaggaagggguuccuaacgggacagaggaguaggggaacagaaguugcaccucaaacuucugcuaaaucuuaacuaaaaagcaaccguuagcuuuuagcacaaacagaaccuguagauuuucauauuacagugacugcagaugucuucaaucucuaacguuucccauuugcuugaaauuaaggaacuguuugucguucauggcuaguaauuaaaauauguuauagcuggauaugguugcccaugccuuuaaucccagcacuugccuuuaaucccagcacucagaaggcagaggcaggaggaucucugaguucuggggaaagccuugcucaccuuuuaaucccagcauucagaaggcagaggcagggcgaucucugugaguucuggggaaagccuggucuacaaggagaguuccaggacagccagagcuguuguuuguuacacagagaaacagucucaacaccaccaaaccaaacuauuauguccuuaccuugucaaugguguauuuuaguagauacucuucuagaucauuuguuuccuuuguauuacauaauuuacuugugaaaguauccuuauguaucacgcugccucaggaucccuuggcauacagcccgagauuaagguaccucuuauaaaauaguuaaagcugccagagcauggggauuugaaccuugguucuauuguuccaauuccuugacucuuaaacuaacgucgaacguaaaaugaaauaaaagauaaacuggguccuguguaugccagacacagcaguaggcugcuguaauuggauuaccucuuggucaccuaagcagacaagcaagugcuugauuauuugcccuugguaguuaaggaaacugaggccuagccgggucacacagguuucgugcucaaggucacacaggugcaaccugccugaccccagauggaccccuguagucucuacaguguagcacuuccugcuucuuguugccucugcugugccagcugcagaacuucagaggaagagcccgaaagugauugcagcuaaguuugcucuggugcagcauguuuaaucuaagucaucagcguggcugcucagcucagcagcaaagacccugcugugcuuuccuggcuggcucacaagcucuggcacuagaaacaaaaccacacggccaucacgguugccuuccugguguuuucuuagcccuagugcugaguaucuacccuguugcaaucaucccuucaauuuugccuugaguguaguccaagcacucaggagaaacugaagcauucuuugugauauaaaacuauuggcacgugucuuauggaggacagauugguuugcucuugugacaguucauuugaauggucaggcucauuggacuuagagauucagagcucacuguuuuaaccauagcgguuaagagcacuuccugcucuuaaagaggaccagaguucuguucccagugccuacaugcagcucacaaccaccuguaacuccaguuccaggagauccagugaccauucuggucuccaucgacaucaggcaggcaggcaggcaggauacauacauaugggcgaaaaugcacacagucaaaagaaaaaaacaaggaagaaagaaagaaaagaaaagaaaagaaaaaccaccagcaaaccuacccccaaguacuuugauugugcauaggccuacuuguaggugggagcuuaggugggaucuugccuugcugagguggaacagguccugacuuaaagcugaugugaaugagcuaggcuccauucgauucucagugugacucaggcagggcaaggugaugcuacuucccauaucaguugugaaugagcuacuaaguguuuauggucucaguagcugcuuuaaaauuaagauuauguagcccuccuucuuuucccaaaucgugaaaguagucguuuugcuuugguggugguggugguggugcugcugcugcugcuccuccuccuccucuuccuccuucucccccucccccuucuuccuuugauccucggacacaauauguagaacaagcuggccucaaacucacaguuccaccugccucuuuagaggucaauggcauguggcaccuugcuuggcaaggauagauuucuuuguaauggaagacauuuauuaacuacuacuugaaaacaaacaaacaaacaaacaugauuuauuuaggaucugaguugggaguuaguuacagcaggcuaugugcuguacuagcccagccuaggcuucucuggagccugcaaucacaacacacccugaucacacuuccuugagagaaacugguagaagcuugauguccucaacaugaaacaguuacagauuuucgggagucucauugguguggagguugguccuucugcaacuauuaaauaguaaauuuggugucuggacuauguccuauguagagugcuugcaguaugaugagcaguguggauugcuagaauaaaaagaagacccgugucugacuuucagcuuucccaguucuuccauuaaaaccauccuuggagucuaggguggaaucuguaucaaucuucuuaucuuaauuaguucuaaaacgugccgaguguugggcuugaggagagacccagucaucccaaccaaugggaauuagaggcagaagauagcugcagguuuaagaccagcaagggaaaggacaaacaggggaagggugucuggguggccucaggaguggaacuuucuuugcaucugucuggugguuaaaaagauccacagaagugucugcaacagugcaaaaggagaguaggucuggccagcucucguucacaguuuuccuuuggaauuugacaaaagucguguuaauaaagcccuggagucaaagaaguaaagccagguuguucccaagacgcacgugaaacuggauuuuagugguucuucuauucuagcgagggaaacuguuccuguugaaugaagugugguccuuaaacugguacaaaaccaguuuggccccgacuugugccuccaccacccacuggggagcugcugguuaccuggcagaaaacccacaaugcaaagcagcuuccauuaaagagaagaauuauugggaaaguguaguuucaggaagagauuuggagagaagaaggaugugugcccuacuugaccccuugacuggucccccacgcucccccauggugccuuuaaacagggacuggagacaaaggagucacagacaggaacuacucuguaguucauccugggagcccagugagcuuccugacucacagucuagcucuuuccaagaugaagacagcagcagccaugagucauuuauuuauuuuuuuauuuuuuucugaaagucagcugucuuacaggacguuguuuggcaacauuaauggaaauggucuccuaagagaucuaggugguuccgugcaggcaugaguuguuccgugguuggucucagaccuguggucuugagaaugagauuucaugaaugaugcugagcaguguuuaaagucucaagugucugcagggagagaagcuagucuccaucguagcuaugagcugaaagaacauuuuuuucuagccgggcucugucauuucugucuuauuccaguugauacauccccgagaaggcguagaaagggacuaaauggcugcuuagcucuaaagucuaauagaacccaacugccuuugcaagcauauauauauauauauauuuuuuuuuuuuccgauucucaggcuucuccaauucauuuguuaaccaggacucacaaauaaguacacuucaccccagaaugugaaauguccuggaaauccacuuugaucccugaggaaaaggacuuucagacauuucagacauuucuuggcucagacugucuagagcuggggcauugcuacuuuacugcucucuguauaucuuauguuuaucugcuuuucugugccccggaguaagugggagucaagccuugccucagaugucauucaguuuacggcagacaucacaaugcaugguaucccuugccuggcaugguggcacacgccuuugaucgcaggacucuggaggcagaggcaggcagaucucuugcguuccaggacagugcgggcuacuuugugaggugaaaaauaaguaauguuugauguuuagcuuuagacucaguagaaaaauaauuuauaacuuugugugcgaaauccuugugcuccagauaggaagauuaacuuuaauccugugcugguuucugaguguccacagacgugaguguccaggccccuccugugcaaugcuuuccucucuccaaucucugcugagaguuaaagcuuaacccaauggcauuagcugguggacaccagauccagaaagccuugcuuuucgcuaaaggccucuuuucuuguguugguuuauuagccguguuuuuaauuuaaccggcuuaaaugccugcaggagucucagggcaggaauuugauguuagauuuaaaguauuaagaggaaaaucccaguagugacauuaucuuguccaaaggagcagaaguaaacaaagggagaaauacuuuuauugaccguuaacuuguguuuauuuuggaauuaggcuuuaucuuuuaaaaggacacucacaguuugaccgcaauuaccaagaacugucuuuccucuucuguggcggguaggaugguucuggagugcuuuuggcugugugguacuucaacagggguuuggggggacuugacuuucaguguagcuugcuucuggcaaggaauaauuuagggguacuugggcccuccuccuggguugaacaccagaaucaccaaggugcuugucacccauuugguuucccuuccccccagagcugcugauuggucagguccugggcggaggugggguggaacccugcugucccugaugccuggggcccauauaucagcuuugugaacugguuaacgacuggaagaagcuacgcaaauacaaugugguuacauuuuuuauugaagacguuacucguguauacacuuucucuccugggcccgaacugagcuuagcagagaguguagaggagaccccgcaguccagaaucagcauacuugcucacugagaaguuaaagccgguugugcugcuguuuacgaucugugugugagcaggcaaggacggcaguugguugugccuccugccgcacuuggcagcgagugcuccuucccaaggaccuugauguuuagucgcuccuuuacucugcucugcuggcucccuuccuaugccacuaagccacuuucucacacaaccccucccccaacagcuccccaggugcuguuguucuccuucugucuccaaagaguuacacacagcuggggcuugcuggugacucggaaccagcucugaaccugaagugaaagcuguuuguguuuguugagcagaaagcacgggcuuggcguccugcuguugaacacgggagaugcccaguaaggaucuugacgugggaucguuacugggaaguuaguguuaaaccgaccgcacagagcacuuccuguagcccauguucaggaagcucuggaggaggugcucuugaguuucccguucuuggagcgcccuuuuagggaagcauuccagcagaagugcaugaaaugugaagcacacuucaagggugcuguguggugucauuaaauuuugaaucggugcacacguuuuuguggccuggacagaccacagucaccacgugacauucaucuccgaugcugugucuggaucuuuuggugaaguugcaccucuccccuccccugcuugcucacuuuaaauguaggagguguaugugaugcacuguggaggucaguguauagaaaaccgcugugaaguuaaccugccaguucccauagaacuaggaaaacuguuuacguuuucauucuuuagcgaauucagaaauuucugguuaacaggguucuuuuuaauugguaguauuggguuaccaaaacauaauauucuaauuuuguuuccuuuuuuuuuuuuuauucuggaaggaaaauuucauaucacugggagacuaugcuuaauuuuaaauaguuuuuaagacuuuuaaaaaacugauauguuaacucaagugccaacuucaucuuguuuucaagugacuuugaggagcuguuugccucuuucuuucauagccugugucuuccauugaccuucuagacacagaccaugucuccuuaacuccauuuaaaaaaacucugugcccugcacucuggaggccagaagcagguggaucucugugaguucaaggccagccugguuuacagagcaagauguuauacagagaaauccugucuugaaaaaucuaaaacaacaaacaaaaacuguaaauaaaacaaaaucauguaaguugccagcgugcguggguuuuguuccucgauuccauggcaaggacuuugauucuagaaaugccucgguuacucucagccaccacgaaggccugaaguuauuaagcaauagucgacaggcucauuugucuugaguuuaauuuguaguuuuuaaaagaaugccuggaacuuuucgugucaugucuucugagguccccaugucccuugaugcuguugaaaugguugcgucccauauucucauggcccccagccagcuagauaagagcuaugcuccuguucuggguuuuccugguggguaacucagugaucaggcagcugcacucauagccgacuuacugaucauuagugacugaucacucagcucuguuuccuaggucacaccgaacuguaugguuguucuagccugguaagaaaacaaauaacuuuacugagagacacagcacuuuccacaaagucuacucauuuaaaucucacaguucauuguuuuuugacaccucugguuuuuuauuuuuuuaauuuuugaaagacuuauuuauuauuauaugucuucagacaucccagaagaggacauuagaacucuuuaugggugguugugagccaccaugacguugcugggaauugaacucaggacaucuggaagagcagucagugcucuuaaccacugagccauuucuccaacccauuauuauuuuuugaaaaacaaguuuuaaaguuacauuuauguacaaauaaccaagcagcguacauuuaacugacucuaguggugaguucuuuggccacugccuuuuccaguugggcaagcgagucagauuuugaacccaggauguugccccacugguggccgcagaucucaucuuaucugcccuuuuaacugacccagaggacuuccaccaucuuaagccuuugucuucugaguuagcugugugguacaugucuucugugggccagccuggccuucucauuggugaugcaguagggaauccuauauugugacacagggcaggaagcaagacccccuccagcuugaucaaguccccaucaccugugaugaccacaagucaguccuuguucuccaucaagguagugaccauauugaccccugcuugaaggacagacggucuuguaguggaggugaccacuuugccaacaguuuucuuaucagcauaggccggcaggcagccuuugcugcucucugcggucuucucuggcauguauuaguggucagacuuaaguagcuaggugcuguuugacggugcagggccugggagaacuuggauaauggaaggaggaggcacuuggagccacuuacagaggauagauagugccuugccacugcagcuggaugccuuggggccguuucacaaagccucugagguuccuuuaggguuggaugucuuguacaacacugaaguucucaaacugaacauugaccaguuuuuuuggcuuccuguuucuucacagcaggguugggggcuggggccaccuucuucccuuggcuugguuucuuuaucuuguuccacugaaggagagaguggguucccaaagauuuuaaagucguacuuccuaucccauucccaaggaucucuaugucauuuacaguucaucuuaguuccguaucccugcaaccguuaccuuacuuucugucugugcaaaacugccuuuucuggucauuuuacauacacggguucaugaauguaauguugugguuucuuggguccaguuucuucacucagauaguuuuugagguucuauuaugggcuguguaguucugucgaccuuaccaccaaauagcaguuucuguguggguaaacaggcuguuugcaguguuuugcucaguuaggaauaugguuauaauaacauuucuuugaggacauguuuuacuuuuuucuuaguuauguguuuagggguggaguuuauggcuucugugauaguuucaugcuuguuuuuagauuuuguguguguguguguguacguacaccauaguguuuaggcagcaaucagaggguggcuuagcgauuugguucuucgcuucuuccucuauguguagucuagagcuggaacucauagugccaggauugcuuugcaucuucauccugugaaucauuguaauaagcauaugcuuaccuuuucuuuuaaaaaacaaucuuuuugagaaaauacuaagauggcguuccaauuauuuguccauucuagccuaagucuaagagaucagauuuuaguaacuuuugggaaguuauuugccaucuuuauagcuguggggguggagaaaggaaaagcucugagaugucacugagucuugguugguuguuaggcagugcauccuggcgcuguuggugggcaccgcuagucccggcacucuggaggugagacaggcagucccucaaggcuacagagaaaaacaaaaaaacaagaaaaaaaccaaaaauguauuauucuuaauuuauaugacuuaacaccacagcaaccauuuuguauagaaaauucuuuuuguuuguuuguuuauuuguuuguuugguuuugguuuuuugagacaggguuucucuguauagcccuggcuguccuggaacucacuuuguagaccaggcuggccucgaacucagaaauccgauugccucugccucccgagugcugggauuaaaggcgugcaccaaccccccagcccuccccccccccccguuuuguuuuguuuuguuuuuuggagacauggucuuuguaugguccugacucuccuggaacuugcuauuguagaccaagauccaccaaccucuaccucgcaacacauuggccaccaugccugcuuuguaauucuuuuuuuuuuaaauaaaugauuuaauuuuaucucuacgagaguuugccuucauguagguauguccaccuuguggaugugauggccccugggacuggaguuacaauugugagcugccaugugcuggcaauagaaccuguguucucuacaggaucuuaaccucagagccaucucuccagacccucuuccuuguacgucuuagauuguuuguuugagggcuaggguuugaccuaagguuuccuacauacugaauaugcguucuagcauugaacaguuuaucucacaaguuuaacaacaccuggugcaggaacauuguuuucuucuuuuauugcuauuauauuuaucauuauuuuaauuagauggggcaaguaauggcuuuauuuugcuuaauugauugauguaugcaugcaaacacacuaauaaauuuugaaaaguuugaugagggcuuuuugguuuuucaagacagaguuucucuguguagcucuggcuguccuggaacucacucuguagaccaggcuggccucgaacucagaaaucugccugccucugccuccgagugcugggauuaaaggcgugcgcuaccacugccuggcgaugagggcauuuuuuuuuuuuuuuuaucauuugggagccaucaaauaagggaugugauaagaucuagaagacuuggcuuagugacagcaggaagugaucaagguuagauagucagaggucagucaggcuggccaguuaguagaaaguuuaaggcuacccuccugcccaucuggaggacugucgugggaccuggggugaaagguagccucccucugcgaacaggucgccaugagguuacagguuauaauuuuauguuaccuaaucaaagcacacaaaggagcuucgagggagaugggccaugaggagcagaguguuagacucccccucaguguuucagaaagaagcagguacauguugcaaguagcuuuuccucugcuucugugacuuccugaaaggaugcaauccuaagaaacuguagcagggacugugagcuccgccccucuggcuguggggaguggcugcagaagccuguucaucucccugugcgucugccccgcagucacauuuuggugaccuuuuguuguguagucuaugacuuuuuaaaauuagcacuuccugagcauauaacaauaauguguuuccauuaucuuuaaauagcagaauuagaaacauuguauaacaugccuuuuuaagggaaauauguuuaugagaaaacaggaagucuuaucuguuguuuugaaguggucugagagcugacuuaaauggcucagaccacuaauggguuuucuacucuccuuggauccugaguucuccgauaucgacaagauggcuuuuaaaaaaaccucuuuuacauguuuuguauguacuaugugugugugcagugcuuacagaagccacaagagggcacuggaucccugaaauaggagauacugacuguggugagcaccaugugggagcugggaaucaaacuggaguccuggaagaacagucaguguuuucaauugcuaagccaucaaucuagcccuuugaugaauguuucugguguguagauaccaguaccaggccuuccuucccuuuaaacuugccauccuccugucucucaaccuucugugugcugaggcuaaugauaauguguuauuauccugguuugugucuuccaagugaccugguggauaguguuguuaucuuugagguuguguuuuucaugugugcuuuaucuugguuuacaggcugagggacaguuccacaaaccaacauucugcaccucucuccaaaguacccauucuuucugucugacagacaguaucaaauucugaacagugguugucugacaguauaacaggaugagcauuugucauuaguguuagucuuugcugagaauucuuugaguugaaauuaaaaaaaaaaaucguucauuuuauguguucuccgcauuuuggcugcagacacauguaguguguauacccgauacccaggaugauaaggacagggcaccagaucucuaguuacagaugguuguggguuguuguaugggugcuaggaauggaaaccugguccccugcaugagcaacaggugcaauuaacagcugagccccuaguuggagaauucucgugagcuuugcugugcaucuucccagaugaccuugagugcccugucaggaaacuuguggucuuuuaauaggaugcuuuccuugcaaauuuggaaagccucauccuguuuuccagaacauuacagcuuaagucaggguugccaugacccuuguagcuuuucaugagacggaaaaggugauucccagcgguuccugaaucacucugcaggcaccauccgucuguaguggaggggagguccuguuugccucaguuucccccagagaguaguagaaaugugccuuggcucuugccauuggcaaagguugcgcuaacagucugaccaaaugucacuggugauuuaaauaugacuuuaggcagaagagcagaucaucuuguggcucugaguaucaucucccuuuacuccagccuuucuucucugucucuuuuucuccugacagggucucccucagaauugcuugcuguuuucaacuaggcugacugccugcaauccugucucccccuccucccuuccugugcugggguuauaggcacucacagcggggccuggcauuuuucuaugggugcuggggauuugaacucagaucccuguguucuuccucacugagccgccucuccagccugaagaaaaaaaaaaaagaucuuagggguaauuugucauggugaauuuugacacuuugaaaggcaggacuuggaugaagucucucgauggcagauaggacgugaacuagagaaauagagcuguaauuccaccucuuucuaaaggccgagcacacuggguggguagacacgugugugaguguauguaugugugaaggaauguguguguguguuggcuggaacuuccagaaaaaacucuuugaaauaagaaggaaaugcaauucugaugguuucuuugagguuucuuuagaggaacuaaaguagaaggugaaaaaauagagcuuaaaagcaggagagauuuuuccuuccuuccuucccccccccccccccccaucaggcuggccucagaacucagaaauccgccugccucugccucccaaguccuguagaggaaggaauucaugguuuucagacacagaaugggacaggguaacaugggaagugaggucaggcucuguucuagaguguuuguuucccaggggagcuaugugcagacacaaagccaugcauagugacccuugaaaucacgaggccaaggcuagccugggguacacagcagcauccuccaaacccaagcuagagcaaacauuuaaaggcuuuuagguaagggcugcagucugcaugcugaucacagacacacaacacaacacaaccacacacggccaacacucauuuugcaaguugugggcugcuguuuuucuuuccuuguauagagucacuguaaaucugguggauacacuugggcuuccagacggcuucguucuaguaaaaccugaaaugaauugcaagcugggucugcugugagagcaucauacaagagagacuucauacaaguccugccuuucaaagugucacuugguugcaccucaacugugguagauucagucagccucagacaguuauccuggugguuuauguaaaacuuucaaacacuuagaaaaguugagugaauuccacaagauaaaguccuguugcauacagauuaugacagcgugcuuuuacagugaauuaauaaugucuuggucauaguagcauacaaugaauauacuucauuuuuuauuauuguucgagucauguaugccauauaccuuuuuccuaaauaucuuggcauauaaaucauuaacugaaguugagucauauaguuuucuuuuccuuccuaaaauauucaaagaggcacaaagcucaaaaugugcgggaguguacugacaggacaaagaacuguuuucagcaucuuuuuugguaugugggugagagggugauuuaaacauggaguaacccuguauauacccgcuguucuguuuuuuaaagcaauaaagugauugaggcguggauugagguagauuaaacuugggaggcagaggcuggcagaucuuugaguuggggcguugccaaaagaacauaguccuugucucaaauaucaguguacaacaaaauaaguauaaacaacgugaguggcuuuauauguucuucauaaugggccccacccgucuaucauuuauccauccauccaucauccauccacccacccacccacucagccuccuacccauccaucuacgcaucccccauccauuuggucauugguugaagauccuguguguggauucugaggucacauguucuuuaccugacuucuuucuaacugggaauucucaugcauuuuuauuuggucacugguauuuuucaaucuagagaaacauucagcauguaguggaauuuacaaagaauauauuuguuuuuguguguaugagugcuuuggcugcauguaugucuggacaccaugugccucacuggagccugagggaaccagaagggcgucaaguuccaugugucuguggcacuuggaauccucuggaagaacagccagugcucucagccacugaaccguucaguuccccaacccuacguuacuggguuuuuuuugacugccuuaggauuuagugaacauaguucuaacacuuauuucccaugacucacaacuaaaacuccugugcuagagguauagaaaacaugagaguaucacuccaaacuccauuauuauuauuguuguugcugugguuaucauuuuucuuuuuggaguaacucuucuccagagaagucacugacaauagagcuccuaucuaauacucagaacagcaaauacacaugaaauguuccuucaagaauggauuaauugcugggccucuuagcacuugugguaggaggauugagaguuugaggcugcggggaccagcgacaagaguguggcucagugguggaucuguugcccagacugugcaaagcauuggguucagagcuugguaaagaaaaacaagaauuuuugcaauaaaagggaggaugacugagcuaugugcauauuauugccaggguuguguuaccgaagccguggcaggcaggcaagcagagccccaucgaaggagaggagggaccgguggaugccaucauucggcauagguugggccuuugauuucugagcucagggcuuuuuuucagagccuucccuuugggccaugaugagauaacugugggagugacuaggugucuuuccaggauaucugggaauggaucucuagauaaccaggggccccacgcugaaguugggcaaguuguaauuugucgggcagguuaucugacagcucuuagccaucucuucuggguagaauguuccauaacuacuuauccgguucucacaacuucacugugagggagcaguugaauuucugacucucagggcugagaggaagcaggggucuccccagggcugacgaggguagugcugaugcugacacugagggauggaaggagguuuaaagaggaagaaggagauggcauggcgugagcauuagaagcccgcucuacaucuguuagguuuaauucugugacuuugguuaucugugacucugaacacugccccuuaugguuuuucaaaucuagugguacugucccaccagacaguuuuggaacaagauuucugaccagacagcaggcaguugucuugauucuucauaugcuccagaaaccgcuguuguuugcuggagcccugagucugaaggauuugaggauucccugggcccugccgguuucagucacagaucugcuuuccuaggcucuccgccucuuccuccugccccguucaauuauuucaccuuaucauagaggauuuuaguaaauucauuguccuacuuaaggcucagccagagccagucacugggguggcuuuauauucauguguccucuugcuuccucuguugagaguuaacagguaaacacaggguggggaaagcuguguccugccauaacguggugagagacgccugaggccagccuggcaucuuucccagcacacagcccugccuugcuuaucuuuggggauaaggggggcagaggaagacauuuaggugagauagccaauaagcugggagauuuauggccuuuucccuucaugucaggaaaguggauaaugagaaguuaaugcuacuacaagacagaauauuccagagaaaauuauuuccaaagcaguauguacuuuuuaaaaaugaaaagucuuaaagugaacuuaaaaaaaaaaaaagagcuggagagguguucagcauuuuacuggcacaggcugcucuuccauaggggucuuucuucauucucagcacacaugaagacuaagucuaguuccaggagagcugacacccucuccuggccugugcgggcauugcauguucauggugcacauacauacauacauacauacguuaguccaaauacacauacacaaaaaauacguacaucuuuaaaaucauuugaaggagggcacuguagcaggguuugcaagcaagccuuuguauaaugcugucuguuccugagaggagcucugagccuuucauauagccccaggugccuguuuagcauuggagaaaagggccuuuagagcacucauugguaacacguugucaucugaggccccuguuaacuuucuuuuuaauucugacuuccaccuguccgcaugguuccuucccagcacaguucucuguaugugcagucacuuuaggucauugcuuguggcuggagaagauuguaggcccuuguugcuggguugcugcucugggauauaauuagggcguccuugcagacuggguguuuguaagaaacugucauccccacaaauuaucagggcuucuuucaaucccugagaaaugcgaguuggggguugggaugagauagguacaaacagucccgagugacugaucacuccucacggggcuugcugcaggggucacggggucccuucccugccugaagacuaaugcucaucuuucaagacccaguucagaugucugcacacugcacuaaguuauuugggcuccucgggacuucuucugagguccuuccuccucauucugcaacauuguaacuaaccuccugaacagcacuuuuucuccuaggacuacaucucuuccuuugugugucucgguaggguguagaaucuuauuuccuuaggucuggcacauaaaaaagucuguauuuccuggaaauaaguggauuuucuguuggucucccugaggcuuaaguguuaaaagcacaggaaacuauagaccaacuuauuuaugggcuugaauaaguuuaagugauaugaauaauauucaagaugccuuuguauuggaagacaaguauuuuauaguugccuaaaaugaauuaguuuugcaucuuugcuuuuucuuaauuuaugacagaucugugcgcuucugcuuuuugagggaggugagaugugacuguuaacacccucuccaggguuuaggcucuuaagaauccuuaagugugccucuucuaguucugagcuuucagauaguaguuucucagugacaaagguaggaugcuuugucgagauuaauaaauacccauugugcauaugcaagugaacagcccacugcuuguacuuggggaaggaugauauauucugcauguaaauguugauguuugggcuaaaguccagcccaaggaaucccagcaagcuguguaaagcucacagcaccacauagcagagguuaaaugaagggagacugcuccaggaaaacaguaacucacuguuuagcuuuaaggagaugccaauuacagcggguggugggaggugaucgggguuaggaugaaaaugagaauauuuagaaacauguaaucguugcuguggccauaggaagcaccagugcaugcuuccagcuuucuccuggaagaguguugcucuuccuccuacuuggacugagaagaaauagacuggcucugcuauuuacaacagugaacuuucugugagaacaaguguggcgugggcaauuagauuuccaaagggggaggagguaaauacagucaggaugcccaggguccuguaaaaugucuuuauggacaauuaguucucaaauuuagauuuuuaaagggagagguaaauacagucaggaugcagaggaaaagaaaugccgaagguuccuauaaaacaucuuuauggacaauuaguucuuguuuguuuucugcuuuguauaauaugcaaauaagaugagcgcccugugcuuugucacuguguuugcccagagucugauuuaaagcaaggcaaagcaaagcaaagcaaaacaaaaccaacagcaacaaaggaaaacuuaaaaguuucucuuuuuaguguguuuguaccuacccacagcagucuguuuaacucugaaaauucaguugacccuggucucugcuggaagagcuuguguuguugagggggacggaggaccccaguuuucugccccugacugaauuuuuuugaguacaaugggagcccugucacuuuuuguugcugcuguugcugcugcugcugcucagucagcaauggaaagcuguuuuggugggucucugcaagcugauaaugauacuguguuccuucacguuuuauccuuggggacgcagagaaacaaauuguagcucaaccguuuccaugccaccccauuguucccccacuguuaucgauacacagacccugcuuuuccuuucauuuuccaagagccagucuuuccuguugcuuccugcugcuggguagcaaagccucagggcugagccuuugucccagcugaggcugugcuaguaagcuggcuucacuucacacagucuccuuauuggacgagaugcaauggguuuucuggaaugugugcuggaaguucauuuuuugggagggacucuuccuuuggauugccaauuccuguguguucagugcugauguacaggagggacugccuucugcuugcuguuaauguuuguaguuaucuggaacuaacuaucaagugauaguuuuaaaaauacuuaggcuuggcaguaucccagaggcaaucagagcucugugaguucaaggccagccugguguauauaaggaguucaaggccaggauggacuguaucaagugaccgugucucaaaaacaaaacaaaacaaaaccaaaaaauacccccgcuuaauguuuagcauguuuaauuuuucuuauggacuauagagcuauuuuuaaaacaacaauaacacuaacuugcuucugaaugaugucuugugaggaaaaauguucaucuggucacccagucacuaucuaguucagaguugaaugauuuugaaucauuugaaugaauuugggaauacauuuguuuguuuguuuguuuguuuguuuucuuuuuuccuguuugguacuugaauaucagccgaugcauuaaacaguacaagaaugguuuacuacugccuguuuuaucaaaauuaugucgugaaagugcaucuuuucaaaauagauguguuguguucauggaagcgaacucauuuucaaccaagcacagagcagguuuguggcaguuugcccuccccggugucuggguagccuagggaguuagagcuggauugagaauuacaggauccccgaguagauaaggugaccguggauaaguuaucuuuggauaguaacugaaagagaugaagcauggugcagagcuagagagccucuugugaggugagccacaugcaguucuagaccgugagauagcagugagaaagaagagagacagccccaggcccaggcccaggcccaguguccauuuagcccuaaacauaacauucaucugucuuucuaucaguuugcuguccguccauccauccaucuaucuauccaucauguauaguguguaggucuacacaugccacaugccacagcaccaaauggaggucugaggagaggucacagggaucucuccuccaaccgacaugugacuucccaggguccucaugucugacaaguguccuuuugugcagaucacucucucuaccccagcauaacacauaaacauuauccccagucuguugauuuaaaaauaaguauauauuugcuaucauaucuuacccaaacaucuuuucccccuuccccucucuguccagcacaguuuuaugaugaauucacgguugugguaaaguaagcugcuaacuuccucccaguguucccugagcacauggaguuaguuacucagcggcucuccuggagccucugggaagggaugaugucagcauccuugaggcuuugagucauuucaugggcagaacgaucugcuggcaagauccauuuuagguaucagacagugaaucacgguuugucaucuuccagagcggcagaauucuacagaauucuuaguggcugacgggugucugcauauaaucacuucagucagaucugaugggguaaguggcacuugggugagcacagugcuaggaauggcucccucaggagggaucuguguccuccaagagcuucuaggauaagaagacaacccuaggcacgucuagagucugucuagauuagauagcuguccacacaacgggaauguagccugauaaugacaauggagagagcuuagacuugagcucuccugccuccuggcucuugagcacugcuuggagaggugacgugaggauccgggagacugggugcucagauucucacaggaggucauguuugcugccaccgcccucccucugcagcugcaaacccuguaggaggcuugggccugggugggugggugugggggugaugaauaagaucagauuuaggaguuuaaaagaucugggaggcagcucuucggagguggagagcccaggagagcagcugguuggcucuacaccccagugccgaaguacauacaguaccucacuugcauaucggguucagcguuccagcguuauuaacuugcuucuccagagaugaaaagcgaugaacuaaaugcaguaaguguuuaaaaauaauagacccaaaggucgcgugccuacauucuucugucuuagcugugaccacaggccagacucuuuuuucagcucaugacuguaaggaggccaaguuuagccagccucauugucuucuaggccugugauacugugcccuucaugcgcaauugaguagugcggagaaugauauagucacguggcgccaggguucugguuguuccugggaagccaacggugcuguccaccccuaagugaaugaacaaugucauuuugauggagaaagggaguguuaggagggcaggggcagauuuuccuuccuuccuuucuuccuuccuuccuuccuuccuuccuuccuuccuuccuucuuuuuguuguuauugagauaggguuucacugugugucccuugcuguccuggaacuccuuagacaaggcuggccucuggaacucagagauccaccugccucugauggaaucaaaggcaugugccaagaccgcuuaguucaagauggcagguuuuuaaucuucaagggaggggguguucuuuguaaugucucuaaaguuugcagcagguagagaaauauuauggggcaacccaucacagagacagaauuuucuguaacuuuucaguuccauuaaucuguucacauuucacauaacaauaaaaagcauuuuauuaaccucuagcuacagauugccaagccugugaggcgagaaguuaccuccuuucacugguguggcuucugcaauuguucuuauuugcaugguagucuuccuuguguguguguguguguguguguguguguccacgcgcgcgugugcgugauuuauuuaucuuccucuauguguaugggugcaugucaggugccuacagaggucagaagaaggcacugaguagcuuccuagaacugaagugucagauguugugaacugccauguaggugcugggaacuaaaccuuggucuucugcguugggcauucucaauugcugagccaucucucuagcccuaauauacauacauacauacauauuacaaguuauauguuauauauuauauauuaauuaugugucuggguguuuugccugcauguaucccugugcaccuugugugugcccagugucaagggaagcaaagguauuccuuggaacuagaguuacagccuguuaaugcagugcuuuuaauugcuuggccauugcuccagcccuguucucuaucccaucccccuuuauugauauguguggaaggcuuugucugcuguguauuggaacaccuagccuuucuucuaucugugucucucguuucugcuggguagugcaucaccauaagccagcuuaacaaaaaggcgggugauuaggcuucucuaccuguagauuaauaagaucuucccucuaaauauaucugcauguauuccaaggagaaacggucagugugucauaaaacaccagcccuggcacuuggacuuuggaucguguuuuucucuguuuuacugcaggcugugagcuuuugcuucuucauacacagggaucuagaauuacaguuuggggcugaucuacuguuuagagcuuugcaaaauaaugaucacaauauuucuuuacuccauuuuguuuugcccugugugugugugugugugugugugugugugagagagagagagagagagagagagagagagagagagacuccgcuaaaauaguauaugaauaucuuuuuugugaagcaaauguuccaacaaaacuguuuuugaaccugagucucuugguaguccugguuccucuagagcuugcuccgcagaccaggcuagccuggccucacagagaucugccugccuuugccucccaagugaagauauugaagcugugcacuaccaugccaggcacagagcugaauauacacagaaugcuccaggaaccacauugucacucaaccacgucacccuagucuccugggaaaccuaacagaguguaaaguguguuagaaccuauguagaaguaugugccagguucuucugcaaggugaauuaacaugguguuuccuuagagccgguaucagucuaaaacuuguaacaugcaucucagguaugcaaacugccucagaauggaaaaagagacuuuaugaugcguaacaagaauuuaaauuucuuuaucgaguguaguuacucucagaggagagugaguggccaggagguucccugagcaguguuuucaaggcugauuuaaauugugugaaggugggugugggguccuaacacagaugaucagccccaggaauacagcugauagaaucauuguugucuucuggaggggcccccgauugcuuuuuuaagugucaguuugaguguuugggggaccaaguccccccccccccccccccccgauucagcuuguuguuuguaguguguuuuagguuaagggagcaguauuaagaauggaaguuuuagcugagugauuuuuauuaugagaaagccucuugcacauucuuuucauacacauggaacuggggggggggaguagucucuuguguuuggaaacauuuauuuuugucuccaaaacacggagcuguccucuguaagcaacauugggagagauacaguuuaauggcaaacuaauguaauuuuaaaaugcagugacaguuuuuccuaaagccaauguguuaaaaaaaaaaaaaagaaaaagaaagaaagaaagaaagaaaaaguucccaagcuuuuggaauggaaacaaaggacagaagacaaauguaagccaggcagaaccguuuccagugcucuaaagucacgugacagaagccgccgaucccguuccuucacuucuauccacuugugacacagggacccuauuucguaaggcaagguggcuggaagccgugagucuuauaaguuguuuuguauggucagggcaggacggcaaagagcuaaaucagugagucagaacccaguggguugauuucuuucuccuucucuggcuacaaggagagacgcgugaaagaagauacuccucccccguacucuccaaaggagaguuaaaacuuugagcauuaauucuagagggagcuggugacaucuuugagagaaaggcauacacggagugagcagucaggggugauaaauggguagucagcuguucacaggcagccccgugggcccuggguugccaugggagcaugaauggcauucagcauuccugauugacuaaccuaguuuagugacaaggcuugugagcucugagcucuggccuggcagaaggcucuucagguggaccuuaccacagcacgcugcaccaugucuccagcccagcuugggccuuuguguggcuugaggccuuccucaucucucccccccuccccccagccucuuugacuccuucccucauuagugguaaggaagaagaagagaggacccccgcccccaugccuacagaguuggguuuucucaguacuuuaacuccucggugacacauuccaucccccaaggagaagccuuugaguaaaugcacccugacaggcccagcauggggcugacuuaaucaccguacucugaagaggugaggaauuggagcugaauuuuucagcauuuucaccaccucucugaaagucagcacacccuguguguuuuagguuuccagagguucguucggauuuuuuuuuuuuuuuaaauuuuuacccguuuuguguggggaguucugucagugagagugucggcuggcuuguguuuauucugcaaugcaguguucugugcguuggagcauaagugcucucucucucaaggguccuggcagcgccugacuuacacuugucuucugcccuuguuucugucccuagcacccaauagcuuggaaacuuuucacauauugguuuuaugaaaaaugucgacacguuaaacuguaucuguccagauguugauuaaauaaacucagggcagcucaagguucugaagacucaauuuugucuuuauuuguuucccuccacccccacccugccccaaaacauucuaugucccccuuucucaaccaugagucugugaucaucaauaccaaggcaaaaguagccuccuugcccuuuacagucagcaggagcaagggucaugaacuuugccuguauucuggaggcaggggggacuuguagauauccuuguagauauccuuguguucuguugacucuccaggaugcagagcauccugaugccagacugugguugcugaguguuaucccugucuguggaugucuuuaguguaugagacaugacuugugagugcagagguuacugugggaucagugacccccaaguguguaaaaucuaacaaggaucuaaagaaggauuguaugcagcucaguguuuagaaaacggaagagcaagcgccuguugaggccccucucaaggagcuuccuguaagggcuuuguggaaucagccgaaccagucaugcguucugugguuccgagauuguucugcugguagggauaauaccuggguugccgugcaccuccucgaaacgaaggaauuaagagugauuaacagcuagcacaccuuagucaucacugcccuguguaacucagcccagcgacugggagcguaaggcugcaucacuaaccaagcuuggauuuccagggcuuugugagacagucagucagucauugagccucuuuuuuuuuuuuuuuuuuuuuuuucccaaauuggaaaaugggucuuuaaagaaauucuacuuugucaggucugauugaaaacgagagagagaaagagagagagagagagagagagagagagagagagagagagagauugagaccgugcgaaagaaccagugaggcacucaggacagugcugacugaggaacaugguggccgggacagcugguccucuguaaggucauuacccuguuuccauggggcccuccugggcucuguaaucugccuugacaaggccuuugcccuacucuuaaacacccaggaggguguguuaauucagagugccguugccccccagcaaggcguuuuggauaucagugugguguuacccugaguguucaagagugugaaaaucuguugcuucucccaggggagguaguugccuuuaauuaaagcuguaguuaacuuguaauuauuuagcaguaauuacagagugagaaucaauaagaccuuugcuggcuucaggcuugggggggggauccccucauuucgaaguucauccaggcucuugacauggcuuagcagguaaggugauucaaaccagaguuugauucccagagaccagaucacacaugaugcccccauaucauagugugcgcucguggaacggucaggcucugcaaagcucugccccgcaugugugcuguaacugugugccccccccacaaugugcacaucugagugccugucuuuuccuaucuugcccagugcuuggauuaaagcagcccgcuccaucuacccugcagauggugccacugcuuugcuuugacauuuaccuugcucuagauuucaaaaggacuaagaaacaauuucuggguugugguggugguggggauguauugccuagggccuucucagcaagaacacuucagcuacuacagauuuguagugagugaacuuggagccugcccgguggguguaguugacaaaugccuguaaguacacagaaccaaaaggcaccugggaauugguugcuuagcccucugcugugguaaaagagaccacagacaauagaugagucucccagucuagaccaggacucaccagacagcaacagccacaggugucucuuccagcgacagucaguuacaguuacuggaaguuuguaagacugucccaguauuacauguauuugccaauaaaaguucaguaugaauuucuuauuacuuuuaauguauuuuaggaccagguuucucaguguagcugcccuggaauucagagaucuccuuaucccugccuccuaagugcugggauuaaaggcgugcaccaccauaccugguccucugauuaauuauccaguuccuaauuuaauacaguuuuuuuuccugugggaggcucucuaguuugagucuuaucugccugggcuuucgugguuacuucuggaguccuucucauuagugcaggcugaaaagccuuaggagaguguagacuccugacuggugcugaucuggccuuagggauacugggaccuuacacaggauuacuuugcuuaaaagauacuugagugugcaauugauguggaaauuaaaggaucaaacagccuguugguugcagggcuaccacucacagcccuggcuuuacuacucaaaggucuccucuuucugagucaggcaggggcuguucacagugggacugagcucuggauuuugggauggagagguguggagacagguucucauugugcagcccugacuagccuaugccugcagccuuccguuuugucuuucacacucuuggcaucagcaaggucuaguuguuguuguuuuuucuuugcuuuuuuuuuuuuuuuuuuuuuuuuuuuuuuuuugucuugugugcuuuuaagauacggucuguauguguagcccuggcuguccuggaacucugugucagagcacucaggccucaaacucacaaaggucaaggcuagaguguuuaaaaacaauggggagggguguucuuagcagauccccagaaguagaucugugaaguacccccaccccauguauguauaauuucuuuauuuccauuuucacuguagaucacagcggagggucuguagggagcagguuagguuacaggccuguaaccugugcaggccuggcuggggcugaaagcggcuuuuuucuggaacuagucucugguuugccuaucaauuuuaacuaguuugacaccacagccaacgauguaggauacaucauuguaaauuggauugugugguacuccugguauauagaacugacuucuagaauuggauuguucauccuuuauucgugaaaugugaaauaaguaaaaaaccaacuuuccaaguuuuuaugcuaagguauccugaguggggaaugaacuaagugguguuuuggguguuuggugaccuuuuggcuuuugucuguagacgaggauugucuugaacacauggccaucuuccuguuucugccucaguugcuggaucccuggugucaaccucuggcccagugugauuugcauuucccacccacuuuuccucucccuuuuuuauuuuggaaagugugugugugugcaugugugagcucccaugugugugucugugcaagcacacacacauacacauacacacaugcauguacucgugcccgcccaauaggccagaaaagguguuagauuuggagcuagacuugcaggugugagcugugagcugccggacaauaugcccugggcugggaacucaggcccuaugcaagagcagcaugcacccucgcugcugauuccagugcaccuucuguaauuacaccccugccgguacuucuucccggccacuucuugcuuccucccacacucguguuuguguguguacaaccaaacuuggauacugaugaccuuuuuuucuuuuguggccuuggaaaaaagcuuguacaaugaagauagaaaccugcuucgaaucagagagaaggaaagacgcaaccaagaagcucaccaggagaaggaggcauuucccgagaaggcuccccuguuuccagagccuuacaagguacuuauagugugugugagagaagacggucuggccuguuaaaauauuaaacccggugauaaaaucauuccaugcaacugaguucagucaggggucacgagugagaaaauaacuuauuccagagguuguuuuugaaaacaaaaucugaaaacucuuugaacacuguuagucagaauuaccaaaguguguggcuuucuuuuguaauguuagccuucgguaauguguguccauggccugcccucagcaggggaaguggguuaacauugcguuccauauuaaguugaggggguuuuuccucacugacguuacauaauaacuuauuaauuauucaaauaauguaaauauaaucauaucaacuuauuauugcucugcuuagauuuguugccgagucugcugucucuguuuuuuuagacugcaaaaggcgaugagcuaucaagucggauccagaccaugcugggugacuaugaggagaugaaggaguuccugagcagcaagucccacccccaccgccuggauggcucugaagacaggcccgggaagcccagauaucccuuaggucaugacagggggaacggggcugcauccagcucccuccgcacacaugucuaccaccagccuauccacacuucugcucccggaucacguccugucgguaacauuagccacaguccaaagauggcacagccaaggauggagccaagucuccacaccaaaaucuaugauggcccacgucugacucaagaccaccucagucagggacauuguuccagaaagugugaccgaagagcugaaggagacucugcucccgagaggaagcucucgcccuugaucuccucuuugccauccccggugcccccucuaucaccuguacauuccaggcugcagggaaccagcaaggcucacagcaguggcguuagcaguaaaagcugcuguguggccaagucuuccaaggacuugguggcgaaggcccaagauaaagagacuccucaugacgguuugguggcaguuaccagccuuggaucagccccuccucagccaccuugccagacauuuccacccccuccucuccccucaaaaagugcugcaaugcagcagaagcccacggcauauguccgucccauggacggucaggaucaggcucccagugagucccccgagcugaagcugccacuggaggacuauggucagcaaagcuuugagaaaccagaccuuaaagugccugccaaagccaagcucaccagacuaaggaugcccucucagucgguggagguaagugggauuucgugaggguuuuuuucucuuuuccuuuuuaauguauauuguguguaugccugcccauccuguguaugcauggccagaagagggcguuuauccucuaaaacuagacuuacacauuguuguaacuguguagaugcuaagaauuaagcccaacuccucuggaaaaucagccagcucucaaggcucuuuguuuuuucaagacaggguuucucucuguagccuuggcuguccuggaccucucacucuguauaccaggcuaaccuugaacucaccugccucugccuccugagugcugggauuaaaggcguguaccacuauuagccagcuucccuaaucuugacauuuagagaaauuacuaccaauuucaaauuuuagugauaguuugugaaccccaauucuucccccacacacaaggcuaucauuaauugucacaggaguagaagaguuuuucucuugaucuaaagaaguaugcauauaaacagacugagcaggaauuugcacacacacauacccacagugauuaaaaagauuggcaguacucacauauguacacaugugcauucuugagcacacauacaacacuuuggagggguuacuaguucauuggaagugauguuuguuggggggcgggguccucucaccuuauuguuaaguguagacaguaauuauccugaacccucccaccucggacuuccaguuagccaggccugaauuuagacuauaaauuuaauuuaauuuagaagugaaucuaaugcuuacuuaucucuguagagggaguuucuguuugcauagacauucuaauuugcucaaaggucaccaaguuacaguuuuauguaaugucuggaaaauaacauuuuaucuuauuggugucuguaugggaugggauaugugcaugccugugugcauguaugugugcauaugcauguggggaguaggggugcaaugagagaugguguguaggggugcaagucccuaccuguauugcgugugagaaagccugagguugacaccccaggccuuccuuaauccuguccaccccauguaucaaggggcagcggaucacugagccccguccucaccaucccgcuaagcugccucuagagcauuuggaucaccagggagcagcuagcuuagccccccccccccccccccaggauccaggcucugcuucuaugagcacuaaugcugcuaaccuaucuuuccaaaucccuucuuguaacacuucccuuccuggagaggaagccaggcaccaugggcucccaccuccagucccagcagaggcaggucgaucucugaaugugaggucagucuggucuacagaguuucaggccagccagggcuacgcagagacuccuguugacuuuucuuuuuuauaagaagagacuuugggccccuagcucgaagauccaaguauccccucaggaccagaaagagaagccugauccuuuuaggcacuguccgcuuugguuauuuauuauuuauuuauuuuugugugugguuuuuuuuuuuuuguuuuuguuuugucuuuuugguuuuuuuuuuuuugaaacaggguuucucuguguagcccuggcuguccuggaacucacucuguagaccagguggccucgaacucagaaauccgccugucucugccucccaaguucugggauuaaaggcgugcaacaccaccgccuggccgcuuugguuuuugaaucaacacguuggcuucauuacucaguucucaaacaaugagugcauuugagaauagcuagcauuugcuuguggucugagggagagccaaucagaagauagaacugacccacggaggcagagcuugcuggaccugugauuucagcugguggagauuucugcacacuucguucugcaccgugcagaacaaagcaggguucuuaucucaggcuuguuuuaaccccacuucagacucuuccuuuuacuaauguuuuuacguucaucagggucacuggcuggaguugguucucuucuucuuccaccguguggaauggaaaucggcuugguuugucagucuugguagcagucuccucuacccacugguccaacucauuggcccuuaaccaccuucuuaagacugaguuuaaaucugaagucuaaccagucccacugacuacacaucuaaacacuugcucaagucaggucaugaaaacuuccugggucuucauagauagguaaagugaccacacaauacaguuaaaauuguucaaggucacacagagguuccagagauuauucaacauaagccuguuuuauuagugaguauuguucucuuguaaauuccccagggaucagguaaugaauuucagcaguccgcucuguuccugccugcucauuucccggccgcucuaccacagucucccggagccagugcuggucuccacaacucagccucucaccgugucuuacuuuuaauuuucuucuccuaaaaucuguagucuguaaauuacuuucacugguacccaaagugcuuuaauauuguacuuuugaaagaaagagcagagcccuggguaugaugguucacaccuuugaucucggcggggagacagggaaaagacagagaggcagagaggccugcagaucugugagccaggacuaccuaguaagacaaggcuuucuaaucuagaagcaacauaauaaaggugcuguacucaguggugggaacucuggaugaggcuauacaugagucuggauucccacaccgaggaccccaggacaccuguccagaaggauccuuuugugucuguaggcuucucagaacaacaggauggaggugucaagacuuccggugugggaucugugaggugcauugaauuagcacacacaaagugucgggagcccccaccacugagcucacaugccagaggaugauguuauccuacuuaggacagguguuguuguuguuguuucagaguaacuaccuauuccauuuucugugccauguugcaaaagaauucacuguauacaggcucuuggauucauccauugucucuuuuuggguuuucagugcacacuggucaaaaagcugaaauauagaauauacagcuaugaauccuucugucacuaaaguaauuguuccuggcaggaaagcgcuuuuaagugagaagaauguccagacuaaguaauagaaaaguuauucucucccaaagcucacaaguucacaggcaggaaaagaauguuggggaugacugaaggaacugaaaguguagcaggaugcuggaaagcaacaaacagcacuugaacagcacuucuaaagggcugccacaaggguuggccuuagcuggauagaauacuuuaaauacagagucucuucacaaccuccgaacacaccaguacaccucaguauauauaccaguacauacuagaacacgcaagaacacacaaguaugcacuaguauauauuagaacacacuagcacacucuaacacucucuagcacacacuaguacucucuagcacacucuaguacacacgagaacacacuaguacacacuacaacacauguauacacuagaauacacuaguacacacuacaacacauguauacacuagaauacacuaguacacacuauaacacaccagagcacacuaggacacacuguaaacauguauugaagaaucauacuuucucauaaauaaaugcaauugguacauguuagucagacauuuuuuuaaguauuuaagguuuuacugacucgugaauacugauauacugcagguucuuuugaaugaccacagaauauccugugcguguggauaauuaggggaaccacgggcuugaggcagcauagccaucccagagugcuuuuucuuguucucacauuuagucccaaucuccaaauccuugaccacugugaguucuuagaauucuguuaauuauaaauuagaauucagaaguaaaaagguaauuuaucugaaggagagagcuagagauaugaccucuaauuacuuaaauaccaaggcccccuagauuaaaacauuaaacucaaaauccuucagccgaagggauuaaggagcuuagacugaguuugacaaauuaccaugggguuaaagggggaagugcaggcugaaaguaggccaugcucacucagauagcagaugaacuucaggagaaaaagccugguuuguuuguaguccgaacccugugggggaggggaggauuguacucggucagucuaaugauuucgacagcuaaaaauaucaaaaucaguguaaaaauagcuaguuauagaggucucguggagucugggcaaacagcagacuuaaaugggauuuuuuuggggggggugguggcgagggucacaaacuuauguaucucuuggcaaccaggagauagaaaugcaacuucaaaaccaaguuugcaaugagaugccagaagaauucugcuuaaaauaucuucuaaguauugauuguccugcccaaagagucuaaacccaaaccaugaauucagccaucgcaucuggcuuucucuguuccugucaacuaaaugccacacacaacagaaacagcacagggaagaguuaaaaaguuugggagagcagccaggcaggggagacucccaugcagggcgagccacugcucuagggaccagggugugagguggugugugugugugugugugugugugugugugugugugugugaagugugagcacagcuagaaggaacaggaauuucuuauucugguaccaaauguacucuggcaguuuugagaaggaacagagagugaaaaacaacaauuccagcuaacaccacccagcagacacuccaggcucaggguuaagcucucucuccucuugggcuacugcaggcagcucuguucuuugcacaaccucauuuccagcaauuuuugaguuuuaaaaaaaaauuuuuuuuucuucuauaauuuccuaauguucugucaaagcuuaaaauguguuucagaaccuugcccagcuccaaaaccuucaagucuaagacuggcuuugcaccaaagcagggccuuagccgggacuggaaggucucauuuucuaccugagcuuagaaaucuccagcuuguaaauacuggccuuuaaaacaaagccccagaaaacacaccauccaacaaagcagcucucggcccagggcugucuuaacagcuucugcucaaaaugucugugggucauuugucacuauuuuuaagcuucuauauuuagaugugcagguccauccgggacuucgccagccuaucccgagagcgagggcacucauuucugguucuucaccgaacauaguuugcaagucuuuacccaacacccauaaucuaaagagagguacucccugauucugauuucugacuccugauuuuaaauucugacucaugugggucacccugagcccuccaucugccuggcccuccucacuggcacaaccacacaacgacagugccaggcaguuggcacagcagcugccgcuggcaucagggcucuggcaaggaucagaggaaacugucacauuacagugacacugaccaaagaaggcaaguuuacauauagucagcuguuaacagcagagcuucugugcccugauucuacaaucacaugcccgccccugaggagaugugccggggcugccuggcucaauguccugugucucaaauacuugugcaguggcagagacucgaagguacgggagaaaucuccgcucuccuauccacuuuccucccccuucucccaaagaacucacaaguugaagggaaagacccaacucccuaaaguuaccuucuagccacaccccucggauaaauguauaaauauaagaaaaagaagaagguagaauuuggagugguaauuuguaaugcuggggcagaaaggcugaaguagacuuuaggaagcucagcccaaugagaucaaagauaccaugaauccuaguuagggcuuucccaagagauaggacccuucccaauuuuuacuuuuuauuuuaaauauuuuagugcuugggguugaaccuaggggccuaguugaacacacuaggccacaggaucugcucccaguuugauguuucuuuuuuuuguuuguuuuuguuuuuguuguuuugagauaggauuuuuuuuuucugugcagacucagcugaccuggagcucacucuguuggccaaccuggccuagaacucagaucuuccugccucugccuccugaguccuggcacucaguuugaauguuuuauuuuaauguguaugcuugcaugugugcuuggugcccuugaaggccagaagagggugucaggucuccugcaacuggaguuagagacauuuguaaacuuccucuggaagagcagcuggugcccuuagcuacugauccaguucuccagucccucccucccauuugauugaaaauaauuaaaaagcccagagaaagagaccauuugcuuuggcauugcccuaggagcuaguucucagugaauguauguuacacaaguauaguuccuguaaccccugcauagggcauggggaucuccaguuaagaguccaggacugccgaaguuucaggaucccugagucguccccccccccccccccaauucccuuaguauggcaaacucuccugaagaauaacauccaauuggcuuggcagcuucaccaagauauuuacuuggugaguaaauaucucaccuuacaagcaaucagaaauauuuacuuugcucauuuguccugccucccccucccccaccuccccuuacagccaccuguggcaugaaucagcccgaucccauuauauauguugcagaccgagucccuuaggaguuuaagaaguccagccccaugucgccaaguauacugucaugucacaaagauuguggaguggugaccuuuugugccuuuugugcgacuuaaguuuaccgcuccccgauuuucucugcagccgggccagccuguuggcaccugcgguaaugcaauuagggccguugaugaagggaugauuaaaacucaauucaggcucugagugaguacuaucuauaugcacagggcuaagcuucucccuuucagagcugcaagccaugcaggugagaucucuguucucaccuaguuaccuccaccuacguggucaauuugcuuuucuccuguggucucacagaaggugcgagauguuucucucuugcaccccccccacccccccacccccacccccacccccacccaagcccaugcuccaucuggcugcuugaagcuccacccuucugcuagcacccugcucagacuacuggacugcacuuaggucuuucagccucugagcguaguaagccauuuauuccuguccggcaucacuacuuucuugcucccuccauagcugaugcugugucgugggaaguagacagacacugugccuggguuuccucucagccucuugggccucuguuauuuggauugugccaccagaugacccaggaaagcacgccaagucaugucaugcuugaagucucugaacaugggacacaccauguaaccuccuuggcggcuggcuggcuuuuaccugccucuguagacaggcuccaucucuguuggaaguguguuuuccuguuucuucccagggcuccaacuucaccugaugauguuuaucgaggaggugucagcugcuagaaguagagaacgaccuggacgacauuuucuggccuuaaacauuuaaagcuucgugacgcuuccucucugugucucuccuggggcuuuugucgaaggcugugugguuaucucagaucuauuucagagucucucuccuuguacccaucccagacauuggcaauggucucuugcuuucuucuugggugccaggaucaccuucucucugugaccagcuuguuuggcagcuuaguccccugaguauuaccugcugacccgccauggcaagccuugcaucuuucucccccucacuguucuaucugaacuugagaucuguugcuuuuguuuuuguuuuucgagacaggguuucucuguguagccuuggguguucuggaacucacucuauagacccggcuggccucaaacucagaaauucgccugccucugccucccaagugcugggauuaaagacaugagccaccacugcccagcuacaccuaagaucuuuauggcugaccuugaaccuguuuucugcugccugcuuuugugugagcuuaguuuucaccccuucccugagguuuccuuuguuuggucuuauuauuuuggccagucuggccugaaacacaugggcucaggucucuauagggacccaggaaauccugccucuggugcucaccucuggccccaucuuuaccguuugccuucuuuguagugauacaggugguuugucuugagaaagccacacccugccagaccuuugcuuuccucucagagccucuccuguccucagugguaguguuccuguggugcugcccauaacccccacccccaccccccagccccacagagcuggcuucuccccgagcuuacuguccuaguaacuccucucccgaccuuaugcuaugucucuuuccccuuccuccacaaggcaagcauuuagaggucagaaguguuuaguuuguguuugcacacaagugggcacccggugaaaacugcaguuucugccacauugugcucaccaucaagauuuccuaaccuaaugugcuuuugaucuggaaucagaaugauaaucccccuaauguguuccaccugccgaaggggcgaucgcaugaugugaaauauucucuauuuaggacauuugucuggggacaugucacuaaacucauuuuagaaaugaguuugaaaaauggauuuauuaauguuagaguguuguacauuuagguucucccuguguuucuuuuuucucuuguauguauaucuagugugugcaguuuucaugaaguccagaaggaagauguucaauccucugggauuagaguuuucaggcuguugugagccaccuccguguggaugcuggcaauugaaccuggguccuggcaugaguagccggugcuagcaacugcugagccauagcuauagccccauaauuaaaaaaaaaaaaauccauacauuuucaacauucgucuuuaagucuuuuaaaggcuuucuacaugugaggguuuuugugugaugaugauugcauacauauauagagaaauaggguuucucuaccuagcagcggcuguccuggaacucaguacauaggacagacugacucagacucacagagaucacuugcuucugucuccuaagugcugggauuaaaggccugugccaucaugcccagcuuuuuuuguuuguuuuaauggcaugucaugaaaucguuaauguagacgaggauucagucuuaaguguuuuguauggaauagaucccuuuuccugggaauaagccaagcauaccguguggaacauuugcucaucuccuccagccacaaagguaucauuaguugguauccuaguaacgugggaauuguugacccugaacauggucuucuguggccugggcuucauuuucugguaagacuaccuaucuccauuauguccauucaaguugcaguugcuaaggggacacacugguguguuguucugaaccuuguugggacagguaugguacaugucaccuguagcucccagacuccucccacauaggcccugcagugacugcacuaugauuugguucauguuucuggugaucugucaggugguaugugccaaccuaccgaagucauacagaccauggcagagaccaaaguaauaauucgguaagauugcuuuauacucuguacccccgaccaagggcuuuucauacuuuggacaaauacuuugaggaaugugcuauauaaaaauugugucuguagugaguuaauaagagauucuucaacgugaauauaucuaucuucuauucucuuuccauauugccccucuguaagaaaaggagugauuagagccaacuguuggagauacagccccauuaaggagcacucucugcaacagcguacuuaauugcuaacaucuaaaaaguaguauucuccacauugaaaucuuaauuuucacuaaacauuggaaacauugaauucccaacaaaacaguaauugauuuuuuaaaaaaaugauuuauuuuauauaugugaguacacuguagcugucuuuaagacacaccagaaaagggcauccaaucacguugcagaugguugugagccaccaugugauugcugggaauugaacucagggccucuggaagagcagucggugcucuuaacugcugagccaucucuccagcccaaguaauugacucuuuaucuucuggaaaacgccaaacagcagauggcucaggugcagcagcagggacugcaguggucuuagaggcuguggcugguugaggcuguggcuguggcuauggcuguggcuguggcuguggcugagguugaggcugaggcugagggguuuaauggaaguaaagccaaagacaaggaguuggauuucugucaucagacuggcccaccugcucaagacauaaaugucacgcucucccugcccaugaaggaacuggagauuauuaacuuuguucugggcucaucccuaaaggacaggguucuaaaacucaugccacugcagaagcagacuugggcuagaacacagguucaugguuuuugucccuauugaggaccugagguccugucugucuuggugguggccacugucgucugucuaacuauccucuuagccgagcuuuccaucaucccuauguguguggaaacacuacuggggcaacaagauugucaagcccuacaccguuccaugcauggugacaggccgcugugguucuguguuggugccaagugaggugaggauccaucuugugaaaacugugucaaguucaugucuggcugugccagcaggcuuguccugaagcucauugguugaguggggcucaaaggagauuggagaaggcggccucaacauauucagcaauaaagacaacccaagggguguguguguguagggggguaggcuaucuuacuacaggagagcaaagcuauagaugauuugcaaaacaggguguuuagccuguguuuuauuucuuuugcuuauaauauuaguuccuuuuuuauuaauuggcauugauaauggcuuuuguccuaaagcagccauccucaacuugagucaugacuuuugggguugagguuugcaaaucagauauuuacaauaugauucauuauaguagcgcaauuacaguuacacaguaccaacaaaauaauucugucagaaaccucagaauagagccuacucuuuaggacagugguucucagccuaccuaauaaugcuacccuuugauauaguaccucauggugugaugaccuccaaccauaaaauuauuuuguugguaacacuacagcaguuggguacgaacauacaucccaguguuugcucuguagugucuuugcccuguagaccauaugaggcacaacgcugcuuucccugauagcuucaaacuguauaaucucagccguugagacuaaggugggagagugguugugagucugugugugauacagagugaaaacuggucccaacaacaggcaggaggggccccuugcuguccgcugccuccugcccaucccugcccuggaaugccuugccagaagccccuuucccuuuuccuuuuucuugugcaacuuauggcuugagggauguuuuuaguuacucccagccccaacuuuuaggguuuaucagcacucgccugguggacagcacccacccugcuuccuuccuccucauccccaagagcacaggauccccacccuccaaacuuauaacauuccuuccuccgcacaaguuaauucagaguagcauguugagacacagaugucuacagagaugguggcugcaugaaugagaggcugccauguggguggagggaaagggaggaaaggggggugucagggaagugccacagggccacauggcucuaauccccccauuugagaggcagacacaguagacuucugugaguuugaggacgucagagaugaauauaucuaguuccaggcuggcucaggguaccuagugggacaagacucugcccccccccccccccaaaggcccauguuucauuaaggaugacuucuguucaugcugcuucaugcagugagcuuaacugauacacggucccugauagagucagugcuggaggcuugcauggcuaucagaaucuugcucaucagcccuaguguagguaggcagaacuuacacuguaaagaugaucuugacaucugagauuuccaagacucuuccaguuugaagaaucggcucauguuuuuccuacagaagauagugaggagcauagcuugcugacuguucuaucugcauccagcagguaucaggugaggguccuaaugagaaggagauccuagcguguugaauucauguauguguuuuaagugacauggcauguugucaaggaccuuuugagugcagggaauaugaccucagcuucuaguucuccugugucucuguggcuugagagcacauggcuacucuacccuuuauagccagaacuugguuucaacagaguuguuuugaaaacacuugcucauaauauaucagaauugguuggcucaaggugaagaggaaauuguaaccugauuuguuaaaaacuaggaacaaaaauguucaugugccaacagugugaaugugcagagcacuguucaauuccgagcaggcuuuaaaaguuauaugaagaauuaggauauuucaucuacauuuuauuuuugucuuaugcaugugguaucagcacugugaggaacuuguguauaaugguaaccuaagcaaaugcuaagguaccugauagaugaaguaccaaauacugagaugacaggauuaucuugaaaucuauaauaguagguuaauuuuuuuucuauuuguguucgugaaguuugagaggugucuagcugaguaguaaaaacacuugcuuaccauucagaaggccuuagcuuuuuccaguucagaagggagaagagagagaggagaggagggaaggagauugcuacuggguuuuuaucucacuggugacuccugcguugcacauaaugccacaggacugaauuuauucuaaaugaaguuguuacccagaugagguuuccauuucugacacauccucagguguaauugugcaggcacacuaguuauuagguggaguuuaauaggaacucccacugguggcuuaaauauuuugcuuaugugccaccagcugccguaaaacuacugaucucucucccguccuugcaagcagaacgaagaguaagccauuuugcacucuuggcuuuuuuucuuugggagcaagggaggaggagcaggugcccaucggggaagcuguacguuuuuaaaacuuugcacauggugcuuugcaugagucgaaauugccaaagggacagauguugccaauuucaaauguacagggggaaggcaaacauugcuaagcaacgcugugcuugagagagcguuuuuuaggagcagagccaggggaguugggccugggagcacuccugcuccuuauggcuccauaccagggaagacacgcaaaguucuucccugucugggcggccauugcagccaccgcaccagggagagcgaccuaguggcauugagcagggcuggcagggcagguguugagacaggaaagcuuuuuuugccauguaggaaggcauuaagacaugcucagggagguaagugccccauugccccacaguaaguauccagcgagaaguucaggugggaaaggccagaaaguagagggagagaguggaguaaggaagaugacggccugaacagaaaggugugucuuucuuaggaaucaaucaguacagccugguuuagucugcugcgugcaugacuguaacaagguaaauaagucuuccagcuacaggcaugcugugccucccucccgggucuuucccuuuguauacaucuguuagguaacagacaguuuuccuuuugugugugugugugugugccacaggagacuugggcgaccucuugagauuuguguggcuguuuguuuggacuuuggagccugccugccuuauaaaauaguaaucguggagcuagagaaugagugcauaaacgaaugcagacuuguuuuuauuguguguuuugaaacauugucucacuauguagcucagguaggccuuggacauucuccugccucugccuccugaguguugggauugcaggauuauaccccaugccugacuauguguacauugguaguauauuuuauggcaauuaaaagcauaaguauaugauaauucccauagcuaaugauuuuuuccuguauccuucaaacacugggccuaaauuaaugaaugauaugagaaaugaagcuauuauuuaaaagccaaaauauaaauugucccuuuaaagauuugguuuuucaauugguauguugaauuagagucuagucuagaaggugugugugugggugaguggcuugggggagggggaaugugugugcugguggcuacaaaacccggaaguauuagaucccccuggagcaggagucgcaggcauuugugagccucuuuauaugggugcuggacuagaacucagguccucugcaauaacaugaauuuuguguuuguuuguuugcuuguuuuguuuuauuuguuauguuuuucgagaaaggguuucucuguguagucuuggcugucccggaacucacugguagaccaggcugaccucaagcucagagacccaucuucuucuuucugccugcuugcuaaaugcuaggauuagaggccugugccaucaccuggcacuuuucuuauuuuuaaauacaguguuccagccauuucauucuaucuacaaaagucugucaagaaacuaucuucauccccaaaccaacacagaggugacuggcagaggucagcuaaaaggcuuaccugcucagcggccaagcugcagucacacaccugcauuguucuaguguguaugagagagcauucuaguuggcaacauggugcuuguuuuauaauaaaucaauuaaagaaguucauucagguugaaaggaccuggagcagggcuuuuaacuguuacucccaguucggccugcagcugcugguguaauuaccaugucaggaaggaaguggguacacccaggacuguguccccaugggcugugugccagguggaauugucaggaaggcugcuguugggucagguauaucugaggggcaguucauuuucgaaaggagguuauuuuuguuucacuguggcuaugguuucuugauuccuucucuggauucugcauugagcacaugcucacgucaugacaucuacuugagcuugguuuuaaacaggccauacaagagcgauaauauauuuuaaauuuaggucuaaauaauuuauaaccaccuaugauauccuucuagccuuuguugauccgguguuggggauugaacccagggacuuguauguguuaagcaggugcaugauaauaaauaaguuauacuuucccaaggugauuuuccuauucuguggaaauuuauuuguuuauuguuaaauauguggaaaucaaagccaucucuuccugccgccuccuguguugguuacagugcccauguccccaugggaguuugaagcuguuugcuuccucguaggaguugugccucuggcugcaggacuugccuugccuuuucuuucuguuccccauuggauugcaguuuuuguuuuugaagauaaucaaugccaagagacacuacaccaagccuggaggagacacugggauuaccugagcaaaccgaggauaaaaccuuccguccuuccugacaaggcguggauuaaauggcuuaucucauuccucugacuucagugucuuuagccucuccacccuggaaagccccacccacccccuuuuguucagaugccuauguagccuccacuuaugcuuaaguauuuuuuuuuaaaggucuaaguacccaugaaacauggaauuagacaugguuuccaaacccugugugccacuuacaaaaugugacagacacagacacguagagaguaggcuuaagucucuguaaacauccugcgauugacagaguaauguaguacuguuguuucagaucagaacuguauguuaauaugaucugugagagacaggaauagcagagagacagaaugugcauguguguguguccacgggcaagaucuagguaucuaggcagugcagagcacacagggacaucauauaccaccaugguuucauacucuuccgugcucauaaucugcacauuggauguuuacacgcaagguaaccccucucacauucacacaucugaaggcauuuuaauaaguagcauuggauuuuggaagaagaaauagaucagauacuaugaaagaaaaaaauagaucaggccauaugaaagaucucucucucuuucucucucucucucucucaucaugguaguguaauaucuagacuuucuuguggugguuuggcuuuuccccuaucauuuagugccuacuuagccaugccaucauucaugguuuauacccacaauggucuucacaaggccucacaugaucuuucaucaagaguccaaaauguuucaaaggcacaccccacugggaauuucagcuccccauacuauguggcuaauggcaauaguucacagucagaaagcuggaaacugggguuagacauguucucuugucuuguuagagcguuuguucaucuggguacucuacuucugagugaacuuuaacacgacuccuuuuuuaaaaguuuuauuuauuucauuuauaugaauacacuguagcugucuucagacacaccagaagagagcaucagaucccauuacagaugguugugagccaccaugcgguugcugggaauugaacucaggaccuguggaagagcagccagugcucuuaauugcugaaccaucucuccagcccuauuaacacaaauucuuaacuguuaugcaagaagguaauugacuagcuggaauacaugugucaacacuaaguccuuucauuuagcuucaaugcaccuugcaaaugcuacccaaaaccuaggaccuccagauccucggagcaaggaaugagaaggcagaauuaagggauagcagcauuuuugcuacuucuucauaucauuggcauauuuguguccagugaauguuuauaacucuacacagagagaauagcuauucauuaauuuguucuuauuuaugaauccagauugcaagaaacagagccccaaguuucagaauuacccauguuucugucuauucuaaguggaauuucuagaguggaauaauuuaguuaauucagauugugauuuuuuaaaaaaauaauuuaucugauuuacagaaaugaacuaucuuaaugacacuaauuaaaacaaguggcuucagucgugugaucaaaugacugccagcgaaacugucuaaugacucuuauugguucuugaaagcuaccuccuguaagagucuguucguuuuaggucccccccacccuuuucaucuuuagugcauuuuugcuuuaguugguuaaagaaggacauuguaguuuguggcuggaaguguauuuuaaacagguagggaugaaggcuucauuucccacaugaaguggagugccggugcacacaggcugugggaauucucucucugugucuagcucguaggaucuuugaagcuccugucucaccaaggugucuacauccuuccuuuacugcugcuugggggagacccuugcaguuuggagcugaaagugguuggauucugggagaggagaaacuuccagagaagagcagcaguguuugucuccuccucuuucagauucucccacaggagaguugcuuagucuuagguuuuuuugggaaguaaauaacagugggugaccugcaggcuccucuuuauuuugucuuacuauguaguuagauggcccaggccucaugggagcugggacugcagacaugagccauaucauauugauaauccuuaaugcuucuuccuccugcaaaccaaaucagagaugucuucuaauuaaguguuaacaucugucccaagcaugccguuggguaccaagaagagguguuuagggacaugaaggaucacuuguggccuuugucccuuccuacaagugaucaggucugcagauguagcucagcaguugaauuugugcuuuaguaugcuucagucccuagugcucaaaaaccggaaggacagccacuaacaacagaaaagggaaacaucacacuauuuagagccaaugagauggcucacggaguagggcccugccacgcccgaaucggauucaauccuagggacccacaucauggaaggaacacgaauuauccccuaacuagauaauacacacuuugauaugcaugcacccauacaugcacaugcguacacaugugcacaaauaaauguaagguuaaaaauaagaaaauacaaaaaaaaaaaaaaacccugucuacuuuuuggaacauguuuagggagagaaaucauguuuaaaaaucuucaguaaaaauguuauuuuuuuauuuuuuguuugcuucauuuuuguuuuguuuuuugagauaggguuucucuguauagcccgguuuauucuggaacuccuucugccucccgaguucugggauuuaaggugugcaccacaagaccauguaaaaauguuuuuaaaaugaugugugugucucugcaccuaaauagugucauuggaggccagagauggggucaugaaccauucaguguaggcagauuuggguauugagagcagugagcaguuuuaacugcuuuuccaucuuucuagccccauuaauaaucuuuaaggggagauuuuaguaguugacugcaacuuacauagcauccuuucaauuaaagaaacuguauaggguguguuagcaauuauuuuuuauuaauugucgcaaacaccucuguguguguguguuuacuguuuuaauuugauguauaagaacucacauacaucuauccagaagccuuaaaacaaaaccucuuaaaguuugagguauggaaguugacauaaagacagucgcccaggggcuauggagcuguaaugccugugccuuuaugugucuuccggcagaagcaggcauacccagguggugcgagccuguucuucgagccaaguuagcuguguaggugauuuacugcuuauucacagaauacaauuaucauuaugugaagcuuuguucagucaggccuuuuggucuccauuucuaaucuuucccagaaguggugauuaugguguccucuuagaauugcaugcauuuuuauguauggcacagacuuuagcaugcacugucuuauuucucccuuaucauugccauuccaggcuuuguguauuucauauauguacguuuaauacuuauuuauaauguguuugguaugugugcuccagcauauaucucuguguguguguguguguguguguguguguguguguguguguguaugaacacguuugagauagagcaagcauugccauggggcaaugucagggaacaaccucuucuuuguuuaaccuaggguuccccacacaccccucuucuguguaugccaggcuagccagcccccaggcuuccagugauuucccugucuuugccccugccucaagagcaguagaaauuacagacacgugugugucacugugucagccuuuguuaacuucuuauugaaggcucggcugagguccuuacucaagaggcaagcuccuagguccccuguucaguacuuaagugcuaagaagagaaagagagguaaaagcugccuuucucucaagcaaagcuuuuccaguuucauuagggagugagaacgggcuacagcucugaugccuaugccuccggccacucugggaaguuggcugcugaucaggaggcggccucucagugcccugcuuuguggugagugggccgugcugagugcugcugaggacagacucuggaagggcagacacagggcagacacagaggaaggguaaccaagggccaggagcuggaagcaggugguggacuuugagacguuuuuaauuucagucuaauguuuauggguucuguuuuguuuguuugguuugguuuugucuucuguuuuuauguucuauguuuguuuguuuauuuuuaagauuuauuuauuuuauauaugugagucagugcucuuaaccgcugagccaucucuccagcccauguuuguuuuaucacuaaauuuaagggcuuaggauuuaaaaguuuaaaaaaaauaaggagauagggaguugaaaucuuuccuguuguucuuuguagaggaaacugauggguuuuuuuuguguauucuuagcuguauuuuaagcauagaagucaacucuaaacacacaaucuagucucugacauuuucuuuuuuuuuuuuuuuuuccuuuuuaaauauuuuuaauuagguauuuuccucauuuacauuuccaaugcuaucccaaaagucccccauacccuaccccccccaccccacccccgcccucuccccuacccacccacucccacuuuuuggcccuggcguuucccuguacuagggcauauaaaguuugcaugaccgaugggccccggccuagucucacaagagacagcuauaucaggguccuuucagcaaaaucuugcugguguaugcaauggugucugcguuuggaggcuguuuaugggauggaucccuggguggggcagucucuagaugauccauccuuucaucucagcuccaaacugugucucuguaacuccuuccauggguguuuuguuccccgacauuuucacuuauguaaaugcugacaaaguaccuuguuuauuuuucuucuguuucauauaguuaggguauuaccucaucaguaauguccuguauauaauguuauauauucucaucggcauaucuggcuuccuuguccuuuaucauaguugcauaauauuuuuuucaugugacccuguaguugcauuagucaguguuuguaguaucccguuguuugcaggcugaccggaaaccuugugaacauguuguuuggaacacaucagugcuauaguucaaaggaugcauguaacuggaauugguagcuugggcuggcuggggagaugggguauaaaaugcuuacuguguaaguaaccaugaaguugagaccaccagaacucauguaaaagcuggauagcacaugccuggaacugcagcuuagggguggaggaagcugaggcaggggcugcuuuuacuagucagccgagucaaacaagaagcaccagguguagugagagacccugucucaaacuauaguggagagccacccacagcagccccuggcuuccauaugcucaugcucacccacacagccuagcuuccuccucucuugcccuccaacccuguuuaugggagccauugccuaagugaugcugggguuuugaacucucuauucuucugccagugaaccuugcaucugucccauagcuuaggucuuguaaguccuuugacuuguucccaauccagucuaaggagaaauggggauagauggauccuguaucccggcauauacuuguuucuauauuguuagcccacguguuuauuucuaauucagacagcuuacagcaccuaacgugcuuucaaaucccucagauuugaaauuuauuuuaauuuuuuuauuauguguauuugugcaucgugugugggcuuggugugccuccucagagaggccagaagagggcuggcuccccuggaacucgacuuagagauaugguaugggcucugggauucccacccagguccucuacaacagcaguaugugcuuuugaucguugagucaugucuccaaccucagaaaaaaaaugagaauucuaaguuugaagaacagaaagaccagcaaauaucauugguggcguuuauguagcagguaguguguggucaggugggcgugggggaggcugcccucugcuuuccuagaacuuguaaccuagaagaagcagaggacauaagccgaugguguauagacaagucuagggcagcucuacagggcacaguacagaugucucugcaggagucaugcuauagcaaguggucucaggaacaccauggcaaagggggagugacaggguguguuuucaccagccccugagcaggaggagggagggggaagugaguuucagguaggcggacaguggacacucaacuuacugagcagcagacagcaauccaggaggcaguguauuugaagaaaaguaucuaugaaaauugguuagaauuucuuuugaaacagucacauuacugaauaauacuuagauaauucauguuggcacugggcauuuccuuacuuuaauucccauggcagcguacuuggcuucacccugcuccugugaggugguuagauuugguaacauucuccuuuaucaccauaaggaaauagucccaaagcugaauuguauccaagaucacagagcaggucccgagcgaagccacccuagagaagcuggggccuggcuuccucuucaguauucagccgcuguggcccccauuuccugguaagccuucacgaaaguagcacuguuguaaaagcucuuuucuguugaaacuugaugccaauuggacuugggcaggagccaccagucucgguggccaggugucucuucuauuccguucuuuugguaguaaaccaaaguccagaaguccuuugcaagggacuccucguuuuggugucaguaccgagugucauuuucaggccaugcucaguguuuugcucuggaacuugugggugaccagcagugagagauggugacgugugaaguccuuaacaaaugguuuuggucaugcuuagaacagaaaccugcucaaauauuggugugucugucucaggcacagacaaucuuugggaagccaguuugacaggaucuugaggcuuggcucagccgauucagagcuuuugugugaccuuggguaacacaccgguuuuagucugcauguuguaaaaaaugccuaccgcggugguugauaggagaaugaaacuggauaccguauuccacucccugagaccuuuuaauugaucuaaaggcuuucggaguggggauguccacuucggggucgauggguggggaaauggaacaacuuucuccacgccaagcuagugaucgauuucauaaucaaugguaucaauuugaggaaauaauaguauguaaauaguuuaaugcagugccaaguauaaccugaguucaagaaguaacugcuguguucucugcuuuguugaguagggcuauuguucuaguguuauuuacggccaugcccguggggaugucacccugcuggaacguuggucucuguauagaaucccaugugaugugaggucagcagugguguccugccuacuccaggaacacagacaccaaguguggaggcaggacugaguucuggaaguuagucagcaagccuucacacacagccuuaggagaccccuguuccucuugaccaauuaucgauuuugcuguuguguuuuauuaucuaguguuccggaaggaauccuuuuauauaaucuuuuuauaagucucagcuucuuagccaggacugauaguucauucuggggcaagaguuccgugaagagccuggcuaugcucagcaggagugacaguagguaaccugagccccacaggggccauguggcuuuuaagagcaagguuagcacacaggucuuuucagcaucuccuuccuuguuggaaguuuccuuucaguggcagaggcaagcucggaggugcugggcugcacuuuauugcucaaggcagccuguccucugacuugcuagagauuuguacucucagaugaaaccuugguagacuugggcugcacugacuuauguagccucuuuuuuguuuuacuuuuauuacuuaggggagaguguugugugugugugugugugugcacaaguacauauguaugguguauguguuugugcacaugaauauguaugguugugugaucauauguauguaugguguacgggugugugcacaugcauauauguauggugugugugugugugugugugugugugugugugugugugcagaaggcacagcacaaauguagaggccagaggaaaacugggacuuaguucucuccuaccauguggcuugugggcacugaucuccucaucaggcuugguaccccuacccaccgagccaccucaccagcccuuucuuuuaaauauagguucagagguagccgggcguacauagauggguugggaagaaaggggaugaacacuaauuaacaccgcagcaguucaugguuuguguggaugggcaugugggcaggagaaggcaccaggaagcaugcucuaccucagaaggagaauaaggggauaugaggauugcuuccagcacuuugugagcaugaagucaccucuaaggaggguacaccuuggaggguggcuucccaccccauucugauuuuagaaagaauuggccaggucuugguugguccucaucagagcugcuuuaccguuuccuuuuacugcugguugcuucucagccauuccccagcuuagucccaggcaggagguggaacuauaguucauagacauuggagucccaggcucuguuguuucauguauauguacuacugauggugacuuuuuuuucuaacaauagaugucagucauuggaaccaguuuaguuuauguccagguggaaacagccuuuuuucuccccuuuuccuuuuucuccuuuuguuucugauacuuaugcuaaacugugacacuaucauuugguccuaugacaucuuuuaguggauuuuggaaacuaaaagccgguuugacaugcagaaugucugaggaaggacuggauagacggcaguggaguaggaauguccuuacccuucucggguuguaccucagaacuuccuggcugugccuuauaaacacaaagcuccaaaaauguccccaagucauuagggugacauuagugaacacauaccgaagugguguuuccauuuugacauggcuguuagauuuguucacagccugguacagaaguuauacucuguuuucuuuugauuguuccuaaguuggaaugacuaggaugauggcuaacaaacccucgguuaugaauuagcaaccaguguuauaggaugggacacucuuuuuuuuuuuuuuuaagauuuauuuauuuauuuuaugcauaugagaauaccaccauugcucucuucagacacaccagaagagggcaucagaccccaucagaugguugugagccaucugaugugauugcuggggauugaauucgggaccucuggaagagcagucagugcucuaaaccacugagccaucucuccagcccaggaugggacacucuucaguuguagcugagcccaggggcaaggcugcuuuguaccagccugcugucugcgggggcaucaccugauguggcacuugcuguguguacaagggcucgcgagugacacagaacagaagcaguagauuugugggcugcauucuggguuccuaaugucggaaaauuuuagauuuaaccuuuuugcuuuucuuugugcuuaaaaguacauagacuauaaaguggaguuuucucagagcugucuaucacagcaagucuagcugccacauuugaugcuuucuauuuaguuagagaucaggucgcucuaucucaucacucuaucucaucacuuccuguguuguccuuuaugcacauaaaggccagagagauggcucagcauuuaugaguucauacuguuccuccagaaaaggagacccaaguuugauucauaaauaacacccuaccaugcagcuuacaacuuaguguguaacuccaacaccggggauugugacauccuccucuggcuucugggaauaccuacacaaaucccacuauauacacccacagagagagagagagagagacagagacagagacagagagacagagagacagagagaaagagacagagacagagagagacagagagagagagaggcagggagagacagagagacacacacagaaagacagacagaaaucuucaaauguagaaaugaguuguagaggacuguauugaagagcuguuuccugccugggcuuggccccuguggguccucuaguacucagacauuguccaugucuaugcucuucaguggauguuacuguaagguagccagcuucauuauuugauuacucuugccuccauuucuguucaucuggugcucucuuagauuuaucaauaccuuucuccccucuccccucauccucuccuucccccuucuuuguugagaugggggccuuacacaagccaggcaagugcuuuacuaccgagcuauguccccaacccucacuuuucucccgggcuaccuucagcgaaguggucacauucagaugggugcgggugagccucuagccuccugcucuuccccaagaugaagucgguguuuccuucuuccacggugcaguuccuagcacucugguaguaaaggguagguccugaagccaaccuacccaggcugauccacaccuguaccuagcacugcaaucaguuccacuggcaagguuuuuaaauuaagcucucucucguuuccuuugcagcagccguacuccaaugaaguccauugcguugaagagauucugaaggugaguuaguuaauaauuccuguuguggguuugaagaugaaguuuacaaacugcaagaauuuggaucacuguuuugugaauuucucaaguucugcuuuuccauaaagacuggggagugugcucauuucccagagaagaaacacccucaaugggcauagcauggacaguaccaggcuuuaaauagccccgugucugugaucuugcuuuuuauacagugaaaccuggugccuguggccucugagaucuugaaacuugaaaucaguggaggaggcauaugcacuugacugcagaagcaggcagaugaucaggcaagcugugguuacucagugagauccugucacacacacacacauacacacacacacacacacacacacacgaaugaauggucauauuuagacuuccacauuggguuguuuuugucugcuugcuuauuugaguugugugaacaccuuguugcugcaaauguaucacuauauacauuaccucccgcauauuaccccacacauuacccgccugcugcuguaaauguauaguuauguucaguaccuauuguaaauguggccacacauauauuacccucccacucugguuuucuugcacuagacaaaacaaaacaaaacaaaaaaaccaacaaaacuaaauuaaucuuaguagauucuucucuugaccugugagcuugcuuuucucaagagaagugaacaaauugucaugugacccuccugaaauucagagcuuaauuuauuauuuguauucaguaauuguaauaaccuggggugggggugcuuuccuguguguuccuuauuuucucuauggcucaugauuugcuccuguuggucuuagugauauucuuguagcuuuuauuguaaaauuugguucuuuugaaguucuggaucuaugaauuuuaaucuccugcucacuguuuuucucuaaaaauuuacuccaaauuuuacuuuaauuccaccuucguugcaaaaauacuaaccaaugcugcugcuugccgccauuaaauaagaaagaauauugguuauauuuuucauuugugauuuuucuuuauuuuaaaaacaaacaaagccgggugugguggcgcacaccuuuaaucccagcacuugggaggcagaggcaggcggauuucugaguucaaggccagccuggucuacagagugaguuccaggacagccagggcuauacagauaaauccugucucgaaaaaccaaaccaaccaaccaaacaaaagcagcauuucagcaaauguuugaacaguacuuguguuauuuuugucuguauucuguauucuucuuucuguaguuagggcuuugcagucacuccugagagacaugcuuugaaccacugaaagcugauguucucgccaauuagcaaggaggguggauuuuuaacuaauuacccugcucaggcuuugguauuaacuuuuacacuucaugauucugaaaauuuccacacaucaucucaaaauccuaaauuacuuauuauagaugaccacuuagcauccucucugaaacagggugugaucuauucuguauuuaccccggagugacugagagagagggugggccuccgugggcauuguguugugggguuugauguguagaagacaaaccauauccuuugcucaggggugauagcauuauaguacugugccauagucaaaacagccacccucccguccuccucacccggugcugugcuggggacgcucagacugaaaugugagcaaagucacauuugggagucagaagugagaaguggaagaagggaucccggacagaagcggcaggggccucuucacagagaaagcccaacucugccuuucuguuucacauucuccagccuuggcucucucaugguggaagcagggcucugagcuagcaggcgaccccugugcucuauaugaggggcugauccagagccuucuggucaagguucccauucuuuugugucaacaaucuugagcuuaccaggagcccaccgaccuuuccuaagagugacguuucuuucggcccuagauggugcuugcuaucgguucucauugguucucuagggccauguuuacuguggaaguaaagaggaaguggugugcucccuggggcucucagccagagcugccuguugaguggcaugguucuaggggcccauggagguguacacgcuggcaucaccugagccugugcuuauaaagggaggcccaucccccgccaauccauucuuggugccuguugccagccuguaggugaucugcuggaugcagucuccugaauaucucuagggccucucagcagguagcagugucuuggaguagagucgcugcaggugacagaacaauagagcugucuaagucggaaggcuccaccccaggugaucucaugcucaguggcagcaaggucaaagccagccuacucaaggcugggggaggcuacagccuccuguggugacggcuuuauguggaguagcauuauugcuugcuuauuugguauucagauaggguucuagguuguuggaugucagugaagaugauagagccauugcuuccgugaggauggggguaggagggguaaaguugccaugugaaugacuggcgagugaacaaaguagagaaccgaggaauagugugggggagaaggccacagguugaucguguuucuagaggaauggcuaguaccauggugguucuugugugugugugugcgugugugugugugugugugugugaugagcaaggagugagagaagacuacagcuguaaggccuagcaguguugggcuaaagagguaccauacaguccaucuuugccgguaggauggcuuggagucaaccguucuuuucuuuguaauggccccaauuccccuaaugucuaagguguuagggaagugagaagguucuuuugacuaccacaguaccgccuagagucugaaaguguugcuauacuucccagcugugggcuuucucaggacguagccuuaggucuuggguaguguuaggaauaauugguaguuaaaagucacaaauuccacaguuguaauaaguuaucaggaaacauuccgacuaagcaaaagagcaggaguucacuggcacacgaucagagugccuggaagucuccauuucaguuaaacauggugcagcugcuaagguuggugcugcuugcucuaacucagcaaacacucaggaggcugaagcaggagaguucuacacaccaugcuuaucucauaguguuugugugcacgugugcaugcgcggaugugcguguuccugauaacacacuuaaucaacaauaccuaauuucccuuuagugcuuaagcaaagcagcauaaacgccacgauugugcugaagagcauauuaauucguaagugcuagaaaccuugccuuuaacucagauauuagggagugauuaaaguuuugcuucuuaagccugcugacggugccgccagggaagggucaaaucuauuagaacccucccgcacggagcaaguggccucaaugacuuguuuguuuaagucaaacaggaaaguucuuccuuugaacuucaauaauucccggaagugcaguggagaagcugcaaggcagaaugugccgagaugguggccuuucuuggcucagccuucccagagcugccugcugcuccagggcccagagcugcaccagccugccggcaccugcuggagcgcuugcgcacugugguguucuugcugggccgcucaguuucuaaucuaauguucuuaagcugcuuuuugucaguuuuuuuguucagcuuccaguguauguagccugguacaaguguugcccacuuuguuagcugaaaacuaauucggauguuccacuuacgucugccuucccuuccuuuuccaaaucucuuucuaggaaaugacccacucguggccaccgccucugacagccauacacacacccaguacagccgagccguccagauuuccuuuccccacaaagguaauuccauaaaucaugacgggcacaauaucugcagcagagggaaguguaggggugugcugcagauacuguauccaccacagugagaagaauacaggguggugcucugguccuugcucucuggaaucuuuggagacugggcuaaaggucacgguuuagcuuuuaugguacuuccuaaggcuuuuagauaauuuauucuccuucucauguuagcaagaaugucuuagaauuguauagggcuuuauaucuucaaaacuucuucgugcaguuucucauuugagggcuuauucucuagauaacaaaccuuguuuaucuuauacuuccuaaaaguuuuuugaagugaacagcuaacgcuaauguugguuuccauaacaaccaaacagacuacuggcacguuuucagugauguauugaaacagccauccuuuucuuuuuggcuuauacuuuaaaaguauuuuucuguuuuguuuuagugggcaugggugugccaccugcaugcaugacuuugugugugcagcacgugugugcuguggccacagaggccagaagagguugauggcucucuugguacugguguauuagaugguugugagcugucacgguggugcugggaaucgaacucugcucuguggaagagccaugaucccucuuaacacugagccaucucuccauucccaguguauacuuuuaaauaaccuuuagcauggauguauccugagcgcaggggucugucuggcucgaugccauauucauauucauaucucuaggaaccuuuuccaugguacuguuuugaggagcucuaccuacaaaccccaaacuuaccucguuuauuccacccuguuuauaacaaugcuuuuaaaccaagaagauccauuaagaacaugcagagaucagauuggucaguguccaucuugucuguucggugugauugaugauuuacuggagaauugggcuguuugggccuugcagaggccuauagaaggcgggcgguuugcuucauguagcaggcgaugaguagacuguucccuucgccaucgcuacauuguuuucuccaaauuugaguuuuaggaaaauaucguuugcuauaaagccuacaugguguugcuguaagccacacagcucuaauggugaacguuucuucuuaggacccucugcacgucaguccugcaacccagagccaaagugagugaccgucugccguuuguguugcuuacagagcaaauccgugcuccuuuguugugguuuguuuuuguuuuuaauaauuguuaaccgauuuggcaaugauacacucaaaacaaaacucagagccacucuguagguacuguaugaaguaagcuguuuucauuaaauucuaaacaaauacaaguuaauauuacauggcacauuuacuuuucuuuuucuuuacaucaugguacauuuuuuuuaaaagauuuauuuauuuguuuuauguauaugaguacacuguugcugucuucagacauaccagaugagggcaucggauuccaguacugaugguugugagacaccauugugguugcugggaauuaaacucagaaccuuuguaagaucacucaguguuccugacuacugagucucuccaucccuuaugucuuguuuuucaagacaggguuucucuggcuguccuagaacucacuuuguagaccgggcuggccucuaacucagauccaccgccucuguuggguuaaauuagugugccaccacaccuagcugacacaugguuagguugacuacaacucuuggaacuguauuuaaggauaaaguauuuagcccaucagugguuuccuauagcaugaaaccugacucacucagcugucugaugcugggagacugggcugacaguucucugguuaauggaaugcuccugugaauaauaauguggccucuguggcuaucagaugagcacaaccuccauugcagaguguagccugcaggccaguuucaucucaacucaacacaggcgagagccacuuuagaagagggagcuuccauugaaaaaauugcccugccaaacuggaccugggggguggguaggggugggggugggggacggacuguagucauuuuuuugacugcuaauugaugugggaggacccagcucacugccagcaugccaccugugggcuggugguccuggugccauaagaaggcacguggagcaagcugugaggagcacggucaguaaggugugcucuucuauggucucugcucugcuccaguuccugccuugagcuccugccuugacuuccuugagugaugugacccuuuucacucuaagcugccuuugaucuuguuguuuuaaucacagccauaaggacacuaacuaagacagcauuccugucuuaguaugauagcaagucaguuuauauuugguuuguuuuuuuguuccuguuguuuuguuucguuguuuuucuguuuuuuuguuuuguuuuguuuuugagacaguguugcucuguguagcucugccuggccuggaacuuguuuuguaugccaggcugaccuugaacucacagagccaccuccuucugucuccugauugcuuggauuaaagcugugugcuaccacugcccagugaauucuuuuuaaaaaacaaaaaacaaacaaaaaaagccaaaaacaacaacaaaaaaccccacugagccuauuguaccaaaacauauguuucggaauaucugagugucuugcuucuuaugucugugcuuacacaacauggcugccuaaagauuuccaguuugcauuggccaggauaccuucccaucagaguccuugugaguuccuggcuccuguagcucuagaugucuaggccacaggacagcaauuugaaaaugugagagcugcugccaccaugaggagagaguggguaacugcaagugcaggaggguuuaagaguugcucacccagcauugguccccugacccugagucccuguguggacacaucaacggccuuuuggguacaucaggacaguccuuggggaugaaucucucuguggcaccccugugccaugucccugaacuuucuguccuggauccaguucugugaaccuggcucucaccccucuuccuccuggccacugcacacccaaccucaccugggacacacccggggcuuaacuucuccaucucuccacaugggcucuucuucuuccugaaggucuuccugcauccacacugcuggcagaaucccacacguucucucugauuuagccauuguaagcuuuccacaauuggccuuuggucauuacugguagacuauggaaucugaggacaguaaauuuacauaauugccccauguacuuaccucagacugcccuagguaguggauguuugugggccuguuucgugucccucggguaccuuugcagaaugggacagaugucuguauacauauuggucucuaccaggcugucuauaaauagcagcugagugaaugaauuauacuaugggagauugacuccaggagggacagaugugggagagaggcuauacaaaacaaacaaggaugaaccugagagucaagccagguaugauuugagaacagaauugucauggagcacccuuaggggccuaaucaauugucaucaagaacagaaacugucccccgcaguuaugagcaggaugggugccaccucaagcucugugcucuggcuaaaaguccguugcugccguuucguuuccaaagaagcauucucuuucaugagaccauaaaugcugccccaagcggcugcaucaagugcagauugguacugcaccuggguaacggggaaaagcugacaagagggaacucagcgagugguugguuguauaaaacuguuuccaugcuguucugacugcaucuuccuccccacagaacaauaugacacgccuucaaaaacccaccccaauccccagcaaggaaccucguaaguaaaaaagggaaaagcaaccuuuguguauuaaaauuugauaauauagcguucaaauuuccccuguaagcccauuauguagacugacccccccucgcucucagcuaaugaguucauaaaagggcuucacuguagagggcagaaaugacccccaguaauggccaguugaagguuuaugcacugucguagaaugugcugaagggguuuucuggaaagaaaggucuugagcuauuauuuaugcauugaccauggaacuccaaaggcuuuggcuuuuaaaauuucaaacuuaaguuacccuagcucuggaaauuaaauuugggggggacuaugggaugagauuuucugccguuuuccagccuauuuauugucaguauccuguucuguuaccugcuguucuuauccaggucaggcaccucuaaauguauucagggauuuuggaacacuuagucuucacguuauagguguuucacucagcauuuugacccaguuuguuucuuuaaaguaaccaauuacuauuuccuuacugcuugccccauaaguaauugcuagggacagagggaggcuagcucuucaggcuuuccccuccgugucugugaugucaccagcacacugacugguuagauggauguugcagaugcucucagaguucagaauccugccccaggaggccagaggagggcguuagaucccuuggaacuggaauuauaggugguugugaaccaccauguaggugcugggacuugaacucuggaaaagaacuguugaacucuugguccucuggaaaagccaccagugauuuuuauaugcugagccaucucccuagccuguuucuucuaauuuuuuuuuuuuuuuuaaagcucaguuuuuguuccuuguuuugggggaagggcauugccagaaagugucagaugaguuggagagauuauuacaugucacugucggagugauucucauuucaacacagaaagaugaacaguagccuaagaguuuugauagaugaauuuucaucuucuggaggauugugaguugcuuguuuuugucuuguugguuuuaaaauauguuuuauuuuugcuugaucagaauguauuuuaaugugcucuugguggaugagggguuuuccuuguugauguccucuauuugaaaaagacaaaacucaccaaacuuauguuacuuuguuuuccccauuucuguuuuguguugucaugcuuucuggcaguuuugagucacuagcuuagacuauggaagagcuacuagggccaaggaccaaucucaugggagucugugauacugccccaggcuaccagacucugucugcacuugucugugaugguuggagauugaggaucaagccuuggucauggaaaaaggucugggccauugcauuguggcauccaggagggcucacuuggaucagcagaguaguggcaucuagggcaggaaguggcugugucugcuugagagugaaggaugaaggguuggccggcuccugcaccccagagcggccugagagggagugggcagaagucacuucucugucuguccaucacacgcagcccugguguccuagcaacaccauagcaaccauggaaaucacagaagcucuauugcaaauguacuuacaccuccugaugggguccucuaaauaaagacuacucauucauuuuugaaacgaguaccuguaaugguugucagggcaagguaaaaucaggacugaggcagucagguggguguagaaagaauguaccagaagugcugcagaggcuggguggauggaugauaaugcgugauucaguagugcuauggggcaguucucaacaguugguauggucucaucacaguugguaugguagguuucuuagugcugguggcuaauuugaucggugacaaccuugagucucacuaauguagcugagcucuuugaguggcagggugguugucuaacauuccuggaacaccagaauuguucauuacaggguuauuuaugcuuugguuugaaagggaagggcaaccuacgucuugcuaucucuagaaguaacuaauucuagagugaggcccuacucccuaccucugggucuguaguaccucuugcuucugucuagucuugggugcaggagcaagcacagugguagccgaauauaugugagugcaugucuucugcucucauuauuuuccagcgaacccugucugcugguaacugauuagcuaugguaucaguacuguuugccuccaaguucaggggaggguauguuuguuuagugacacuuggcuguugguccacuuccuucccaagauguggaucugcaguugccggacaacacagaauguuuccuaagguuaucgugucccgugcaguuccuugccgggagcgcagggcacuuggcagccccucaggagggcugcaggacucaggccuuugacgcuguagagcuuuaguguacaucucagggaugagcggguggaagggugcauacuucauuuauuuagucauugcuucaaccccugcuuugagugaaggaauaagagacagggacuucaggguuaccugggguugagugaguuaaugguagccagggguagucuaauuuuuuuaaggggggguuaaauaacaugcguguucauguugucuauugcuaguguguaaguaccuugguacagagggagagccaggagucguuuaccgugcuaccguuccaaucagcacagcguacucacaugccagcuggaaggcuccggccuucccuggccuucuggcacuuccuuguuuucuguuuuguuccucugcggugcaggggaugaugccuaguucaaugcuccuggaaacuuacaccccaaaucccgacaugucccuuagaaugagcuccagugacacagcucccuguaccuggugaucuaaaucguauuagucuaagaaaauucacuuuucucuccugccauuuuauagaaaguugacuccuguaguuugacgguguuuuacuugugcauucauugacagcucuacccgagaaauguguugcuggcagauagcuaucauuaaaaagagaugccgccccaguacuucagggacacacaccugugcugucuuguauccagugacggauuuuugugguugccaacacugcuuagugugcuacagcuggcuucuuugaaaggggacaccuuguuuucaagugacugagaaccuggggucauguuauauacaaugaccucauuacauagagaaggaaguguuuuaauguguuucuggaagaaaacuagagauuggcagugaggggcaguaaggagcccucccccugcucccuccugcucuaccguugcccuucccucuccauucccuccucccuccccuccucuuccucccucuuccccuccccuucuccccucuuccagccuuuaguggcucaggaucugauuuuuuuuuuuuuuguuuauguuaugaucucuccuuucuuuauaauucguagccucccaggguuucccacaggcaauuguggcccauauuucucugcccuauuuccaaaaggaacccgaagccagaauuaguggguacuguaaagcuaucaucacaggauuggagacaauuuggucugcauuaugagacugggucuccaagaggaaaaugcaccaaugccaggccuugcucaggaggcagaggcaggcaggucucagugaguucaaggcuagccuucucugcauagugagaaucugccuaaagaccagacaagcacacaaagcaacaaaugucugacugcauuauaaacuuggggaauuccagcugugucuuggaguucagcuuccuccacuccccaugcccccaagucauuuggaggauggaauaacguacuguguuuucauaccacguuugaacacguagggugugaacacaugagugcaucaacacaccuaccaccaucaggacuuagcaguuacagauaacuaaaaugguacuaaaaauuaagccagaggugagcuuauuuuaaauaguuuuggggaucuuguuuguugagaauuugggcagagauuucauugaaaaagccauuacuagguaauggcaggaaaguaagacucgugucugugucuucacacuguaauguuggggugacucauggaaacaagccugccagggccugccuguccagaggagcgggaugcagucacacaggcgccagggcugucuguaacgucuaugugcaagcugacuucaccgcugcuggaaauguggucacacuaugugcaguccagaguuuucuggaacauugucucucucccuuuuaacagcauaggucuuugggguuuuguuguuuguuugauuguuuguuuugagaaucauauauaguucaggcuggccuggaacuuuuagccgagguuagccuucugauccucuugcccgugccuccaucccccucccccccccaccuuccgcccaccccagugccaggguuucaggcaugugccaccaugccuguuuuauucuuguuuucauuugucugucugucugucugucugucuaucuacuguguauaugaauggugauaguguggcggcuagaaggcagccagcagaaguuuguuccccugcuuagcaaguaccugcuuuuacccucugaaccauuucacuggccuuugucuaagagcggauuucucucuguggaccagacuggcuuugaacucagauccuccugccucaaccuccugaguaugaauuguaggugugugcuaccauaccuggccuggcuaacuuuuuauuucuuuaucaaagacauuuuacgcacagauuuagaccaugggaaacaaauacuguguaaguggcaccagugucuuacuuaagugauugaugccaucugaccuuuucugauggaauucuuacauuuuaauuuuguagaaagcccucaggccccucuucagcagcccuccuucacagaacgcuguucccacuucaaaacgucuugaguagcuuuuaacccagcagacagguuuuauuauugauucucauccuguacaacuuccagagggggaaaucuguagaacuuucacaguaccugcuauuuccaaaugagcucagaacuucucgugugccuggacuugccuuaggagagcauaucuguagugguuagguguuauucaguagcaagggggacacauaaaugggauuuugauucucugcugugaguggacgcauagugggauuacaggaucauuuguggugcagaaaaguuaaggaagauuaguuuuguacaaaagaacccgguaacuaagagacggugucccuuuauaugguuuuuuugggggguuguuaauacugaauacacuuuaccaacuuugccagacuucccccacccugcagugaguuauaccuugugauuuucuuuuucuccuaagguaauaccuuuuaucucuugcugugucuccuugccaacccaaccuagcagcaaacucguugagugacuuuuuuuuuuuuuuuuuuuuuaauaccauucugauggccaacggccagguuccaugacugagggcuguguuuuuuagucaugguaaaauaggaauuuggucuccacuugguaaacauugagaaagaucuucaacuuauaaguagcuaaaauuuucuguucucucucucucuccuuccuucccuuucucucuccuccucucucccucucucucucccccuccuuuaguuuuguuuuguugguuuugguuuuuugagacaggguuucucugucuggcucugaccucaaacucagcgaucccccugucauccugagagcugggguuaaagacgugagcuaccaugcccaguuucaguuuucauuuuuuaagaaaauguacacaggaagaauauuagcacaugugcugguggaauaacuccuugguggcguugccacaucacauggucauugguaaaaagcccaguuuaguuccauaauuuaucuccuccauggcuuccuccuucagagagcuacaguaagaaucgcugcucaaaauuccugagaagguauuuugagaucuacugaaugaauuuuaauuugcuuccuggaacauaagcaauauacaaauagauuuuuuucuguuuuacuuacaacuuugugugugugugugugugugugugugugugugugugugugugugugugugugguagcuaugcuuguaaaauuggagagaaaugugagagacaguacugggcacccuugauauuugggaucucugaauggaagggugggugcuuagauuugagaaaacaugcgcaguuuagaaacauuuuuaauauuagaauuuguccuaagccagggugccuagaaauguguaguaauauaaauuuugggaaacaagcugacucccccccccccccaccaaaauuaguagugcuaagauugagauauacuuucaacagggccauuugcauuauuagcuaaacuaaugggaacuuugagcauugauuuguauccaagugaccaaaagagaaugauuuuuuggggaggaggucugugacaaauuaauaguguccuuuggacaaaaaugaagagggugucuugaggguuuuugugcuugcuuagcacuguuuaaauaccucacuuccauugggaagcagcauagauaaccgcuuauuuuacuucugucagagacaauggaagaaggugguucagggucauuugcugucuguguauucccuucgucuucguguguguguguguguguguguguguguguguguucguguguguucguguucucccugaauaggagucgagggcagguaaaaaaugccugccagaaguugucugcaggguuccaaacaggugggauguucggcuuuugcauugucaggagcuuggcugaccugauuuuaauguuaagugguaaagcuugaguuucuagaaaauugauuuaagcaagcaaacaaaacaagucuccagcuuaucccugccuccccccagcccccauguucuauaaaguuauucguucuccuaaauucuccacugucugucgcuucuccccagcaugcuggaggacgaccugcagcucagcgacagugaagacagcgacacggagcaagugaguguugaauucaaugcccuaaaugcccgagaccguuccugcugcuguccuaaccuguguuucucuucuuucugggaacuucgcacccuucccgugaauguccaggccacagagaagccuccauccccaccugcaccucccagguacugucugcacacuucucccccaaacuauugccuucccucgcaaacuacaggagaauauaguccuacuaagugccuuguggcuucuugaaaggcacaguguguggucacagcugagaagugccauuuuuguuauuuuaaaacuugacucagcuggugggagguugcuaaccccauucaagaggaagagcguuguuuuggaugccuuugagcugugggguuggagaagugacuugguagagugauugccuuccaagugcaaggacucaaccuucagcaagagacucagguguggcugcacagucugggaguguggagacaauggauuccauggccuggccuaguccaugagagaccuugucucagaaccagagguugguugaagaaaacacuaaauaucagaauaucaacuucuggccuccacaugcauuaccaaguacacauguauguguucacacucaugcucacacacacacacacacacacacacacacacacacacacacacacacacugagccaggugugaugaggcauaccugugauccuugaaccugggagauugaggcaggaagacaaacagaauguuagaggccagaugggguauggagcuuaaauaagcuuuaaacauagucgaccauuggcuuugugugaccagcguuugaaaagucagaggaaggagcccaugcacuugugaaacuaauagaaaagcuugucuucaaaaucaguaacauugaauucuuccaguaauuguucccaguguuucugauugguggguucuuuuggagggggagagauaugggggcaggggucaaaccacugcuuucaccuucaaauggaagagcaaugcucuguguuugggauguagaaacuaauuuuuaaaacuauuuuaugguauuuuccccugguacuagcuauacugauuuaagauagaaaauaccugucucucauagucaaagacacaaucuauuuugcggccuugcaagguugucagugacuuagaaagaaggucaccaggaagaauuugaguguccaggagcgaugacgugguuaaacuaaaggaaaaauuaauuauauagcccacggauuccuauaugcagccugucuauuuauacccaaucuuguuaaaauuucguguggcucacacugacucauaaaauaugacaaacuggucauaggugaaagcugagggaaaggcacaugugacagcagaggccaggaauaagcuagaaucaagaguguucuucacagcugacuccgugcugguggaguccugugcagaggggagguccugggacagugcuugcucuaaaaugacuccagccagugacuuuuauuacauucuuauucaccauuuaauaaggguuuauuuugugacuauuguagguagguuugggaauguugaaagauuucugcuuuagcucacagcauuuagggcaguuuuuaagauugcauaugguuugaaacuauaucuagccucaauccgugugucuucuccuuggauuagaguuaauggccuaccuguaaaaccuggacuugcucauggccugcuagucguaaagaguuguauaauucuaccaggaaccgugacugggugcuuugagcucacccggccaacgaacacccucugucaucaguaacuguuggcugcuguauaguuagguccuauguagagaauacgggggaggguuguacgcuagcuuuucucuuaugcuuucucuuuugaguuaucaucuagaguaaucuucaugagccacauaguaaaaauuuuagcuuuugugggauacuuaagccuccgcuguaacugcuuaccucuacuacugcagcaggaaagcaaccaugaugcccugugagacagcugcaggcagugauaauaaaacuuuauuuaggaaaucgggcaggcugucuaggcccugcuuuugauauuaggcgccuggcauagguauuguuuguaguucaaugcaucuuucaggaggggaauaccaaaaacuccuuccucuccugcuauuacccagugaccacgauucuaacaccuuggccucuguccacuggaugacaagccugcauugaugccuuuacugucugggagcagauagauaggcauaagugauaggggaagaaauccugugugcguaauccucuaacgguacccuccuguugcuuugcagcgcuccgcagacacuucccgagcccguggccucagcacauuccaguaguggggagucagagagcagcgagucagacaguuccucagacucugagagugagagcagcuccagcgacagcgaggaggaggaagagaacgagccccuggagacccgggcucccgagguacugcgcccccuccagaacgcuaugcaagauggcaggaugcugguucgucagagcugcccacugagccguccgcucauuggugcuuucccauggugcacuucgcuguucagcaagugcuuagcgguggagacgcugggcaggccugaccggggccucucucuggcuccacaugcugcucccuaagaguguuugcaaccuuguuuucuuuugaaaagggaaacuuguuuuuaguuaagcagguuaccguaucagugucgaugauagcucuuugaagauucaggauucuguagcugaaaugagagaaacaggagcuagaaacaagucgguucugucuuugaagcacuaaaagccauggaguacauugagagauagcaaagugcacugccgggguuguccugcccuggguagaguagggacagccaagucugucaucacccacacuuuggaaauagcauaaagauaagcaaacagugagacuggaagucccgaggaugacauuucccuguuccagaaacugucugagccgcauggaacucugagcucguggaaagggaaggaagcgcuacuuauuuuuuuuuuaacuggaugaggccauccuucauagagaacacugccucuguauuuaagauuagaauacaaggagaugaagcuuuuuaauuagacagcauuacauuuuucuguguucaacucugugagauggcugugugccucggggagaagggugggguaagggcaucagaaauugaagaaaugugcgcugugccuuuaggugugacggugccugacugggcaguccuuuguuuuuguucuuuugagguuuuuacaguucacagaccugggucagcauuaacugcguuggaggagccuuauuagagcuuaaaaagcaacucuguggcucucucugcugucuuguggcaccggcuguacggaagugaguuuucuggaucugaggagcgaggcugauggacgugccguguagcucagcuuuaugacgcucacuguaugucacaccguuuuuguguggcguguuuucauuuuguuuuuguuauuuuugguacugggacaugaaugcagggcaugcuuagcaugcacucugccacugaacuguguucuuaacccauguuucaucuuuaguaagaaaaacgugcaugcuuguaagaugacucauagaaaauguuccauaaaagaguggagucuagccaggcauugguggcgcacaccccuaaucccaguacuugggagacagaggcagguggauuuucugaguuugaggccagccuggucuacagagugaguuccaggauagccagggcuacauagagaaacccugucucaaaaaaacagaaaaacaaacaaacaaacaaaaccaccaaaaauaagaaaacagaguggaguccagugagauaaaguuuagcacauuugacugaguaauugaaaugcauucauuguuggccuguagcuucuuagggcccuggcucagucccugcugccacugagaacacaaagaaaauagaaaaugauuuagucuuaucuuuauuguaaagaaauauagucuuauugaucaaaaaguaacugguaugaggcucacuguguuagcacagcacaugcuuauacaccuaacccucugcacgcugaggccggggaccagccugggcuaggaguauacccuagccaaaaggcccaaccaaacaaaaguccagcaagguagacuggaacuuccucggugcagaauaacuguccugaucucacccugcuuuuuaaaaucucugcagugaagaaauugugucucugugaggucaggggccucugcugagugaggcucgcucuugggaauaucuugucuuaguuuauuuucauuuucccuuagguauuuaacuaguuuuuguccccuuuagaaugaauaucuccccuuuuaguugaggguugcaugaguuauauaaucaucugcauaguggcuuuauuuuauuuuuaacuaguaaugaaucaguuuauugcuuuugagucaaggucuugcuauguagcucuagacagucagggacuuacucuguagaguagacuggaagggaucugucugccuugagggcugggauuaaaggcauguaccaucaugccuuauuuauugugugugcacgugugugcgagugugugcgugugucacaguugacaacuuuggggcugauugucaccaugggcuucaccaagcucaggucaucaggguugugcaguuuaaguacauauauaucauguaugccuuaauauuuuaggucuuaagccauaauuuguuguaaauccacacacauuugugacucagagguuaggagagcuaagggagcgcccagacacacugggaacacuuccacgcuuucgucccgucccuuccagucuucaguaucuaggcgucaucaccuuugagaggagcaggggaugcauggagaaaaggaagagagaaaugaaaagccaaacuuggauccuaaucugucuagcacugcuguuugaacauuacaaucucauuuaauuaaaucucucccuuuuaaaaaaagauuuuauucauuuuauuugcaugaguagcugucuucagacacaccagaagagggcaucaaaucccaugauaggugauagugagccaccaugugguugcuggggauugagcucaggaccucuggaagagcagucugugcucuuaacuguugagccaucacucuaguccuuaucugaaucucauauucaaacauuuuaacccaaguaauugcuagccuuaagcuuccaugucauuuggauacagaggaagagcugugucuuguuuucucauuguuggguguaugauucggguuugccgugaaagugggccacuggacauucaggagcacaguggagguaaacaugugcuauuucugaaaccaggacauuccuuuagggacuccacacugaauauuucacggugcuacucuguuuuagggauagaguuucaggagugccuuuuccauuggguucacacauugaauccauucuaagcagccugccagugauaggcuggagcuguaaccacaggaguuggccugucccagccuuuccuaaggaauggugggaacgguuugguuccaagggugcucuaccuacaauuuuaucagauggcuuaacuacugugcuaccaaagccuugagucuaagcaggcaauuguguagcaaggaggcaucauccuccccuaugaauuuccacacucuagcaaccaccuugcugucuuagaauauuggauguguguauguauuuucaugugauaaaacgcucugcacaucaugguucuugccuucucccuguccugcugaaauuccaaacagacaccuggaggagaugcucugucuaggaggcuggacaacagagauaucaccaaaggaggaaaccagccccuuuucugucuaaaacaacccuauuuauuggcuucuucucaccauucuuugggguguuacuccauugugaacacaggaagccuaggcuauuuuacuuccuacugaccaaaauguacccacaccauauguuuucuaucaggauugcauauuuuugcagggucggauuauucguugcauuuuacuguggaaaguugucagcuaucuccccuuugaaaacucgaauccagaggcugaggauaaaguuuagugauagagcgcuggcccacaaggcaccagguucuucguuuguuccccagcaaguuaagacacacuuaagaagauucuauuagguccagcuuacuggaccagucuuacccgugaucuaucuaaucgauuuaaaucucauguccacuauuagcucucugguuagcucucuggugcucuguguauaugauuuaacuauucuugccagugauaggcuauagcugugaccacagguauugaccuaucucagccuaucucaguaugggaucuucuaagaaguagaaccaucacucacccagucaacauuggucucuuuccauaugauauauaucucauaagaauauuucagcacuuaggagcauauucugcagaaaaccugacuuggguucucagcacccauaccaggcugcucacaaguacauguaacgccugcucuagccucucacuagguaucugugcucauauccacccccaauauaauugcuauacauuauauaaguguauaaaacccggaauauagaaaacuaaaaugaauaauacaaguuacaaaauaaaauacuaaaaacuuuaaaaaagcaaagaauguccaaguaucuuaugccacagcaugcaccaacuguuggagucacaggauguuugaggaacaccaguugaucuucccuaucaguuaucuggguaacugacugucugcugugggucuucucuuugugcuuagggacaugugcgaccucagaccugauugccuuugguaaaagaugcugugucugucugaaagaauagagggacuagucccugcuaaugugauuucacucugucuuacuguguagguuuuggaagucagaucugucuguguuauauugauaauccugucacauauaaauuacuguuuuuaaguaaauaaagagaaaucaaauguuagaaguggggccuuaucaguugaagaaaaguacuguuuuucuuccucguuuccuuauuauaacuguaccauaauuaaccaucagggcaaaaagacaagccacaaaggccucucagcaguugccaauuacuuauuagugacuaucuaucaggcagaguucucauugcaaagcuguucaagcucauuugaugaagugcugcagaaucugauuuguaaucugaaggagaugacuggaggguaaauucuuaggcucaaaaugaccacuugucuuggggacaguccuguauagacugcuaacauggccacuuguccugggaaugguccugucuaguuaggcugcuaacccaguucaucaaccccgguugguuaauacuuuucuguuucugcuucuagcccgagccuccgacgacaaacaaauggcagcuggacaacugguugaccaaagucaaccaacccucagugccccuggauggccgggggagcacagagucuccacaauggcgccaggaaaguaagggugucgcugagggcagcagugaccagcagcauccugauuccaaagacccucucccaaagagcuccagcaagacucuccggggucccucugaggggccccagccugggaagaggggcuguccgaaaucccccgcucaacaggaacccccaccucggcaaaccgugggcagcaaacaacccaggaaacccgccaagggcuccggccaggcagagccccaggccagcucgcaggcagagagugaaguaggaccccuucccuacggcucaaaggagcagacuuccaaagacagacccaaggugaagacgaaaggcaggccgcgugccgugggcagucgggagccuaagccagaggucccugcgcccacgccucaggcagccgugcccagaccgaagccgccugugcccacccccagugagaagaggaagcacaagagcuccacggcccccuccaaggcgcccucagccccccagccuccgaaggacagugcuggggacaggaacccagaacacucugcucuugucuccuugacucagagccaggguccaucccacagcagcaggggcagcaguggcagcgucaggacuaguggcugccgacaggcugugauugcccaaggggacggcuguaaagacaagcuccuguugccuuugagagacaccaaauugcucucgccgcucagggacuccccaccaccgacaagcuugguggugaagauaacccuagaccuccucacgaggauuccccagccucuggggaaggggagccgccccaggaaagcagaagacaagcagcugucagcagggaagaagcaggacucggagaccaagagcugugacagcuccagcagagugaccaagaagagaaaggugggugcagagacaggugguggcauggucuuugaguuguggaagcuugcucggcugagcugccucuccagggcuccucuuggccugcauccgcuucccguccugcgggcugucacucggucaggguaucuugagucacugaaggcauccucuuucugcacaccccacagcgaggcgcagcauuuuuauguuuuaugcagauaugguuuacucccugggugcuguauuuuauccuggagguuccacaaagcggcgcgauaguguucugagucgucugaagaacugugcacucaugaccacgugcuuugucccuagaacuagcuaaggccucuggggagagguagcgaagugagcugguggggcaagcucggcaugcugaguggccgucacgauguguuuucaaggcaaaccuucaugaugcggcuuucuauuaggcaugaugccaguuuggacagugucgucuuccuuuauucaaagggguugagcucuggauuccuggauuuuuuuuuucuuuuucuccuuugugaugaggaaagacucccgaggguacuacuacuaccugcccagaucuuuucacagagcacaagggccaucucugcuuugcugaccaggagaggauuuagcacucuugaguauaagaaagauaucuuacgaggaagaucauguugaagcccagauaguuuauccaccugguuaaagauauaguggcucuagcaaaccgaaaagggagauuucccccagaaccugguugcuggagacuugaauaucugugacccuaucuacugugcccaggugcuuacugaagaaggggcugucugagcugagagaggacagguuuccgugucaggacucuagcugggggacuaggggugagacaguauaugucuauggagcucuguucuggaucgugccacguagaccaggcugaccccaaacucacagagaucaucugccucugccuccuaguuaaaggccugcaccaccaugcuagaaagauuuuuuuuuaaagcuuuuagaaugagauggaauagugugugugucuguccguccauccgccugccuuucugucugagacaaaacuuuaucggaacuugugguggacaugcuuagggaaaagugucccugcagcuacugccugagcgggaccccuacucgugcuggccagcagccagucuccugucacccccaucugagcugccuuggcuuauuuuauguugucucuggcacuaauccucugcuuuucugccucccacuggaguggaaggaaauacagugugcagugugcuuccuuguugguuagagagucgucagccuucacgggaagggggacguggggggcgucuaggcuagcuccuccgcauucugagaucagagccuguccucuggaagcugagccucuaaggcauggcucaagggaagcauucuguucagagcuuggggaaguuuccucaucuccaccgugcacgugaguucugcaaagugucugguccaagagaaacugaggauaagugccaacuguggugccuguuagccaagcagacugugcccuggccucaugugcucugugcacugcagcagguaccugucagggucuacccggcuccucucagcucuccucgccccaccccaucccaaucuucuccaguuugugggcuucccuaccccagcuucugauuccgauagaaccugccauuugggccaugugcuccaauagaucuugguccccucuccuuuuuucucccccccccccccccccgcccccguccccguccccuccauggcugauucagucugcugaccauguuaaguucgcuacuuccucucccuacucuggacccuuccugaugccucuggcuguacucucccucauaugucuacaacaggaagcuucccuucaaccacaccuuggaguggccauguccucauucuagacacaaagcucuagcaaacagccaagagauccagcuugguagucagccuuuccguggugaagaugggacccauugguuuaaauccuggcuguauuaaaguccuggcaagccugaucacuuuacagucaccuagggacagcgggaggaggacucuggcauuuuuuaaauuccuaggcaguccuaauuccguggggcuggaagcagugaagcgcagccuucccaggucccugcucaggccgagcuggugcuuggguagaggagcuguggaggugugcugugagugugguuagcaucgguuaggcauucauugcuucagguguggcauuaguuagcugcuugacugagacgcuuccagagagcuauggauccaaagcuaguuguuguauauuuaccccucagcagagucauguguucucugaugcgguaggccuugcguauguuacccguuuugugcgucaaugccaugacggccauucaggccucccuggcuccuccgguggggucaccugguuugcaaaccugggaaccuggcucuaggccagagguuuaccaacuuuuuuuuguuuguuuguuuguuugcuuuguuuuuaagauuuauuuauaugaguauacuguagcuguuuccagacacaccagaagacuguaucagaucccuuuacaggugguuaugagucacuacgugguuaaugggaauugaacucaggaccuuuggaagaguagccagugcucuuaaccaucucucuagccccugacuuguuuuuuaacaugggaauauuucuccccaaugccuucaucuucagcgugaaagcuagaaaacgccuuuucaagauguauuuagagacauuuaagaguuuuccaaaacguucacgugagugcaguuuauucaaagccccccacccccacccccagcuucucacuguccuacuaugaaguuuaacaaaaguucucaaaggauucaagucuuugaaggcauuuuagccuuaaauacucaagagaauaucagagauuacacaguaggguggggauggaguucagugucugagcaccucucuagcauuauuaaggcucuggaugcaauccucagccaugcaaaaccaaaagccagccagcaagagagagccgauggugcagacagcugugaugaagaggggacuggguuaggaacaguugaugaggcacaguggagaaacugagguaaauacacaagccgagcagugcuucuuuaaacugcuguguacaagugccagcauccacucccuuuucuuaagauuaugacucuuuagggacacagucggagacuucagcucugugugugcgcgcuuuuguaaaugauccauuccagccauuugacugaagauugcccccuucaaauaaguggcuaucuuuugauauuauuguguuggugucaccaguguagcccaggcuagccugagagccaagauccuucugucucagcuucccaagugcugggauuauagucaugugcacagauaaguagacagucuuccuuauuucaauaaauaacgggaugaagaguucacugaagucuuccucucuaacagaauugguuuauuaaucaagaaaccgucauguuuggugggggaaucaguguauuuauauacuccuucauuuauguagacagaggaagggaagucauuguaugacaggaagaggcguguuuuuuuauuauuauuauuauuagauuauuuuacuuauuuacauuccaaaaguugccccccuucccugaguucuucauaucucuccucgcuccccacaaagguguguuucuuaugcuugucaugguuaguucugccuuugacccauccaguuaacuaacgccuucuagguuucuuuucagcuugguuguuuauugacuggggagcauggcaggugugugugguaguggaggcugccuuaaguccgccaguuccugugugucugccucaacugccaaggaguaaagccgauccacuuuccuguccuguggggcuuucuuccuguccucucaggcagucuucugguggaggugugaagcgugaucuugggcugagaggucauaucuuuucuucuuacugaaccuccuucagagaguugcccugaucuucccauucccccccagcuucacacgcaggcaagcuacguugcuuccugugugagcagagccguagcagucccuccaagccaccgcccuuugcugagacccagaaaggcucaggaaucuuauggcuguucaguaguggggugugugugugugugcauuccucccagucuugugguuuguccugucucucgugucucuauagacacgugucucuggggaagacucuugagaggcacaaaggcagagcucucagaucuguauacugacccuggcgauuacacucaccagggcgguuacaacacucuuccuggcuccaugccuccauugcccaauguggccacccuggugcccaugcacucccguucuccaggaucucagguucuuccucacacccucucgucuccaccacuauagccaagcucccaggaucuuucccaccagucagaaccuguggacccuaagugaaacgcuaccuuucgcuuuccuuugaacuacaggccacccucaugaugagcaagguaggcaccaggccaccgccuacccucauggugggccccgcacccgcauggccccaucucuuccuuuuauggccuugcucuuuugcucuguucuuguagguggcgcagcacuuggcaugucacccaacaggcugagaaaagccagcaguucacugagacuugcuggcagccguuggucuuuccugggugguuggauggggaugcaggcaccacuggaaacucacauuccuuaaaguggguugacuggcagagagauuugcuuuuuccccucuuaaagaacauugcagucaccuaacuuuuguguggcuuccagaccuagaaaaagcuaaagaccccaugccuccuauaaauguggcaggccuuacucaugggguucaaguucaauuacugacccccacuaccgugcacccccacuuuggcccucucuuuagucuagccucucaggguuccugugcagccccgccccaggagugacugccacacagcuuggcugcuguucuuaguuucuguaccacuuggagauuccacugcugcucuggggaagccugggccuuuccacauagacaacauggggggggggcacggugcacagggggcccacacuggagccuuuugcuuacuuaguuuaaugccauccuuuccguuaggcguuauguaccaugcuucuguguucugaagugcccauagaaagcuaaugauuuaggagagagguaaauguuagcauuuccagacgcuggccucgaagcugaugucuccugugugcuggcuccccuugugcuugugauuggcagagacuccagcagcagucagacaaagauggacucuuguuuccccucuggacuugggugucugcacaguuugucuuuggccuucccuguuuuccgugaccugccuggaaaauaccuuccacuuagauauaugcuuuaucguuucauguguaaauuaaucucaguggcauacucgagcaaauucuuauuuucuccagcuguggacuucccacuuugaugaaaugcuugucggggcgucuguguggccuucagguggcacaagaaggugcuaaacagauaagagauuuacugucccuguggcagaguucuguuuuagccuuucauuagacaagagaugugugggcguuaccguuguucugagcagagagccaggcaugucguaaugacaccacaguccugcgcucaccaguaccucucacauccagauuuuucuguuagggacugcugcuggcucaugcucacuguggaauggaacuuggggcauuuuaguuguggcuuuaggccuuuuuuaccucacacacuagauuuugcuauuagauuuaucacuguacauuuucugugucuuccauuaauaaugguuacaguuucaucuaaucuguguguauguguagccagacucagacaaaccucacauguuucaucuuaugaaaaacccagaguuuaaaaugcaagacaagcugggugugguggcacacaccuuuaaaucagcuccugggaggcagaggccggcggauuucugugaguuugagacuagcuuggucuacacagcgaguuccaggacagccuuuguguguguguguguguguguguguguguguguguguguguguguguuauguauaagauaaaguaggagagggauuauaugcacacacacauacauaggugacaauguaggagaagggguauauugguaucaucuauauuauacauauaugaaugacauaggacuauauacauauacauauagcagugacaguaggagagggauacuauggaagaaaagaggaggaaccagcaagcgucaaggguggccaagagaagguaaugaccaaaguauauuaugugcaagcugacagugccguuagaagcccguaacuguguaagggugcucucuccaccuguuucacacgcaguccauacaccugagggcgcaccucuaguggucauuuagguccaguugcugugucugcacuucccucucccuuugucugugugaugguucuaacaugucugugucuaucaccugcaauaacagggugacccagaaaaagagcacaguaacaagagacacaaacuggauaagucgcagacugcgucaucuucaucuucccauacagaaucuuccagaacaaagugaguauccaggcgggaacagccugcgacaguagcgggcuccauuugcacuagaaacagaguguggugcuuacucucggccaugggugugcucauuucuuugguggcaaacugagauuuaucaaaaacauuuucacagagcauuuccuaaacaccuagaauuacuguuuauguacauaaaaucaggguuggggauaacuccaggccuugcacaugcuaagcaagguacccugcauccagcugccucuuaccuucaauucuuuuuuuuuuuuuucauagaagaaaauaagaaucaguuguauagguuaguggcagagcacuuuaggauguagcgauccuagcuuuaaucccuaguuauuuagauggacagacauacagacauagaagaaaagcacuaucagccauuuucuucuucucuuccuccucuuccuccuucuccccuuccucugccuccuccuccucugccucuucguccuccuucuacuuuauuuuauuauauuuuauuuauaggcguauaagaaagacgggcaaaauugauucaaagcccugggguagcuacuggguuuugcuuggacucaggacagcucagguucgaugcucugucuuuagagggacagagguaugcccaaagagaucaguaguguugagguagcauggcuauaaagaauaccugucauucaugcucucuggcuuauucacaaaaucgccucacaagagacucggcaaaacacaaguauaucccaaguacuuuuuuuuugugggggagccugcugucaguuaugucacccugccacgugagggugacaguugagcuuaccuguuuguugggguaagguacggauaggugagcagggaaaaccagugauagaaaaugguuaaaaucuuccagguuggugcaaacccuacaguuugguacuauucaacagcuggauuuaauaaagcuugagaaagucccuaaauccauaauuacaugcuucauggcacugcagucuuuugugccggugaccaccuuguccauuauaaacauacucagaugugaugugucuucagcuuccauuguuguuucacaccagagcgcccagguccuccucagagaacucaagaaaggaaaugcugccuccagcaucggcguccucagucuccucuuccucauccucccagaagccaagcagaccugcacagaagaggccaaggccagacgaagacacguguagccaggaaccccccagaagugccagcagcacaaagagcagcucuacagacccucccgcucccaagcacagaaaaguacaggccaggggcucugaacacaagguaagcaaagccgcuagugggucucucacacaugcuggcaaccuugaguuguuuuuaacuaccacaaaugacgugauagcuacucuuauagaaaauaugggguggcguucuuuguuuuuuucucgaagugaucagagauggaaaaaucacagcagcuuucauagugaguuucuuucagauguugagauguuggcuuaagaguucaguucuuugccucuuuaaucucagauacuucaauuauccaucuuaacaggacagaaaucagccacccuggcuuccaguuacacuggugcgugccgggggcagagagaccacucugcuugugcguuauuuguucuuccucacguagaugccaggccacagagccagguacagccauagcuagggaagugguggccaagcuaagcuagccugugguuuuacuguuacccaccaugcacucuccuggcuuuggaaggcuggcgcugcuagguccguggccucucgagcuaacagcacaaucuguggcuguguuuuauagggaucuucuggggaugcugcgaaugcugcaaauccuuuuccagugccuucuuugccgaaugguaacgcuaaaccagggaagccacaggugaagucugacagguaagcccagugucuaccccaccccccaccucccccuuuccuuuucaccucuucuccugccccagguagucauucuuauuuguaugacccacaccugccuuuucuuccuuguuuugcagacaacaagcugacuuucacaugaaggaggcuaaaaagcugaagugcaaagcagagacaauggucagucucuguucccaugcccuugauuaaacagugguuuccauucugcccucaccauacguaugggaauggggcagcggguagaguaaugucugugggugcucugggauucggcagcagggaggaagacuggggaccuggggaccugggaugggguagacaggaagagggugccugcuguuagccacuuguaagcaggauaaucagaugucuuaugacugaggucugaggcguucuguguucuuuggcuccuauaguucagucugaucguguacagguuugcagacuguaucugaguggaacuucaucagugggaugucgguuuaauguauggguacuuuucucaacccacugaaucaguucuugagaugucccacccugagugcuaugcaaggcgaggcagccuauuugcauuccagagugaucuugugcacagaucugaagggauagcuggccucgggaagagauuguaaggugcaggcacuauaaacauguccaaaaacaguggcugucuucaucugccagccucugggcugcuucugaaagggcauguuuugcuguuaaguaugggcaugguaggauuccauuuucccuuagucuuauuuauuuguuuguuuguuuguuuguauuuaguuuuuauuacacuuauuugggguuggggguugugccauacucauaagaugacucucaggacuugggucucuccuuccuuccaccauguggcucccaagugucagaccaugucaucagacuugguugaagcacuuuuaccugcugggccaucucagucaccuucuucauccuauuuaaagauccuggagguuccccagacagauugucucugguucuuugugacaagcugcccccuuguggccaugggaauuuuggccugugccuuucuaucccagguugcaggcccccuuguuugucagauaaaauggucucuggucgccucccaugccuagugcugugaggggucaaggcacugaaccugcucugugcccuggcugugugugcucagucugcaccaagcaggguugugagcucagccaccucuuucacacuucccaagaugcugugggcucauugugacuguuucagguuggguuaggggagagggggaccuauuuugcacuguaggcagagagcaaaaucuuaccucacuuagacacuguuagcauuugcaguuaauacugcagagagcuucggguugcauccccuuccucucuggugagccaggacccucugcuuuauaccuguuauaccuguugcaucuaauuguaaugacuauucucgggaccugccaguucuggaagugaccuguuuguggucucccuccucugcuucucaugaaagaucuuagcccagguuggccucagacauguggccaugcuccugcucggccucugaguucuggagucacugagugccacuguggcucagcuaccacagagcugucuacuuggcguuccagacagugaggugcacagcuggucauggggauguguuucuucuuuacauuguucucuccuugaggagggaauucuguucccuccuagaaccgagauagcugucuagcugucucaggagacccguuagccuuaaggagguagggauggaguaaguuuauaugucccuucauuucuguacuaagggcaguauucauuuuggaaauuccccgagagaaaugguuuuaaguaaguuugagaaucagagccuuggguuuccguacaggaguuaagagcacuugcugcuccugcagagaaccugggcucggcuccccaacacugcauggcagcucacuuugccugcagcuccgggucuagaggaucuuaugcacuccuuuggccuuugcaggcccagcacauguguggugucgauacauaugcaggcagaacaccacacacgugaaaauaaaauaaaauaaaagaggauuggugcuccaccaucaaagcaagcuauuuaucacccacacagcugaccgaggcauacaaauuucacuccuacucugcuacagauuuucugagcuuacucuuuuagggaaaaccacuaaguuucuucuaaaaacugaaaagcuuuggggccucugaaaugcaggugugcgugcuuguguaagugcauggaugugcauggaacacuccacuuugcuccucuacugggaagaggcaccaaaagcagcgggagggaggacuguuucccugcccuggagcagcagcagcacacagaagcccagagcagcugcagacgaucucugccuuccugguuuccaugcgcauccuugcugcuuucaucccuguugaacacagugaauugaagcauuagcaaaaccuacaagccagccccaguuagccagcugcucccagcgugcggugccugugccacgugcagagaagcgggcugugggccacauuuccgcuuaauugaauugacuguaugccacucagcgagaagaucaagugaccaaauaugugcucaggauuaggcagaccaccgguguccgauuuccacauuuccuugaagggguuuugagagucugucccuguuggccagggcauguuuuuguacaaggugccgaaagagaugaacagucuguugggcuccaaaucauuaagugaccaguuacauauuuuauauaaccucaaccuccacaaagaaacucgugucuguccuguuaaugugcugccucguaggcugcaagggugauugggcugcagcugguagcagcacuauacccugcucgugcuuggcggaguucuaagcguugugauuuucuuuucccugguggauuuuugcuagaagacaaucuuguaggucagugcugacugccauggcuggucaucucauucuauucuuccucacccgucuuucuaaucaggugaagacgguggagaaguuacaggguugaaugggguaagggaccgauggcugcccacagccucaugacgccuguguuccucucccacagguagacaaggcuggaaaagccuucaaguauuuggaagccguccucucuuuuaucgaguguggaauggccucagagucagaaagcucagccaagucggcguacgcuguguacucagaaaccauagaccucauuagguaagugcugagguauucugccaccgggccaaaccugucggucuccccaccugcggcuaaagagggggagcccuacaaagcuaaagagggggcccuuugcccuuucuugccugaggaggcccugggugguugguccacagguuuuucacaguuaaaguguguugcauaugagggagcacaggauaacuggaugcaacugugucgucuuuuuuuuuuuuuuuuuuuuaaauuagguauuuucuacaucuccaaugcuauuccaaaagucucccauacccuccccccccuacuccucuacccacccacucucacuucuuggcccugguguuccccuguacugaggcauauaacugucaaguguccugaagagaacgcugagccucucagggagggugcuuuucccagcuuagguuucauaacgggugucuucuuucuccacugugugccccaggccuuucauuaagggcuuaugaggacaccacacuugagagagcaggccucagggccaggucuucugggcggcaugugguugcucuuaacccuuucccugcuggguugcauaccccuucauacccucuagaagacagcagcagcacagccagcauuacaugcgcugccccccccucccccgaguuuaauguucaaugcacuguuuuaucucccugcagguaugugaugucacuaaaaugcuucucagauaacacgaugccagcacaagagaagauauuugcuguuuuaugguacagacuuuuuucuauuuguuguacuaaagcuuguuuagugcuuuuguauaaaaaaacacuaaaguuuuguuuccuuugacuaaaaaaauauuuuaaaaauaucuuccuuuuuuucccucuuauuuugagccaaguucucucuacauaacucuggcuguccuggaacucauuauguagaccaggcuggccuuguagaggaacauagagaccguccugcuucugucucucaagcacgcagugcuguuauuaaaggcacaugccagcacgcccggcucuaacuuaauuuccuuaaagugaaaauuauggcaggagggaacuuagucugacucauggucacuaggaacugguaccuccugucuuccgauggcccaggagaugcuucggucuuaggguuuaagugauauucuugcauuuguuuuucugccaacguuuccuuuggguggugguguaccuacaguauagugagaugcuuaaggggacuugcucagccagaggggagaacccaguaugcucacaggggaggacugggagaguauaucugucuguccacaaggagcucugccugugaggccacccagacagaaccucugguuucauucacagcuugcguugccagucccuuuugaacauggcgauguuucgauguaagaaagacacagugaugaaguauucucguacucucagugaacacuucaagaguacuuccaaaguggcccaggcaccuucuccaugcacggcaaggcaaguguuaagucuuguuaagucaagucgcucacguccggcuucuguggcgguuuaugugugacuauggauuucccaagaucuguguuguucaucuuuuauguguguuggccccuuaaacuuuaaaccguuagcuacaccgucccucugagaaacagguaaacuaaacuuagguugaugagggugacacaagguaccacgggucccucugaucugcaagugagagcuucccaagauucccagagggcugcauaaaauuggagccaaaauuauaagcccucccuaaacugagaagaagggaacaguaagagauuaacaacaguggcugaggaggggcucuggagcagagcgcuugcugagcccaugugggucucucacauccugagcaacagaauccuuaggcugcuuugagaugaauguuacagugugcauuucuucgcaauccuacccaagugcaguuugcuuugucugagacggaaccucacucuugcccagacuggccuugaacuugugcuugucucagcuccccacuaagcaccgcaccucaggaagucccauuucuucugagcuagccauacuuucagagagcauuaaauauaauauggacccauuucuagcaaucaaaaaggagaggcucccuguggcuucuuaaaaaagaacuuccugaugaaggacaucuaauguaggugaauaugucaucgguccucggauuuagcuagggugauuucuucacaccaacccucacagcugccaggaugcagcgguaaugacucucccaggcagcucccucucuugccuuugauugugaggcagugcauauccugucuuuccaucuucugucacgcgcucauaugacugaacuacuuuuucuccuuugacccacaugaaacacgugagcgugcaggacccaggcuaucagccaagggucagaguagagugagaggccucuggcuccugauucacagccacugcccagucugcugcuggucuguugagucucuuguuuacugauccaguaggaguuuuuaggagccaggcucucuaccuuuguaauguggugacccaggguaagaaagaugaauucguagaaagugagguuugagagguggcucugugguauauccacaggucugagaguccggucugagcaguuuacugcugaccgagaggaggaaaguguaaaccacaaguggauacagcucagugaugccuacugaccaugugugaggccucucuccgccucuccuugcugcugccuuaacaggaauuggagagggaggguggugguuccggaagaugaagacuuagcaaagccucagaacgugccaggaacacagaucaguuggucuucuggcugugucuuugaucuuguaugacugacuuagcagcgauuauuguuuugggaagcacacucugaaauucagacugcaguucuagagacuguagucugugaucugcucauuuacgugauuaaccaagucucucuccauccuugcagaagcacaggcguuccguccccccucuccccaaugccuucuccugccagcuccguggggucccaaucaagugcuggcagcaguauggggagcgucggggugacggccaccgucaguacuccagucuccauccagaacaugaccuccuccuaugucaccaucacaucccauguccuuacggccuuuagccuuugggaacaggccgaggcccucacaaggaagaacaaagguaagugaggggcucugaaggagcacucaguguugugacggucggggguacacucugucccaugaagcaagagccacggagagcuguucuacucucuucacuuccgcuucauaaccugguugcaggucuuccugggucagcuagaggacaaaauaugaagccgaggugugcucugucccuugccucagcacacuggggaugaagcagcuccuauccgaggcacacagcauagcaaauguuaccgaggcacauuaggaggagaaguggggacucccaagauuugagucgggggcagugacugccugguguuuuggccagugcccacuaaauaaagcguacacacaccaggugacugguaaacaccauuaaguuuucuuccugguuggaagcaggcagccugcugcucccacagccucucugccuucuuggagaacuaauuaacaccuuccccucugcucucauggugcacagugcaucaguuggacacuuaaaacauaccagccacuguacuaguccugaguuauggauuuaacuuggaagguuccugacauuuuuauuuuauuauuauuuuuggauauuuuauuuacauuucaaauguuauccccuuucccgguuucccccccacccccuucccagaaaccucuuccuagaaaccuuccauccccucucccccugccuccaugagaguguucauccacccacccacccacccacucuugccucccugcccucaauuccccuacacugaggcgucuaucaagucuucauaggaccaagggccucuccucccauugaugccugacaaggccauccucugcuacauaugcagcuggagccacauguacuccuugguugauggcuuagucccugggagcucugggguggggggucugguugguugcuauuguuguucuuccuaugggguugcaaaccccuucagcucagaagguuccugacuucuagucuaguggggaacucugaagaauuaaguagaacuuaacagaagaguguguuggaugaggcgcacagagugugguggggauaccaucucugacuaucuguguuaucguuuuaauuugaucccgugcacguauuuacucgaguuugaccuggauucuguugcagaauucuucgcucagcucagcacaaaagugcguguguuggcccucaacagcagccugguggaccuggugcacuacacaagacagggccugcagcggcuaaaacagucacccaaaggccccuaacguaggccggaccuacuccugccucggagugucucugcaccauuggaagccaugauccagugcagacaacgacugucagaucggaaugucaguacucaacaagagaagcacccgagagauggccgggaugcuuguccacuuaaacucacaacagcuguguggucaucgcucagcgcuggucaucugagcagaugcugcaagauggccuugccuuugccaaccggaggacaaguacaacggagccccacuggcguaugaauggucuagaaacauuucugguuuuuuucuguuuguuugggcgauaggauaaaaauugcaaaugagaggaaaauuucagcaaacucuugucaucucagaagccauccuaguuugcauccggaaggaauuuuuuuuuuaaauaauaauaauuucuggugaagggcuuuaaagauuuuguuuucuuuucaaguuuuaaagaauacauuguuugauacauucugauggccaucuguggaacacaccuugugaaggacuccauugcacuccccuuacugcagggaaggggcucugaugacagaguacugauauuuacagaauugaaggugacaaccccacuccccagugccuagagugcugcacauugucuagcucuggucucucuggcuguccugagaagaaucccuagucaguccuaugggggaguggcagcauuuggaugcggguucuaucucacagucuuccccacaacccuagaggccuaacacuuccuccugacacacgccaccaaagggacuggcuaagcagcauugaccuugggcgaacacaggagccucauguugacuuugggcuguaggcagaugcaguucaucaucugucugcuggagcuggagucccgggcacugacagugcuguggcuacccuguguaucagugagcgaaagugagaagucuuccuagagagguauuuuucugcuacaaguguuuuauauuuauagcaaaacucagcuuucuauccaggauauccuuggcuauccaggggacauuagcuccuggagaggauguggaguuugggggggggggcaggauuaacuucaacuuuaaaaaacaccccacuaucauacaccuucaguccagaccaucuucuaagguaucgugacuugaugagguugaagaagaucugugaccuucccaggcuacaccccacccacaguagaccagguucacuuagaugggaagugaagaauacacucagaauucacaccugcccguaaacacaggccuuuccuugagacuucaagguuacuacuggaauacucucaaguguuuuuaaaaagccaguucuuuuuaaucccuucuagaaagaaaguagaauuugcacauguucaccauggagguguguuacggcucccccugccucucuuuccugccagccaugcuugucugugugcauuuggagauuaguggagaugggagacccaucuuuccuuagugaugaugucugugguccuugugguaacaucaggacuuucuugguaccuugguuaaaucuacacagggucucuaggugagugcgauaccagguuuuucagggcaaacugucugugauacuccuuggucuucucagccuucucuccugguuugaaugaagccagaaaauggcuaccuuguacauaucugaguauagaccaagacggugauccagcuaagcccuuuucuuuauugauauucugaagccaagccaugucugacugagucgaaguguaugguagguggucccuagcacaguggggcuugugggcucaucaggaucuuuucucccacagcccugcaucccuugcagccuguugguuguaaaauggcuaugauccuugugagagguucuggccuacugaaguuuugccagagcauguguacauccugccagcagaucacugugccccuugccuggacagaaucagccaguguaggaagaacaggcugccucauucuuuaauggguggguuuucuccucaguuuuauuuguaccuugaaaaccaaugcaguuggacaggauccguuugugccaguuuggucuguagcuauugcacugcugguuuucccacaacacugcaccuagagagcaugagccuugucugucuucuucaggggaaaaccccagggcuguucugcgcugcuuauuguaaaaccccgaagacucaaauuuuauaccaucugcacaguucacugugugcuuaaacuuaccagaggcaaauuuuccccugaggugauuauuuugggaggacuauaacauuagccccuuugaauaucugauguucuuaaaaccauggaagagcauccaccuuaugggggggggcagcauuuaaugaaugaaucuuccauuugccacuacaaaggguguguguggcccaucugucugggacacaaaguagaggaacacaauaauguuuucucuuuuggaaaaaauuaaaauuagauacauguaaaaaacccuguuacuaaaacagguugcccuugguuaaggugccuagagggcagaccacauggcaguagggaggagcaggagggcccagcaagugcuugcuaauggucccuuacaaagugacauuuauuuuguagagguucugacaaaugucuauccauucccuggaccaccaccacccagccucaucuguaggaaguuucaaacgggcucuuccccaucuuaauugaaaaugugccuuuacuauguugauguuagggacaggaccuuaaguccuacgauuccuguuugguaacuuauaaaaggacuugugcucuugagcuguggucucugaugcagaagaugagagauucagcuagacguauuugugccuuugcugaccaaacauaaauucugaaguuacgcuguuuguuuugcuguggcuuugaguggguucauggguuuuauauguuuccuuuccugcuuugugaaauucgagaugaguugggcuuaaaaaauauuauauauaucuaagaucuuuccauaccucuuacagauucuuuuucuucuuaaugacuuauuucccccaacacuacgaaaugucuuugaaaauuuaccacuucaucuguuaccuucuucaucaaugguuaguauuuaaaucgccucagaauguuuuaggggcuccugucuaaaacacagaaguguagguuuuucucauugaagaaugagcuauggagaugcgaggaucaauuuugaugccccccucccccugccucuuuccccugguuuuggcucauuuggaacuacugggcaagaggacuuuuccuguggaagggaaguguaaggacagacgggcauguguugggauuuugggauuucugccaggcgauccuccauaugcaguccaguuucccacuuacugagagcagcugucugguagccgugccucuuacugaugcauugacaagcaccgcaucaccacauuucuuugagcgacuguaaaauuuccugguuccuugggggugaaucacacucuguucuguuccgcugugcgucagacaucagcaguuacuguggugggcagagaagugccucuuucccuaccuaagagggagccagaggacaggaaggaagcguagagcucucugcaagccuguauauugcuauauuuguccccauaggacaccggauugaggcuggcggcaggcaagccgggcugcacuguugagcuggggcggggggaggggggcagaggcugaccuaaggaagaugaacucacuuugcuuagauguuuuagcaaugcucaguacaggcaguauuacguuugccuuucauucaggccaugacauguauugcuaagaacacugcacaucucaugauaucgcggguacacuguucguggugggguguguccaugugugucccgaauuuuaauuuuuuucugaaugugaucaugcuuuggaugauaccugagcaggguugccuuuuuuuuuuaauuuauuaccauuauauauuauauuauauauuauauauuuucuuucuuaaaauguuagaagucaaaucuugguauuaaaauugcuuuaaaaaggaguauguugucaaggugauaaugagaaucacuggucugccuuuaaugaguuuuucuuuaucauggaauaaugugccagcucugaucagcacagugguuuugugugcaggcuggggaagcagccaggcucccggugaagaugcgcagugcaaauacggggagcaccacagauguaaaaaucagcaucagcaguggaacggcaccccuggggcuucugugaaugggguucaucugccucaugggagacucugaaagggggcagacgugaucugugagaguuuuuuuuaaaagaaacugcaaaagaucuuuccaaagaugaugugccacagaucuuuuguuuuucucuguaacaaggacuaagugcugucuuagaaaagguaauugacuuguucaucuucacaaucuuuccuuuccacaagaucaaacuguagggaaaaaaaaggauauuuaauaaaaauuuagagaaaugauugga

SEQ ID NO: 12102 - RNA, 5934 nt, Mus musculus
cagcagcucacacugaagaagcauccuugcuuggguuugcagucuucugcggcaggcauucucggaggaaaccagccaagguaagccugcaguggcccaugaggcugcaguucuccuggcugaauucugagggugaguccagagaacauucuuucaacagucguauuuguuagucagacucgugcuguucuggucuuuuugaauaagcuggucagguacauugcagguuucccgguauuuucaaagccaguuggauguagaaguuaaaauaaaucuaguugguccucuaaaggagagagagagaucugcuaguaaucucucucucucuuucucucuuucucucccucucucucuuccucucucucccucucucccuccucucucucucccuccucucucuuccucucucucucccuccucucucucucucucccucucucccucucucccucucucuccugucacacacacauuguaaaguucuauguaucuuuggaacaaaugucugcaucauuuuaaaguggcuggaugacuguggagaccaguaaaggaggauccucuauauuaauauaaaccagauacaguuauuuuuagaaaacugucucacuucaaaagagaaccuuccuuaauuucucgcuucugcacuuggcuuuuacaguuuucacuaaggucccugugugauaacacagacucaucaacaugcacagaaaagcuguugccugcucucaguguuuuauuuuuauuauuauuauuauuguuguuguuauuauuauuauuauuaguccaaauagaacaucuuacucaaauucaaagauaucuuuguuucuuucagcuuuguauaauguaaguuaaaaucacauuugaaaugcaaauggaaaaagcaauuuucuuuuaucauucuauuuucucuuuuucuuccuugcagaaaguacucucaugguaguucguugcuuuaauuacucgauuacugugaaacaaaucuugguguggagcucuagagacaucagauagugggggcauaagcucugagacuccagacguaaaguuuggaugaauagaguugugaaauugcccuuuuccuugcuaaggaugagagguggagagguagaaaaggcacacaaauauugacucacugaaauuuucucugagauguagaaagauuccauaaauuauuggugacuugguggugaucuaguggugccaagaguguguuugaaccugacaagacaucaacugugccucauaaaauauguugcaggacuaacuacgaccaugagauuggcagugauuugcuuuugccuguuuggcauugccuccucccucccggugaguacagcugaaucuuagagagaauucuugaaaacaaaugaauuuuagcuuuagcacacucacacgcauuuccuugucacuuuucuguuuuaaaggugaaagugacugauucuggcagcucagaggagaagguaagcaccuccggguugaucauuuaacugaagaauguucgccagcgucgcaaagguugcuaggaacagcaauuuuuuguugccauuuuauucaucuauauaauuagaccugaguauuucaaaguacuuacuauguauuuuagacagagacaguaccaaaucggccauuguuuuuaauaaacagauucucuuauaauuagauuuuuaauauaauaaaagcauguucuagacaauugcuacuuacauaaagcaggucacaggaccuugagugacugguucuuuccugagucagcaugcuuggaaaauccugcaggcugacuuuagaaggucacucagaugucagcuggagcugaucauaugacuaugauauuuacaauaccauccaaguccaucuugaaaagaaaaguccauuugugcuguuuggaucuauuagcugacuuuagaucacauuuuccuaaaugagaaugaaaaccaaaccaguaccuuuacauguuucaacauaagaccagcagcauuggcauaccugugccuccacauagguaagaauaugcugguguaacacagacccugugcuuggacaaaaaggcacacagaguucagguccaaguguagagcgucauugcaguuucauugcucagcgaagacagucagggaagcacuugugcacagaaugugugagcuggugguggggcugccugucuuccaacagucuggagaacaugggugcucaacuacaauaacaagaugggagaauuaacauuuccauacaggaaagagagaccauaacuaguacuuuaaaaugucacaagagaaauauuuuuaaauacaaggaugcauuuuaaaaagaaguaacaguauaagucaucaaaugggauuuaggauguagccgaaaagcucaaaagucaguuuucuagaauuucagcgauguaggagcagaagaaaauauuuaaaaagccuuuaagaauauacuccuaaagauaagcacucguuguucauguuaagguuauggcuuacagagcucuguguuucuuuuuuuaauaauagcaaaugcauacuuuuuuuuuuuuuuuugaaauagcuuuacagccugcacccagauccuauagccacauggcuggugccugacccaucucagaagcagaaucuccuugcgccacagguauuguguuuuaauuucucaaaacugaacagcugggcuggauugauggcagagcuguucuuacagaggacccagguucaguucccagaaccuagauaucaguucacauucuucuuuaacuccauuccaggggucuguuguaguccucugaucuccuuggggcucggcagauacauggaacacuacuacgcaugcaagcaaaacaguuacacacaaaaauuaaaguaaacaaacaauaaaugaacaaaacccuaaacugcuaaugagcagcuacuaaucaagccacacaggcuagguagccggagcuucuugcuuagaagugagugucuagaggaccaauggauaguuugcauccauuguagccuuuguaucuauuguaucaucuggcaggcugaaacaugacaccugcauuaggaugaaaaggguaacuuuagaauuaagcaacugaucauguauguuguguacugauaugugaccuuccuuuuuucagaaugcuguguccucugaagaaaaggaugacuuuaagcaagaaguaaguucucacauucacugagaccuauuuuuagagacaccgaggaagccaccacaucauuuucuucagauugucagucccuuagaaaguauccaaguaaaucuccauucaaaaacuugcuuagaggggcucuguguucauucaucaccaaaauacacaggcucuucagagaaguuuaguguuacagaaagugccuacucgugccugcuauuugaaacuuuaagccucuuguaaaauaugaaaauacgaaaagaaguuuacaguauuuuaacuaauauuugaugacuauaucaucaaugcuuagccaagccaagauacuuuaaaguguucauguugauaauauuaaagauuauuuaauaaguguucuuucccuauuugcugacuaaauaaauaaaaauuucccucaagauuaaauuuaacauagagacaauuuaugauaagaaaaacuagaucaaaagaaccauaacuuuuguagauuuguagauuaauagauuuuaaucucuaguucacuguauggauuuuggcuacaguuuguacacccauguauaacagagccauuucuuaacuaccuuugacaacagggaggcaauuauagauuuugaucuuuauauuaauauacagaugaucugaugucuuagggaacuauguuucagauuaaagaaacucaaucuagcaauuuuuugaauuuaguaaauuaauaauguauacuauuuacaaggaaauauguguuaucaauaugaauguuuuacuuuuaaguuugacuugaaaauaucuaagaaagugauauuuuauuuaaaagacaaaaaaagugccucagaauguuauuucauuuguuuguguguuaaaaagcaaacaagaggcccauuucauuagcuuaaaaccauagaauguaauguaaacacaaagacuuugaaauucaauuaaaauguuucaacgaagcuauuguagucuaaaacccaagcgcuaauuuacugagccaacuugcuuugugauuuagacucuuccaagcaauuccaaugaaagccaugaccacauggacgacgaugaugacgaugaugaugacgauggagaccaugcagagagcgaggauucuguggacucggaugaaucugacgaaucucaccauucggaugagucugaugagaccgucacugcuaguacacaagcagacacuuucacuccaaucgucccuacagucgauguccccaacggccgaggugauagcuuggcuuauggacugaggucaaagucuaggaguuuccagguuucugaugaacagguaaaugaugaacagacauguugaagggcuauggcuugaucucacuucuaggaaaccagagucugcagauucacucacucuucaucaagcacuguacauuuauaugaaaucuacuguaugaccuuugaauacagagcuuuuuuuuuuuaaugguccuguuuaaaagugugugugaugucuuuuuaauuuuaccuaucgcacacaaugucaucuuuccauauucaaagucuuagcaauauuuaagagcaauuuauguuauuaaauagcuacuuuggaaaauagcaauuauauguuaaaaauaauggccauauauagaaaacagucauauauaauggaagcuaaguggguaagaggaauuguaaagucacuguuacaaugaacuuaguccggcuuagacuuagccuuggcguuacuguucaguuuaacuuuaacgcucaaugccuuuucaucagagauagaaccuuauagguuuuaacacacacaaagaugauaucccuauuaaaccagaaaugauugauaugaagcugacuggugaaauauaaaguacacacuaauauuauuuuucuucagucaaaauuuuaaaaauauucaguacaguuugaccuaaaaguuagagaucaaagcauuaugaugcucuuguuccugucuguuuauauaauucuucaauuuguucuugauucaguauccugaugccacagaugaggaccucaccucucacaugaagagcggugagucuaaggagucccucgaugucaucccuguugcccagcuucugagcaugcccucugaucaggacaacaacggaaagggcagccaugagucaagucagcuggaugaaccaagucuggaaacacacagacuugagcauuccaaagagagccaggagagugccgaucagucggaugugaucgauagucaagcaaguuccaaagccagccuggaacaucagagccacaaguuucacagccacaaggacaagcuaguccuagacccuaagaguaaggaagaugauagguaucugaaauuccgaauuucucaugaauuagagaguucaucuucugaggucaacuaaagaagaggcaaaaacacaguuccuuacuuugcauuuaguaaaaacaagaaaaaguguuagugaggguuaagcaggaauacuaacugcucauuucucaguucaguggauauauguauguagagaaagagagguaauauuuugggcucuuagcuuagucuguuguuucaugcaaacaccguuguaaccaaaagcuucugcacuuugcuucuguucuuccuguacaagaaaugcaaacggccacugcauuuuaaugauuguuauucuuuuaugaauaaaauguauguagaaacaagcaaauuuacugaaacaagcagaauuaaaagagaaacuguaacagucuauaucacuauacccuuuuaguuuuauaauuagcauauauuuuguugugauuauuuuuuuuguuggugugaauaaaucuuguaacgaauguaa

SEQ ID NO: 12103 - RNA, 5934 nt, Mus musculus
uuacauucguuacaagauuuauucacaccaacaaaaaaaauaaucacaacaaaauauaugcuaauuauaaaacuaaaaggguauagugauauagacuguuacaguuucucuuuuaauucugcuuguuucaguaaauuugcuuguuucuacauacauuuuauucauaaaagaauaacaaucauuaaaaugcaguggccguuugcauuucuuguacaggaagaacagaagcaaagugcagaagcuuuugguuacaacgguguuugcaugaaacaacagacuaagcuaagagcccaaaauauuaccucucuuucucuacauacauauauccacugaacugagaaaugagcaguuaguauuccugcuuaacccucacuaacacuuuuucuuguuuuuacuaaaugcaaaguaaggaacuguguuuuugccucuucuuuaguugaccucagaagaugaacucucuaauucaugagaaauucggaauuucagauaccuaucaucuuccuuacucuuagggucuaggacuagcuuguccuuguggcugugaaacuuguggcucugauguuccaggcuggcuuuggaacuugcuugacuaucgaucacauccgacugaucggcacucuccuggcucucuuuggaaugcucaagucuguguguuuccagacuugguucauccagcugacuugacucauggcugcccuuuccguuguuguccugaucagagggcaugcucagaagcugggcaacagggaugacaucgagggacuccuuagacucaccgcucuucaugugagaggugagguccucaucuguggcaucaggauacugaaucaagaacaaauugaagaauuauauaaacagacaggaacaagagcaucauaaugcuuugaucucuaacuuuuaggucaaacuguacugaauauuuuuaaaauuuugacugaagaaaaauaauauuaguguguacuuuauauuucaccagucagcuucauaucaaucauuucugguuuaauagggauaucaucuuuguguguguuaaaaccuauaagguucuaucucugaugaaaaggcauugagcguuaaaguuaaacugaacaguaacgccaaggcuaagucuaagccggacuaaguucauuguaacagugacuuuacaauuccucuuacccacuuagcuuccauuauauaugacuguuuucuauauauggccauuauuuuuaacauauaauugcuauuuuccaaaguagcuauuuaauaacauaaauugcucuuaaauauugcuaagacuuugaauauggaaagaugacauugugugcgauagguaaaauuaaaaagacaucacacacacuuuuaaacaggaccauuaaaaaaaaaaagcucuguauucaaaggucauacaguagauuucauauaaauguacagugcuugaugaagagugagugaaucugcagacucugguuuccuagaagugagaucaagccauagcccuucaacaugucuguucaucauuuaccuguucaucagaaaccuggaaacuccuagacuuugaccucaguccauaagccaagcuaucaccucggccguuggggacaucgacuguagggacgauuggagugaaagugucugcuuguguacuagcagugacggucucaucagacucauccgaauggugagauucgucagauucauccgaguccacagaauccucgcucucugcauggucuccaucgucaucaucaucgucaucaucgucguccauguggucauggcuuucauuggaauugcuuggaagagucuaaaucacaaagcaaguuggcucaguaaauuagcgcuuggguuuuagacuacaauagcuucguugaaacauuuuaauugaauuucaaagucuuuguguuuacauuacauucuaugguuuuaagcuaaugaaaugggccucuuguuugcuuuuuaacacacaaacaaaugaaauaacauucugaggcacuuuuuuugucuuuuaaauaaaauaucacuuucuuagauauuuucaagucaaacuuaaaaguaaaacauucauauugauaacacauauuuccuuguaaauaguauacauuauuaauuuacuaaauucaaaaaauugcuagauugaguuucuuuaaucugaaacauaguucccuaagacaucagaucaucuguauauuaauauaaagaucaaaaucuauaauugccucccuguugucaaagguaguuaagaaauggcucuguuauacauggguguacaaacuguagccaaaauccauacagugaacuagagauuaaaaucuauuaaucuacaaaucuacaaaaguuaugguucuuuugaucuaguuuuucuuaucauaaauugucucuauguuaaauuuaaucuugagggaaauuuuuauuuauuuagucagcaaauagggaaagaacacuuauuaaauaaucuuuaauauuaucaacaugaacacuuuaaaguaucuuggcuuggcuaagcauugaugauauagucaucaaauauuaguuaaaauacuguaaacuucuuuucguauuuucauauuuuacaagaggcuuaaaguuucaaauagcaggcacgaguaggcacuuucuguaacacuaaacuucucugaagagccuguguauuuuggugaugaaugaacacagagccccucuaagcaaguuuuugaauggagauuuacuuggauacuuucuaagggacugacaaucugaagaaaaugaugugguggcuuccucggugucucuaaaaauaggucucagugaaugugagaacuuacuucuugcuuaaagucauccuuuucuucagaggacacagcauucugaaaaaaggaaggucacauaucaguacacaacauacaugaucaguugcuuaauucuaaaguuacccuuuucauccuaaugcaggugucauguuucagccugccagaugauacaauagauacaaaggcuacaauggaugcaaacuauccauugguccucuagacacucacuucuaagcaagaagcuccggcuaccuagccuguguggcuugauuaguagcugcucauuagcaguuuaggguuuuguucauuuauuguuuguuuacuuuaauuuuuguguguaacuguuuugcuugcaugcguaguaguguuccauguaucugccgagccccaaggagaucagaggacuacaacagaccccuggaauggaguuaaagaagaaugugaacugauaucuagguucugggaacugaaccuggguccucuguaagaacagcucugccaucaauccagcccagcuguucaguuuugagaaauuaaaacacaauaccuguggcgcaaggagauucugcuucugagaugggucaggcaccagccauguggcuauaggaucugggugcaggcuguaaagcuauuucaaaaaaaaaaaaaaaaguaugcauuugcuauuauuaaaaaaagaaacacagagcucuguaagccauaaccuuaacaugaacaacgagugcuuaucuuuaggaguauauucuuaaaggcuuuuuaaauauuuucuucugcuccuacaucgcugaaauucuagaaaacugacuuuugagcuuuucggcuacauccuaaaucccauuugaugacuuauacuguuacuucuuuuuaaaaugcauccuuguauuuaaaaauauuucucuugugacauuuuaaaguacuaguuauggucucucuuuccuguauggaaauguuaauucucccaucuuguuauuguaguugagcacccauguucuccagacuguuggaagacaggcagccccaccaccagcucacacauucugugcacaagugcuucccugacugucuucgcugagcaaugaaacugcaaugacgcucuacacuuggaccugaacucugugugccuuuuuguccaagcacagggucuguguuacaccagcauauucuuaccuauguggaggcacagguaugccaaugcugcuggucuuauguugaaacauguaaagguacugguuugguuuucauucucauuuaggaaaaugugaucuaaagucagcuaauagauccaaacagcacaaauggacuuuucuuuucaagauggacuuggaugguauuguaaauaucauagucauaugaucagcuccagcugacaucugagugaccuucuaaagucagccugcaggauuuuccaagcaugcugacucaggaaagaaccagucacucaagguccugugaccugcuuuauguaaguagcaauugucuagaacaugcuuuuauuauauuaaaaaucuaauuauaagagaaucuguuuauuaaaaacaauggccgauuugguacugucucugucuaaaauacauaguaaguacuuugaaauacucaggucuaauuauauagaugaauaaaauggcaacaaaaaauugcuguuccuagcaaccuuugcgacgcuggcgaacauucuucaguuaaaugaucaacccggaggugcuuaccuucuccucugagcugccagaaucagucacuuucaccuuuaaaacagaaaagugacaaggaaaugcgugugagugugcuaaagcuaaaauucauuuguuuucaagaauucucucuaagauucagcuguacucaccgggagggaggaggcaaugccaaacaggcaaaagcaaaucacugccaaucucauggucguaguuaguccugcaacauauuuuaugaggcacaguugaugucuugucagguucaaacacacucuuggcaccacuagaucaccaccaagucaccaauaauuuauggaaucuuucuacaucucagagaaaauuucagugagucaauauuugugugccuuuucuaccucuccaccucucauccuuagcaaggaaaagggcaauuucacaacucuauucauccaaacuuuacgucuggagucucagagcuuaugcccccacuaucugaugucucuagagcuccacaccaagauuuguuucacaguaaucgaguaauuaaagcaacgaacuaccaugagaguacuuucugcaaggaagaaaaagagaaaauagaaugauaaaagaaaauugcuuuuuccauuugcauuucaaaugugauuuuaacuuacauuauacaaagcugaaagaaacaaagauaucuuugaauuugaguaagauguucuauuuggacuaauaauaauaauaauaacaacaacaauaauaauaauaauaaaaauaaaacacugagagcaggcaacagcuuuucugugcauguugaugagucuguguuaucacacagggaccuuagugaaaacuguaaaagccaagugcagaagcgagaaauuaaggaagguucucuuuugaagugagacaguuuucuaaaaauaacuguaucugguuuauauuaauauagaggauccuccuuuacuggucuccacagucauccagccacuuuaaaaugaugcagacauuuguuccaaagauacauagaacuuuacaaugugugugugacaggagagagagggagagagggagagagggagagagagagagaggagggagagagagaggaagagagaggagggagagagagaggagggagagagggagagagaggaagagagagagggagagaaagagagaaagagagagagagauuacuagcagaucucucucucuccuuuagaggaccaacuagauuuauuuuaacuucuacauccaacuggcuuugaaaauaccgggaaaccugcaauguaccugaccagcuuauucaaaaagaccagaacagcacgagucugacuaacaaauacgacuguugaaagaauguucucuggacucacccucagaauucagccaggagaacugcagccucaugggccacugcaggcuuaccuuggcugguuuccuccgagaaugccugccgcagaagacugcaaacccaagcaaggaugcuucuucagugugagcugcug

SEQ ID NO: 12104 - RNA, 19319 nt, Mus musculus
ggcgcgcccacgcggugcggccccggagcccucucuggccgugugcuccgcccucucccccuuucagccccgcgacccuccuccccuggccgaacaugggcgcgcgcgcgucccaggagccccggacccggguccgggccggguugcgggugcugcugccgguucugcuucuggcgcugcugcugcuggcgcugguggcuccuggagcgcagggggcucggggccgcggggcugcggacaagaacagccaccggcgcgcgacgagcagcuucucgcagagcgugagcagccucuucggagaggacaacgugcgcgcggcucagaaggugggcggcgcgcccgcggucaccuugccgggccuggagaccguuggggguggggggggcgauccgagcuggggacagucgcggccugcugcagcccggaccgagcgcggcccccgggugcgcgugacgcccgcgcgcuacccgccgcgucucaauggucgaccacuaugagccaggcacuggggacguccggguccccgcgcggcccggccccaugggccuucugccuucuucuaccucuugccucggagauaacugggccgaguucucuuuuccagggagugauggggucugagcuauugcuuuagcaaccugaucgccuacuguguguuugggguggggguggggaaccucuugguuggaaccuuugguucagcuugggagccuagggucuccgggacugggaugagccccuccaccaaggagcucucccccggcuccuccuugguaccuacguugcguacaccguacugaaaaaagagaagucaagaugcacgcgguucuuuugccuuccucucguuuccucccuggucucuggucucgggguuguggaguccagagaacuuuggguccaaguuggggcgcucccucuuuccagcaggaugagauuaggucggugacuucacuugaugugugugaguauggaguccagaagucaaccucagguauucaacuuaaggagucguccaccuuuguauuuugagacaaguuuucuuauuccuccgaaguuugaagaugaggccaagcuggcuggccagugggccucuucgaucuucgugcuccacuuccccagcaucggguuucaagcguucuugggcuuguccuaggguuauacuggaacccagguccuuauaguugcacaggaaguucuuuaucgccaucucuucccagucccagugacuaacuuuuagauauuuuguauuauguuuauuuguugacuguauuacgugugugugugcgcgcaccuaugugcacauguacguacgaaagucagaagacagcuuuaggacaucuuuaaaguucucugcuuccaccgugugggucuugagaauccuuauuuggucaucuggccuguggcaagcaccuuuauuggcugagccaucuuaccugucccuggcuuggaagcuuuuaaaccucaguuucuuuugucuguuaaguggggaugggagcaauaguucuuuucuuacuuguuggugccccugguugcuuccuggcccagaaucaugguucuccaaguucccucuugguguuucuagguuguaagguaauuuaauugaacauugcucaguccugcuggggagauuuagagguuuaaaacaugaaaguuuauugguccuuagcaugagggagaagaacauuaaguacucaaauugacuuuuuuuugagacugggucucucuuuguagguccagaacuuucuauguagaccaggcuggacucuuuaacucagaagaaaauccacuugccucugcuucccgaaugcugagauugaaggugugugcaaccaagccuggguguauuuuuauuuauuuauuuauuuaacaauuugcuuaacgauuuauaauguaugguguuuugacugcaugugugccugcaggccagaagagggcaccagaucccauuacagaugguuguuagccaccaugugguugcugggaauugaacugggggaaccucuggaagagcagccagugcucuuaaccucugagccgucuuuccagcccugcauuucuauuuuugaauuauguguauguguguggucaugugugauuauacacaggagugcaguugcccacagaaaccggaagacagcaucggaugcccuggagcuggaguuacuggcagccaugagcugucugacauaggugcugggaaccacacugaggcugaacacaugcugaggcaucccuuggggggaguggggagagaaaaggaggagaaggagagucuggccaggaacaugcaguuguggggcgugggaugggggagaaagguggcagagagagagagagagagagagagagagagagagagagagagagaagaggcagagagggcaaggagaggccaaacagcuuuuauagcaagccaggucuaccugacuguugcuagguaacuguugggcggagccuagaaggaaugccaauauuaaggaaaaaagggaucguugagaaagagggcaucauuaucaugguuagaccacuuccugcugauuaggggccucaaguuccuugggggcaaguuugaucuuugcugucaggauaccuaauuucuucuucucauuuuuuuugugcacggcuacuagacuaaccccaaacaacagcauccaaccaccaaccagccacacauccaucugugcucuagccuuugaaaaguccccaguccuccaaacauuacacacucauagaaacuaccugcagcugacuaaaccucgacccuguuagggcacgaggcgaguaaagcagccucauauccccauacccaggaugaaaaccaaagcguguucuuauacuauuucuguguuuuguuuguuuguuuguuuguuuggguuuuuugagacaggguuucucugaauagcccuggcuguccugucacuuuguagaccaggcuggccuugaacucagaaauccaccugccucugccuccuaaaugcugggauuaaaggcgugccccaccacgccuggcuacuguguuuuuuaaagaacccaaaaauccucacuacucuccuauuaggcaacagccuuucauauguaaauauuuccccucacugacaaauauuuaguauguggcaaguauucaguacguaguagcuacaagcuagucacacccaacuauccauauucucucuucugcccaaaugagaugagacagagaggaagucaaaaccacagcgcucucucuugcucuccugcucucucucucucucucucucucucucucuuucucucucucucucuccugagucucacuauauaucccuggcuggcuucaaauucagaccucugccuuauucucuugaaacagaaucuugcacugacccuggagcuaccaugguaacaacaauccucccgucuccgcuccugcagcacggugguuacaggaauauaccgaugcagaugcauggccaccccuggcuuuuuagguggaugcuggggauuggaacugaggucgucaugcuugcucagcgagccuuuccuaagcuggcuuugaacucccaacccuuucuugccuccagcuucuaagugcuggguguucaggcuugagccaccauauccagcucauggcaaacuugggguugaacccaggguuccgugaaugaagcaaguaagguaccaauaugacuauaccucucgccccuuaauucuuuucuaguugcgguaauaaaauacccgucgauuccauuucacuguuuucacucaguucuauacaaaagcaugggaacaggguuauacacccauaaguccccaaaggaaacucggucuccacuaagcaacuguugcccuccucugcagccaggcaccugcuggucuccaucucuacagauuuuccuguuuggguuuucacauaaacgggaccagacccuugccugccuuuugagugcagucuggcagcuugcucggcugccuuuguaggguuguagggagcaaaggcugugccugauggaguccaccggaguguguccuccagaugggacccaagcaggaccuuugugggcaggccgugugugcacagacagcuuccacuguagauguuagaaguggauauguugccaggcugguccaguaacauacacccguaauccuggcgcuggggugguggaggcaggaggauugguaguugaaggucagcuucagguacacagugagcugaagccauccugggguacaugauaccaaagguggcgggggggagcuuuuuuaaaaagggcuuauuauuguuuuugugauuuugguuuuucaagacaggguugcucuguguagccuaggcuggccucaaacucagagaaccacuugccucugccucugagugcugggauuaaaggagugcaccaucacugccuggcuacuuuuauuuguguguguaugugcauguguguguuugugcaugcaugcauguaugugugcauauguguguguguuuaugcaggugcccacagagaccaggagaagccguagaugcccuggggcuggagcuaccgggguggugagcugcuuaaugugggugcugggcacugccucugcgagaacagcaagugcuuuaacggcugagccuccucuccaccuuccucuuuugaaauuuuaauguagaagaugugaccaaacugcccucuggauguucuagacuccauuccugauguccccugagcugcaccguguaaacucugguccugugucuccaugucuuccgagagcucugguucuaucauuccuggggcccuuuuuuuucccuuugccaggcuucaguugaacgguuaguuggucuguucuguuuuuauagacccuuucuucuguugccgcuugcagggagguauuuugaggaaaauaauugacagcucccugguccuuuuucucccaccuuaaucauuugagcagcuguauugaagaacauugaguugacgccugcacagacuguacacagggugugagcugacagaggaggcgugggcauucacggcgaugccaccaacagaagagugucuccucuucacauuugcuuguuuacgugugugugugugugugugugugugugugugugugugugccacaguguuugaucagaggacagcuugggggggguuaacauucuggggaacaaagucagcuuuugucaggcauaguggcaaguuccuuuacccacugagccaucucccugacucuucucucucucccucucccucccucccucucccucucucucucccucucccucucucucucccucccucccuuucuuaauaauauuucaaaauacugaaaaauugaaggaguagcauacacccucagcugccuucaucuguuguucagauuuuguuuuucuccaugcacaccgcacgcauacuuucugcaucguuuucuaaacuguuugaaauaagacagauaucuugguaucuucugcacagucuacaaacaucaucccacccaggaaacuuacacuuacuguaguaauauuucacaauagucaggugguauucacauucccuugugugugugugugagagagagagagagagaguauguguaugugcgugugugugugugugugugugugagcacacgcuagcaagcaagcaagcaaacgcaugugagcaugugagcacgcgcgcgugcacugcuugaaccauggcugucauucuucaaccacuccaccuuuuuuuuuuuuaaagacauuuuuaauaaugacuguguguguguguguguguguguguguguguguguguguguguguguacucgagcaagugagugcaccucaggccuuuggaugcuggagggaguugucagauccccuggacguaaaguacagggacaugguggggggacuaagaugaaaagcagccaggucacagucgugcgggccugcagucucagcacccaagaaacugaugcagggguggaguuggguggggugggggugucauugaaaguuugaggccagcuuaguguguguguguguguguguguguguguguguguguauaaucucaagaccccaucuccaauacaccagaaaaaaaaauaggacacaggagaccuaaucuuaaaaagaaauaagccgggcggugguggagcacucauuuaauccuagcacuugugaggcagaggcaggcggauuucugaguucgaggccagccuggucuacagagugaguuccaggacagccagggcuauacagagaaacccugucuggaaaaaaaaccugaauaaauaaauaaauaaagccgggcauguuggguaaucccagcucugaauggauaggagcaggaaagucaggauuugaaaguuguccuugagaggguaaaggcgcuugcggugcaugccuggugagcugacuuuaauccugagacgcccggcccacagaguuggucuuccgccccucauucaugcuucuccccauaauuagcacuuuuuauuauauuauuuuuuuccgccuguuuucuuugguggugacaccucauuucauggcagccugcucuccucuguuguccagccacauaguuaccaugccacuuugguguccuuccuccaguccccugaacugacacauuuggaguccugauguaggacagcucugucacaugguauuuauuggcucugccucccggcucuggacucgcugacacucaccaggaacccaguuaccccagugggugcucagaccaagagaccaagagagugcugcuuugaugccagaaaucugaggucauuguucugauaggcuggcuuccugggacccaaaaaugggccugcagaguugcucuucagucucuguucugauagcugucuguugugugucucugaucuuagcucuuuuguauauuuguuuguuugcuuguuuuuguuuuuguuuuccucccagacaggguuucucuguguagcucugccuguucuaggacucacucuguagacccugcuggccuugaacucacagagauccaccugccucugccucccuagugcugggaucaaaggaguccuccaccacuaucugccuuuuuauuuuucucucucucucucuuucuuuuuuuuuuuuuuauaaugagacccaguaccuuauaugugcuaggcaauucuaccacugagcuacaccaccaacuguuuucuauuuugagcccgggaucucacuaacaccuccuggauggccucagacugaucguucuuuagcccaaagcagguuuggaacuuguugucuuccugccuguuugugaacacaaagguccuugcgcucacagauaagcacuggggaaaccaggcauguuaaacacacauguucuuuuuuuuuuuauaaccuguuuucugcccagagggcuggcaauggagguugguaagguguagaggccaggcgauaccugguuccccacaagcuaccacagccaggauuagaggugcccaauagucuagauggucucugcauugucuauauggccagggcuuuccccaggcucccacaaacaggaccagaggugguugauagcccagaugaccucugggcuguauguaugacggagaccacagcagauccuccccucggccauuaagaaaauaauagcucaccagaggcaggucgaucucugggaguuucaaggcuagccuggucugcagagaaacccugucucaaaagcgcaaacacgugaagguaaagccuaucuauaaagcccaucuucauagaagaagcgacacguacuuugagaauaguuuugguguaauugucaugccuccuugaacaccuaggauuguguuccaccaggaacccguuuuguuuuuuuuuuuuuuuuuccccaaauuguacuguacuuaacuaugccuaaaauaaacuuugugaugucagacagacucuagaugguugaaucaacccccgcugcugagucgugcugaaucagguuuccuuccuugccucuuguggauccugggaucauucauuggaucuucacuccgccagcccugguguaggcagagacaccuccccccaauacccuucccccugcccgcuucacacauccccugccucagucuccugaguagcugggagacaagccugucccacugacacaagccuuuaccagcucacuucuuuaaagacccugucuuugaacauuccaucacuggggaccaggggcuucauauuuagaauacagcugaacccuaucaauucuaugaagucuaugggucuagcuuugccggagagaucugcauguggcugaagggguggggaccuccccuggcguguccuccccacucuuguccaguucacagccugagggaagaaccucuggucuggauuugcccucccaggagccuuguuacccugucacucacugcugacuggaccaggugaccuaccacaaaaaccauuaugcuggcuuuuccuguuuuucuuuuuuaagauuaguuuuauuaaauggugagugugugugcuugugugcacaaauaacagaggacagaagaaggcaucagaguccccaggaacugggguugcaggcaggaaugagccuuuucaccuuccuuuguugaauccucucugggucccauuuuccaacugggaaaaccaagguccagcauggcucagaauguagcuuacccuaaaagaacugcacacuacuuccugggcuuuggugccaucaaagccuguucugcugccuagccugcugcucuagcuccauccuuccuugugauuuuuuucuauuuguucucucucucucucucucucucucucucucucucucucucuguguguguguguguguguguguguguaacaugagucucaauguacaaguuuuguuugucccagaacucacuauggacauguagaucaggcuggcuuugaacugucagagucuaccugccucuguccccagagcauuggaauugaaagugagaacaccacuaugcuagcuuuucguguuuuucuuuuuuaagauuaguuuuacugaauugugugugugugugugugugugugugugugugugugcuuaaguauacaaauacaagaagaaggcaucagaguccccuggaacugggguugcaggcaguuugagcugccccguuuuuguaauggugggagcugaacucaggaugucaugaguugcuaggaaaacuuacaucucagcccugguuucgaguuguaggcuacguguguauaauaucacuguuaggguugcuguggaaagggguuauuugacucgugcuuucauauucauuauugaaguaagucagggcaggaaccuggagacaggaacaggggccauggaggggugccacuuaacuggcuugcuuuccauggcuugcucagccugcuuucuuacagaaccuagguccaccaaccuagggauggcaccacccacagugggcugggcccgcccacaucaaucacuaauuaagaaaaucgcuuuacaggcuugccuacaaaccugaucuucuggaggcauuuuucuccauugagggucccucucugaugauaucagcuaugccaaguugacaggaaacuagccagcaggauuacucacucaaaagagaacaagagaugaggcaggagcucgaacucccgauuuccuggucuccuggcuuucccaaauccccuggagagccauagacagagagcacggucucgggcuucccagucaguugguccuuugagagccaacuggccaaggaagcaucuugagagcacacacucccagauacccugaccaagagccagcagaacucuaggggaagugguaggugcagugcagccagauuguggugugugugugugugugugugugugugugugugugugugugugugugugugagagagagagagagagagagagagagagagacagacagacagacagacagacagacagacagacagacagacacgggcuuuccgcauucuccauggugguggaccagcuaucaacccuuguucgucacuuggcuacagacuguccccaaggcagcuccugguuuuccuguccaguccucucccgagcucacacuucaguaccugaguggcuuuugggaggacaguggauugauugguugauuccuuacugucuucucgucucugcaguuacuguccaggcugaccgagcgguucgugcagggaguggacauguucuuagagacguuauggaaaguuuggauggagcucuuagaaguccuugggcuugacgguagguacggggaugguugugcaagguguuuggguugcgagcuuuuguuuuggggggcugucucacuauguggggagucuccguguccuuagcugagagaacaccagagggcugaggguauggagcaccauggggaggaaggagcauuuuacuuuuaagagcugaaccuguggucugugaaacuucaaaagcuguguggguacccggugguggcgcacaccuucaaacccagcacuugggaggcagagacaggcggaucucugugaguuggaggccagccuggucuacagagugagguucagaauagccagggcuauuaaacaacccucucuugaacccacccccccaucucaccccccaaaaaauacugugcagacaauggagguagagccugcagugauggugaccugggccaccuggagccucuggaagccagaagagggcagaagaggcucccgagaguccucacacagguaugcuguaugcagggcuguguguuucagcaugccagagguagagucaguagagaggaaagucacuuugggagcacagccguggacuuggccuuuuggcuccuggaacccggagaggggaugaaccucaccaucuaagguucaucagauaccugguguauggggcucaguuguggcaaagccagaaaacagauauagugacguaacaggauccucucaaaauccguuagccccaggcauccuucuuuacgguucuaggacccgggcucaugguggagucagacugcaccagccgggacccacauaccaccacaauggucugcucuuuaccccucaccccacuuccagccuccacucaccgagucuaaccuucgaaaggccucacaucaggucgugucaccuugccacucaggaaguagagagguggcccucagaaugcugugaggcacgcggcccacccuggggacugggcugagucaacauauacccaaacguugcaacugcaugcaauccugccagggcuggcugccucagccaugaccugcugggauugugcaacuccggguuaccaucccugggcagugagccuguggagauaaagcagauugcaaggaauugcaugcaguggggucugggagacagcagagcgggguaacacaggacccugggcaucacugaggagacuuggccgggugcuauccccugaugccuuguuucugugcugugagucucccucuugguuugaauaagcugcagggcaccgaaggccuuugggaaccgugacugaagcucagaaccagggucgucuucaagguggcugcucucagcucccaguauuuucuuccccaucaguuuucagaauguuaguuacaauggagaccccucugcucagauugguuugauagcaguaagcuuugagguauauagaggcacucuacuggucuaguuauagggaaaagaaauuggugaaauuuacccuggcaugguggcucaugccuuuaacccccauacucagaggcaggcagaucucugugaauucaaggccagccuggucuaugugaggacuccccaucucaucucaaaguuggugaaaucaauuuuacuauuucuguuuugcugcuuuuuuuuuuuuuuuggucaugugugugugugugugugugugugguuguuauuuugcuuugucuuugagacagggucuccuguaccccacacuagccucaaauucacuaugguggaaccaaggauggccuugaacaucugauccuccugccucagcuuccugagugcugggaugacagaugugagccacuguaagcagucugaggguagcuccuuguaaaaugaggaguuugaacuccagcaccauuuuuauaaaaaugggucucuguguguagcccugacuguccuggaacucaucuggagaucaggcuggccuugaacucacugacguccaucugccucugccucaugagugccagguuaaaggugugagcuaccacugcccagcuuguaaaaauauuuuucuagguuuauuuauuauuuguuuuuauguguuauggguguuucauacaucugugcacuucauguaugcagaaccuaagggucugucugacauugcccugucucuggaguuacagaugguuguugggacucaaacuagguccuugcaagagcagccagugcuuuuaaccacugagucauuucuccagucccauaaaagguguuuuuguguguguggggggggggggggagggguucgagacaggguuucucuguguagcccuggcuguccuggaacucacucuguagaccaggcuggccuggaacucagaaauccgccuuccucugccucccaagugugugccacuacuacccagccauaaaagguguucucaacucaugaggauacuaauaguccugagagaccaccugugccccucaaguauuugcuuuauuuugcuuucguugugucggguugugaccggagccuauggguccggccccagagcucagcuguccuuccugcuuuccgagaaggucccgaccacgugggaauaacuggcccuguccucuuuugcaguguccaaccugucacaguacuucagcccagccucaguguccaacagccccacccgggcccuggugcugguuggugugguucuccuggccuacugguucuugucucugaccuugggcuucaccuucagccuccuccaccugguguuuggccgcuucuucuggcucgugcgugucauccuguucuccauguccugcguguauauccuacauaaguacgagggcgagccagagcacgcagugcuaccgcucugcgucgugguggccaucuacuucaugacggggcccaugggcuacuggcggggcagccccgguggccuuugcagccccaguguggaggagaagcuggaacaccuggagaaccaggugagguugcuuaacauccgccucaacagggugcucgagaaccuugaccgcuccaaggacaagugaaggucagcugccuagccguccaaccagcuagugaugucaaaagacagaagaagaagagaagagccggcaaccccaccaaaucccaacccucccaauaaacugagcaaaaacgccacgccugguauuucccacugugugucgaccuuaggagccacuggaggagagagcacuuucguagaucaccagugggaaagcaguuuuuaaacaacggauauacccccuguuagcuguguagucggauaacuuuaccugugcauagaacauaauguugauuuuucuucccaaacauuuaaauacaucuuuuguaagguuuuuaaauaaaggcagauggagucaaguuuaucagagcuuugaagggaacgcuugacguccuuaaggagguuaaaauuggcuugugggugagcaccgugugcaaucucuucgucuucccgaaugugaccuuuauuucgugucuucugggguugguggugaccugguuaacaagugcugucucuuguucuuguggacacuugggcuucagaggauuggauccuagggauccugugagcucuucguccauugugccccuccaugucuauuucuguuuuguauggugcuggggauacugagcccacccccccacccuuguccauuguauuucugaaugaagguacccacagacgucccgagaucucuuucucuucucuggacuucaauguagauuaacccuagccuuuccaggaagaaaggacauggauggagcugcaaacugucuuuggaguuugaugcuaagaaccggguaggccccgaagaucauuccagaauccagcugaaucucacauucccuguuggccagcgaggcccagauagccggcuggacccucaugggaaucacuuguuuccuuugcuucuaauugacucgggaccauagaagaaaaaggaaccguucacggccaguaacauccuuuauuucauuccuucuagaacauucguaggcauaagcaaccuugagaucugaaucguuuguccugaaauuuuuauaauuguguuaggugcuuuuuaaagucugggguccagggcauugcuuguuaauagcuaaaccccugggugcagagaccucucugccagcuucuguggaaagagagcuggcuuuugugggaugucacuagggucgcccgugaggacuguggagccacugagucccaacuugagcuuggagggggacccagcugauggcagcucuggugccguaugucugugaaguucugucuuugguuacagguaucugucacacagauuugggucuuugaggauguggccgagagagaccucuguucucgaggugacaggcaguaugggacucucauuuucuugaauuucauucccuucuggaaccgguacuggggaaaucucuccacagacauuggaaauccacaacuugugaugugaaacauuccgauuuuguuguuuagaugcucuaggcauaucuacucgcggcacaggguggaaguagccgagaaggggcaccuuggcuguuaauaucuuuccuuccagaugucuggucauaucauacuaaaagauuacuuuucagauguuggcuagggggcagucacucucuguaaagcuaaaccuucuugccuuggcuccucucaguggccacuugagauguuguaggucgauuccuauacaguccacuguagcuaagacugcaacuccacccaguauucaggaggcagaggcaggaggauugcugcuauuugaaggccagccaggucuuaaguggucuauuucaggucagccaggguuacauagcgagaccaaaagccagguaugguagcacaagagagcagaggcaggcacaucggaguuuaaagccagucuggucuauguagugaguuccaggacaggcaguuuuaauacacugagaccuugucucaaaacaauagcaacaaaaaagguaaaaaucugcaauauuuuuuuccagucugaccaaauguagacucuaaagccaguuuuauaguugaauauauauaauguguauauacauauauaugcuauauauauucauguauuauuuguauauauacacuauauauauacauacacaagaugccuucauuuuaauuuuuacaucuaguuauuaugauuuuuugagacagggucucauguauuuaagacuggccuugaacuugcuaaguagcugagacuggccuuaaacucuccugcccccagcccgagugcaggaaugaugugcacaugugacuacgcccccauuguucgaacgccuuggggugaacgcggccuaugcauguuaagagagcacucaagaguccaguccuggauaccuucauucuuaguggaagaauguacaaaucagaguagaauguuacuugaaauucuaguaguuuuuuuguuuuuaaaaacuucaaccgggcgugguggcgcacgccuuuaaucccagcacucuggaggcagaggcaggcggauuucugaguucgaggccagccuggucuacagagugaguuccaggacagccagggcuacacagagaaacccugucucgaaaaucaaaaaaacaaaaaacaaaaaaaaauaaaacaaaacaaaacaaaaaaacuucagaugguguuacuguguuugaugcauauauuuuagcuuguuuguuuguuuguuuguuuguuuguuuuucuuuuugaggcagggucucucuacauagcccuggcuguccugcaacucucuguguaaaccaggcugcccucuaacuugcagagauccaccugccucugauugcugguauuaaagguguugcaccaccaugccuggcauuguuuggaaguaaucauagcccccaguaguuaaagauuuuuuucuuuucuucuuucauuccguggacagcuuauuggccucccuucccuucccccucccccuaucucuuuuguauguggaaagauguauuuuuguaccuuauuucaugccuuaucuucagggcuguguacaacuccuccuuaaccgaauaacaugauaaacauuuggacagcagccacuguggaucuauuauagauaaggggcggggcaggcgauauggcucaaugaagaaaggcacuugccaccaaaccugaguuugauucccgggaccaacauggugaaaaaagacagaccacucccacagguuuccuucuaaccucuacgcaugggcuguggcuucccaccccuuggccccaauaaauacauauauacuuuuuuuuuuuuaaaugaaaagauaguguaaggauuauaacugucucaaagucaguauuaacucccugguggucgucucucauauuagguacuugcuuuaccgaggacaggacugguugccucugaaguguacugacugggcuuagcuuaggguauugggguuggugauuuuugauggugguguuuuauuuugaauuauuuuauguauaugggugguuuuuuuuuuguuuuuguuuuuuuuguuuuugucacacuuguaugucuguguaccacguauuugccuggugccugcagagaggagaagagggugucagaucgcccuggaauuagugauaacugucagcugccuuguggaugcugaaaaagucaaacccagguuguuuggaagaacagccggugugcucuaaccacugagcagccucucuggcccuaugguucgggguuuuagagauggcaucucuuggacuccugacuggucucgaacaggcuaugugguggagaaggaccuugaacuccugaucucgauccuucuggaugcuaggauuagagacagaugcuaacacaucugcucgggauggaaccccgggccuccuacauuuuacauaagcguucuaccaaauuagcccggucccagccuguagucaguguuuguauaguggucucuucccuuuucuagucaggaggcuguugguauagcacacagacaccuuucacagacucacuuccuguuguugcuagcaucccccacccuuugggcccuuuguugaggcucgacccucuuucuacuggcaauaaguguggaaaagaauguccucacagcuggccuuuugacccaugauaggguccucuaauucauaaaagugacccagggacgagccuaagaggcagccuggggaugaggcucagcaggccacaggggguuaggagcagagcugugaauaagcaaccaggaaggcaugucuuuccuagggaccucaugagaaccucugagggaagguugggagcauuguccuauggcccuggcacacucaagggcccugugugugaagagcucugcuugcucacgugguccugucacuccggccugcucacagauggcucggaaacagcgugaccaggaagcccgaugugcuuugcaaacccaggacucagucuccagauagauaggaaggugcugaguucaaagccauccuggucuacguggcaagacccugucucagcaaacuaacccaacauguucaagagucagcacgagaaucuuuaacaaagcuccucugcaucuugugcuugguaggcagccugaagcacuucccuucuucacaagcccuguugcuuuggucuguucugagacagggucucaaucuagcccaggcuggccucgaaccuagagaucugcucgccucugccucccaaguaccaggcuuaaaguugugcaccaccaugcccagaaagccagcauuggugagccuggugcgcaccuggagcuacaaggaauuuccaaggcgacccucucagccucuuuaccuucaaguccugggcuccugagcucugcccccagcaugaaagcugcuuucaaagcaaccugugauaauucuguaauguuuuugaguuugaccauuuauguacuugggcuuugggcuccucaccugugaauuguagauuucuauuuugcggguuuuaacccaauacccuugucacuggcuggcaucagcaagcuucggccuuuuugcuuccuucuguguuuugcucuuuggugguccuuccauagcuaggacagacacggagaaccugucuuucaguccugauggcacaaacagcacauuguugcugccaccgggacagcuacggcagccaguggcaugcccgacucuccgcccgaugucucugcggauuucaagcuuaugcuguugugucaguuuccugucugcaucugugauaaaucucuaaauauccuguaauuaaauuaauuucuagugacagugaucaaugugcaguuaaaucccccaagagguaauuauuucccuguuuuuagcugcagauuaaaaaaaaaaaacaccaaugacuucuucacaguugaguuucuguuuugugucucagcuuaggaaauuuuaaauaguauuuaguuugacacaguagaaagaaagccauuccgugugaacauaguggggugugugcacacacgcacaugcgcaaacauuaauugggaagcugauucuacgaauaucuuauauagggaaaaaaaagcgucaggcuuaguauuuuuuugcaaagugauggauacauuccucuuauuuauuaaucacuggcuugauguuagaggucuuuguagaucgacuuuaagaauuggauuaaaauauugugaacauugcggcuuaauaaauguuuacuguggugauguucagacuccuggauggauuucuuuacuuuggugaggcacuugaggcaaccuccagaauuagagagucauuuuauggcuuugguuuauuucuuuaucuuaauguguaugacugcuuggccugcgugaguguauguauacuuugugugucccuggugcccuugauggucagagucccuggaaacggaguuacagauguuuaugagccgccauaugggugcugggaagugaacccgggucaucuacaugaauagcaagugcuuuuaaauauugagccaucucuccugcacuaaagauuaauuuaaaaaaaaaaaaaagggcuggagagguggcucagcgguuaagagcacugacugcucuucugaaggucccuaguucaaauccuagcagccacaugguggcuugcaaccaccccaccccccaacccccguaaugaggucuggugcccucuucuggagugucugaagacagcuacaguguacuugcauauaauaaauaaauaaaucuuaaaaaaagauuaa

SEQ ID NO: 12105 - RNA, 1646 nt, Mus musculus
gguggugagcaguagcuugcaacuuuuauuugagaaaaacagcagguaaauguauguaucaaaagagcgcacagauugacagagagggguggccagcaauggcuaugggagauaggcagcaggcugauggcuucuacuuggcuccagacuguucagacuucccagcuucugggcccccaauuugggcgcgggccucgaaaguaaccggaauggugaucuccgcugacugcgugacugcuuugggcaacggagccuccacgguaagugugcccucaggggauagggaagaggacacuagggugggguccacaccuggagggagccuggacacacagaaaaucagggcaaggguuacacaucccuccugacccggggcucuucgcccuccgcccuggguccgcucccccucccccccaccuccccgcccuccaugcaaggaaucagaacucacguguauuuccgggugaagcaccgagagauguagccauguucguccugccuuucuucgugcuugccuguggguggggacagaaggucagaagcagcccucugcuguccuagcuaaggaguggcugggaccccccagggaggcaaacaaacccgagugcggcggggugccugacugucuggaaucuuaaaacuuuccagaaacuucccuucugagauuugggaugcgaagggcuuggcucugacccagacuuggauaccaggguagguauacucaaagccucugcggcugggucuagggacccugauccugccgcuugcuuauuugggaaugaggucuuccagaagguguguugggucuuccuucauuuuguuucugugcugcggguggaacgcaaagccucaaggccucccggcaggccaggcgaagcucuacccugagcuacauccccagcuguugguccauaucaucgaagaugacagagcuuuuaagagcaaccugcaccccgcguuccggggcaagagaagcaggcaaaggagaaugaugcgggcuccgggucccuagguucauuucuaacuucucaggguucuauuccucaggguuucagcccccacccucagccccccagccaccacucucgccucggcagcuucguccccucugggcacaagggaaacucaccagugaucuccaccacgccuuccuuggucuucacugugagcuccuccggagcgaagugguugacguccagggacacgcgccagcgaucagccgucugucggaucuccgagaccccgcugcugagcugucgguugagcgcucggcugaaggcuggugcggccagggucaccgccgcggggcccucggcggucgcggcgggcagcgggcgcacguauccgggccacccagcggcgcugaaccacugcgaccacucaucgggcaaccggggcaccccgaaagcuugaucgaagaggcggcugugugcaggguaccagucccggaaugguucccagcucgggcuccgcagcagcgagaagggcacgcggcgcucggucauguucuuggcuggucaaggcugaggaucuagaagcacugggcugaggauccgagaagugccggacuggagccccagcgugcuuuuaugugugcccagccggguauuuuuagcaggcggugcuucaggucucuauuaauggca

SEQ ID NO: 12106 - RNA, 312865 nt, Mus musculus
gagggagaucugagcggcugcugcagcaccgggcuccucaacugagguaagggacccgguggcgggaucugcgagcgccccaggcgccucgcgcccugcccgaccguaacgaggccacgggagggagcugucugcugccaucgacacgcaugcauucugagucgguccugucgcgcgccuucccuuugccgggucccccgugucucccucccggggccgcucuggacggucucccaccccggugucccgcugcagagccugggguggcgggccuggaccgggaccgggacgggggcgggggcggaggggacagcguggcccacugugggcugaagggcucccgggguuggagucgguuauuuuguaggucccagggaucgaacucagguugaccagucuugguggcaagccccggugagcgcugagucgcaugucaggcccacugugugugugugugugugugugugugugucugucugucugucugucugucuguuuguuuuuggcaguacuguugauugaccaaggaacuuaugcauucuaccacugagcuauguccccaguccuuuuaaaaauuaauuaaucggcuaauuaauugauuuguguguguuugcauauauauaccaggcuuccugucgagguuggaggauaacuuaauucucuucuucuuccauauggguccuaaagauggaaccuugcuugucuugucuugcccuaaagugccuuuacagauugaguuguuuucaguccccauucucgcagagcaguacgcuaagcagucaccuacucugcugccuccucagcccaauccuuacuuuuucuucuuaauuuuuauucugugauggggcuucccaaguuuuccgggcugaucuugaacuugccaccagcccuugaauuugucucagccuucugaguaccugggaugacagaccugugucaccaagugcuagguucucaggcugucccuuggcugaaaccagaaagaaggugugugugucccuguuaacucaggagccauccagagcagcugguguccuggaaagucugcugucuggaaguucaggguucuuguggagaggguacaacuugagguggcgcuuuaguuaccuguguggugucguggcuucugaaaccgcagcccuucauucuuguguguuaauggcagaguucuuguguugguccgaagagggaggacagaaagugugucuuggugagcaaaggcccacuucucccacugugccuguuguccaccuggccacuagcuucgcuuugucauauguguaauuggggugcacaccacgguucuuguaagugggaaauucagaagaaauuucugcaaaguuaccccccccccccacacacacccguuuugagauugggucuagcuguauuuuuagguuuuuguauaacccaggcuggcccaugacuugugaucuugccucagccccucacauacauuccucuucucaaggaccuuucuccaacugagaaaugcuuagacuccuguacuggcugguuuugugugucagcuuaacacagcuggaguuaucacagagaaaggagcuucaggugaggaaaugccucugugagauccacuguggggcauuuucucaauuagugaccaaggggggagggcccguuguggguagugccauacuggacugguggucuuggguucuauaagaaagcaagcugagcaagccaggggaagcaagccaguaagucacauucccuccauggccucugcaucagcuccugcuuccugaccugcuugaguuccaguccugacuuccuuuagugaugaacacauguuuggagguguaagcugaauaaacccuuuccuccccaacuugcuucuuggucaugauguuuugugcaggaauagaaacccugacuaagacaacuucuuugcugcagacucucuccaacaccuuaccuggucuuucagucuaaccuggcgugacauauauucagccucuccauucuguccccaguggguugugaaggaguuuagacagcuacugaggcagugcagacuccuuccauacagccccacugguucacucacuguccccugggcugacucuaacuggaaguuguaggacagcucaggugaccuccaagagaaagguuaugggguuacucaacucucaauagaagacugaagaggcuugggguccccugccuaccaccaucguggcuucugaacccagggcgguauuguuaguugcuggcaagucugggucuacuuaucuagacuuaccagaauauuuuggaccugucccagaguccucuguucuagggggaccaggcaaucguuuguggguuaaaggcuagaauguugccuagucuggaugugucugcuuuuguuguccucaugugucugaaucccagggugucaggugucacagugugggaaucauuucuuuccucccuccuugggagucaugggacucaaacucaggucagcaggguuugugggaagcaucuuuauccacuaagccacuuccccagccccacaccagguaacccacagacauuaaaguuacagacaucccacauagauuccaugaucccaaaccgagaagagacccaaccagggucacagaaucccagccauguccucugccuuucugccugacuagaugccaucugucacugcaugccucucaaggaccucaguacaccuauuuccugagugucugcacucugcaguuuuucaguucucuagcuccuggcuucagucugacagcuggaugcugcucauuguccuuauccaggcgucuugugagagcccugcucucccuuugcuuggccuccaugcccaugggagggcagcaguccugccagugcagcgcaugugagccccgugagucagcguguaaguccccaccucacuuacuugacuccuucccuggcccaucccaguccccgaucugaacagagccuucgguuugcccuucucuguccacugacuguucuuucagaaagcccauggugagcuguugcugccugucuccagcucagcuacauagccucuucuggcuacuaugcaccugucaugcaggucccagccuuguccuccccccugcuggggugggagugggcauuucuauccugaucauucucaggcuccuuucccugggaauaucugcucucuguaacuucacugaugcaggauauuugaucacagugugaaccccaagauguguucuuuuuuuuuuuaagauuuauuuauuauuagaaauaaauacacuguugcugucuucagaugcacuagaagagggugucagaaucucauuacaagugguugugaaccaccaugugguugcugggauuugaacucaagaccuucggaagagcagucagugcuuuuaaccacuccagcccccaagauguguucuucacuggaaaaaccuguuucuaguugugguguggcucagcccuagcacacaucuuuaauccaagagcuuucugcuuauuguaaacaggauaaaauaaagucaagagguggaccaagcauccagcgugaccaggagugaacauaggaaaaaaaucauagagaguaaggggaaaucaggaggagggauagagagacgcacaggaagcagaagggagggacauuucagugcgaggguuuuugaggugguguggagaagaacugccuuuuucuucuggggcaucggcugaggagcaaggucagcuaugugcuuuuucugucuuucugagcuggcaggcuuuaccccagcaucuggcuccugagucuauugguaaaacuaagcauuuaagauuuuguugaaagcaacccuucccccuugagcuguguccugcaguuaucagagcauugcucugaaagcucgcccuucagauguuuagaugcacagugcaaggaucuccucacugcucaccguggccuucgagccuccugccauccgaaccucagcugcuuucucaauggccgacccuggagaugcucuuggucuaccggccucaagcuugcucacuuuacuuacuuacuuauuuauguagaggugggggggucucucguaaccuuggcuguccuagaauucacuauguagagcagugcucagaagaaagacaugccccgccacacccaagucauggagauagagaagaguuggggcugaagggcucacugcucccauccagcaaaccaccagcugcucccuccagugucacacuccgugucagaagcagauauuaaauuuucaauacccauugcugggccccaucuguaaugccacaguguggaaguuguccgugggcucugucagccucccccaccucacccucccguaggugcucuccuaauaaacccaugcuacuguuccugccugcgccuugucuuguuucuucaccccauacacccugacuuaacaggcagccagcucagccagguauugggccguaaugagggcuucacacaagcagagcaaaugcacugugugccaccuuuuugagaccaggucucacuaaguugccaagucgggccuugaacuugugcucaugccuccugagugucugggaugacagaccuguggcaccagguuuuacuccuccagcuaugacuuggcugggggccaaaagacaguguucacugacucucagccuacagacuaggcagagugcuugccaagucugucccucacccuucccaucugagucaaagggugguucugcugaaagggugagguuugaauccgugcuuuauguggcucuggagcagccugacucuuggagguugaacgcagucucaggcuagccugggcuggauagcaaaaccaagucuuaaaaagaaaagaggggcccaccaugguggugcgugccuuuaagucuaggcacucugugaguuugaggccagccugucuuacauagugaguuccaagccaacuagguuuguggccugagagcuuauauuaauacaaaacaaaaacccacaaacaagauacuaaaaaaaguuaagacccaaaguacccaauauguaagaagccuggguuggcccacgugcuguggacugagccagcguguguaaacgccagcagauggagucuccccuugagaggcaguaguggcacccccagcauuggcccucugacuccuuuacaagguccagguggguuuaugggcaaguaaagugaggcuuugugagggugcuaggaaccugcaggacccucugugugugcgacccagcugagggcagugggcagcacugcugguaacagcauugcuggggccacaguugucugacuguuucaugcuuguuucugacccccagaggccacauuugccaugagugugacuuugggguggggagugcccuugggccucugagcaccuccucucaggaccuggaaugucugaugcucagucaguagucuggagcugaagauuucuaguaugaacguuucacgaucuuucucucugucugucugucucucuuuguauguaucugugugccauggagguuagggaaacuguguugauucuuguuuuccauuuuguuagagacacaauuucuugcucugcggccugugagcucuggaagauucuuuugccuccaucuuacaauuugcauuaggagggccggcauuagagacacucgccaccauguccagguuucugggaauucaagcuuaagccuuuuucuuguaggcacaugggugcccuggugugagugaaggacaguggugcugcccaucugugggcuccuugguuggagcucagucauugggcuucaucgaguuuaccccugagccaacucacucaccuggcuucuaaguuuacuuuuauuucugauugugugcaugucugugugugcgugcuucgggaggccagaggucgccggaugcccuggaacuggaauugcaggcaguuauuagccugguguagaugcugggaacuguaagaacaggaaacauucuaagcaaugagcucccuuuuuauucccucagcacuuucuggaugggaucuuucugugcaguccuggcugaccuggaacuuucuuuguacuguguagaccaggcuggccuugaaugcucagagcucuuccugccucugugugaguacugacauuaauggcuaugucaugccccaccccuuuuuucaagcagggucucauguugcucaagcuagccucgaacucauguagcugaggcuggccuugaacuucucccuugauccuccugccucuaccugcugauaucauaggcauguuguguggugugcuuugggccucauuuccucuccacaaugcuggcaguauuggcuucauguuaauguugaaaaccugaucguuuacuccauaaggguguuagugggugggcugugccagcagacagcacaugggaaggcugccucugaccuuugcucugucuucuagaaggaggcugaccauggaagaccucggggagaacaccacaguccucuccucccugagaucucugaacaacuucauuucucagcgaauggagggaacaucaggccuggauguguccacgucugccucagggucccuacagaagcaguaugaguaucacaugcaggugaguggcccucugugugucugggaauacacuuggcuuggaggccagaugaauguccugcagacuccuggaggcauuuaucaacuugagcaguagcuagagaccagggccgggcagacgguuacugugauuuguagucuuauuucacucuguucuaauuccugguaguguuccuagggauauaguuccagaggggccagggcuccugaaagaaggguuucccagaaguggcagccguagcugcaguugggguuagggcuuugggccgaggagagcaguugccuugccugguccucuuggcacacagugaccgugcaugcacgaugccccaggcaucuuugcucacucuuuccugucccucgucugcucugcugcggcugcucugugaugaggcgggagcagacuggacagugccugugagacauucguuguugacugucccagcaguacccacacucagcuuuuugguggcaggcauugucuuuccuugugaguaggucuuuuaugacagucuucuguuguuaaguccuccucuccgccaccccuuucuugguaacacucgguauugaacccagggcugcacuugcugaacagucacucucccucugagguucaucuucagcuuuauuuuauuugaaaacauguuuuuagauuuguuuuacuuuauuugaguuaguguuuugccugccugcauguaugucuauaucauuccuggcuccucucuaauagcagcaaguuccuucacuacugagccaucucuccagcuccugcauccucggcuugaagccacuauuuucugaagcgauguugccaauagaugguaguugugucugagugcuagugaaauaagaagggguuacuguguucuuaaaaaauacucccucuugaaaaaccaaaagccauccccuuccucuccuucccucccucccucccucccucccucgcucccucccucccucucuuccucccuccuugccugccugccucccuccuucccucccucccucccuccuuuccacaacugaaccaugggccuuggauacaggaggcagcccuccaucccuguagugcaucuccagcaccauccuuacucuuuauuuugagaccaguuucauuaaauuguugagguuagccuugaaguuacuguguccugggcugaccuggucccugugauccguccucaugccucagccugagguggcagacacacacucccacccacaaugcauuucaugacgccucagcuugugguucaguaggaggaagauguggagcaggcugucugaggucccgggugcucuguggugcugcucccccaggcugggugucucuucuguaaaagcuucagccugcugagacccaggacagagcugggugugguacaccuugggagauagaggcagaagcguugugaguuugaggucagcuaggcugcagagcaggacugugccggugaagccaaacauggacugugaagggacuucacccucccaucagcagguagguguggaaaugagaacaagggcagcacuuugugggcuagggagaugacucugggugacgugcuggcuucacagacaugaggaccugaguucagauucccagcucccuugugaacaucuggcauggucacaugucugaagcccacuucucagagggggcagcaaguacagacaggaggacccuggagcucacuggucagucuaauggaauggaugagcucugcguccagugaggaccuuaagaaaauaaggugggggugaucaaggaaaaugcccagauugaccuccaaccuccagguguacaugcccacucgugugagcacauacauacaccacaagugcauauguaccccagaugcacggguggagggauggagaaggcugggcaucaggcauagcaggcuggguaguuuguagugugugggauccguagcaggagcccuggcuucuacccauuaggugucaguugcauauacaccucuuaguggcaacuggaguguuucagagucacaacauuucccucucuagggagccacugccugagucugaaauucugguuuaaaguguguaugagugcuccuaggaugugucuagacaaaauguugcuuuagugagugagugcguccugaggaucugugagcacccagggcgugcuguggagugggccauaaggcucccguggacagucccaugucacuccaggacagccaguggcacuuccucuaggguucuuugagacugacugacucuugcuuaggcacuccucuggcaguugagguuuuuuggcucuccaguucuggacuuccagcagacacuguugucugucuucugcuugucugggcauuagcuaaguguuguaguggacugagcaggugugccaggucucuagccagccuucugaucaggggagucucuggauugacucagugacagaguuugugggcuuggaggugcaagccugucaucccagaacuugggaaucgaggcaggaggaucccagcaaguucuagaacuugccagaacuacagagugagaccuugucuccaaaaaaaaaaaaucaaaacuaaaaguuaaucaugguaugguggcacaagccuaucacccaacuacccauagagacaaggguagagacaagaugaucaggaguucaaggccauccaugacuacaugguaaguuugaggccaacccuaguuuugaaagacuaagucagcugaugguggugguacaugccuucaacucagcuccuguaaccucagcuacuccagcuauuccagcuacuucagcuacuuuggaggaucccaaauucaaggcuugccuuggcaacuuggugaaaccaugucucuaaacagcaacuacaacaacaggcugguguggcucagugggagaguccuugccuccuaugugugaggcagguucaggguuccauccucuaaggaaaagacacacacacacacaccacaaggcggggugugugugugucugggucuaagccucaaacucaaagcaggagagagagaggccacaguaagggacauggccacaaucaucccugguugacaucucagcagggaaguggaccucuguccucccucagugggguuuccagagugaggcuuuccagguguuguccuggguugugcagaaauacaggcucaagcucccaguaacacaagcuauggggaaacaaauacacccaagaacaagcuuagaacaagcucacaugugucacuuuccaagccaucuuccuuuuucuucuugcccuucaugugugcacauauggaggccagagguuggcauuguaugucuuucuccauugcucucugcuguuuugagauggggucuuucgcugaaccuggagcuugccaguucagcugggcuaccugggcuagugagcccucagcuccuuaccuccaccuuucuagugcugggauuacagaugcucacagcugcaccuggcuuucucuuucuuccaauuuuuuguuuguuuuuagagacagcaucucuauuauauagcuguccuggaacucaagauccaccugccucugccuccuaggugcaugccaggucugugggucuuucuuuugugugggugaugaggaucugaacuuagguccucacucucaugcggugucuuaguuauuuuuucuuuugcuaugauaagguucccugacaagagcagcugaaggaagaaaggguuuauucugcugacacuuaaggguagagaggccaaggcagcagggucuggaagcagcuggucacaucccauccacaccagggagagagggaugaguguaugcugcuggucagcccgcucuccacuuacacagucuagcaucccagacagggagugguacagucuucccgcuucaauucaagaugcuccacagacaugcucagaggcccaucuuccagcucacaauagauccugucauguugacaauuagcacauugcacccuguuccuuuucauaugucuugcugccucccacacauuuccaaguaggaacucaagcuuuugacagugccuugcugggacaggugcuugggcagugugcacagguucagacauuugcccaccuaccuucuuccuuccauucuuccucccucccuuaguuguuuuuugagacagggucuugcuaugcagcaguccucuugccucagccucccgcauguugcccuugcagguugucacuugccuuauuugacauggcuacugaacccucucuuuucucuuuggguaccaacugcucagcuggaggaaagagcagagcagauccgcucaaaguccuaccucauccaaguggagcgggagaagaugcagauggagcugagccacaagagagcccgaguggagcuggagagagcagccagcaccaaugccaggaacuacgagguggguccagcccagggggcagagggcugugugccacacuugucagaccaccaaacugggacccagcugcuguggucagaggccccaggcauucuucuguggccaccuaacacuagcagguuggagaaggguggccugcuauagggaugucugcagaguggacucuuugcugugucguuugcucagugguccuguggugugggcagaccugccucugacuggcuucagucauccuguggugugggcagaccugccucugacuggccuguuuccucuuugcuucagaagaauuguagugcuguggaagaaauauuaggugcuggaguagggguggggugacaggcucaggaaaucucaggcuugcagagagucuuggggucuauguuguauucuaccagagccucauuuuguaaugguccugggcaacucagcggugcaacccugggacuugggggacauucagugcaggaaacuguaauucacuauuuauguguguguugguguggauguaugugcaaagggcauaggggaaccuuggugucauccuuaggaaugcuacccaucuccuuggagacagggacucucauaugguguaggccagugagccuuagggaucccccuuucucugccucccacagcagagaugaaaugcacaccccauuauacucuucacuuuuuacauggguucuggggaugaaccugagguccucaggcuugcccagcaagcacuacugacggagccaucgucccagcccuugcuucagauucauuacuggcuuugcuggcgcuuucuaggacucugauggguaugugagugucacugugacucaggcugugcaucagaccucagaguuuguaaccuuccuuccuucccugugaugccaucuccccuguucuugucugaugugccuaucauaacuuuuccuguccuugugggaauggcuggccucuucccuggugugcugcugguugggcagauuuaagucugaguuguagaguccuggcccuaguguacugucccggcuugucucucuguuaggguucugccugccugccugccugccugccugccugccugccugccugccuuccuuccuuccuuccuucuuuccccuccccuccccuccccuccccuccccuccccucguuccugugacagaguaccagacaaagguaaaguuaggaauggcuuauucuggcucacaagggugcagucugucaugucagggaaggcacggcagcaggauccuuaggcggcuggucacgucgcauccacagucaggaaguagaggagguggaugcuggggcucaguacuuuuuucuuuuuauuuagucugagacccagacugggaccagacugccuguuucagggugggucuuucuuccucagguaaagcucuguggaaacaucuucauagacaucccugagggugugucuucuaggacagucaaaaucucgcuauuugacagucaaaauuaaccguaacgaguagaucuguggcacucuggccuauguccugugcugguggccugguccugccucuuaggcagagcuuguuugcugcugugcaucuccagugugcagugcugauguggccucaugggcauggaggacacuucagugagcaagggaaggcuucuccugagggaaagcaggcaucgccgugaugagagaaagugaggccuuggcccuucugucucucagaggcuuguccucuguucugcuuagagaugcucuaagggguggggugagcugugaggugcuggagaugucagacugucccuuggagucuugacauuuacaguggcuuuucugguauagcucaagugaugguggguagauuagacaggucaggugccccuuccaccuugaaauagcuacuugggaugaggcgaaaggucagaagaccugccugaacaaucuccuuccugaauugugcuggcaguaccaguagagugcucucuggcuccccaguacucugauacauuccccacucccccugacuuguagaggggucuuccugcuguuuuaaggcuacacuugcaguugcuguucucuuggguccuuggguccuuucaaggugugguucagucuuccuucuuccuagggguugcagcccccugugugugcauugagucuucauugguuaggagcugcagcacuguuuuaggcacaggugacaucuacucuccuggaguaggauuggcuguugagguucuuggaagcucugaguaggagcuuggguagguggugucugcugaggacagagagugacuguucucaguccuguccugcccaaacucaucuggggaaguccaaggaggccgacauaguaaugguagucaugaugugacuggaccuuagugcuguccuggggauuagugugcuggcccugaaggugugugugauaggcacucuggacaguaauggcccugccugcagcugccauccgugucccuuuccuaacuguagucaucuucucuguggggagucucaacgcauuuuaaugacagccugagcauggccagacaagaucugcuggcgcugcagaagcuucauuccaaggucaagucugaauuguagauuuuccaugcuuuaucuucucuugcaaggaggguggcggugagcagacagugugacgagugacgaguguguagugcgguccaugccaaaucccucagagugggaguccccaugcugccgcaucaggagcccugguauccgggucuccugccugcucaugcauuuguccuuugugauugauaggccuaccuggcuccucugugcacuacacucccugaccaggcucuuccuucuccacagcgcgagguagaucgcaaccaggagcuccuggcacgcauucgacagcuccaggagugugaggccacagcagaagagaagaugcgggagcagcuggagcgccacaggcugugcaagcaaaaccuggaugcugucagucagcagcugcgggaacaggaggacagccuggcuucggccagggaggugagcgccggcccaugccggccggggaccuagacucacccggguacagaugguuguuuucuaagaagagugcauguacccguaauucaacauggugacagcaaggcaagaugugugugagcaugcccacaugugggugggcacauuauguguguguguguguggccagagaccaaccuugucugguuuuccucaggugccaucaccuuguuuuuguuuuauuuuauuuuuauuuuaaagauuaacuuauuauauacaaguacacuguagcugucuucagacaccagaagagggcgucagaucccauuacagaugguugugagccaccaugugguugcugggauuugaacucaugaccucuggaagagcagucauugcucuuaaccgcuacucuccaguccauuguuuuuauuuuuaauuauacauaagcauauggauaugugcauguuagugcagguucccaugaagacuaggcucucuuuguggaccaggaugguguugaacucaugccagaaaugggccagccucugccucccgagugcugggauuaaaagugugugccaccacgcccugcuuugcccguuaauuuuaaauacauccauaggagugacgucauuuuugggcugugaucauagugaaaauacugauuuuuccauccuacaggaucagugaguaugcugagcauagguguuguuugguuggugugaggcaaggucucagguuguagcccaggcugaauuggagcuugaggcgguccaacuaccucagucucuccaguccugggaugacaagugugaacugcuccaaguuucugacauuggucuuuguaaaugagaauuucauaacuguccagacauugauuuuguguccucauacauguuugguacauggcuuccuguguguacccauugguuuccccaguguugcuucauuuggguaaacggugcaggacggcaggccucgggcagcucccuggcugcuccugucaccugcuggucuguguuaccagccacugugacugagguauuggugucccugucaucuugucugucauggauagggaauguucuguaaguccuguuuccuuucuuccccagaagauguaagacugugucuguggauuugcaugucuuugauuagcaguguucuguuagcaucagagacaaccuuugaagcagggcgcaggugcagcacaguccagggaagcuggugcugguguguuuggagguugccugagugaggguuuggagagagucugucccccuccccugcuaggccuccuacccccuucugugguguucaagaucacaggugccugaagggggcagcugagagcgccaagggccagccgcauggcgucauugguauucuguccccacaccuucuccacuugauagauccuuggagcgggcugcgggcuauuuuugccucuguagcaggggcuguggagggacacagcuuacgcccuguuccucauggcuuacucagccugccuuguagcacccaggcucgucugcccaggguggcaccaccacaagugagucaggccacuccuuaccaaucaccaaucacaacauugccccuuagacccccccccaggugagucuggugggacauuuugucaguugauguucugucccuuauccaaggugacugacacagagcuagcugacauccuuagcuuaucacacggugcugggaucugagcucggcaccuuguguuugugcaacaagcacuuuccugagggagccuuuccccaguuuccugauuuaaaaacaagcuguauuucauuuuauuuuauaugaaugaguguuuugcuugcuuguaucuaaguauacuauauacauuccuguugccacagaggccggaagaaggcguuagauccccuggcuacuuugugggugcugagaacugaaucuggaaaaguggacaguguguuuaacccgagccagaucuccaggcccuugauuuuuguuuuuguuuuuguuuuuuuuuaaagauucuauuuauuauauauaaguacacuguagcugucuucagauacuagaagagggcaucagagcucauuacagauaguugugagccaccaugugguugcugggaauugaacucaugaccuccggaagaguagucggugcucuuaacugcugagccaucucaccagcccuguuuauuuauuuauuuuuuugagacagguucucacuguguggcccaugcuguccucagacuuacccuuuaacucaaccuuagacuugcaucccuccagccucaggcucccagggguuaggauuaaaggucugcgcccugugaucugguuugaacaugcucuuuuuucauuuugcuucuuuuaaguuuauucaugcuagcaugacguguguguguguguguguguguguguguguguugcaaauguggagcuuagaggccgauggugaaguuggcuuucccccugcuuuaugugaguccuuucugaguggccagugcuuugcaguugagcugucccaccagcccuggugauugucugccugucucccccuucuuuucuuucuuuuuuuaguuuuuuucuuucuuucuguuuuucuuuuuuucgugucagggauuuauguaguucaggcuggccucaaacuagcuauauagccaaagauaauguugagagacuuuucucccuaggcuaugucugcucuuccccuguaagggacaaaagacacucguggggaagcagugaguuuguuagguuuaugcaugugaauauaggugcucauggaagcugugugcuggaggcauuguguuccccagagcuggcauuacagacaggugugccacccggugugagugcuggggacugaauccgggugcucuggaagaguaguaugugcucuuaacaacugggcccuaucucuguuuucaacuuuuauauauaucuguuuucaacauucauucauucauucauucauucauucauuuauuuaggauuuuucgagacaggguuucucuguguagcccugguuguccuggaacucacucuguagacaaggcuggccucgaacucagaaauccgccugccucugccuccugagugcugggauuaaaggcgugcgccaccaugcccggcuauucauuuauuuuuuaagccaagaucuuacucuagagcgcuggccggccuuagacccauauaguucuccugcuucugccucugagcgccaggauuagagaugugugccuugugcuuuaccuucuuuugaguuuuuauuuugagauagguucucaguaagcugcucagauuggcuuugaaccuacucuguagccuucauggcgauuaaacuuuuaacucaccugcuucagccucccaaguagcugucuuaacaggccugcuucaccagcugagcucugaagcuaaguucugaugaugaccuacaucuuggccaggaccuugcugucuuuccauccuggguuacguuauguuggaauguugacaugcagaugcuauggaggcuuggagugugauggagguccgagguguggaaaaugcugaaguagacaugugggguccaggaugcuggaugugguacccuguauggaggcuaauagacuuuagaguaucagacguagcuaggaccagcuucccuagaggcucugacccucaucugugucagugguguggagcacaaggcaggcauugagccgggaugcucaugagagacaguguugucuacucgccacaugcuucgaggacagggggcucuguucuguccugagcagcacauggaggcacacugcccuuccuuucucuuuggucucagugagggagagcugugcuuggguacuuuugguucauugucugcgugcaguuggggccucacugagcagccaguuuugcuuucuuaacuuccagaugauuaguucauugaaggggcgugucucggagcugcaguugagugccauggaccagaagguacaggucaagcggcuggagucugaaaagcaggagcugaaggagcagcuggagcugcagcagcggugagagccugaccagucgcuaagacaguccaaaggcugcauggaggacacagcgaggccucuggacuugggaagugugugucagaauaagacggugacagccucguucccuucuuccugggacuggcuuccacagagggacgaagcuacgcuagguuuuugagggcgugggcugcugugcuugggcaagcuguucuaggucacagaggacacagauaugugguagcuaguggguggcagucaggagccuuuggauucugccuugaaggucuggcccuuacccuagggcaggcauugccuuaggauuguacccuuagugugggcaggccuggguggccucugaugcuugcugugacgccaggcuagcagacacuguggauugagugguggauagagaacuaggucgugccacaggaagccugggcucccuuguagccccaucagacaaugucacagucuuaaagguuggcuuaggacuugagguucccuggauaagggguguguguguguguguccaggcuagggguaagguuaaaguggcauuauggacugaccuugcauguacuucucucacaggaaauggcaagaggcaaaucagaagauccaggagcugcaggccagucaagaugagagagcugagcaugagcagaagauuaagguagaugcuuccugccagacugugcagcuuccuauaccaggcaggggugggacagcccuccugucacucacacaccuuccugccuagacgugugcucaguggcauaugaggaugcaugcugauugccuuguggaugccaggcccugugcuggcuccuuggaggccacagugagugcucaagugccccagugaugacgacccacuagaaauccaugggaaaaggcuaacacagaggacugcaaucuaggcuuagagagcccagccacagaggccaagaugagacacuaugaguuugagagcgagugcuccaugaaguagaguuggggguggagauccugugcaagucugcacagcuaagcauggccgagcgagaucaccacuccagggcucugauuuaaguucagccuccuuuauucugguggguguugcuggagaggugccgccgccgagaccucccuuccaugguuuccuguugccuuuacugugauagccaguccugggaaggagacugugucaguugucucccucucuguguggugugagcaccaaggcaguaggcucugcuccuugugccucuggcacugcuuuaccuggcucuguugucuuuuggacuuauuugcuuaaagaucaauuuuuauuuuuauauguguggguaugggugucugcagagaucagaagaggccuggaauuggaguuaagaugcuagcugccuaaccagaugcuaggaacugaauuuggguccucuggaagagcagcaaguauuguuaguugcugagccuucucccuaggcccgaguccaaccuucuuaccucucacaauucccuugugcauagagguugaccaguuggucuucucugucucuuuguucccacuacuugacucuaccuggauggagcugggcucuaugaaggguccugaucaauuguuuugguccugguuuuauauauagcuuguucagugacuugucacuagguuccugugcuaccuuguugagagucauagugacaggugcaguguagguacgccugcugcacagugggaacagaugcaaggguugcagguucaccacccacguggcagaagcugaccacagcgggccagaggggccuguggcacugaaccguuggggaccagagggcuggaugguguguggccaggcacaggcaagagggacagugguguggguacuggcucuugggugcuccagugcugcuccagaggugguguugaggaugcagcauagcggguuagccuuggaacacuuccuacacugucuggacuguggagaccauugagguccuaggacaaguuagaagaccuuugcuuugcuuaaaaaaagaaaaaaaaaaaaaaggaaaaaaaaaagaaaaaagaaaaaaagaggcagccgggcagugguggcacacaccuuuaaucucagcacuuggggaggcagaggcaugcagauuucugaguucgaggccagccuggucuacagaguggguuccaggauggcuagggcuacacagagaaacccugucucgaaaaaccgagggaaaaaaaaaaaaagagagaagaaaagaaaaaaaaaaaagaaaaaagaaaagaaaagagaaaggcuuauuuaauuaaaaauuagguauauauguagguauguauguguaagaaugugugugugaaugcggguguacgggcaugccagagacgucauauccccugggccuggaguuacagauaguugugaguuugacauguaugcugggggucaguguuguuccuuaggauguuaucuacuuuuuucuuuucuggacaggucugguuggcuuuguuuuucauuuaaucuaucuaucuaucuuccuuccuuccuuccuuccuuccuuccuuccuuccuuccuuccuuccuuuauuuauuucugcaagucguucuauguagcccuggcuguucuggaaaucacuauguagaccaggcugaccuugaacucacagagauccacuugucucugccuccugagugcugagauuaaaagccuguguuacuauaccagucuuuaaaaaaaaaaaaaguguguguguguguguguguguguguguguguguguguguguguguuaggaagcauugaggggauuuagggccucauacuuucuugcauggcaagugauuacugaccgagcagguucccuagcuucugacaccuccauuuuuuugugucuucucuuaaacugacugucaugaucuccaugucugucugucugccuucuccagaucauuccgugguugaagaccugcaugucuuucagcccagccucucuguuuuacagaggcugugugugcaguucuucuggcugcuuacucucucucucucucacaggaccuggagcagaagcugugucuacaagagcaggaugcagcuguggugaagagcaugaagucugagcugaugcggaugcccaggauggagcgugagcugaagaggcugcaugaagagaacacucaucuaaggugagggcucaugcacagccugcugccccuaguugguaguugggcccugggcuuggugucccuggggcuuguccuccacgugcgugacuguucuggcccuguagggagaugaaggagaccaaugggcugcucacagaggagcuggaaggucugcagaggaaacugagccggcaggagaagaugcaggaggcucugguugaccuggaguuggaaaaggaggugaguagugggugaguugucucuccggggccguccucugcccuggccggagcacccugagcaucuccauuacaccuuguaguuggucagcuguggggaugccgugcuugugugguggguaguacagucaguuaugagauucuccauuacacguuguaguuggucagcuguggggaugccgugcuugugugguggguaguacagucaguuaugagauucuccauuacacguuguaguuggucagcuguggggaugccgugcuugugugguggguaguacaaucaguuaugagauucuccauuacacguuguaguuggucagcuguggggaugccgugcuugugugguggguaguacaaucaguuaugagauucuccauuacacguuguaguuggucagcuguggggaugccgugcuugugugguggguuguacaaucaguuaugagauucuccauuauacguuguaguuggucagcuguggggaugccgugcuugugugguggguaguacaaucaguuaugagauucuccauuacacguuguaguuggucagcuguggggaugccgugcuugugugguggguaguacaaucaguuaugagauucugcagucacugcugccuguugcaaauaggagcuucuuugauuaaagcucacagugauacauauuuuaugggcauaaguguagcugcuuagaaggcaacuugacagacucacuacacacaauagcuguugcuucuguacugaggucuguccucagccaugagcuuuugacuggguuuacaguaccagaugggguucccucuucuggagugagcaucaaauccaauuagaaagcaguugguuacccugguaacauaccugccauuguugcacauguaggcucauuuuggcugcuuguuauugugcacacaggcucuaaagcuggguaagacuguuaaagacaguuuuucccaucggccugcauaguaucuugcagaccuccaaagacuugcuagcagggaggaagcuucuagcucaguucuagcuugauuuaucuguucuugauggcaugugcugucuuuagcaacaacaucuuacuauguaauucugguggucaaccaauagcaauggcuauuuuccuacauuguauuagagccucagaagccucuccuuuuguuuugagauggccucacucuuaaccuggggcuagcuaauucagcuaggcugggugaucagugagcucugccuaucuguucuccuccagcauuggauuuuagguguuuguucuaugcccaguuuuuguuaaaugagcauuagggagugaaugcagguuucaugcuugugugauaaucuguuugcuugacugaaccaucucccaagcuccaucucuggcuucuuuuagaaguccaagccagaugaguuucuguuggcaccagagaguucucugugaccagcccgugcugcaguuccuaucuauuugugcugucccagacaggccucucuuggacacuggcuuuauaggcaaaaagaccuggaacuucuuuuguccuuuccucuggcauucuguccagagagccauucuuuuauucuugcaugagggaguuaaguauagagcaagcaaagguaaacgagcaguauaauaagcagcagcuagagaugcagcagacagugcaaagcagcucacugagagcuuacagcaucccacagagacagcucagaaguccugcuggggucccaggagacuguuguggguacagugucucugcauggcugaggcuuucggcuucacacucccacaacaggaauuuuuauaccaugaauaagcagugguuaccuuuguuggaugcuucccccuuuagcuauuuuuuuuuuuuuuuuuuuuuuugguuuuucgagacaggguuucucuguauagccuuggcuaucccggaacucacuuuguagacgaggcuagccucgaacucagaaauccgccugccucugccucccgagugcuggguuuaaaggcgugcgccaccacgcccggcuccccuuuagcuauucuuaagcccccaccccuagccccccagacaggguuucucuguguaucccuggcuauuuuggaacuuaacucuauagacuaggcuagccucgaacucagauccaccuaccucugcuuccugaguuccacuacugggcaggcaccaagauuuuguaaugucauaauucauagcagcuuguaguucucguuucuccuuguugcuggaccaggggccagccugucccagaucuugacauaaacugguuggacucugagauaaugaaggccaccuugguccgugagcccacuuucaugagcccaaaugucaugcaaacagcacaugacauuuaccaacauaauuuauaucacaccuggauguaauguuuuuuguuuguuugucuuugacaguuuugagguuuagggcgcuuagcuugaaguccuauauggaagugugcuugcuguugacacugggucuauccaugcccaccugugaaaaguggucagggccuagcugggaacaguguccuguaaugcuggugguggaaaaguuaguagcugagcagcugucccacccuuuuaaaguuuuuauuuuauguuugugugugugaguauguguguguguuagaaagagugaguacaugugucuuaguguauguguguauguauguauauauguguguauguguagguaugcaugugagaaaaaaaugagugcacaugccacaauguauauguguauguagauauguguguguguauguaugugagaaaaagugaacccaugugccacaauguauauacauuuuguguguguguguauaugcauauauauaugugugcuuguguguguauaucuguauguaugugggaaagagcaagugugugcaugugcagugguguuuguguggauuuuccaggacaauuugugagaguaaguuuucucccacuguguguauucuggggcucagacucaggucgccaggcaugguaaugagcuccuuuaucuugcuggcccucgcuaugcugcccguccugggcacagguuuuuuuguuuguuuguuuguuuuuuuaaaagucuaguuaguuuuuauuuaacaaaucuccaaaagcuuuuuaagggagaguugaaaggccaaucaacagauuguucacaaaaauuaaauauccaucugaguuuaaaaggugaguccauaccuuaaaugcuauaccaaagucugcucuaaauguaaaauaggaaacuaugcauauguuucuuccacuauagaagcaaauaaaauaacauuuauaauaucuuagguuuuauauugacuauuuagcuauaacuuacaacaauuauuuauaaagaaaaaauaacaugauaauuugaauuuuaucaaaauuggaaacuuugcaaaaugaaaaguugacaguaugaaaacaugagcugggcacagguuguuuuuuguuuuuuugucaguauuauucuuggcuggcuuggaacuuccuauguagaccaggcugucucuggacuuucagaggucugcuugcuuuucccuccagaguucugggauuaaagccauggggcaugccuugugggccgagaaccuuuaaaaacaauuuuauuuaacuuuuuguugaauuugugaauuucauaucaugaaccccaauuccauucaucucuuuguccucugcccucugcccuuguaacuuccccccaaaaagaaagaauuguuguaggaacuguaguguucauugcaaagagucauuuggcugguuugaggucucuggcuucugcuacacuauuaguuccugaccggaacuccucucagauauccuguggcauagagaucuugcagcuuuggaucugcagggcugguagguccagaaucaugagugaacccuugguaucagcuaugugcuggcccccuaaagauggggcugaucugaagcacauauucauuucagcuccaaagggguagggagagagacuuugugggaaucaagcuggucuggagcaggcacacgggcauagaugacccuguuuccuccucauggcuugcuagcccgcaucuaagucauuuugguccuggccuaccauagaauuagggaaaccguggcucuagaacagaguuugucggucaguaggucuaggacuuagcauucuaggacuuagcuuucugaaagaggcuccuggcuaauuuggcuggacuugcaccauggggcaggaaggagcaaggccuaggccagucauguaccuucaucugcuaagaucaccuaaccaccugugaucacagauaggaugggagacuccaguaccuuugucauuguuugcuuucacaugacaguugcugggcaagagauacugauggcuauaacugucuuucuagaagcuacuugcaaagcugcagagcugggagaaccuggaccagaccaugggcuugaaucucagguagguaagcuguugcugucuucaccccuggcugcuggcuuccagugcuuucuucugccuccuggcucagagucugcagaggacagggcaggcaggcuccuucuugugcuguggugaggagcucuuguuuaggcuuaaugagugcuuuacauggcagggcgauugagccuuacuguaaagacuguugagaaucuguaucuccacagagcugaugguggggaaagggcauugcaauggccugcaugcucacaggacccagugcauguaaggaagucacugcuuugggggaaaaugauaaacuuuggggauugacugacugaguuaaaacccaauaauacuggaagauucaugucccacuggguccuuuggagcaucucauguuacuggucugugucagguaugagugcagaaaugcagaguggaucacagggcagagaugcugggcacuguguguucaacacauagcaagggcaggguguucccuguggcuuucccaucuguacaguugugaggugucauucacugauggccugaugcauuuguaguucaguuuuggguugacucucagcugccaucaacagcugugaucccugagucuuggucuggcugucacccuucaugauggcugugucuguucuaggacucagggcaguugugguguauuaguugggauaagguguuggagcuaaggccugugggauucaagcagcccuuuguuguaauacuuccggcuugcuggcugucuuccugcugcucugaguaacaaggccagaugaaaacugccugagcucagcugucuuauaaucacacuguccccugcuggcucuggagccgucaccuuuugauggcagcauugccuuccauucuguuacuugacagugccucuucauuuccuuuccaguccaucugcagaacccuucuuucagaggcuggcccagcaggcccagugcugugugcuuccuccugucuucugggcuuguuagcugccggcaagggucccuccuaccccuggggauacucugcccagacaagacaccuccgugacuucuuucuugugauggagaucagaggccccucaugcccaguuggaccagcccuguuggaacacugguguucugguuugccugcgugucuggugccugccgcaugguacuuagugucaaucaguucuguggagccguugccuuggcuggaguagcacaggucacaguggccagguugcagugucuagcugcugugugagcccuuuccccaacugacugcccugugcagagcuuggcugcuuugagggcaagcugauccuugguugcugucuagcuaccugggccaagcaagagagaggagugggugcuuauggugcuccacauucucaucgaggaaugcggggagacccuucuuaggagccauacugcccuggaccccucuucucuuaacugaggagugcagggcuucuaccagcuguguuuguaagguccagcaggcucauguccuuaggaagcaucucagcugguaacuauccuuucuagaaggcaaagggcacuggucucuugcuucauagcccccuuggucuccugauagcugccguucaugcauugcccugggcugcuaggcugccuggcaccuuggaagcucagugucaccugcuuaccuucccugugcaccaagggcagagauuuggguacaggccagggucaaggcugaacucugggugacauggauucacccuuguggcuacacuuguucugugauggugacagaugcagaccagcuguauuaaaugugcucccuuaacaugagaagcugggucuggggccaggacauaugcuggagugugcacuaagaaugugugaugcagccaggugugguagugcaggccuuuaaucccagcacucgggaggcagaggcaggcggauuucugaguuccaggacaaccuggucuacaaagugaguuccaggacagccagggcuacacagagaaacccuaucucgaaaaaacuaaaaaaaaaaaaaaaaaaaaaaaagaaaaaaaaaagaaaagaaugugugaugccuggguuuauuucccagcaacugguccuuaacaaguggaugggggcugagguacucaguggaugaauccauuaccaugcaagccagacagccucagguagaucucuagaauguaggcaaggguacaggagagaaccaguuccacacagcuguccucuguccuucguacaugaguugcugggauuugaacucaggaccuuuggaagagcagucagugcucuuacgugcugagccaucucaccagccccuguuucuuuuuuuaacaucugucucucuuucucuguguguguguguuuguauaugcacaugcauucgugaguucgugcccaucuaguguguaggugucugugcaggccagaagaggguguuggauuuccuggaacuggaguuacaggugguugugagcuaucauguacccacuagaaacugaauauggaucuuguaaaacaaaacaaaaacaaaacacacacacacaaaaacucagacagugagugcuuuuaacagccgaaccaucucuucagccccaaggcuuccccuaccaccaccaccuccuccuccuccuccuccuccuucuucuucuucuucuuuuuuaaagauuuauuuauuuauuuaauguaugugaguacacuauggcuguacaaaugguugugagccuucaugugguuguucgaauugaauuuuuaggaccucugcucgcucuggucaacccugcucgcucuggucaacccugcucgcuccaguuggccccgcuuacucaguccgugcuugcucugacccaaauauuuauuuauuauuauacuuacguacacuguaguugauuucagacguaccagaaaagggugucaaaucucauuaugggugguugugagccaccaugugguugcugggauuugaacucaugacuuucagaagagcagucagugcucuuaccugcugagccaucuuacuagcccgaaccuuuuauuauuauuauuauuauuauuauuauuauuauuuuuuuugugguagguuuugggaaguuguuuguguaaggcuaggagggugacugacugaagcaugagguacugagauuggacaugaugcaggacggggcagaaguaauggaaggauggggcaaaguuaggguucagugccaggacagagucuccuuagaagucauacauuugccuacucacauagucauacauguauguacguauacauaagcacauauacauacaaaugcacauaagcacaaacacacagcacacccauacacauacaugacuauguauuaguucaaggaugcacucuuuagcuggagacagccugcaugucuaccugucugauguguaacacuguggauucugagauguagcaaccaguagguggcacugccuccuugaugaucagcuuucuucaaggaggccugugagcaccuguggcagccugucuuggggcuuacugcccuuccauaggaacuuccucacuaguaucagggaucuuguuaacugaggcacaaggggucuggguccacuggcugccuucuuauggacaggcagguugucaccaaagucugugcucucccugucugucuguccaucugugaccaucaucucucagaguccuuguccccuagggucugagugcugauggugaauggugcagauccugugaggaugaggucuggcuaccccgaggggcucagccguaguguggcuguuacuuuccucauugccgugacagacagguuaucugacagaauagcuugacucuggcuccagugugaguguauagucuaccaagguggagagcgugguggcaagagcauggggcagcugcucacauuguguccacagcugggaagcagagagaugaguggaggcucagcugcuuucuccuuuuuauugagaccagcucacugaauugugccaucuccauucagguuggcuugaaacuccauggaaacaccuuuacagucgugccagaugugugucuccuagguaacaguaaauccagccaaacugaucaugcagauuaaccgucauaccuagguuaaaagaguguuuuggccugugugaguuccucaugguguaacaguguugcucucugcacugugacacuucuuaugucugaggagccuagaguuauuaggggggaguguuuaagccacuguaaaccaggaaucagaugcugaaaucuaacuguagauacacugugauguguccuaugcauugggccacgugggugaggagaaaugggccugucaaccuguguccagugcauggaaucaugugggcugggucagauagcucucucuacugugugucuagugcacagggccaugugggcaggaacacaugcuucugucuuccucuggugaauccaguguauggagucccaugagcuggagcugacaaauuuguaucuauuuguguccaggucaguagggucguguggacugggguaaaugucucucucagaugcaucuagugccauggggcaugggggcuggggcagaugguacuguugugaacggugugguuaugcacagagucacauggggcugagcacacagugcucucuaucugugauguguccaguacauggugucauguaagcugggguggauguacacagggccaugugggcuggggguggacaggcuuugugccauggagaguaaugggcaggaaagugccuggcaguguacacauaugaugcuguggcauggggucaacagagccuucuguguuguguggcaaguaccaguguggguaagccagugaccuuaauccucagggauuuuuuugaaguucugugggggguuggcacaguguugucaugaggagcauggagagugaugacaucuugaccuuggucucuuggggcagacugugggaaagggcuuucaguauggagaguaaaugacugcagacagaaacagccugcacgaugguguggcuguggagagaggcuggcaggaugguuuugauugagaacauucugaaagcucagaaagaagggaaccagagagaaggcaccuggaaacaacugcggcggauccaacgcuggugacccuuaugcuagggaugaggcauguguucucagcaucgugcucacacuguagaugcugccccucauggggaugaggccacauguucuuaccuuccuguugaauuuccucaccugugugacuaauuacagagcaggucauccugggagugaguagaugcuuccuuggguaaguaugcuugaccugaguuccuucuggucaucaauacccaugugaagaaccaagcauggcugccugugccuguaaccuguaucccuagcacugugaggggcagaguucagagagagaccccaucccaagagaauaaagcagagaaugacagagcaggacacuuggacagccucugcacacaugcauauggguguguacacaugcacauauguccccucccugcagaaaucaggauguguggccuggauaggaaaaaacuaucuggagacaacauaaucuuguagggcuuccaaaguaucaauaaaaagcucuuuggacccaucagccaggucugcaggguccuagaacgggugacaguugacaagaauagacgguauuucugaguaccguggugaccugugggaaggacacggcguguauaguagcaucaaaacagugcagcacugagggauaaauuuaacacagcauguccaagaucugugcuuugcaaacauuaagaugcagcugucaguaauuauggaugaccuaauaauggcaggacgugguaagagacaggggaggagaaaauagacccuucccucuuugcucccaggcgccugcucggccccgcacccugacaccagaugguuuguuuuuuuucugcacagcaagcaguucuccaguagaugccagcugggcguccuacaauccagcucagacacugucagaguccggguuggaucccacagguugagaccucagaccuaaaugauuggccuacuaggcugccuguucucaauccuagguugucaccaaauuccaaagacuggcaccaaggugagguucccagaagccccuuggguuaauuugcuagcugugcucagagaaugcagaaacaccuuuauugugccuguccauccuuguuugguuuguguuuuugagacucauguagcucaggcuagccuccggcucacugaguagcugauccugaacucuuggucuugcuguuuccacuuccucaguacuaagauuuuaggcauucaccucuagguccacuuuauauagugcugggaguggaaccaaggucuuagggcacacugggugugcuggcuaguuuuaugucagcuugacccagcuacagucaucugggaagaggaaaucucaguuaagaaaggcuucuucauuaaccccacagguuggccuaugaugccuuuucuugguuaaugauugaugucuuggggcccagcugacuuggggcaguaccacccugggcagguaguccuaguugguauaagaaagcaggcagagcaagccgugaggagcaauccaauaagcagcauuccuccauggucucuacuucauucgguucuuacuuccagguucaugccuugagccucuucccugacuugccuggaugauggacugugaucaauaaacccuuggucuuggucaugguauuuaucacagcaguaguaccuagcuaaggcaccaggcaaguacucaacacucguccaccugagccacguccugugucugucagcuaaucuuugcacuauaccugcaccagaucgagugcuugagucacuccccaguccugcaugcuauggacagacugauuucuccaugcugagggacaauuacuuuguuuccccuaaguaaacagcauuagcauugcuuagauaaauuccuaaaggcguguuuggcuuuuuuuuccuugguucaaaagaaacuguguguuuagaauugauagcugaugccaaauugcccuuugaaaagcuguauuucuacacauuuccgucagggaaugggagcccauggcuuaauugggugaguaugcuuucgaagguucaagcagagaugcagagugagucacaacagagcgaggagagcaggcgacuuuacugcuuggcuuuuuaaacacuauacuuagcaauucagauggaagcaagaggcuuauuaagcaggcucagagugaguguuggacccucuguagucaggccuguguucuguguagggaauaauuugccaguggcugaaugccucugcuacuuggcaucugacucugucacuuuugugccugaaccuggccuuguuucagaucccucuggguggucauuauaccugucagagugugugugugugugugugugugugugugugugugugugcugaauggcauugagaagugcuguggugugggcccugggaggccggacaucuucccacuucaaacugcugaccucaaaucagaguuggaagccagcaagugcugaccucggcuuugcugaagcaucucuaggccagccagaugacacguucuggggacuagcuuccccgaugugcaggccaauuagggggacuuuggggagagugaguggguagacucacuuccaagaugggagcaaauuggccaacccagccccacacuccgcuaaccuuucucugcucaauguuuguaaugacccuggugucuuguugauggauauccagagcuuccagugcuuggaagguuagcgagcugcugggugucuugauguccuuaauggcuggcuuuuaguugaggccuagcugugaaagagggagagucauaccugcaguguggucuguuccugggcuucaguuggcuuauugcucacagcugcuuauguuggggccuguguucuggagagggagggacccugcuggcuuauguguuuguggcgggcuuuuccuaccaguggucucaggggccuuacauauucacucauuccuaacagagucuccggcuguuuucuguucuggagauugugaagguuuugugucagcuagcucauaaguuugaugauuugguaccuaagggaggggcuggucuucugagcaguaggcuuuuaguaaacacugggggcgagugugaugaggggugugcuguggugcuuggcuguugccucuggcaaggcccuggggcggcccauuugugccugccagugggaagcagggcuucaggaccugugaggcuggggaaguagcucuuguguuucuuugccacuuauaaaguugcaggagggucuucuugggguacugaugacugucugcuuggaguggauggucucaucuuuccaugggacaggaugggagauagauguucuguguuggcuagugucaucccugugccugucaugugccagagcagggcuggaggcagugggauguagagcguggagaugaaaugcuugcuggagcagacaccacacaugcacacaggcagcuacauguacagcagggaguggcuuggcccaaccagugcucucugcuguuucucacagugccuuugggccuuucuuccagguuguguagauagggcucaucucaagugccugcuuuggaguugauuuagcagaacccaaagccuugagagcauuggggaugugaugugcaccuggggugaugugucaggagguggcuauggcugcaccccugguucacaguugguuuuuguucccuuccuuccucuacuuuuccuuucuuuggugugugcauaaucauacuuauauacauguaugugaagggcagagcuugaggucagaugucuuccucaaucaugcuccaccuucuuuucuuuccuuuuuuuaauuguuagagaauuucacauauguauuuugaccaaauauuccauuuccuuccagcucccccucacuauccucucccaacuuccaguguccuuucuuucaaccuacagaguccacuuacugccaaugugugcauaggugucgggccaccuacuggaacauggguaccuuucauucugcucccuuccccaagcccucugccgcccauguugggauuuccacuggcuugcucuugaauaagucuuauccaugcagcgagaaucucugagugccuaggugcaguggcccugccaugucuagagaauacugcuucacagcagguaccugugaccucuggcucuuaggaacucucuagacccucuuucacagugaccccugaaccuugguggauggcuuuugauacagaugucccguuuaaggcugagugcuucagucucuuauuuuuuguacaccaacuaguuacagguuucuguauuaauggcugucuaccauacaaagaagucucuuugaugaagauugagggaugaguaugaagauaaguacuuauggggcaauuuaauacuagauacuucagcagaacgauaguaguagauucuccuucaggauucuugaucuagcuaacagcauaagguauaacugcaucuguguggugggccuuaagucaauuagaaggucauuuguuacacuguaacacuuguacugcuguugcccagggagcaucucuugcuaggcagguuguuguagacagaagguuuuacagcucaguaagacuauggguugcuuagcugucugguagcuugcacggcaccuaccuucaugugcuaugaaggcugcucacuaggaaugaagcuuucaccuugguaccagcuugguuuuucucuguccuaugacucaaguaugugucuacuguauuuuuuaaggcagggucugucacucaagcugaaacuugcuguccugguuagacuggccagugagcuccagggauccuuucuccccuucuccagggcugggauugcaagccuaugcuuuguaccccaaugccucuuacacccccuuuuuuauuuugagacacagauccucucuauguaucccccgcuauccugaaacucacuauguagacuaggcuugcuucaaacucacagagauccuccugacugcuuuccagguacuaggagguguaucccaccgugccuggguccuucucucgugcugcaagcacuuuccugacuagcccugguggauuuugucucagcaggugcuucacuugaguccuguuaccuacuauguguccucuucugaagucaggaaccccagggugccagguccuucuaacucuaagcagagugacaguccuggggcccuaggaagcggaacggcucugauaggaauuugaagggcaucuugagggugaaaccaacugagcauagacuagaguagggacuggagcccucuucugagauggucugugccaaccuccuuuucacugaggguuuucccaaagcuaccauggcucaugggcuugcaucaugcagacucuggagaauaauuaggaaguuugggggcuugggcuucccacauggccaucacucuuaugaccauaaggugugagauagugacccuggaugugucaccuaggaucaugcaccugucaggggcuuugucccuguccuuccucacagcaguuguuacuggugucagaaacugcaaagcuuucucaaguugcucuguucauaauaaccucccugugcuggguugucuguuuuuggggauucccucgcuguagggugucagagaacccaggucauuagucuucuauagucucugcaccccuuuucuugcaucuggccucucaccugcagaauagagcucaugucuuuccagaaaacagauggaggggcagccuagaccuggggguggcuggcccucaucccacacagggacuuugguagagagcuggcacacugagcccuucaagcagaugucuuuauauggagcuacagcaaagagagcagguuugcauucagcaguggaauugaauucucauuuaaaacucaggaggcugcaaugcccuuccauucucuacccugccuuugugauacuugagcucuuacaugaauaaagagcccugaccacccccaaaugcagagcuaccuugcauccgggcagguugagcuuaggucuucauuuacaucuugccccacacacagccaaccacugugcucugcugccugcaucucagugagggaauuggacucugagcucccauauaagcaucggcuuugaguccauggcucaaacucuucaguguucacccagagcaggcugccugcugggacaggaccugagaaucuggguccugccucccagcuuugcauugguaugugcucuuccaucccagggccugcggaaggaggucuuacaggcagaccucuugcuguggggaagaugggcucagaggcagguuucaagaguaguuucccagcuccugcugcccauguaucuucuccgcuugacucuggccuugucccuaggcuccaggaggccaccuccugccuuugguugggcaagaugcuggcugggugguggcagguggaggauucugaaaugaagcaugaagcacugucacuguagcuguuacacaugucacacucauaggacacagagugccagaccauaagcugcaggcaucauuccaugucuucagaacacacacagcuugacaaugggacauagcgacagcugucaggauguccugggagucuggcuuuggcugaagcuuggcauuugcagagaucaugguugggagcacuuguugaauggugccaguggagcacaugacaaauguuacacacagcacuucuucaucuuaacacgagugcuaggaaaauccugggauugcacaccuggguacuugucuggaaaaugcagugaucucucugcucauucucgagccagaaaagccucugaauugcuuuuuuuuuucuuccuuauuuuguucuugucuuuaaaaauaauguuuuuauuccauuuauuuauuuaguauauggauauguaugcacacaugugcuaugaugcaauaugguggccagaguguggucuguggaugucaguuauuucuuucuacauguagguuccaccaugugggugccaguaccaaacucagguaggcaggcuuggucacagguuccucucuauccccugauccaugucucugacccugguuuugguuuuugagauagugucuuaggcuaaucuugaacuugcuaaguauccaggaaugacuuugaacuccugauuuuucugcucugccuccccagugaugagauuauagguguccaccacuaugucugcccaguucauggggucucacuuucgugcaugcucagcaagcauucugccaacugaaauacagccccauuagggaaacaguuuucacauaguucuucccuuaagugugggaucucaguuuggguagaguugugguugguucacucaguucugucuauaagugaggaaucucaugccaaguggaguuguguucagguagacucaucaggcugguauuucauaggccaaaguaugcuuguacuggagggaugcuagagugaaccagaggaggccugugaccugcucuuaguguggaucugucuauccucagaggcucuggcuuccuauggccuaugcaaacuggggugugggacuuaggaauguuuauucuguaacuugucauuagagguaguagucugguagcagccaggugaccuguguuuguggacuguacaccugguacguguucuagggcacccuauuggauuggggccagaccuguugcguauuugcugguuugaugcuguugaugggaacacagccuagggcaggaaacaggugccuuuuuagagaacccacagcccacuaguuugaagauaguucuuguucggaugguucugagguuucuuaguugcuugcuggauacaccauucaggauaucaaugcuguauaguagcuacagucuagccuguaccuugguagcuucucuacucuuccucaucugccuguggcucuuuauggccucugccugauggugugggacgagaggcccuuggagggaccagugacccaaugucagccaaguaugccugugucuugcugggcugcguggcugcuccugaagcguggugggcucugcucuugguaaccuccauccaucuggccugccaccugugccaggcagcuggcccgaagucucugugggcuguucagucccaugcugucacauuuccuuucugccaggggccgccauuuuggagcauagcacaggcacauguggcaggaagccccagcuggaggcucucuuacagaccugucuguaguacuuuggcaaggccugcuggaaggcuugcuccgcccaccaccuuugcccugccucccagcuggaucuggaacugcuccuggcguggaggcugccugguggaggcugccagguagagcgcaggcagccgucacuugggagaggaaacauuuaacuuuugaggcagcaacacaauaccaucuccucuguggaggcggccgagguagaagauuagcaauuaauucuuuauuacgcgcaaacuccucuucaguucuguggacccaaacaguccucccgccucgaggagggcggcuccacucaguccauuccccagugcaccgcugcucggcugcucuugagcugauaggaauugcuuacgagucuucauggaagacauucagauccgcaguucucuggcuuccuacuugcucccccgccuuucccccucuucucugguauaguuuauugugcuucggucucaggagcaucuugcuguuuauugggauugcaauuauagaauacagguaucagcugccuuuuaggcuagacaaguuguagcacgcugauuuucauuuucuuuaaauuauagcuuuuuuuuuuuuuauugaggagagugcuguuauuggucuugccuuuaguuuggaccguuuuauuguuuacuguagcuuggaugaacuguuggaggcauguugguagguguugcuucucaguuaucugcaaauuaugaagugugaugguuuggcguugaaggcacugugggcuauaggucauuguuguagucuuaaaaaaaaaaaaaaaaaaccaaaccaacagccaccaugacaguaugaguaacugaacccagcgaugcuauguccaauaaaacuuuacuuuuggccugagcauguagcucagugguagagccccugccuagaaucccccaaugaagggcugugguguagcucaguaguagagccccugccuagagucccccaaugaggggcugggguguggcucagugguagagugcuugcuuagcaugugugaggcccuggguuccuucuaugguagcauaaacaagcaaaacaauuugguuuucaaaaccacuaucagucacuugguuuaaaggcagcauagaaccugucucuuccuucuuaguagcuuagcuuacuuccugauaacuuucugcucugguauaccaggaaguuuucucuugucuuggucugcaagaaucuaccagcaucuugugcccuuauuugacaguguugggcauguguugggcaugagccuaguacaggguggggugguguuuccaagcuucagguaguaccucucuugguuagaaucuugaccuuggucaaauugugccucacauaguaaccuggagguaucugaaggacauaggacucccuugaggagauuuuaagggaccuagucccuauaaaguagcuucaggguuuagaaacauggucacagaguccaaugccaugguaugagcugaggguacaaauagcaaggggaccugccugccacagauuaggacagccucccugucaggguugggcucucagaaauggcuuuaugaaacucauccuuauagauuggguagcuggugcuaggggcugcacagggaccuacaggucugagugcauagucagcucuggguaacaugcucuggcuuucuuggguauggugugagcuuuauucuucuuaucauagcccccacccccacccuagccuccuucagcccugaggcugggguugggguugagacuacuugucuccccacccuggccgggcuuugggcuccuucccuagugccaggugagccccacaucagucuguaaguaagaccugcuuuuguuuccaucagcaaacaugaacccuuguuuauggccuuuccacuuacugacaacccuugccaaauuaauuuuauuuaauuaucucccagggcuaagcuugaauacauuuuguguuaaauucacaguuuuuuccuuuucuaaccgaaauggacuuaauauccuuguuaaaaucugauuaaaacuaaaauugaguuuuuugaagucugauuaucccaugaaauggaauuuuuaaaccuaauuacgaguggauuugcauacacuuuucagcaccauugaaaagaaagucgaaggaaauuuauuaaugacagccuuucuugcauuuccuuggggcaugacguugcuguaggagcacgggggaggccuccgaggaaggcuguguuucuccccaccccucuuuggggaaaaaaaauucacuccucagagaccucguuucccagaaggcugugcuucaucuugucucuauucucucucgagcaucaguguuucagacuuuucuguuucccuugcagaguccuuacggaggguagggguaccagaugcagccccuccuaggcucuggacccaccccacaguacagacgugucgcccgcaagugugucaacagcaagccugauuucggcuuauguuuguggcaugugugccaucuuucugucuacugugugcagugguugaggcuuuccucagcugguuuccacugagguccauuucugugcuuuugggagccaugcugccugcucccauuucuuuguggagggugagggccgucaggcaagcacucagccauugagcuccacagcuccgaucccaggagugggccugauaguaauguuucuuucugguaaaaauuucccucuuguugccccaauuaggcuggguuaaacuuggcugagcagaaucacuuacaucacgguucccaggaagugggggguggggggggggcgcggagaaaaagaaugaaugaaugaaugaaugagaaaaaaugagcugguuuccuuucccccuuugcuugggcccgcagccagagaggcaguguugcccacauucagagugggucuccccuuaguugaucccacagacaugacugacuaaguuuggcagucuucaaucaaguugauggcucaguggguguaggugcuugccacacaagccugaccaccccaguuugauuccuggaacacagguaaauguagaaggagagaacugacuccacagcuuguccucggaccuccacacucgugcuauggcucgucuacccuucuccccauaacacacagagagagucacagacacacauacacuaguaguauuauuaauacugucaaacuuauuuuagggauuuuguauagauuuuagaaucagcuuugcauuuucuguguaugugcguguacgugggguacacgaagaagugugagucuaggacauucacauuguccugcagcccucacacagaacuggucuugcucacuuacuagacacugacccuuguagccuccauucugccgucuguaugguuuuggaucuaccagucagcauaucucacgggagcaggguccugcgguguuuguuacuuugggacuggagcaguucauugagugucauguucuuaaggccagcuuguguuuuagcaggugacaggguuucuuuaagauuuuauuuuuacuuguguauaugugcauggguucauguguggauauguacaugagugaguguguaugccugcagaggcuggaagagggcauccgauuggcuggaguugguauuaccagcaguuguggcaccugcuguaggugacaggaacugauucuggcuucguugauagagcacaaugauucuucuucauugcagagcuuucucucugcaccuucuucaucuauuuuggagacaagguuuucuguuguucaggcuucaaacucgccauguagccaaggaugacaucugauucuccugccucuucccucccaaggaauuaccaccaagagucacugugcuuguucuggucacuaugcagugcuggagaacagaacccaggccuacacaugcacuugggcaguuccugcugacucagccacaucucagcccugccucuguccugacagccucaaggcagcaguuuccuuuuaaaaaucauuuuucuggcugcucuuccagagguccugaguucaauuccagcaccuacaugguagcacacaaccaucuguaacuccaguuccaggggaucuuauacccuuacaacauagcauauuaaauaaaaguuaaaaaaugaaaaagaaaagaaagacauuuuucuuuucuuucuuuuuuugggagggggaauugggaggagcaguaguacuggauauugaaccugcuucuucaugcaugcaagacaaguguccaccacugaccuagaaccccauuguccguccuuuuuaagguuucccacucauugugggcaugagcuuucucuucucucauggcugugagauugcuuugguuugguuuggggcccuggcucuugugaagaacacuacauaagcguguguagacacuugaagaucucacuucuagcucuaggguccacacucaggcugaaagcuccuucuaguuuacgcuauuucgggagccacagagugggaucuggguuccaggaaugcuccuacaugggaccaaggguuccccucaacauguaaggcaggaagcuugccagcagcacugaacucaguguuaaggugacagugggguccccugaguguugugcagaccuaauaacaaugugcuugccuuaucacaauggggcacacaucuuuggcugccagugcccugggguuaaagaaaccugcuuuagaauucuagaaauaaguggcccacuucagaaagucuccaucaccuuugcuuugacuuguuuuguauaaucuucaaaggggcacacagaaagaagacucucuuuggauuccucuucaauaaaaagcaaguagugugcggugugugugugcggugugugugugcggugugugugugcggugugugugugugugugugugugugugugcaugugccacagacauagagugagcucagaagacaacuuuggauguugaucaucaccuuuuacugcaguucugugagcuccagauuuucugaucuaugacuuuccuggaggauuccucugacuuccccucucaucuuauuagaggagugcugagacuauagacacuugccucuguguccaguaucuucuggguccuggggaucugaagucagaucacuuugccacccugagccaucuuucagccuuuaguuauuauuccuucaaagauaccauguccguucaccauccauccauccauccauccauccauccauccauccauguguauuuacacauguaauguaaugggcaugugaagauuaaaggaacaacuugagggcucuuugcuucaaaugcauggguccuagggauugaacugugacugugaggucuggcagcaaccaucuuugcccacugaaccauuucucccaacucuccuggauucuucuuuaaauaucccucccgccucccccccuccucucucuuucucuguguguguguuuaggcauaacuuugucauucaucuguuugaggcagggucuccaguagcugaaugcacaaguugcaacucccuuugaguuuugaaugagaugguaaugacaugcagugcgauggucgguuccuugguacaugauugaaggguguugaagacacgucaccugugcuccucuccucaggcaggcaggucacagcauguucucuuacuuucccuggcauuccucucuguuccugccagucuguuccugcccccgggagacagcacuguucucaguucuguuuccaccgaucaguuuccucucuuccagaauuguaaaucagggaaaugugcuguuccugccuuugauggcuucuucuuuuuccuggggcagaaucggaggcuggucucuguuccugguaacuguaagauggggccuggagauauggucugggccuaucugugcuggugaugcucuagcuucaucaucuuccuggcccuggcuuugcucaacaugaugcuuuucugaugaagcauauuuuggggcacaucaggggucauuccuucuuguggucuguugcagggacaugaggacugcaucugguuccuguugggaaugugacauggauaccuucaucuuguuguguauggauuuacagccuucaccuaagcuggagccuaagagugaaauugcagggccaguuagucagggugugcuugacgugugcgaauggccauguggguuuccagugaggucgcuggcuugguguuccucuuguagccucgagauuccauaugcuucacaucagcucaucaaggcuguguauuuuauucuuuuuuuuaaaaggcaauuauguaauuauucuaguggguaugaagugcugucuguuugggauuuuaaucguaucugcucagugacugauucccuagugucaaucuucaauguucugagugguuugugcucuuuugugagugucuuuucuguguguuuuacaccuuuuauugauuuauuuuauauuccuuuguguagaauggucauauucucaugucuguguggaugugcacuuuagaccaagcauguggaggcagagaacagcuucagauguccuugccugacaccuuguuugaaacagggucaucaccucugggaaccucagauugagugccugugagaucuugggcauucugcgucuaccuuccaucucuccagaggugugcuuggauuagagacuuaggcauuauuccucuaacaccuuucaccccuuccccagagagccaucucccagugcaggagaguuuuauuuuaaaguuauauuuauuuuuaugugcauugguguuuugccugcuuguaugugugugagagggcgucagauccccgggaaguggcauuacagacaguugugagcugucauguggaugcugggaauugaacccagaucucuggaagaccagcuacugcucuuaaccucugagccaucuguccagccugcaggagggaucuaaucagguuccugaucuaauagcuaucagccauccugccauguaaagggaggucagggagguuucugaaucugaggaccucagggaagaacagacucuaaacuguuguagguuuaaaaguauaagaaggaauugcuucuuuccguauuuagaacauauaaaaacauugcccacagauggucucucuugcccacuuauggucuucucucuguaguuaacucaguucuguguaauuaguucuuacugggucucaucuggguugauggucucauggaaccauguggcucuucacugaagagcagucuagaagucuggaugcuauuggaaguucuugcccagagucucugguucaagcagugguguguccuucccgcgaguacgagcaggcuuggucuuccaugggggaagauguugacucugaccauguuugcccacagccucccaucgggauugagaguacaguaggacagucuggagacggcagaugguguucaaauggugggucugaggcagacuuauagcagugaugugaaugaggaggaaacuggcuuuccucuggcaucaaaagcagagauauaagaaggcaauuagaaaauuagacagcauuguaugucuagcgauuaauccuguuugaaagaaauggaggucagcauguaauucaucagaauggaugaacaucauuuuucuacagaaagucuugguguacaacaguugggugaggcagaacauuccggaaauauaccaaggauugucaaaugaagagauacagugaaccuggccagggucucgccauuuuuauuuuuacagaacauuguggacaggucugaggcgcauccacccaguucucgugugcguaugagaaacagccuguguguauugacuugguauuuguugcucuacucaaucuucuuuugcugugcgagugucuguuuuagauccugggaacaugugcaguacauuucugugugcucacacaaaugcaugugcuuguggaggccacggcacaucuuagcugcuguugucuacuaaugcuuucuguccuuuccagacacagucucacuggccugggauuuggugauuagccuggccugccagcgagccucagagaucuuucugccccugcuccucagcccuggauucauaagcaugugauacuaugcuuaguugcuguuuuuuucucucagacuuuauuuuuauuuaauuuuguguuauuauuuuauguguauggauguuuugccugcauguauguauaugcagcauguguguguccuauguccaaggaggacagaagagggaucagaucuccuggacuuggaguuacagaugguugugagcugccaugugggugcuagaccucuagaaaaguaaccgugcucuuaacuguggagucaacucaccagcccccaugccuagcuuugugugugugugugucugucugucugucuauuguauaugucuuuuuaucuuccugacacucaguuuccaaacugaaggaaguuugucuuagaaaggaaugcucauguggcaagggacaaagugaggcugguuuguaggagagauggggauggacauugcugacuugagagaacugaaugcuaauuuaggagaaggggaagccaagagccagcucaguuuaugacauguggcuuucagcugugcucaggagcugcggucacacaccuccaggugggcuaugaacagggcaaguacgagugauuuguaacagaaacugugaguuuauaaaaguaacagaguccuggagccucuaauguaauaguggggcugccguacacucagccuggcagagagaaggugccaggcagagagugaggccuccagucccugugguuggugcccugguacaugaugaggugagcuuggacauggcugaugcugagguuacuagucuccaucucacauggcugaugcugagguuacuagucucaucucacauggcugaugcugagguuacuagucucaucucacauggcugaugcugagguuacuagucucaucucacauggcugaugcugagguuacuagucuccaucucacauggcugaugcugagguuacuagucucaucucacauggcugaugcugagguuacuagucuccaucucacauggcugaugcugagguuacuagucuccaucucacauggcugaugcugagguuacuagucucaucucacauggcugaugcugagguuacuagucucaucucacauggcugaugcugagguuacuagucuccaucucacauggcugaugcugagguuacuagucuccaucucacuuggcauuaaaucuggccagccagcugucauccuccaaggaaaugaaaguauuucuuuuaaagacucuggcuguauggaggaggucaucauggugcacuaaccugggccucuaagcucccccugcuguagggcgagucuacaggcucacucuguauccaagugugcuuguuaguguuaacugucagcuugaugcgacccaaaauugccugggaggagagucuuagggaagauuuaccuagaacagguuugacuauagacaccucucugagggacugccuucauuguuaauugguauaggaagucccagcacauuguggucagcagcagucucuaggcuggggauccagaacaguuuaaagaggaaaauacuagcugagaacaagcaggcaggcaggcauggauccagaucuagguguuuauucuuugcucuugauggugcaugugacuuuacguuccugccuugacuuuccuucaaugauggaucuuagccuggaguuguaaguaagguaaacccuuccuuccuaaauugcuuuugucaggguuucaucagaguauagauaugaaacuagaacacugaggaagcugcacguuggugauucauugacaaaacagauccaggaacuugguggacaugggagcuguaugaggggagacuucagaagcagcacccuccacugaguauucccagaggaaagauagagacaggaagagaguucuaugaaagaagagcacccaguggaccagaagagcucaggaaaauaaugaauacugagcagauaggagguguagagauagcugcagagauggggugccccuuucaguuacucuucuacacuuaguggacucuacccccugagacccagagaccacaagcaucuuguguagcuggggcagaguccacacagcugggagggguugcaggagaaaauggcugggaucucagguggaaguuccguguaggaggucacagcuauucucaugaagguggugauggcuguuacccagguacugcucagaggacagggcuccacagcaggagcaguggauucuggagcucagacgccauucuccuaagggcucagccugagugucuaggacuguaggagcaggugccauaggacacagcacuaagccuaucuccucugucugucugucugucucugugugugguacaugcucgugcaguuauaagugcauacuugugugugcaugcguguguaugggggcagaggaggaugcugggggggggggcgggcuugcucugucauucccuccuuuguucuuuaauaguagggucuguucuaguuugcuuucaguugugauaaauaucaugacccaaaucaacuuuggggaggaaaaguuuuuuuugguuugcagguaauagucuauccuugagggaagugagggcgggaccuuggaaguaggaacugaaguggauaccauggaggaaugcugcuuacugguuugcuuucaugacgugaacagcuugcuucugcuuucuuacauaucuuaggaccaccccucuagggauggcaccacccacaguggacuggggcuucccacaucaguuagcagucaagacaaugucccaagauaugcccauaggccaauccugauagccaguuccucaguugagguucgugaccucccuggugucuuugguuuguuccauguugacagaacuaaggagcccugggucucucacugaaucuggagguaggaugggcucacccagcagaguuuugucaucuuugcuccgugcuggguuaaaggcuugcauggcuacacuuggccuuuugcauggguacuaagggcucacacucaggguuugugcuuucacaguaagggcuugcagauugcucacacaggcuuugucaggaacccaucugggcuugagcugagucugcgggaggcugaggggugagcagcugccacaggcugggaccuaagcauguaguucuccuuccugugaagguggcaacauccuuagaucucuguugccuuaaaaaaaaacaguuuugcuuugcaauuuaagcuugucuggaacuuguuauguagcuuagguuggccucaaauuacccuccagcuuuaacuucuugaauacugggguuauaggcacagacuagagugcugggcucacagaacaaacuuuucucaguguuuggggccuguccugguguggguacuugguugguaagcgcucugccaaugcagcuacaucgccaaccuggggugguggaggaagcuuuccacaaggaggcaugagaguucuccggagaccaagggacuuuaggcaccaaggcuguaacuuccuacugagaguccuagggugccuuacagcuugucucaaggcaugcugccuccagccaccacagugcucugacaccaaauauauaagcaguccuuucaaugcauugucccaagccuccugccuccauguguguauuuucuagcucugcacuccauccuccagaggaucuugagagaauuaaugauauaauucaacucaaagccauguccugcugguccuugcucaucuucccccaacccuuuuuugugguacugaagauggaaccagguggugcacauaaacccacacagguugugugacauguacacacacacacacacacacacacuuucuaaauaaauucagaaauaaaugaauagacagauaaucuucuguuuugcuuuguuuugagacaggguuucucuguguagcucuggcucuuguggaacucccuguguagaccagccuggccucccaagugacggaauuaaaggcaugugccacuauugcuuggcuaugaauaaaaaucauaagucuuagggguugaggagauggcucagugguuuagggcaguuguuacucuugcagagaacuagaguuucauucccagcucucacacgaagcacuucagaacagccuguaaaucuggcuugaagcuccaaggaauccgauacucuccuuuggcuucuauggucaccuucacaccugugcuuguacauauacucacacaugcaugcacaaacacguucaugugugcucucuuacacaucuuaggguugacuugaugguuugucaaguaaaagugcuugcuuuuaagccuaacaacuugaauuccaucccagggauucaucuagaggagugguucucaaccuuccuaauguuguuccuaauguuguauaauguacuuccucauguugugaugacccccaaccauaaggucauuuucauugcuacuucauuacuguaauuuugcuacuguuauaaauuauaauauaaauauuggauauguaggauaucugauaugccaccuccaaaggcgucacgacccacauguugagaaccacuguuuuaacacaugugaccacaucccagccuaagcugucggccauuuguucucuaauaugucaccuggcacaggccuugugccaagcuuccuguuccuugcagccuagacuuccuuugagcacuucugcugugggaaugugguccugcuuucuugucugccugcguucuugcuucugagugcuacgguuucuguuuucucuucacucucauggccauagggaugaaaaucugaggcauguuuuaguuucuggagcgaguaucauaagucaggauguagcugucuagcuuauuccucucacuuauagcugggcuagauuaaaccagaguucagaaaggcaaaauaacuagccuagggccacacagcaagcuagcgagcaaucugggcucacagcucggcucuguguggauggagccguugcuucuccaaaguucugagaccuucucuuccauuugcuguucagugaguucaaagugagcaccucacuaaugauggcgccucucugagccucugcauccaccaaguccuuuguucagccgaugcguuugauuguuucccuggaagccaggugcacuugauuuuuaauucacucuucccucucugagagaaguucugguagguaggugagugggucgggaguucuaaauuuauuauaggagguucccuccccuucuguuuaauauugaaaguccugucaagaguggaacaggggcuggugagauggcucaguggguaagagcacccgacugcucuuccgaaggaccaaaguucaaaucccagcaaccacaugguggcucacaaccacccguaaugagaucugaugcccucuucuggagugucugaagacagcuacaguguacuuacauauaauaaauaaauaaaucuuuaaaaaaaaaaaaaaaaaagaguggaacagguugauaagccaaccucccugaagucugaucagcguccaaauaaguccacuucugaccacacauccacugcccacaguggaacaccuguagaggacacagcuugucucaccuacuauuuuguccguagacaccacuauccaguguagguaaguuuuccaugcugaggucauuuuggguccucuauggggaggcaggcaaauuuggcuuguuccuaggcugauggagaccugucagucccucccacucuugucuacauuccuggauguggacauugugaggagugcaugcacucuucaggaugugugggaugugcuucaugccucucccucccugaaguuuguuuggggccagaguuuuggauguuauagcaucagccgaccagcucuuucagagcaggaugcaggagaggaauugaggcauuuguuugagagcuucugagagcuuuuuuuagugugaacaguucaaagaacuccucuuguuaaucagaggaauauuccagcaucccugggguggucacacuggcuuaauuggaacccaggcugcuuugaaguccuuuuaauccuuccugagcugggagaaagaauuuggaggcagcaacuguaaauuugaaaauucuucauuuuauuuacaugugucuggggacgcguggaacucauuucccugaggcaguuaagcuguguuuccgacuauggacaguugaaugggauguggacauuagguggcugguaugggauugcugcagggcauuggguuacuuaaaaguggcagcaguggacccuggugccaugggccuucuuaggaagugugcugucuugcugcuggccuccagaugccauggccaccggccauuuauucugcuccaugaagaaggggcauuagccacccagcagagcuguucucccacaccuccuuaguugcucagagguggauucaggcugcugggucaacuagacacagcaggacaagcacucuugguuagcucuuccugagcugucuaggguuaguugugauuuaaaaaauuaaaaaauaaaaaaaaaaaaaaagaaagaaaaggaucuuauauggucuagacuggcugugaacucucuguguaguuacaaaugacuucauggcauuaggccagguuuaugcaauggaacuuaaggcuucauucaugccgggcaagcagugggacaaccgagccauguccuugcuuuguguuugcuucugagucaggucucacuguauagcccaggcugacccagaacucaugacuguccugaagcaagcuuccaaguuuugugguaggagguauuuuugaaauuucauucuuaugugugcucacuugcuuuugggcauucucuguuucugccuguuguauuucuguaggagugcugggauaacagaugugggugccacugugucuggcuauuaugugguccuggggagucaagcuccagccauccagccuuagugaaucacuuuacccauuagccauuguccuagccucagagccacccuccuagagacuguuccuaaauggcuugucaagugaucaccuuacuuuagucccuuuuccuggcuggacuaucacugugcucauaaaggaaacauuuuacacauugguuuugucccagugaucaucagccccagcagguagugagugucugugacucuggaugguacacguucugucaggacaguagccauggucucaggaugagcuacacacagcacuccuagauguguuggggacagggccuugguuuguguaugucaggcuggcauggaacgugauuggaauccucuugcuucagccuccugaccacaggcuaagcuaccauccugauaggaggcugcucccuccuccacagagccugucaguccucacagguaccgugcugagucagagcugaccuuugguuugguggcagccuuccuuccucucuguuaucugcccaccagccugacucuugaugauuuucagccugguucugucacuugggaaguagaggcagucagucucugugaguucaaggcuagccuggucugcauggugaguuccagguuagccaggacuagauaguaagacccuguucucccacccccuccacuaaauaacuuagguacauagauuuuugauuucucuuuuaagcaacuuuaaggaucgaaucacaagccuugaguauuuagauaggaagcccuacucucagcuagcucaugcacucguuacaccccccccccccccagauuucuccaauacuccuguaauggccucauuuguaaugcaagugauuuguuauauguagcugaaccucauuuaagaauggucugauugcuugguuauaaaugguuauaguuggauuuccauguguuaauuugucaugggaagggcauguuugcuuuuuuuuuuuuaagauuuuuagauagcacuugcuccauaagguuaagagcuaaacuuugaaauaaguagccauugguuaccuaucauugaauuuauuuucaugguacaagauauuuaagaagaaaugggugaacuggcucggcaugugaaggcaucugccacuaagcuuggugaccuguguuugauuccuaagaucuacaugguggaaguuguccuuuggccuacacaugugugcuaugucacacaacccccuaauaaacaaauaaauguaauuuaacaauauuuaaaaagcuuacaaacacuuggagguaaguuuccugguuauuuuuuucaccccuacaggaagccacuucugcuuuuuccuuuggccccuacacccuuauauaugcaggccaacacagcuaugcuuaauuuuugguuuauucaaauaacacaguguauucacacauucugcuucucucuuaugaaguaaugcauuuuuguaggucuuucauucauauguguguacguauguguacauauguauauauuuacauuuuauauuuauauauuuauauuuucaucuagauuucaucaucuagguagacuguaauuuggccaguaacauugagccugcuuuuguuuuuuccaguguuugggcauggagucccaggccuggcuugugugagcaggcauaaucugccacaccuucagcccagcacugagcuuuuuuuuuuuuuuuuuuuugguaugcuuguuuguuuauuuuuuaaagauuuaucuauuauauguaaauacacuguagcugucuucagacucaccagaggagggcaucagaucccauuauggaugguugugagccaccacgugguugcugggauuugaacucacaaccuuuggaagagcagucggugcucuuaaccgcugagccaucucuccagcccagcacugagcuuuuaaauccaguaucuugacuucagauucaggcagaacuuugcugggaauauuuuucuagaaagcgcucauggguuuucauucacuaucuguuuggggucucugcagugaagagucagaacagagucuaaggugaaucccucuugggacgcucuuaccugauggagaaagauggcuuggagugugugagucugggcuuugggcuggggaagggcaaugguguaagcaggacccugagcagcagggugagguggcgaggcucucaguaaaagacaggacaccuaaagugacaggagagcugugugugcacaccacaggagaagcagcccugggaagggacaugaggggccagaggagggaaugugguaacagcuguaaacuggaacagcaucugucuuccugucccuuccugaccuggccaucugugugaccucauuuccaaaaaggaggagggaugucaugugacaagggcugcugugguccuuugcugcuguggcaaaccucugucugagacagcagccggcccugcuuugacuuccuuaggaagaggaacugucccucccuuuacaugcuuugaacugguagcuuuggaggguagaugagucauaauugcccacuucauggucaggcugccauagggugguccugagcuccaacaacaagacagacuuguuucucuugacugucucuagaauccuuaguggcuguggccuuagaaccugauaauccaacacugcuggguggccuuagagcugugggcagcaggcguggccacuguagguagcucuguagugcuuggcacagcccacagcugcucugcagugcugacuuagcgugaugugugcuuguccccauguccuggacccuccguacaguggcuuaucagucccaggccugcagaccuacaucagcuggagaaaucugauuuggagucuccauagcugugagugcccauccuuucagcuuuuagcagaaguuuuugcugucuaauguguucugcucuggacuuggcauacuuuuugcaagaacaauaaacccagcuccauagggguaggggaaggccguguucccuccuucuacuuccuuuucgauugggcccuggcugaagcccagucccugcaguuuuggaccauagucucagcccuguagcuuccuauucucuggagagaauggcaccuuggaagagagcucauggccuggcguuugcuaauugggucuguggcugcugccacuucauucauucucgacauugguauccucgggauugggugucuuucagacauugugaaaccagcacuuauagcuucagugagagccauggcaccugcuauuagaacucaaaauagccaugguuggggcuggaacugucuuugccucagaaauaaacuagcgggcucaggccgccggcauucugugccugcagcugaguuugugucacaauucagcuguucacagaacaaagagaccucuccccgagagcccccgucagaccaugaaaggcugcgcagcugaagccacgguuguucggcagcagaugccacagcuugggcugcaguuggaacugucacuccccugucauccauguguuggaggccccagagacccugagugccuuccacuuuguaguugugaagugcgagugucacgcucgcuggaccggacaggcagugguauuuuuaggccaaaguggcacucugugggacgccuuguaguugaaagcauuuugcuaaucccucgagugccgggagcaucuccgagcagcuuuagcacacaggucaggaggcuccugaagcacagacgcuuacucggccagcaccuggcgguccacgggcuguggacaaggcgaagaccgcgccuguggaugaguccccgugauuccacagcucucgaaagcccucucccaugccuacgaggcuccacauagguagcacaguugccaccuacccucacuuccuguggggucaagcugucugcuggucucugugcccucccaccucccaguacagcaauuaaaggugugugccaccaccaccucaucuucccagggcuucuuaaggauugcuccccaccccaacucucucgagugcccuucauccuaugcucuucagccuggugccagggcucaugccaggcugacagcggaaagcuagugcccugcucugagcugguguucguggcgccuuucucccuguugccuuuauugucucgggagggauuuauuuauacauauguacugcggauucucuuuaggaauucacacagugcauagaagacaccccccccccccccaguucgauuguccccaccaguuugggcaagcacaguucacugcgucacauuuuccacuagggcacagucuaugaauaaaggaauaaacauacuauuuacucuuauguauguaacucagccacagucaguucgugccuggcucuuucuuugcacguccuuugccuggcacacuuguuuggccuuuugucaagaacaacuuuuuagccuccuuggaucaccagaugauccacaggugaggccuuggggaccggaacugacuuuucaugggucuacaaguggauggcccagugcuggugaauguucauccuccgccucucagugguugcuuuuuuaugaccucauguugcagagggggggaaggagagagguucuccauguauuugucuuugguguugggguuagaacauaugccuacuaggcaaguacucuaccacugggcugucuuuccggccccuuacacagggcuguaguaaggucagaguucaguccauugcacagugaacaauuggauugguagcucauuugcacccaggacuacccaguguccugcucaugaggauuguaggucuuugagguagcaaccuuuuccuggcucaguguccguuuuuugugcucucccagacugaccuaaagcccgagaguacagugugagcauacagguauguggggugucucaggugcuuucugugcaucugggcucaaaccuuuuaucacacaaucacacaguuagagccugccuuuuugggugaagcuguaggaauucccaaauaaguggguagugacuucagugugccuugugcucacuguggccacaguugaugaggaaagcagacccagcgucaccaucugcccucauguguaucugggcauguucacacuguucuuaaaaacaccaugaaauucagaguaugcauccugcugugcaccagucacaugaccaggcccaccucgagucuacucacacucaugggugcacccaggcgguaucuggcugucaguuuucucacugaaaauugaaacaaaaagaccaggucuguuaugguagacugauaggugaguagagcauuuuggagagcugggaagcauguacaugcauagcaacccacugcugcucuuuccuuuugcugccugaucugcagaagcagcuagccgggugaggucaucugagcccugccuuugugccaggccguggcuagugcucugugcaucuuauuuccuaggcacacugguacuguuauauagucuuccuauuuuuagagcgagaauaaaguuaaagcucuugugugcaugccuggguacauacacauuuagaugccagaggucaagcuuggguguuguuccuugaugccauccaacauguguuuuagguaagagucucucguuggucagagacucaccaaguaaguaaggcuggccaggaagcccuagguauacaccuguguccaucucagcacggagcaggugccaucacaucuggcuuuguaugcucuuaauauguuuaauuccauuuuguuuaauuaguuguaugugugcaugugugugugcaugugaggcucagaggacaacucuggaauugguucuguccuuucauguggagccuagggauugaacucugguucucagucuuggugccaagugucuuuuuacccacugaguucuaaacaugacuucugggaacugaauuugggucuucaacugaguaaccuccauuuaggagucaguaaggcuuauuuugaaaguagucuauccacccuccacugaggugcuuggaccugcgugcugugaguacuugcuacucuguacuugggcugcagagugaacuuccacagaccucugaauugacaguggaugguguggcuuuugguuuucuguuuugugugcacaauguggcccauuucuggggagagaaggaacuaagugugucuucuuuacccaucaggacuccagaggaccuuucuagguucgugguugagcuacagcagcgagagcucacccugaaggagaagaauaacagcaucaccagcagguagguggccugggggcaucugacagugugauggcuccgggcaguuugaguacugccugcaugccuuccucuuuguuuacuagucuguuuuccauuacuguuucauaguaccuggggcuggauacuuuucaagaacuuuuuucuaggguauaaugguggcauuauucggguguagcucugcuaaagacagcuggugauagguuuuuggguagugcaggcuugcuugauauaggagaaggcuagaggggaaggguuggguuuuugucuuaaccgcucuuuugagcacuagccaaggguuucugagagcugccucagucccuuugaaggucagugcacuuggugaccugaaggccucucacacuacccacaucuauauaugagugcuccuggcagacucauuuauuaacugcgugcacucaagccacagugucaggcguggcugugccucacugcuccauggucugagaugugggaguaguuguuaccucacaugccacauccagugagauucuagagccacucugcaaauucuaauuuaagugcuguucaccacuggguccccuucuagaucuggagccuugcaacuuccaggcaguguguggaucuggauggccucuggaugcaugcaugugugaugugugcagcuuugugugcucacagaugugaacauucuaccagccugugcucuugaucacaagugauaacaucucacccugagaugagcaguagguguauuuguuccgcaguccaguaggaaguccaggggcagcuuagacccugccgggccugccgggcccuuguccuggcaacaccacacacauccuguguuuuucuagaacugcuuucuuuccaagcccuaaacagcagugugcuuucugcuucugcucugacaguagguucuguucagacagucacaagugucagguccccaggucacccacauucccaucccaccacuccuucucaggcucagggauuuucagaaaucaggagagugucucccuugagacuccugguuucuucugaagaauccagcccaggagcaaccggaugguggcauuucaggcagggacauagcuuucuucaguuaacaccccaccacuaccaccuugaugcauacaucaaucuccauguauucaaauccuauugugaaggguuucacagcccagcucccaagucaguggaugggguggacuuucuccccucugcuuuccagucuuuuugugacuagcuccaaccugagcauugugggacuuguacuagcuuaucucauuagcuuguugcgaauauuagcagacaggccugucacccaguagagcccaagaggucuuagggcucugcugggaaccagagacugaaaccaaacauguuuggucuucucucacauugggcugggcucuuguccauuugcccuguggcugggcacuuggccaauuuuaugauuuuugaagugccuuccuaggucuagucuuauguccagagacaaaaaggaaaagucuucuuugaguguuaauggaauaaagaaggcuuuucuguggccaccauccaccugauccccuucacugaccaaaacugggcugugugccugcccagacccuguacugucagaagauggaguugccauagugaacccaaggucaucccauguguguguguguguguguguguguguguuuauauguguaugcucacgugugcgcgcacuaccugaggcaagugugggcuccugcagagccagagggaggaaaguguacagccaccagggcaagagcgccuagugccccaguggacugacuugcauggacaggacuaggaggagcauggagccagccuguuguugugggugauccaaccguagucuugucuucuuagggagacagcauuuucaucauucauuacuagccagaaggagggguucucauuggagugcugaugucacucugaaaauuggcuucuagaagcaucugguuauguuggacauaaucacauccauuuacuugagaaagcucacaugauaaagauugccuuuugcuuucaaagccucugucagaugaaacgggcaugaaaagugauuuggaauuaaagcuugaacguuugccgggugauccucuucauuuuccucugacuaugaaauggaaugaacuauucaagucaaggaaaccuaucugcauuucccucgcacccaguaguuagcugcugugaccaggcaugcuaagacccaugucugcccaagagccacgagaaacgggccacuggcacaccucccaauguaccuggcuuguguuugccaguuuggguugagucagccugugguuugguuuauguagguuugagacuggagucuuggaguagccugugucaggggcaggcagugcuggggaguggggagguugggguacaccucuaaccucaggacaucccauggauguacuuguguuuugcuuucuucuguagaaugcugaggucccuaguuagcagaucucagacaggagaggccugguccacaguacugucucugguaauguuuuuacaagaugguuguguuuggguuuccugugugcuggccuucugugccuggguucaugugggacgugugaccuuuuguucuauguggcuucuguagccuggacacagacuucuuguggaguuggcuaagcacugccugccuugugagucucucagagcuaggcuguugagcugaggagcagagaggcaacagcuguggugcuggggcuggguucacagggcuccucacugguggacugggggcagaggcucucuuaguaaggugggaaccggugguuaucgugaagucuacgcagcucgagccuugaaacugagauggccuagguuaagguaguuguuauuuugcuagugaggagagucacucaggagaugagcugagacgcuauguuuccagccuauuguaugcuaggucaugguugugccuuuccuuuuaaugcagguuccagauggaaccagguggcuaggguggcacuggcuucagugguuggauggauuauugcagcuucagcacuucagcccuuggggccugagcuuaaaagggcaaguuuccaccauuuuguucaugggaccaggagacccagaaaggccaaguguuuuuccuuggccuuuuaaagacgguugggcagauuugaaugaagugggaaggagagagcaugguacauccugagcugcagagggcaucacaggguaggccaggcuuugcacagagggagcaaggcaaggcaaggcaccuguuuuuuguuuuuuucagugugugguguguaguuggggaggagcagaccaucagaccaccccaagucauggugucgcaugcugagguucuggucguauuucacagcuaugcaggccaguggccugcacucccaucaugcuguguccuuguccaauguucuagcccagcuauugaucaugucugaaucuugcaaacaaauguuugcugcuucuguggcuuuaaaacauguucuuuauuacaccccuagacugcccacuggcuguuagaagagagauuuugugcccccugcccuccugcccccuuguuucugcugugaagggcauggcaguacuuaugagaacacucacucaaguguguagcaccucuccaaccugugcaugagucaacugugucuucugccacuggcuguguuaguaagucggugucagcgacccaugccuggagaccagagaguuucuguagagcugccucugcgaagcacugaggaacugcuagaguugggccuuugccuguugcuguaguuaccucaguaggcccuggcauauguggggcagaacugugccucugggaaggcugcuaggcagggcucugaccugagcccugugugggugaggugccggacuguaaugugccucauugaaggaggcugagccauagacaucaucugggucuaggaaggccagaugaagucacacccuagaguuuccaaccagccaggagcagggaaagcaccuccuacuauugagaugagaucaccuugaucccuagcugggcaggcaccgcucugaacucauuagacugaaacagucuuuuguuuuuuuugagauauugucuuuuuauauuuucuaggcugaucuggaacucucuggaguucccuguguaucuugugcuggccuuggacugacugacugacugacucucucucucucucucugugugugugugugugugcgcgcgcgcgcguguguuaucccauucagcugaauuuguuccuuuguuuguuuguuuuccucuuuucucugaguguuuaggugaaagcucagaggugggacuggcauuuccaucugauaggagacugguguuuuugaguagcaggagaugggaugggagaugguagucaggagagugucacagggauauauggauggaggagggauggguggacgggugauguguccuguuuaguaggugaggaggaccagggagccguugcccaggugaauguggccuguugaaguggagaguaugcucugcagggcuguguuggagacugugcccaggcauuggguagcucugguuggugaggacaggaggggggagguuccuuugcagcaugugugcagcggggguugggcagauuccugcuugguggguggcuugcuagugggcaccaguauagggaauccuccaagaagguguuggucuguacauucccacggucggcugccgugagccaucaggcugcgccugcgcuccuccucacccaucccgcacagcucacagguaccaucgaucauggauauggauggggcugucagggccugccuugcauccucgguaccuucggacaggaucugauuacagugucaggaaccuugcccucuucggugugccagccuugcuuuuuguucuguagggcugauaaugccucucuugguuuuguggcuaaggagcuggcagguugccugggguguauguguagaucuuagguguguccucuguucaguaucuauugcauugggcugaccagcacugcccaaaagaccccucugcucuugauggggcucuuuagggucaggaguucaagggcccagguagguccccacuauguuacuaacuuaccagcuuucuguagguugugcugaagugcugugauugagugucaggcaggccugggaacuccauucccucauucauuugcagaaggugaguuugaacccugguggaucugcagggagucaguagaaacagaccuugagccuagucugucagucucccaagcauccaugcuacggcugaguuuggagcccaggucuccaaggagguccuaacacaacugcucuccagggcuacuucaagucguaggcuggcacccucugaaauguuuauguaaggcagggccacugaagacaaacuguguagugauguggaacgugggugcagauguuuccucuuccacccuuuccuguccacucccuccauccaggucaggacacagggaggcauucacucuuuuucuagccagcuuucaugaaccaugugcucagccccagggcuccauucaccauggccucaccuuaugccuguaguccagaaggucuucugcugcugggcagagcagucaugccugcagucauggggcaggauucgggggucaggggcagacauguugagucuguacguaccugugguccgggucuuugcugaaccagucugggccucuuuguugaaagccacuuuccucaugggugaacaggcacguagcacaaugaugaugccacaacaccauaccuacuuaccuagcagaggguccuuaaggagaaacaguacauggaggguauaacccaucugggucacaaaggcugugcccugacuuucuccauugccucccaagggcgguuaagcucagagucugagucauaauucuugccuguuugucuagagcaguuaggccccccucucacagcaucuuguaguauaaugaggccuugucaccugugugagccuguguccacaugaguuauagugcucucgagcugucuagaagccaacaaagccagugacaggugcucaggauuaauggugcggggacauguuuugugucuccaagggggugucaugcuguauccuggagcugugauggggaagccauuauugccggcuccaaacucaggcugccuguguuugaaucucagcuccacuacugaggagcacucgguccuuggacaguuuaauuagccuguccacagugaagacaccuuuucaggugggguguguacaggaggguaaaguauauuaaaggauguagccauaaaggauacaggcuagugucuggaacgguaaacaaggggcuggccagcaucauaguccucuuuaaugccauccuuuguguaugaggaaccacagugagcagcugcuaagauaugaugguccugguauugggguguucacagugggcaccccuggaagaugaguuuugguagaugacugcuggugaugguuagagggcuaggggcugggcacgucuucaguggagaagaugcugaaauuuguuaugguugauugggugggcagaagaagagcagugaguagcccaucucccauggcuguguccccugccaggucuuaugcucauuccagccauuuacuguuugugcaugagccagcuccugggccugucaggaacacaggccaaggccucaaaugucugccugguucuuucuacccaguaugaauggucuuuggcagagcaguugagccagcuugcaucuggugagcucucuccauguguccucaaugguagccccuacuauguauuuuagggaugcugugggaccugcucacacugaucacaugccuguccucaguggcuccaggucaggcuuuagggguugcuggucgcaauucauauaccccuagagacguggcuggggucucuggaggaacaccccuagaaccuauacuuucacucuugggacacagggaggaaacguccccuguagcucagggcuucuuguuacuaguagauuggcuguauaaauacuuguuucugagcugacuauaucuaggcuccuuauaggccugugggaggcuuaguuuguuggcugaacuuccuggcuuacaguuuagugcuaaggcugagaguaugguugcaaacacucguguuucuaaaacccagccaggguggcccuguacagcuggccagacagacugaccugccacccacuuucugugcuauggucugucuauaauggcccacaguuuguguccuagcucaggucuugcugagguguuuguuucuuucuuccaugcuagaauccaugucacucugugucauugccuuuguuaaagugacaaacuauaucauucuuuucuacaguugucucuagacaucugcuuuccacgcagcugucugagggacacuuucugacucaggucacgccauauuguccccacaccugagccuuccccuggugcuguguccucagggugugcgcaguuuccuugccagguuuucaccacagcagcauccucugcugcugcucuguguuguccggggucugugcaccuucucuaggcugccuuuccaccuccuuccccaggcauuauuagcaucauguucuuggccuuauuuccucugcugacuuggcagacccaucaaagcuaggauuuuuguuaaaaugaauauauguuugccucugucuaacucugccugugcuccucugcuugucuuucucggugcaaggcuugugcuggcuuuucuuacagugagccaaccauuauccccaccauagcacaugcucucugcagcugagguggaggagccagcaccauuggcaggcccacaggcccauggauuugguccucccucacaucuuagccaagccaugagguuauuggcuguauaugaagcccagcaggagcccuuuccccacuagccuggacuagucucccugucucccuccuuggcugcucugcacucaguaucaucugaggugucccaagggucacugccuuuguccccucuugucccacaguuguguggacucugaaugcacuugcuucuguccucccaaccucaagugguugcacagcucuaagaugugcuaugccuguccacacaacuugagggcuucuccccuucucaccacugcaccuuggccucucaucuucugugggacugucaugaccucccaaguucccuuccuacugucucuucaguucccuucuuucugucccuugucaguucacaugcuccuuuagguagggcauuucucccagguuccacguugcauguuguuggguaaggugucuuccuuaaggagacaugaacagucaucuauuuccccccaaagggagcaucagugacugaccaaaguaacaccuccaccugccucgccuguagagccacugaguucauugagcuccuuauguaagaccaugguggaggggcacuuacagaagcauaggugagccccacgugucaacuggaaauccccaugccagcauggaagaagacagcugcauagcugcauagcuggaguugcuacggcacuugacacugcagacacuuccgcaugccuccaguaccucugagaccaugagcagcagggacagaauuacaggcaggugggaaagggggucgaggacaggagggagggacuggggucucaggauuuaaugauccuuuccuuuuuaugagagaguaucagcaggccugucucuuuugggggcagggauucaagacaggguuucuuuauguagcccucgauguccuggaacucauuuuguagaccagguuggucuugaacucacagagauccaccugccucugccucucaagugaugagauuaaaggcaugcgccaccaccgcauagcuagcaggccuguucuucagggcuguuugugaguagucacaguugcugugguauguaugguaauggcugcuauggugacugugugcccgguaucuaguucauucccaagagguauuuacugaguaaauaaaguucccaucagcuugagaaugggguguugugauggcucuggcuucuuagggacuugugguguugucuguggcuuguaagcucaucuuugucucccuucccugcuguccucuauucugucacuuugggucccuguuuuuaccaaguguggcagcagcagagcuggggacuuagugccuugcauugccuuuggcuggucugcaauuuggcaccaguaguguacguagcaucugucagcucucagccacccccagccuaccugcuucagccuaggguagcugaauggcuuagcauuauaaguauagcauuugauuggaggccacacccucauuucuguucagagccuaagcaauaagcuguccccaguuuccucucaugugguacaugggaggcauucugugccagaccugaggcugugccaagugggaagaggcagaguuccauucugguagggcuuugugugcacugggccucggcacaggucuggcaguggcaguguugggcagcaauggugucacccugggccgucugcagagacgcagggugcaauggaggcaggugagggggcaacauauaacuaugcaugaugagugcccaugcauguggggugcguguacuuguguggacagggacagguguggagauacagaagcauggaacuuguguaagcuguaugcauuccaccggcuauaaaaguuguugagggaacauuucuuagcagaugcuaagauguuuuguuuagauccuguaauaccagaacugguauuaagcagcuuaaaauuugccuuggaauguggagaguggcuaccugagucugagcacuuuucucgugccuucugcagcacuagugacauagagcucauggcuguccugcaaggaguaugcugcucuuagccaccugcagacccaggagugccuggcuaggacucauggucgucugaggaugucugacucuaugcacguuuaccuccuacccacacaucuaccuuucccuuccuugugacagugggcucuguggccuuucuuuggaagcuggaguggcucagcagggaaucccucuauccugauucucuuuaacuuuuuuuuuuuuuuuuuuuuuuuuugagacaggauuucucuguguagcccuggcuguccuggaacucacucuguagaccaggcuggccuggaacucagaaauccaccugccucugccucccgagugcugggauuaaaggcgugcgccaccacgcccggcucucuuuaacuuuuaugucaacugugggucaacacugagccugccucccagaaccacucacauaguaaccugggcauggcuaugcaggcugcccacaccaaauugaucuggucuuguuauaucccagacugcagaaugcacuaggcauugugguauuugacuaaugggcuaguccaagcucaagacaguuuaccuaccaaguaauggcuccuacuuaccaucucuuccucugauaucccuaucagacaaaggcuuugagcauggcuguguagcaguguuuuguuaguuccuguguacagguugucaccuuccaucugguaaguucagguuccauagaacaggcccagagugcugcuauugagguuuagggacccagugggcugaucucugauacuauuccugcuuauacaguccccuuaucacacuguguucugaaggggacaugaaggcaggcaaguuuaacuggaggcucccacagugcccaccauagcugggaauuccuagccucucuguccgagccugauccccacccccuuuaagauaccccccucuucuugccuguguguguuuccuuccuuccaggaacagaacccaauagcacugucaagagcugucugugcuugagccgggccagguuuaugcucugagcauagggcagcuucagaaggcuuuggcagcuggcugcagugcccagcuuuggacaugagauggugccugcagcauuucgagcccuaucugcucacuccucaaagcuuccuuccauagccuccccaguggaggcauccaaaccaagucuauaaauuuugugaccaguuaguaggagagagaguggagagauaaagagaggcuggaaagaccuugagaugggugggcaucugucauaggugccuaccuggagcucacuucugcucuugagcuguauaaucuuuaccuucccauucuuugcuggggugggcuggugaguccaggagggagggagggagggagggggagacagggggggggagagacagagagagagagagagagagagagagagagagagagagagaauguauguguguguguagugauauaagccccaacccuagcuuggcuuuggcucuguuuaagacauuccuguuucaggcugccucucuucuacugcuuugccuugagaccaagucuggguacccacauccccaaaaggauggccagugcauccugggauacagagcaaggcuuggguccuuuacugaauuuguggagauacacagcugugagggugaaaggccccuugaugauaggcccuguguguggugggaagaugugcauacuccuucuucaagggccagguugcugugcuccaggccuacccagccccaaccacccagucauggaguuggggagggccagcguuccagacccggcccucuuagucugcuugugcuggcucuucaacuaggggagcugcgguuaacauuucucacccacacggacuguugcucuguaugucuugcauauccauauuuaaaaugguauuuacauauucauggguuuuuaaauaagcucuuauuguuaaggaauguagaaguggauaaaaugugaaacucccucuuuuauucaagcaccagagaaaacgucacccccaucuaccccaaugcaaucacuuucugagugcuuagcucuguugccaugggagcugcccugucccaugguccucucucaauucugcccagcccguguccagcauacagcauacaauacacagcauggcucacagcaugcccacagccauguccuuuucuugucauacucuggaucccucugaugugacccuuacuuccugauagaguccugaagacaccauccccauuuuuccccucauucauuuguauguauguguacauguguguauauguguguacaugaaggccaagggugucuucuuccauuacccucacuuucugagacaaugucuuuugcuugaaccuggagcucacugauuuagguagacaagcuucuccaguguccugucucuuccuucccagcgcuggaguuacagacauccacuauugccccuggcuuuuuggaggguuucagugauccaaacucaagucuccuguucccacauccuccugcccccccccuuuuuuuuggaagaaaaauuaagacagauaaagcuugucguuuuagaaguggcagaguuagagaugccguugucauuacgugucccugccuuggccucagguacuccuuguucugcagcuggugaauagggauuugaaggaccagugucuuugcacuuuccuuuucuauagagacaagaagcaaccacucccuucucccuccauaguccuauaagggucaugggccagacagaccuaguaggacugccaguuuuacaucuggagcugucugagccuuugcuucugggaugucugucuguaggaagcccauuggagagcacuguagacggagagaguggaggagccaaggaaggaaauuuaguggacuagccuuggcugggguggggggcaaguugaguaggcauuggguagguuccagagauccauagagguguggcugugcucuucuggucaguggcuggcuagcacgaggcagcggaucagugcagggcucuaagguuugaacaguaaauacuuggcuggaagagccuuuagggacucuuaagaauuugacaucacuuugacagaggcagacuuaauacgcauaauuucuugucucuguccuuuacaucccuuuccuaagcaugacaucauguuuggucaacucagugaggccuucuuguagaccauggugucugggaagcccaaggagacagcaauagacaugauuguaucaguaguagaaagcagaugugcagaaaacaguguguaggaaagagcaacugaguagugccaucugcauuccacauagcuuuaggagucucugcugaggcuguagccccugggaaccgcugagcauuugacacccuuccccugccagcagcugcaggccucaccugaaccgcuuagcagccuagucaugacuggaaugcaggcauacuguggccauuccuugggacuccuuuggaguggcaucacuuugccugucaccagagggcagugagagaugccucccuuugucaaugacuggaagguggcauuggccagguuacuguuaccugagcugcuacuaacuagguccuuuguauagagacccuaacucuggccuggccuaucuggcuggcuugaugugagugcacugcaguucucagggccaaaaccaagggaggcagccauucuugaugagggcagaagugcuugcuggguuuagggcugggcagcucucuugcuuuccagccuugguuacagacccaugagccuggaagaggguuguccuguggcucagggucccaguucuaagcacucccagcucaaggccagucuuugcuuggcuguuagugcccuugguuugaggcuggaaugaguaugcuccauaucagggcaucugucauaugccucugaggggucucuagggccagcuguguagcuggggagaaugggagcuguggcucauaaagggccuguggagauucaugacccuuagauggcacacuccuugucuuccagccagucccuguggccaucugggucugaacacgggccugucuguuaucucugucucacagugucccauugggcaguacuuuuucaagccagaucagucaaggcuuucucuggguuaugagaccuccauuccugacaguucuuaaaaccugggccaauagacacaguuuuuuauagaguguugguguuccugagacugggaaauauggcacuggcccucgugcuaucaagcacugcucauucaugagccagcaugagauggagguggcgugcaguagagcugugaucccuaucagaaaggaguucccugugauguggaaggauaaacagaggaucagugggaaggcugggaaggguaaacuuggggguccccuucccagcaaugcuuccuucacacuugccggucccacagguucccaccuagcugcuuaaggagaccgucggggagacagcugaggcuucaucaaggcccagacuaguugccuuucccucuuuaccagugcacuugaguugcagcagagaaguggugggcacauucagcuugcaacccuuggucccgugucagugcuguuuggcaucugguuucaggaacccagcauagcagucacugaagacaaaguauuuauaauugagacuugcaucaggguuuaucuuuuuuuuaaaauuaagauuauucauauauauauauauauguguauauauauauauacacacacacacauauauauguguguguauguauguaugcauguauguagguuuaaauaaauaaaauaugcaugccaggcauggugguauacacccuuaaucccagcacucaggaggcaaaaguggacaaaucuuagugagauugaggccagccuggucuacauagugaguucuaagcuagccagcagggccacacaaagagagaccuagccucaaaaccccccaaaaaaauggaagaacaaaguaaaacaacaaaaaacaacagccuuuccccccaaaaaaccaacacaacaacuuuaaugugccaagcacaaacacacacauauaauaauuaauaaacauauacaauuaauauuuauguuaaauucuuucauuuaaagucacuuauugucuaugaauauauaaaguacuuauguaucacccugcccuaucacucuugcuuaucucccuuccucuccuguugaacucaauguucuuuguaguuagcaccugcggcauucuaaugucuuuacucuuuucuuugugaccuacugaguuugucgagugaggcuuauuuacuggagaaggacaacuuuguaguguauagcacugaaggacaucacccucuccugguguagcaguuacuuuucuguugcugucgugaaacaccacaaccaaaagcaguuuauggaagacuguuuauuuuggcuuacaguuccggagaggguccauacuggccagagagguagugcaaagucucaguggccacagcaggaaggcgagagaucugucucaucuucaguuguaaacuugaaguggggcaaggccguagacucucagccuguccccagucacuuccuccagaaagcugucuccuaaagucuccacaagcucucuccacaacaucaucacuacugggggccaaguguucaaauacaggugccuguggggaucauuucucauuugaaccacugcacccagcagcugugaacggccaguuucuccuuagggagagucgagaccuccuaagucccuccuccauccauaauggauuguuggcugguccaaucugggcccaauaucugugugugaucguagcugcuauguacuuauaaccgcaacagacaugucauugccagaagucucuguucccuggcacuccaacccuuccuucagccucugcauucucuuuucccccuaggaagguguuuccaauacucugccagguuuagugagaacagugaugugccaccuccuuuacguuugguuaaaggugaagcacuggauucccaugucugccucagcgaucaggcugcuguaguggucuguugaaaucuggugacuggggggugugcagcuuguuguaguaugaauaugguugugaugggcuacuguucucucccccugccucucuccccuccucuguguguguguguguguguguguguguguguguguguguuugacugucucugucugucuggaauccagagacucaguaacagaagagcuauagagcagcacagugcuuuagaucagaaagcaaugaugaggucagugugccaggcucagugugcaaacucagaaacagacugcuacuuacauguauacuagccaauagagagaaaaaggcugcgaauauggguauagucaauaaggggagaauuaugaguuugaaaaaaaaaucagagcuauaaaugcucagaaagacaucccaugcucauggacagaagagucagugcuauggacguguuagcucucaucaaccugaucuggggugcaucguuaccucaacuacagugcuggaaguuauuuugugaguuguguguguguguguuugcuuguucaugugugggugugugcacuugugucuuaggguguaggagcacaugucuguacauguauguggaggccagauacacuccucuuggcuuucacuccuuagaugccauccaccuuauuucuugaaauaggaucucuuccugguuuggacaccaagcaagcuaggcuggcuccucugggggccucagaggucugccugucuuugcuucugguuccaaguacaugcuaccugcuuccuuuuccucuucgugaauucuugggauucaguuugaagucuuguguuccucagggagcacuuuacccacugagccaucucucccagccccguuuugagaauguugucacauguaguuucuuaagccuguaugggaaagcaagagauccagaauagccaggacagcagugaggaagauugaagggacagagcggacaucugacagcagggcugaguggggaugugcagugaugcagacaguaugaccucauggaaagguggaagggcucaggacccucaccagcacagccagcuaacucugacagcagugcaaagguggcucggaggaaggagggacuuugccacaggugucaaaugagaacucaauauccacaggaaagaaacccagcccaggccucugccucuuaccagcaccaacuccaggaggauccuaaaccugaguguuaaacacaaaacuugaaauuuucugaggugacaggaaagaaaucuagcugaccuugaauuucauguugacuuucaacagccaacauaaaaggcgcaauuucuggaagaaauaauugauaugcuggacuuaauuaaaauuaaaaauucuuuuuugcugacuauauugccaauagaauaagaagagagaucauagcuggauguagugguguacagaccuaucaucccagcuaguaggaaggcucaggcaagaguauuacaaguucaagggcuaccuggguuacaaaguguguuuagguuuaguuugagcaacuuaguaagauccugucuaaaauuaaaacccaagccuuuaaucccagcaccugggaggcagaggcaggcagauuucugaguucgaggccagccuggucuacaaagugaguuccaggacagccagggcuauacagagaaacccugucucaaaaacaccaaaaaacaaaacaaaacaaaacaaaaaaccaaaaagagggcuaggaauuuagugggagagcaucaauguagaacuccacugugaaagauuauggauauagcucagugguagagccccugcccagaauccuguagugaggggcugggguguggcuaggugguagagcuccuaccuagaauccuguagugaggggcugggguguggcucagugguggagucccugccuagaaucccccaguaagggguugggggcauggcucagugguggagcuccugccuagaaucccccagugaggggcuggggauguggcucagugguaaugugugacaugugaagaagccaagguccagucccuagucuugggguugggguuagggccaacacugacuuucauguugauuuuuuaacauucaacauaaaaggcacaguuucuggaagaaauaaauuuugguaacacuggcuguuaccaaaagcccgcaaaguaauagacacaguucccauucuuugcuggugggaaugugaaaugguacagcuauuuuggaagacaguuuugcagccauaaaccaugggaaacuauuugcaaaauacauguugaacaaaggacuuuuaccagaauaccaaauaugcaaugaauuguuaaaacccaguaguaagaaucaaguuaacaaaauggguaaagaucugagaguagacuccucauugaagcgagaaacagauggcaaauaagcuuuugaaaagauguucaccaucacaugucacuagagaauuguaaauuaaaacgagacacuuccaugcaccuauugaaaugucucaaauccagaacacuggccauuaccaaaagcccgcaaaggaauagaguucccaugcuuugcuggugggaaugugagaugguacagcuauuuuggaagauaguuuugcaguuucuuacaaaaguaaacauacuuucaccauauggcucagcaguuguacccucuggagcauaccuggaugaaucaaaaccugcauccacacagcaauuugcacagaagcagcaacaacagcuuuacucuauuuuuagccccacucccuccuuuccuuccccucuguguguguguucaugugucauuguggguacacaugugccacacacgugugaagaucggaggacaaccucaggugccaguacuugcauccuaccauguuggagucagggucuuucugucgguuuccacuguguacaucagacuagcugacucucaggcuucuguggauucuccugucucugccucccaguucccuguaggaaugcugggauuagaccuaugcacuaccaggucuggcuuuaccugggcucuaggcuucugaacuccaguccuucucuuauuuuuggccagugcuuuacccacugagccaucuuucuaguccagacuuuagucuuaacugccaaagccuuagaagcagcuaaaaugaauugaagaggugacuggauauauaaacuaugguauaccccaaaagugggauacuguuaagugcucaaaaaaaaaaauagacucuaaagcugugggaagacagauggacucucauacuuucucuaagugggagucugagguuucgauugcaggacauauuagaaaaaguaucacaauagcaguggcugguaaguuguggggagaagagggaugaaugaauagagcggcgagcgcacacgugcgugugcgugugcgugugcguguguguguguguagggggugcaggccacaaccuucucuacugaagcagggucucuaacuugaacccagagcauguucccaguuggacaugucuagcuagccauguugcucucugcaggaugacuaugccucuuggcuucuggaguuugugcggcgcuggcagaccuuuaauguuggagagcugcacggugcuccuacuugugcugcaagugcuugacugaaucauggagggaacacaucauuccaggggagcauggcuggcuccaagguucugggggauuccuaggguuucuguucauuuuuguuaacauuucuaacuuucucuaaguaauaauguccaucuggacagaagcagauuacugucugaguucuuuucuuaguugcugugaccaaauaccugacaaaagugcuuuaagacuaaaggguuugucuuagcucacgguucugggguacuguugaccaugccaucguggcagggaaggcauggcugcuaacugcuggcugcaugguguccauagucaggcagcugagaguccagugcugaugcucagcucccuuccuccacauuuaguccagaggaccgugcugcccauauuuagggugaguguuccuuccucagauagucuagaaauuucuucacagacacaccccaaguuguguuuccauggugauucugaaucuacccauagucuacaugaaaguuuauccaucauaauuacucaguaagacggggcuagagaaagcauugucucaguguugagagucucuagaacuugacugucagcauggagacucaaggaugccaaucugaaugugcugaccuguccuuccuuagcuuuggcccaguggccucuuaacuauauggguuggucccuaucauccuucagccugugguugggcaaaacaggcuuuuguagcucucauugagcuuuggagagaacagauugacuuagugaccagagaagccgaagugaggagcuaaguugcuuugcccccagccucacuuguguguauauagcuggaauuauagccgggagguuugagccugggguugugaaaaagucaaguggaagaucaaauguggaucugguggguuccccugagccaucuguaguccaggccuacucugggucuagccugggccuguuaacucaggcaggaagacgcuugcgaacauguuggugggaauggauaggguuuagacucaggcaucugcugacagugccugagccuaccauacaagggucauuggcucagugaauuccuugaauuuuaacagucucuugucuuucuguuagagagacuuucagcaccuucucauuuccacgcucugcuaauuuuauggucauuccauauuuucuugucauaaauguaacagauuuuauuguguuuaaaccauuuuuuaauauagauucccauaaaaagcuggaggagugagaggcuuguaccucaucagaccuuggaaggcucauccaccuauuuucaagcauuugggccccauccauggagcauucuggaggugcuccuuguguucuugcuuagauaugcuauccccagaggggcugugcucuugccuuuucuaacagaaguucccagugcauaagguccuaucaagauauaugggcuuguuugcaaauagacucacagagagggacuggccaagggccuggggcacaggucgccugucacucaguuauguucauggcauagagaauuuaucucuggccacuuggguugcuucuuagccccagauuguccagucugcucauucagcuguccccaggaguauuuacuggggaagacugucagggugccagggcuuccuggcuuauagagccagagcucugcuaucuuacugcuccuacagucucgcucuggccuagaagguggugacaugguucacaguccauauuagguguggguuccauguuguacccagccagucaccuaagaguuggggcacuaacucaggcaagcugccccaagaguggugcuuugugauuuaucucggagaucucugacugucuuagaauuuguucuaaucauaucucagugucaguuuaaaaacauuggaagauuuuuauuuaucuaauuacuccacaucucugucacugaauguugacugucagcagacacucaaucacuucucaucacaccaaauggcucuccucaaagucuggcaggccauucacaaggcacagaacugguuacuuccaggacauggggauggccuuugcaguguggagaacaggcagccuuacagcauuggcugggcccuggugguuccaguaggcugcacuauggauggccuugagggcuuacagucagucaggucugcuucacucaggucuuccuuccauggaaggagcagagccacuggaaguagggacucaggaagggaguggcaucuccucuguagucuacagcacacggcuggcucuccggugggagcugaggugauccagaaggucaggcauucagcagggugacaucuagacccccaggcuguugauagagagcccugccccucaguucuccuggggaccagaucccuggcacugggagggugcuucugucacagguagguuucagugaccauguggugccugucaucugucagacccuccuggcgcucaccccuucccuggggaaauguuuucuucacaguucacuggaucccaacaggacagcuuuuccgacucaccaggaccaugcuggcagcagaugggacccaugauccugagucccucugugcugcccaccugacugucccucugacaggggcugccguguuaagccugggcccuguguucagacaggaccuugagaugcuuuuuuugccauucucugagcugcugcugcuccagcugcuuggaccaacuuggugggugggcagagauagccacauuuguuuuuccggucuuugggaggaggcaaagaaccagccaggcuaucaugugucaccucucagcagaagaugacaguuugccuccugccugccuucuuucauacaguugucucaggagggucugcugggcacacgguccuuucucagaagaaaugcccaggccuuugaaucucaugguuuuuagccaguguuugagaacccucacauuugggcucaguguuggacagugccugcacagggaggagagcauugcuagccaugguugcagagggagccccgaggagccuuuggguguggcagccugaccugucugauauagucccauagagaaaagucuugcugcucugugccuuuuaaaagucaggcagcacuccucugagccccacccuggccuuccugcaugcaucuuccuaucccuucacaugacaaccccugcccccacguuggcucuagcuagugucuuggggcucagagauucucugaguucacccucaggaccauagugcugcuucaguccuggcucuuucuagccauugaacagaggccucugggccuagagagcugcaaguugcaaacucagguuccuuucugcagagaucccuuauaccuggccccuucaacuacaauaccugcagcacacuggcauggcucuguucacugcuguccuucccucauggaagcaucgaacagguaacucuuggagaagaaagaggccacuuggguuuccgaagcuggaggcccacaugcuggcuuuccuuguuuauuccugucaggcccguaugaagagcacaggcagcacagcaggccagcucuucauggaggagcguuuuucuuccuggcccugggagcucgugggucuucaggaaguucuguuugaacaggcugagggaaggcucuagcugcugugucaagugcuagaugacggagaggccugcagacaaggacaagccuaccuccuagcagaggguacagugagcaugcugaguagcuguuagcugucccuguauccauguuuguuugugccaggaacuaucugcuagacaaggugccugaucaaaccuucagccaucuuggauaaaagugguguguguguguguguguguguguguguguguguguguguguguguguguguuggggggguggggcugacucacaugcucucagucauacagguacaugcuguggccagggucaaccuugcacgccauuuccaggagcugcccaccuaguuuccugagaucuuuauuguccuccagcuuggugauuuaaguaggcugauuggccagguccuucuuucuugacuuccuuagcucuggguuuacaaacaugccaucauuccuggcuuuuuauguggguuaacaaggucaaaguuaggucccuaugcuuguguagcagucuguccagccucuauuuauuuuauaagcaguauuuugcucuauaaccuggaauugccuuauacucaggaugcuccuccucuaaccucuggagggcuggggcuuaggcaucuaccauuacaacuggcaacuggucaugguuuuugguucuuugguuuugcgucagacuuggucucaggaggcacacaguucuggucacuucuaggacaugggggguggccuuugcagcaugggaaacaggcacacauacagaaugagcugugcaggauucuugagggggcuguuuucuuacuacagcuaugugucuugagcuucuggcgacuucuuuguugacaagugccgugucaugacccgagaugccuguucuucauacugcaaaggccacccccauguccuggaagugaccagcacugugccuugugaauggccugccagacuuugaggagagccauuuggugugaugagaagugauugagugucugcugacagucaccauucagugacagagauguggaauaauuagucugggaccagagagcuauaaagaguuuguaggcaauggaauagucaccuggcucgugaaagccaaauugauuuggcagugaucuaggauggagccuucagcagccacugaagugcucaaugguggaaggacuggaaccauucauaauuugccauugcuuggagcggccucuguguguucuuccuuguaaugaguacacggcuuaaacacuuguauucuuugaccauuuuagucuuacgugauaugcuuuggcccaaucuccccauuaugcugacucccuccccaaaacccuuuuacuuucacccuguccuuugccuuuucuuuccuccuguaugccuuuuugugugucucacugcauuuaguuaggguugcuuacugaacaugggugggauuauacacuugggcaagggcaccuuaccugaagcuaucccacuuagaaacugacucucuucuacccuucaacagacuugcacugcccauuagcuccucagggagggguagggucucugagcuccuuccuuaucauugguacugugaauucuuggguuugaggcaggaucucauuuaggagucuaacuagcucauggcuuccaggcaggcucuucuuuuugcuucccaucucaccaugggagccuuguaguacagauguguuaucugccuggcgauucgaacucauauggcaaguccuuucgcacugcuaagccaucuuguggcaguuuucgguuacuggucugugccuuaagaccuuguggcagccucuuuuuauguccgcacaucuugccgucaccuugcuuagguguuaaccaaguuccaaggguggaugccucguccaccugcuuagguguuaacccaguuccaaggguggaugccucguccaccucucagguggcccguaucacugagacagcuccacacauagacgucaaccuucaccaacacuggcugugcugaggcuucucaguucauggcuguaaaugucaggaagccaaaugaugguggacugugcacuaauuggccacguacuuggaagcugcaggcgggcucacuuuuaaguaggcgcuuugagcuggccuuccugcugucuacucugaaauucugaugcuggacaaaugucaggaggcuuucucuacaccaucacuuucgucuuuuugaagagaccccggaggccauuacuggagacggaaguggcccccaucugguuuaaagauagccauagagagcucauacgacccugcuucuggcuucucaggcagaggccagcagcugucaugacccacccugucucccgucaggcacauuggccauugaacccucugguccauaguuagcgcuugcucuggagugagcuaagcagguucccaggcucaccuggacagacaagcacucauaaauauucguaaauauucaugucagaaacugugcccuagaaauacaguuggagcuuuauucuuagccuggggaagagggucuaagugauugguagucugaaaugucaccaguauuacucguauggguggacaaagggccaucgugugguuccuuggcuccugccuaggcuagugccuccucuguccugccagugucugucuaugcugguagcugcugcugucacucucccucuacagaguuugcuguuuguuggcagcacuagaggcacucaaaggaccggagaagugaauugaaauaccugguggcuuuugugagucucaccaacaguccaccaucugcucagccucaguucaccagcuucuuguguuuuuaaacuguccaagucacuagacagguuguuauuauuucuucuucuucuucuucuucuucuucuucuucuucuucuucuuccuccuccucuuccucuuccuucuccuccuccccuccccucccucuccuuuccccccuccucccccucuccuccuccuccugcuccuccuccucccccucucuccccuccucuuccuccuccuacuccuccucccucuuuuuuuuuuuuuuuuuuuuuuuuaaugauagggucuuaugaagcccaugcugacuugcugagcagcuaagcauggccuugaacuugcgauacucccucagcuacccaaguguuuauuuauagguauacacaaccacauccaauuuaugcuguucugggaaucaaacacagagcuuugugaaggcaaggcaaggagucauaccuccagucugucaccagguggguuucaaaugucacucuguucuggcuuuguccucgaagaguaaugacugcugcagguuccuccucuaugucacauggugucauaccugacaccauggccuccuugucuugccuuguauguauguucucuggggcagacacuggcuugccuuuccagggcucuuggccaccuauuugagcuguggccccucucugcuuuucuccuuaaauucuuggggucugugucucuagucacuucaucccucaucccaugagugcaucugugcauugucucccugccauauauggcacugaugugucugacacacaccugugccugcuggucaguaggugucccaagugaguagugaugggugggguagguaccacuugagcugagaucauccccccaccccgagcagucccugccuugggaaggcaugacuaaggagcugugagguccugaggccuccugcccaucagagcgagucccucacuucuguuccuccuguuucccugggccauuuguuuccagcuaguggcuuggcauuccuuccugugugcuccuugauguucuaagccuucccacuggcucugcuugcuccauccuuccccuggggccugcuacugacagcccugagggcaucugcacuagauggcaagcugaccucuuacugaauccaguccccagacugaccucucggugucaccaucugacccucuuuacauuuuguguaucuuauaaauauggggccuuuggagcccagucccuuagaauuuggaagggugagaggggcuuucuggugagugcauguggcucuacucucagaguguuucugaagggccugugucgucaugcaugccgucuguccucuucuguuguguggaagguaacagaaccuggacauggccucuagcuacuuccgaguaaauggcauugggcauaugucaccguaagcuuccuguaugguguugacuuaugcaccugaugcccauuuacuaggccuccccuccagguugggagucuugucuguugggagacaacuuuuggguggggacaccugguggggugauagacuguuuuugcugagugcugacuuugcccuugcgauggcuucuggggcaggaaucuaccuaauuagauggguauguggcucuugggagaaaaggccuucuuccagaauggucuaucuaugagagcuauggccucugaccgugcuuacauucccccucugcuccuaggguuggugccugggauagacccugcccagaugagccuacaucugggguuuuagcacucagccuguuccuuccuucaccccuuucucuggagcggcaugcugccugaaggcuguguaggaacacacuggcuuucuggaaguagcugaaaagcucuugccagagagacaaaggugcugacuaauugacggcuuuauuuauuuauuuccgggccuagaugguaaacagcuuugauucucugcucagcgggaacaggcgggaggcacugccugauugauuccucaccugcaggcaugcaugggggagccuaucgauuggccccgcuugccaaaccuacuugagagugggcuuaauugccucaggacugcccugcucacaccaggcccuagcaagcuuggccuggaggugucacucugcuugcugagggucucucuccaucacuguauccuuggaggccccacaacuccuucuagguucuagccauucaguggccccagagguccaggccacuggacauauucccuaggcugcuagagaaagaaaugcaaugaggacagccuggaggggucagggaagcugagugaccuuugcagagacaaccagaggcuggcugaucagcacccucugccucugcacuccgaucuccucucacaguggccauaugucuagcuuguaugggcuccugugugucauuucauuuuuggccucuguacuggcugggcucugcugugucuuguggaguguuuuuuaguagaaguggacagaugccaucccugucuguugauuggacagaucccuuacccuuugggggcagugugugcagggaagauggugcugcauuugggcaggagcuccgacuuugugaugcugaguguggggacagugugucaugucccuccccuaacuucuuaucuuguuauaggggacaguagucuagaacauucauuugcaaugaaauguucauguguuuagucucuauuuuugguccauacaaggauuagccaauagacuagguccuuuucccuggccuaugugaaggguggcuaaaccaggguuccuugagccugcuaucuugccuguucccccaccccugacagucacuuuaggcaguuagugaucccuggacuuuaccacucuuugcuuguguaucugugauucuucuaguguccucucagguguccauccaugcccagcuguuugcugucuuuggagcagcauuugcaagggacagggcugaggccaguuugaugguccucucugucugacacaguagggucagacuuucugcuuuaccaagugauguucugcuggccccucacuugagacuggagacuguugccuguuuacuccugggggucuguggcugguggcugauguccuugugcuugcuuagcucuggacccuuuuaccagccacaaacugccugccugaauccacagcauaauccuguaccucuucucucccaaacgugcuuagagcugguuaccuggaaaagcaagaucaauggcuucaauaaugagccacuugcucagagcugugagucugcauccgucacccauggggaaacuccaggcagagcagugugccuugaccuuguagacuaaagugugugcgugcaugugcugugcuugugucccuccucccccuugucccuuucacuggggcugauacccagccccaucaggcuuuguguuguguucagagcauacuguauguggaccuuaaagcugugccagugcugacauuaauguggcaacagggaacuggucagcuacuggauaucaucucaugaggggucuuagaccuagaaggacccucaucugcacugucuaggucuguccuguaaaugauacuauacaggccaaucccgucagaguuaucugaagcagcagguccuggaugacccuuuagaucugcauugcuacaggugugucuccccugagaccuucacauucaacauuuguauggguccugucucccaugacugcauguuuuauguggguguugugacuuugucaucucucaaacaccaggugcuauguagcaagguauacuagcuguuuugugucaaccugacauaagcuggagucguuugggaaaagggaaccucaguauagaagaugccccaucagacuauucugugguguauuuucuugguuaaugauugauguguguguguauugggguagggggcuagcucacuauggggauuguuaccuugggcugguaguucuugguucuguaagaaagaaggccaagcaagccaugaggagcacaccagcaagcauccuccuccaugguuucuguuugaguuccuguccuguauuccucagcaguggacuggaucugaguguuguaaacagaaaugaguccuuucuucucugaguuucuuuugaucauaguguuuucucacagcacuagaaaccaaacuaagacacagggcuaucgugucuucuuggcugaguucuuuccagcugacuucuaucaucuuuccuagguagcaccagcaccuacaaauggaguucuuugcccugcccauagaaaccacuggacucagcaggaucagucauccucaugccguaaucuugauggcauugagaggcgcaccuuucugucacuaagucgcccuuucccagccuggccuuuccccaaaggcucauugauccuucucuugaagcuaggcugcuuguguuuuuagagaauguugguguuguuagaaaaugaaucacaaauacagcuccugguuugggaagcucuguuuuaggcacgugcuugagggcugugcucagcucaucccaaaguuaggaccccacuugugacauccuguggcagugcuccuacgcuggcacgguggccccugugccagguugucuuggaggauguuauccguggugaggggcaacaguaagcaugugaaacacugccuuucuccugcacauagggagaagugaaggaucgguuuuuuuuggggggggggcagggggcccacugaacuugugguuugguuuguaggauggggaagucaagagaguaugauggauugggcaggcuucguggugucagaccacacucggaggcuagggagggcagggacccugggaggugagcagguaccugagaauguaaggcaucuccagguccccagaagcagagaucuugggaagugggcaggacaggauugaggcucaggaagaagagacugaucuggggcuccugcacagagcuucuugggaaagaggaggauagcagacagaccuuggggaucaguggcucuuagcuagagaguuugaaaggagagugagacccaagaucacaguccuggauacuagcaaggaggggggguucuggaagugguugagucagggggaaauggaaagugagggcccaguggagguuuggcagagugaaugucuagaaagcaccuugaacuuugggguguaucacuccuuaguauagauugccuccaaagucagucugucagucugucuaucuguugccucuguggucucugucucugcacaaguacauauggaugcauaugcaggcaugugcuuguguauggagcccagagacuaaugcugggugucuuccucaacuguucccuauugaaucuggaacuuacaguuguguuagguggaaugggcaaugaacuccuguguuccugaugcuuguuuucucccucagggaagcuagauuuaaggaccugcuaccacgucuggcuauuuacaugggugcuggggauucaaacucagguucucaugcuugugaggcaaguacuugaccaaaugagucaucucucuagucccugccucuguccagagagaagcacacccacaucuggagcuguacuccugccuugcucugccgaaguaagcaagcucuaggggagcccuacacacacauuguucagggacgggggaaggcucccccuuuccuccccugugaggagagcuguggcguggagaugugaaggugccacagccugugagcugccuucugugucccugagaugcucagcugagagcuaggaauggaaggcaguacauagagagaauggcuagggcagaagaauccugcauagacaagccgucauaggaacaaugaagcauagaugcagguccaggcugcccucuguggauaacugugcucugauaagcauguagucaagaggguggggcagcugggaaugcaggcaacccaggggcaagacuuuguuuucugggguagugguucaagugaaugccagucuuguugcuguccacgagcugaccuugucugagcaacccaugacuucacacaggucucucagaauggcaaaucuucaaccagaaugcagagcuaugcucuaucuguggcaucuggucuaccugcuguguuucaggcagcuugcuccccgagucucagaguucugguacucaugaagugcaggcuauggcuucuucuggaccauuugucauucugugugguucuuacaaauuaacaugaauggaagccagagagauggcccagcaugccuugaggcugaguaugaguauugcucuuguagaggacccaaauguuucccaccaccuaugucaggugacucauagacaccuguaauuacaguaaauaaauaaauauguacacacacacacacacacacacacacacacacacacacacacaauuuuuaaaagaugacauaaagaaaccuuuguuuuuuaucauguauucuuacauagauuuucaccucuccuuugucauguccaagugauggcauaaccauuccuucucccaaccuguuucauccaaaggagaggucugucucuagccccuugacacaugccaucuugccauagggauuuuggcuauuuccaauuugucaaaaagcagccgaagguccaugugguuguauguggaugauaccacacugcuuucugcacauuauuccacuauaaggguguaccacacuuuaaucuguuuucuaugcaagaacaucuaugcugcgaguauuuaacuguaagagcacaccacaauuuauuccuucauucuuuuuuuuuuuuugguuuuuugagacaggguuucucuguguagcccuggcuguccuggaacucacucuguagaccagacuggccucgaacucagaaaucugccugccucugccucccaagugcugggauuaaaggcgugugccaccaugccuggcuuauuccuucauucuuauuugagcuauuucugugcuuugguagagggaaugaaacugcuacaugugagcacuccaccccuguguguguguguguguguguguguguguguuuguguguuuguguguguguaccuuuguggucagguugcauuuuuagcuucaugagaaauggcagagaguuuuggcauggucauccucggaguauucuuccuuggguggaugcugaucucuuuggucuccccauucucucagaguugugggcuacagguguauuuccagguguguagcucccuagccuucacugucucuggaauuuuccauuuccuuggcaguguuccagucagcuuguuuucuguauucaacucucugcucaccaagcucaagccccagcugcaagauucagguuuuguuccaucucacuacgcuccagcagcccugcagccauuuaucuuucuucauccccucagccucuuuuucauuuagcucaggacucacucaugacuucagaggaacugcuucuguaguucaucauagcccgugcuucuguguaaggugcaguaugaugacugagcagacaugaucuuggaugaaagugguacccaaaggugugauguccaaggaggagguugggggggaaggagaccaggcugucccgaauuugacuguuuucaagccuugccugguaguauggugugggauacacagcacggcaguagucacauagcaagaugugugcaaugugaugugaggcacacauugugacacaaguguauaugcaucauugugugacuguguagaaugaaguaugugugugauucaagauaucagcuguaugccuuguugguguucucuagcuauuuucuaugauuuuguguguuuguuuccauuugaguauaugcaugcaucugugugcauguauucaugugugugaguucauguuuuaugugcacaugaagauguauauauguguaugugcuuguucacaugcuugugguuuuaugugugugugugagcaugugagcacauaugaguagcccagaggcaaacaaucucaaccacucuucacuauauuuaucauuuuaaaauuuuauuuuauuauauucuuagugaugugcauguguuugugugcaugccagauccccagagcuagagugacaggugguuaugaguuacccaauuaugugugcuaggaacugaacuuguguccucuggaaaagcagcaaaugcucuuaacugcugagccaucucucuagcccauccaccguccuuuagagucagggucucucacugacucagcuaggcuggcuggccagugaguuccagagagcccgugucucugccucccaagcacugggguuauaguugugugucaucauagagacauuuauguggguccuggggaucugaacucugaucuucaugcuugcaugguaaaugcuuuacccauugagccaccuuccuucccacaugcuggcuccugucuucccugagcucuuccccaguacucagguaccccaugcaccucuugcucuucaugcacagcuucccuccugugcucggacauagcugucuccuccaucugccucucuuuagggguaaacagagcuuucaguagaagagagagaaacaagggagaugaugggucagaaaguguuuauguauugcuugcugacgaaccauuuugagugcaacaagaucccagggcaggcagucugcccuuucugugaagaacaggaaggcuucuuacccuguucuuacccugugcguggguaucugggugacagguggugugaacccaucacaggaugccuucauagucuaaagagacgguacaagagugguagguacacuuggggucuaaaguugcugucucuauugaggaugcagagucacuuccucagcuucaugcuuguauagcccuuaagaauggcacaaacagcuuacuucagccccuuuaugcugaguguagaagagucugcuuccagacuguaccccugaaguugagaggaugugggaagaaagggaaagaggccccugcugugcucugauauacccugggguagugcuccuucccaugaaugggaggccaggcacagaaggggcaggagcagccucuguccuuuaucauagcugugccuuuugugugucaaggcaguaugaagugugguguagggccuucugcagccagcaccaucauagucuggcacuacugaggcacugggacucggagccccugggugaggacaguguggagcuucagucuuccuguccucucacuaggcugcaagaucaaacaguagaggacacuuuaggaacauaaacuguguauuuuaaaaaaaauaauuuaagccagacauuggugaugcacacauuuagaccuaguauugggaggcagaggcagcuggaucuuugugaguucaaggccagucuggucuacaggguaauauagagccaggguuauacagaaaaacccuguuuaaagaaaaauaauuuaaaaauucauagauucauucauucguguguguguguguguguguguacauacacacacauugaucaucacacacacacacacacacacacacacacacacacacacacaccccgugcaccauuauuuucuccacuuccucccuccaccuccugauaaacaaguccccuucuuuucuuuuuggccuggugcauuccauuagggaugcuugccugagcauggcuggaaaugauuuacuugagaaaaaggcaacuuguuaguguccucacugaggaauggcuccuaccccuccugcagcuguuaacugccauuagcuccucagggagugguggcaccuccugaacuccucccaucccaugcaggucucauguagguuccugcugcccugugaguuuguagauucacuagaccgcccuguccagaagacagguuucacacacucuucuccauccccuggcucuuacauucuuucugcuccuucuuuggugacuuucucgagucuuagugugguugacaucuuacuucaagcucgccacucaacagccacuuauucucagagcuuugaccaguuaugagucggccucuagacccaggcauugagagcacuaaugagcugaguccuaacacacaccuguuguaguugaauccugccccugcugucuccaucucuuggguuggcaaggcauguggccucgugacagccuuuccuguggcugggcugugccuguaaacaguuugaccuccacuuguaugacugcagugaacaucccuggcaacuguugggacuuccagaauguguucccaaaguccccacguggauccagggaauaauuaguauccuguaagauaggaaucuuaauucuuaaauuacauauuuagcagaugguccaaaauagcacuuguaauggcaacauucaauuagugaguuuaaaaauguauauuauugcaacauucucuguggguuuuauucagagauuucuaaauauaguggauaaaaacacagaaguguugcagacgauuuagacucacacugccgcagugggccaugugcuaaacuucccuguuaaccagaagugacugcccagaggucuucugguuuauuacucaaucuccaaaaaaaccaucaccaagacauucaggggcaucccuggugcccacagguccugcaccccugugccugggaauucugauguccuuagaacucaugagacuugcugggcuugauugauguggacuccaaaggcagccuugcucccucuguggaacggucaagugcauccugucuguguuccgugcccucacaauccuugguucugguuuugugugggccuaagguggucccguagguggacuagaaugugaaucucuguggacaggaagcagcugagagcuugccugccccauagagggccauuuacauugcaggaggggcagagcugggguaggucacccagaauucaggugauagaggucccaagacacaggccuguccucuccuggggaccagagucuucccagcuacuagggagauugaagggaaaugccaguugaaggcaugccuggguuacagagugaauuaguucaagucagccugaguagacucuaacucaaaaaaaaaaaaaaaaaaggaggagggcugaggacauaguugugggguagagugcuccaugagguacuggguucaaacccugggcauuaguuacuuuucuugugacaaaguaccuaacagagcaacaccaaaaagggagaggaggggagagagggagggagggaggauaucuuuugaaucacagucugagggugugguccauuauugacgugaagucauggcagcaagaacaugaggcagguggucuccuugcgucugcaguuagaaaacagagacaaaugcuggugcucagcccccucucuccauuuuauuuagcccagaacccuagcccaugggauggugccccuaauauuuauggaggucuuuucuccuuaaucacccuaaucccucaaacgcacccagaagcguguuaccauuucaguucuaaguuccaucaagcugacaagauaaccaucacacuccaguucucaauuaugaugggagaagagaggcagggaaccaugggguucagugcucugagcuacagagaggguauagugggcccaagacuaugacaagagccucaagcuuccuccuugguggcuguuugucuuccaggaacugcucaucggacaagugccauugcaaggaggcaaggcacuugguugggacagauccccagaaacugugagguccucuuuuagcagccauucuugccagugucugcuugggcaagagaugccuugcugggcaguuagccccacuaggccuuugcuguucuggccuucagagagaggaagcucuccuggugccagagaaagccaaggcacaaggucuuugcucauagcagcagaugcagucugugugagacggaaucacuguugagcugaggcacgggcucugcccuggggagcuuaggucccuggagaccuucauacuaagccuaggcacaggcuucauccugcagagccuagaucccaguguaugaaagcagagccucgauccuagugcaugaaagcagagcuuuaucacaggaucugcccuggagagccuggaucccaguuuccugaaacaggccuuaauggugagccaagucguggguucccacauuugaguccugguccucagagcaggccuucgugguaagcaaguguuuacagcagagucuuuguucagaaccccccaacccucucuguauauuuaaacaaagagcuuuuuagaccuaaacacagauguucauuugaaaaugagaaaucaaauuaagcggaaccagccuuugaaagugaaugccccguagcaagccaaacaaagggagaaaaacacuguguguaaauuucacuuaaaucacuuuuucaucuuaaauaaaguuuuaaaggaacaaagugccgcgucaaagcgcucaucacccuccuguccuccaauggaacaucugcgcucauucugaugugaggaaggaggaauuaagccaagccggggagcgcuccccccauaauugcgccucgucccuuucucagacacaaugcggaugaaaugccgauugagcugcugacgaggaggcugaauagccgaguggggcgaugugaaucccacugagccuauccagaggaucugacugcccccccccccccacuuucuuccuuuugacagagaugucaucuccuacauaaagaaaagacagcuugcacucagcucucagaagccccucccuacgguggaguaccugcucagcaaguuuuaaaauagguguuuccgcacaccuggacaggcacauugcuggacucucuggcuagcuaguguccucuggagggcuguuauacugccaguggcucagcaaaggccagucacucaaccuacaaggacuuguuuuagauuggaaaugguggcuguagguugguguuuuacauuauuauuauuauuauuuugaaaaagauucucauguauuccuagcugcucucagagucacuuuuuagcugagaaugaucuugaauuuuugauccuccugccucuacuccaguugcgaggauuauaggcaugcacuaccauggggaacucaggaccuuaugcaugcaaccaccacacccaaccagagacgguguuaccgucuauuccucucucucccccaaagccaagaugcccuccaaugagagagaauaaagaaaaguacaucccagcauacaggaagccgaggcggcggaacuccacaaauucuaggccagcuugacuuauauaaaugaggcacacagacacauagcaguuuccaguuauagaaagaucuugaggugaguucagugauagaacacuugcuucaugcaugcaaggccuuggguuccaucuucagcacuggagaaaaauugcagggucuggggagauggcucagucagcaaagucacucuuaucauauaagcgugaggaucuaagucuaagcuccggagaccauguaagaacuagccaggcaugguguucagcuuucaucccaaugauggcacaggggagacaagagaaugcuuggaaccccgacuauccagucuggaucaaucagccccagguucagugagagacuccguaccccccaaauaagguggagagugguuaaggaagauacuugauguuggcuucugacucccauaugcaugcauaugcacucaugccaaacacaugugcguacauuuacaaauaucuacaugcaugcaggcuguggagaguaaucuuagaugagacccaaaggaguaaggagugaguuuuguugaaagaaugggcagggcugugggggcuguugucaagccauacaaagcuccacaggauggagugcuguauuuaguuggcuuauuuagaggaguggccuguguuguuuugggaagcaggaagcucuguggugaauguggaccuggagucacaguagcaggcuguugacagcucaugggcuguugccuacucuuagggucugcagucccccaccucagcugaggcucacuaccucuuccuugucccuuuccuuaaagccuccccaccugcagguaaggagcauccugcuucccugcagagcuagggugggccugguucaucugcagcucucuguuuccuucccacccagaagaauguugcugcuuaggagccuguaugccccaaccagcuuaacacuggcaugguggccuaugcaugggcaccuuuucuuuuuuuuccaguaccaggcuguggguuugagccucucacagguacugccuuugugagcacacacagcacucagcaucugcugccuuuucuccagggauugaaugucuucagaauugaauuggacaguuucaucuguccccagagcccuacccgggccuguauuacaagaggucagucaggacccaggggaaucuccauaggcagcaggggcaacugucacaucuguggaaagugcuagucccugccacugaagugcuuccuaacugugggaagguuaaccucugcaccuuagcaacuguagaggggaugacagccaccuuuccccuuuuguuuuuggcugaggcccuaauggcucaagugagaccuuccagguuccgggcuggcagggagccagacuuccagugcaaggauacugaagguuuagggaggacuggcugcccaugcuggccaggcuggccaagcagcuccucccuuugugaugggacugaauccagaacuucagccuugguuucaaaacaaagcaaaacaucuuuuuauuauuuuuauggauauggguguuuugucuguguaucacguguaugucuggagucaguggaggccagaaaaggaagucggauccccuggaacuggaguuacagaugguugugagcacucugugagugcugggaauugaaccugggugaucuggaagagcagcuggcguuucugaccauuaagcuauuucuucagccccucauacucagguuuagacugggcuggggagaacccccuggcccggcagugcucacaagagcacuacuugguucugaagcagguauaugucuguguaggagagcugggaggagggaaggguaguggaaaguggacauguugucaacucccaccuucugaauggccccaggggcagcacugcauggagagagacugcuugucuugucuucaacccauaguuccugguaagguagaggugaguugcaggagugccaggccugaagcccaacccaaaggacauagcugugcaggggucggauucagcgaugggcaugucccuagggagcaucuuuccuuucuuagcuuccuuccucuccguuugaucucuguaaccugcaaucuuugcaaccuguguugcucacuguuagucacacccuccuguugucccucuuacccauguaagcauucuuacccuggcauccccaaugaagcuuuggcagugucucacauaugguguuugagaaaaccaggaacccuucuagguugcaagggcuucucaccccaggacuguuggaccuucugcaccuggaauggagacaaggcagacuguggcagguuucuucugugugaugggacucuagugucuauuuuuuucaugguuuaguuucucagaagugacuggucacauuggaagagucaccaagccuaaaucuaaucuuaccguuugaacugugggcugggagcagaugucugugugggggggaggggaugauauagaggcgauuuggccacagcacucggaggagauauuaggagagucuggguccucucuucacagucauguggucaggcucacaauugaaaggugucaauucauuuaaagcacagcugccuucagggagcuuucugcccugaaagccuauugaguggcucucuuugcagugacuguccucucuucccagcaggcuccucugccacccacaguggggucaauuuagcuugggacccagggugguuucugcucuacugaucacaguggaggcaaugugugacacaugcauguggcuagaggcaaugucugacacgugaauguggcuggggcaaugugugucacauguauguggcuggaggcaaugugugacacauguauguggcuggggacaaugugugacacauguauguggcuggggacaaugugugacacguguauguggcuggagacaaugugugucacauguaugguguuggugagacagugugugacauguggaacuaauagaguucuccucaugccagggaacuaggcugaguuuccuuggucugucagcauggccuuaugguuggaagcugcugccauuugugccucucacugggcucaugugccuccuugagucugugcacuggcacccuagugucucucgguggcaguugacugcuuugcuguccuuggcccucccaguggaguaccugccaguugcauaaguaguguuagugacauguguuuccugugguguggccagccuaccuggagagcucuacccugggccuucugccuagagacuacuuuacuccaucacuaagaccucugcucuucucuuuuuggccagugauuauaggcucuggcugaaggcucaaggcugcucccuuuggauuaauuccucauaauccuucuaggauuggaguguuuuagaucacacaguuauaauuggggguguauggaggucucuucucaccucccauuacaucuuuagaaccuuaguguuuuauaugagacccuuacuuggccuggggguguccucuucuagagacugagauggcugcuggugccaccugccaggaugccugcuaaugugugcacuuuguuacuuguucuucacugcugcuaagagucccugccuggaaucccccagggaggggcugggggagugacucagugguagagccccugccuggaaucucccagggaggggcugggggagugacucaguggcaaagccccugccuagaaucccccagugaggggcuaagauguggcucagacauaguucuugccuauugugaacaagacucuuguucaauccuguguaccaggcuacaccacacuacacuacaccaaaacuaaacuaaaacuaaauaaaaacaaaaaugaaaugagcaaaaacagugauuacuaaggcugugcauaagugugcuguguuguauuccacuauugcugagccugcugcccucuagcaggggauagcacaaggacuucaugugcaugcggccucccuugacagcagacucuauagcaaaagacaacacugaaguugguguagcuaguguagcgaaccacuccaguaauuggaaggggaguuuuuucagacucucaugaugaaggauuauaaaucuuuucuauuaaaggugagguagccacugaggguaggaagcaagaaguugaagcacauuggcagcccuccuugcucugcguugcugauggggaaagugguuaguuaauuaggugauuuuucucuuccucugacacgugcaaaugagccuccguuaauaacugaguuauuacauaaaugauaaaaauuuaacaccaaugucaaguugucaggaguuccuggacaaggaaggugaaccuggggagguuccccacuccaccccagcugguuaguucuuugaaaugguaagugaaccuccgggaaguuacugagagcagcagggccagcggcucuuuugcaccugauggcaggaaucugcacuagaauccugccugguuccuucugguuccuggauggaguccagcacccuggacagcauccuuguuguucuggcucuggaggagcugcugaucaacaggccucuuugaggucuaggcucagaguucugagauagagggacuuguagggcaggucuggggagggaguguucuuugcuggggaccaggcuaccuguaacuccauaaagcaggacccugccccagugucagaagccacaaaacagaaagccaacccagaaugucugagaacugaggaggccaaaggcgacccagauaugcugcuuccaagcagcggaccuuccucauuuagccucagaacuguuaggcuuaggugauggcuuuacuguggaggcagguggcuccugcuggggagcacuauucucuacaugcaggcuugguuucaggcugaccccaaacuccugauccuccugacucuaccugcaacaugcuggcauuugaggcaugugcugcuaugccugguuuauguggcgcuagagauggaauccagggcuuugugcauacuaggcaggcacuugaccagcuaagcuacaagccccugccccaugugacacacuuuuaaucucugugggaagcugcagucuaaaaggcgauguucuccucuuggacauugagaguucagugagcuaguuagagaggacuuguucucugcucagaaaagcuuuguccuccugcugccuugacuggaaggcaguaggguuacuaaaucuagcucaguuggccagugcacaucaccucugcaguaagggggcgggggggggggggagcaacugccuaucacucuaaguguccaucaggucagcacaaagugcuuguguccauaauagguuguuagcuuuguguagcugagagugaaggcccucuuggcagggagcuugcagccagcugccagacgagauaugaaaauaguuggagagcuucuaugacugauaggccccaggugacauuaggggauaugagaacaugguuuucuguguucuuuuaaaugccccccaccccccgacaaagugucacuuuauaucccuugcugccugaaacucacugugugagccaggguggccugggucuugcagauaucugcuugccucugccggaauuacugcugugauucaccaggcugucuuaccugugucugauguauggaguggugacuccauggagugacccuucaagggaguggucuuugcauucuagagacuguuuaugggccugaggcucugcugcccuccuguagcuaggcugguggguucuggaguccagagaaaagugggucuguaggucaggcuucuccucucacuuuugggagcucagcuccuaccuguccucuggcagauuuuuuaggacaguaaaauucguggcugucucuucuggaaaucuaaaaugagauuucauuucuuuuuaaguuaaaaaaaaaagaagcuugaacauuugcagcugggcgauagcagagauuucaguguuacuuaucucuugcacaaaggaggcaggagagaggacucugucaaggcugaauacuaacgauguggaggcgguggaaagcacugagggaugcucuugcagaacuaggugggagauggucagagcugugcacugcagccaggugcauugaaugauggauggaaggaggggugagaaugaccuuggccuuccgagcuguagguccccugggagcugccauugcccuugggacgcuaguuugcagagcuggucccauugagucuccaccacuuuuagaaagucuaggcucaauggcccugaaccuacagucccuacuuccuuugcuaugugcucucagccccaucuccucaguccgugucauucucugucauguuagaaggaugcccuauucucuacauauauccuuuguccuccugccuggaauuccacauccagaucguggguuuagccaauuccugcuuggcuuuuaggccugguucagguaguggggugcucuagccccguuguguggcuuuucuuucauuauuccaucucaccuuggcugccuccuagagacagcaggucuaugugugggguaaggugugcaggaagugccuguuucucccagcccuguuccuuacagccuggugagguccuugcugguuagguguucacuggcucaucuacuuucccaccacaggagugguuucugaggguugcuugugucccuugugaccagacuugugcugacagagucuauaguccuuucugccccgaagcaccugggugccaccugagcuugggguguuuccugcucuuccacuaucagucucugugagggagcacucucugggugacaguugguggccugccccuuguaucuguguuacccuuucuuagucucucuuagcacucucaugcagugugucugggucagcccugugagcaucccagguugcagggcgagggaggaaaagcaucauucuuggcuguccuugcucuuccucacuugcuguaucugccguccccacuuccugcagcugugcccccccccacacacacacacaccugggggugggggaggaaggaaaggaugucaacaauacguuugaauaaccuguuuuggaucugacuacaaaaagaauacaguuucauuuagaacauuugacaauguagaggaaacaaacagaaaagaugagaagaaagguuucccauaaucccucugccuccugaaagccagucuaaauguguucgcuuagauuuggccugugugugugccuucugagguaauuguuaguaaaaacaauagcauguguacuauuuggggagucuaccuauuuugcuuaaucuuuccugacacuucccaaauuaaauguucucacaaaacaauuuuuuagccuagauaacauguuuagcaugggacauacuuagguuccccuccaacuugugacuguggaucuuucucauuaagagugcuuuauucagccauucucccacuguuagcuauuuaaucaucuuuaguuucucaccucuauuauaaauaauacccugauuaauaugugccuccaaauucuugcuugcauaaaugcugauuauuucuucaagaaaaccucuuaaauuagaauuaugccuuuaaaagucuucacauuuuuaaaagcaaaccacuugggaacgcuuugccuuggccaggugguuuuaccaacauuaucuucauuauagucaaguaggccauucccucacccagcagaaaggguaagaucacaucuguguggccuuggguuagaccacaguucuuuaguuccugcaccagaagcaaaucaguauaagagaaaaaugguaaauugggucucguaggaucuggcuguaacucauuuaguaaacaguuaucuuaaauguguuaagccauggguuccaucuccagcauuccaugugccuaguaugguggcucacauguaauccagcacuaaugaggugcagacaggaagaccagaaguuucaggccauuucaacauaaguugaaaucaguguagguuacaugauauucuaucuuaaaaauaaauaauugaagacagaguugaaacaaaacaaaacagcucugccccucugaacuguuguuaucuugagagagugguuacaucuaaacuucuuggcagagacaagccuuucuggugugaaguuccaggucauacauguaguccucuccucuccagaggggucuuuuuuagccccccugcugggugagacuugcugacuccucugaugagcggaggcagaaaaggaagaggacgaucuuugaugagggaggcugcuaauccugugcaagccucucccuguggaugguaggucuguuggcuccucugucaccccugaggaugucugcccaacugauaucuccaguccugcccugagaggaccaguaugcauugucuaagacaaacaaacaaacaaacaacaucgaaaacccaaauagacuacaaacagauucaaaacuaaaccaaaucaaaagcacagacuguugguacagcuuuccagggccagagaaaggcuggagauucagucuuucuaucgcauuuuucuggugguuagaaaugaucucugggaagcugagucagagacaaacaggccuugaauguuugagugucagaaggccaaugguguggcucagaugcagugaccgaggguaggugugaagccucagugacagccguggucaggcugaggcagggaugaaagguaggagauggcucgcuccagaaaagacucaaagugagggugcagaaucaugggcauacucuggggacccugguaacugccagaagcugcucccuccaccauagccugauugccuggugucagccaguacagcaggagguucgggucacgccaugucaccuaccuccauucuucuguguggauucuaaggggagaauuaaaugccugugauggucgggcgugguggcacacgccuuuaaucccagcacucgggagguagaggcagguggaucccugaguucgaggccagccuggucuacaaagugaguuccaggacagccagggcuauacagagaaacccugucucgaaaaaccaaaaaaaaaaaaaaaugccugugaugauugcagucugaguccccaccugcuucaccucucucucccuguguccccaccccaucuucacuuucaacuucagagucuuauggucuaggcugaccucagacucaauauguagucagauauuacuuugaauuuguuguaauccuucugccucugccucuugagugcuggaauuauagguauccaccacuccacaagguucauccaauucuggggaucaaagccagggcuucauguaugguaggcagucacucugucaguggagccacauucccagccccucugagcuacuguuaccuagcuguacucuccaagucucagaagcucucucaacacacuuuauuucucuuggcagcucuuggcuggcaggcagccuucccuuuaccagaaagagaagccuggccauucccgcuaugguccacaggcaguggcuucccgagaacguggcaauccuauugauuuuuauuuaucaguagugaaacucuguuugaugucuuauuuuucgggucuugacaaauaccccaaacauuaguguugaucccugccauugaggauggugguuaucacccucaggccaguccaaccuccauccccaucagcccaaggcagagaguuaagugaacuuugaagucaggcuucuacugaguacagccaccuccuccccucaguucuggagccaagggauuuguuuucuuuuccagcccaggguagccucuccucagcagugugucacucuuaggauuccugacaacaucucacuaucuucugggcuuugcagucuucccuuccagugcagacguuuaguacaagacauuuaguaagagcaauuacgggcaauccaauccaucacccugcagcagaauuuacaaggacucagcacagcaacaagaggcuggcaguaucgugaugggucuuacuuaggccaucucugcucaggcuuuguccugcaguucaucagcaaucacuugcagcucuucuccuuaauuagcacauuuuaaagacuuuguuaguucccuggcuaugacacaagcuagguuucgccaguaauguacugauucuuuguaaagugccaaagucuuuucccucaccuugacuuugauugaaugcagcuguggaugaggcuggucagcaguaguuguguuccuauuggguucccuguucucugggcagaagggcacaucuguacccggugggagguggucuauugugacaggugcuaguguuaugccucagcaggguuggcaaccaugagaagccagagguauguuuguguuccuuacugggaccagcuguaagcauuggcaucauuaacuuugagaaccaccuccuuauagucucuuagaacaacagugguccccuacucucugaaauuuauuaggagggacucucuuaaaugagaguggguaucaguaugacuuuuagaaagcuacaaugcaauauguggggcugggaagauagcucaguugguaaaacguuuuuaaagacgagacuucaagcuggguacagugguguguauuuauuauuucggugauggugaguugaagacagagaugguagcuuccuaggcuugauggccagccagccuaaccuaauggacaaguuucaggacagugugaaaaauagucacaaaauagguggguggccccaauaguaugccaccugacacugauugcuagguccacacacauguucacuuauuuucauaugcaacugugcacacauacaccaagcaaaacaacaauagcaaccuagugucucauugaagucugguuuccaugagguagaauucgggagucguugacauucccugugggucaguauuccaagucacauguaaaacauggcccaugccccagaagugggcugccuguguccccagguggagaugacuauugcuguggccucucuauccuaguguguugucucuauucuugaauuucacauucuucaugugucauaccacauaggaacaauggguuuugauagggcaccacagcacggcagaccccaggcgcuccuggcugagguugcuucugcauugagaagagcuuggcacauuaucucuugcaguugugcaacaucccuugcacacuuaccucuugcucuuaggugucugggucaaugacaccuuugugaguuacgguauggguauauuugugcaaaauuauuugagggcucacauaccugugucuugacauggaccagugcuugcuggguccugugcuugaggucuguccauauguaccauuggaucuccacauaggcacaagcacauacuuguggugaguaggaaaggccuggugagcuugauuugcuuuuaccuggugugcccacugccacucauucuaccugugcacuuucaguccacuugguuggcuuacuacuuagaaucuuugacuacuuuucuguccuccaaauugaauauuuuaucucagaauaucaucaacuccccucuuuuugagacaggguuuuacuguguaguccaggcugaucucaaaaucucaauccuccugacucagucuccugagugcugaaaugacaggccacaucaacacacccugcugcuuucucagcugacauucccucugugugaguacacacuuaucuuccaggcaucggcucugaggucucgcagcaguaagcuguuagugcuuugguuucauguggguacagaaggcccucuuuucccuggaucauuaaggcuaaggcuuccuucugcauuuuccccuuucaugauuuugacuuucaugucuaaaaccauccgcuguaucauuugcuacaaaccccauguuuuuguuguuuuuuuuuuaaucugcauuaaucuugucagcuuacacuccucagaaaccugucuguuauuaucccgaaggcuggaagggcaaggagaggcuguggugagcuccauccggcucaucuucugcagcugucuuccuguggcagcucucucuaaccccagagcugauugauggaguagggguggggugggcugggguuguguuugcuucuucugacuccauguuguuuucuguauugugugauguuacuugauauucucauuggugugauggaacucuugaaaaacaccaaccgauaggaacugggcuuuagucaggucacuguuugagaugguguggucuaccuugucaaggaaggcaugccagcuggcugcuuacagcuguggcagcaggauugagagauugcuuuugugcauauugguagaucaggaaacaguucaggccaggcuguacugcauaaggcccaggcucucaaaacagcaccguucaccagcuggggaaccacgcauucaaacaugucuuuuggggacauguaaugcauaccaaggacugccuucuccucucagcaaucauccucagugaaggucccuagugcccauguuuggggccccuccucccgucagcccuuucucuuugggguagaccauacuacuuacuuaacaugggacaaaauuaagggagauguuuuauggccagaagugaggauggugagacagccuucuucuucugaaguguuggugauagauaugacuuuuccuucuguaggguccagaaaaugaucugugauaaccacauuuucagguuuuuuaaaaaaaauauuuguuuuauguguauauguguguguuugaguguauguauaugcaccacauauguucaaaaaccgacagaggucagaggggcacuggauccucuggagcaggaguuacagauuguugugagcugugcguacugggaauugaacccagguccucugcaagagcagccaagugcucuuagccugugagccaucucucuagccuacauuuuucaguuuugaauacaugacuuuguuaagcaaguagcaagaaaaagaaaagggaaaaaaauagcaaguaguggacaaggugcaaaagaucaucuaucauaucaaacacuuacaauucccauagaggugacugcaguagccuguuugagaguacagaggaaaggucaucacauugggguauuacagcauccuguagagaugacugggaaaguugaggcagucagcuagggggucaucgguugagcuuucuuuccacgaaugaacuuauucuuacugcagguguuuuuaugccacaggagacauaauaguaugucugguaggauuggcucaccuauuggcuguucucaagaacguggaguuuuuacugacgagcuguuaugcuguucucugucuccucuuuacgaagcugagagaacagggucuuagaggacacuuugagacaauccugccugggucugaagugggggagguaauccuacuuccaaagcuggccucucagugagcucauacagcacguggcaguuuacgguauacugugcauuacaccuccccucugccccguauuagcaaugaucuccggccuccaagagcaacccugggccuccagagcucgaggugccaggaugggaaguuugaggagcaaauauucaaaggucugaggucaauucugagugucuucuaagaaaguuauuaaacucgcugugcguugccgauugaguggcagcgccagcagcgguggagucacacaauggcucaggaaauguguuuucuggcuccugcucucugagcugcauuuccggccucuaaucugugcucagcagaugggccuggcagggaucugcucagcagcagcaacccagcucugcuccgcuccgccgcuguccguaagggugugugggaggcugcugacgcuccacucagcagcugccacauuauacagcccugaccccacccuccacuccucaccugcagaguuccacuagugcucaaaguucacagaccucuuugccauuggagauauacuuugcauaguuguggcugucugcagggucccucugccucuaucuugcagcugccugcuugugucuuguauagaucuucagaacauaaauguuucuuacucacagucacccuugccuguuaccacccagcucugucaccauuaggggacacagauggccuaccgcuuacuuacuuugaggacugggguuguuucgggggacagugucucugccauaguguaaguccauguggaagaugaccuauuuccagacugauucucaugacugcucuggggccgaggucucuuccgugguccuacccaugaguaggaucgaggcagggguguucagcuucucagucucuucugcaguccuguacauggucgcucugugcugugggcccucaucacacuggggcccuuuggguuucacugucuccuuccagugaugaugcucacugcugccagugauuuggagcugaccgcccucccucccucccucccucccucccucccucaaucccucccuccccuccccccucccucccuucuuuuuuucccaaggcagaguuauucuguguagcccuggcugaccuggacucaagagauucuccugcuccugccucccaacggcuaggauuaaaggccugcaucaccaccuccuggccaaaaguucaggagaaaaauuaaaugagaaauacagcaacaaaauccaaggaaaacauccagcacagggcccugugaaaacuccugguaaaaauguagaagaaaaccugagcaaaaaaaaugucaggcgaaacagugggcuugcugucuuaaugaauuccugaggacaccucuuccaggcacggagccugcuuuuguucccgggcuuucugcuuuuucacucgugacucugggucacagccuccacugucaccaagggcauugcagaggcccaggggcagagcauacccagugucugaucauaacaagcagguuucaugaacacauuggaaaaaccaacuuaaguaauuagugguaggcuagaacucuuagaaccccuacaggguaccagaaauacccugguuucucagagggcuucucaaggaauggagaagcagauacccuucuuuaugcacaauuugcaggccauagccagugacggggccaaguucuagcccucaguguacugcuuugcucuucucaacagugcuccucuccagccuucaccacaggccccgucacuccaugcuggcaucaccgagcccagacaccuugaaccuacgcuguucuucccacuuaccaccugucgugaugccucccugccuugcucgcccagggacaccgugcuggcggagccugccaccccucucacauuguguacguagaagaguaccaugccagacccaacaagcuuuaacccugccuuuuaaaggucacuucugucucagucagcucuuaaaguucaagaggaaauaaacugcuuagagcuggcauuucucaagccaagugucaacucuccaagccugagccugcggggagaggaagugagauuaauaaaugaguggccauguugacauagucaucggucagcaagugucuuccuguucccagcccucaacagagugguggacagacaggacacuggggagucucaaacucauuuucuccucuuggcuucacuucucagccuggggaacacuuuggagauauuuauuaaucaagugacagcauuuaagcccggauggaucugccccucaguggucccugugcugagacgggugauugacaggggcagaugaugcuucuugcccaggggagacgaaaggaccaaggaaguugccucacccaacuaguuauugacuuugggcuucaggccaaggacagggaaaucaaugggagaauaaacacuagaauggguuuuauuaaucaggcgccaccgaggcaggugcagggaugauacuggagcccaggggucgauuggcagcaugucuggugugggcgcucaggccaugcugacuagcaggccgcuaucgaccacgcuacaccaggaaccucagcaucagaacugcuaauuggacugccuggugauuccaaagagagagggagacauugcugagauuacucuguuuuaucuccuaaaugcucguccgacuugacucagucucaauuaagcucacauccagcucugccccucagggcucuucucuccuguagugagaccugugucccuuuacuuguccuuagacauggccauggagguguagccucaguucuaugcuuugaaugaccuccaguagcuaaagucacuuuaguguugacaggcacuccagucuggcucuccuggacacucucaccuccuauguuaugcauauauacacugaugugcucaguagguacucacucauucauacauauucuuauacauacuagcccaugaccuaucuccuuccuccuuuauacauugacauuuacaguuuucugucaguauacuaaaguaaccgaggcagcuaacuauauuacaaaguuuauuuggcucaguucuggagauugcaacacauaauuggcagcuccauggcuuugagucucuggugauggcaugugucauugggugaagcaagaccauuuaugccacaagccagaaaguagagagagaaagagagagagagagcagaguguuaaaauccccugugacuguguguuccuuagagaucuccugacgcuuaccaggcuacuuccuaaaggacuguccauacugcucaugacccaggacaacccauguguccuugaugacaggccauuucucggccauggcaggauucagugcuuccucaccuucccauggauguccuguguugagcgacucagugagugugaucuccuagggcuucccgugguaacuggaggggugcuccaaggagggagggaaugaagaaggggguccaacagugccugcauaggaacagucuagccagccucccuucccggcugcuguucugucacucaugauagcuccagucaucucuaaacuucuggucucucucucucucuccuucccucucagacugagguuucucccauccccucgcaucuaauuucuaagagucuaagcccagagaagaagcuagguuguauuucagaaguauuuggaugggagagaguaugggagucagccugagagugaugucccucugaaaguacuaugacccagugagcaucucugugucugucacuggaacaugggaugaagacacugcccuccuuaggagggugcugcuccuccaugugcuuacacuuuugacugaugcagugcuucuccguguagcccugccugccuuagaacucucuguguagaggaguuuggcuggccccagucucacagagaucugccugcuucugucuccccagggcugcauuaaagaugugcaccaccaccaccaccaccaccaccaccaccaccaccaccaccaccaucaccaccaccaccaccaccaccaccaccaccaccaccaucaccaccaccaccaccuggcaugcugguuuucuuauaaggacauagggggauugagggugaucuaucacagcugucugucuuaccuuuauuucuaucauucaucuauguaccuguguaccuauuauuuauguuucugucauguauccaucugcuuauauaugaucuacuucucucuauauauuuuugcagugcuggggauagucucagagccuguguaugccagacugcaucgaggugugcugcacccccagucugcaguggauauuuugcuugguuagaauucuugcauaugaaggaacuguaauggggucaggccagcagaacuucugaugguguuagugcauaccggcuagccaagcaggaaugaguugggucaucagugggucagugugugaauguaucuguguuuuauucucuuacuugaguuucaaaagagaacuuuucauguaggcugguggucaguagcccuucucugugaagggcauggaagguaaauguguuugcuugucagcccacacaugugccauuagaaaacaaccacagaacagucagugcuggguuuggcugugguccaccagacuguuugcaaagggagggaaggcuguuugcugacguuuaggcuauagggaagagcagggguuuuggcugagaucuggccuagcucugccacaguugugacucuccuaagggucacgguacccaacucuuauucuccauacauguuaaggcuaaagugacacguguuagagugccccuugucaccugacacacagcugugucagcaauagcuuccucaccugccuuuuaaaauauuguuuuauuuuauuuuaauuacuugucucuguggguguauaagugaugaauaaguacaggugcccauggaggcuagaggauaguaguggagagcagugaaggccagaggggggcagcggaggccagaggggggcaguggaggccagaggagggcaguggaggccaggagagggcagcggaggccagagaagggcaguggaggccagaggagggcaguggagggcagaggagggcagcggaggccagaggaggccagaggagggcagcggaggccaggggagggcagcggaggccagaggagagcauggaggccagaggagagaagaggagggcaguggagggcaguggagggcaggggagacagugagugugucuucuggaaaguuacagguagcugugagcagucuaucagggaacuuuagguuaaccccugcuuagccauuucuaacaucuguucuuuuauauagccuguuucagugccauagagaguaccauugaccuuugaguaaauagccaagagcugugcuuuguagccauaucuucugucugaauuaucuguuuacaccuuuuaucccaaaaguuggguggagggcuugcaaggggagcucugcaaggcuuggaugggugaucugcccucuggugucuacaucuucagcagagacucagugagcggccugugguaacccaucagucaaauuggauuauucuuuaugguuggggagcaaauugaaauugugagaggugauuuuccuucucacauuucaaggccagauaagaauauuuacuuguggccucuguguaucuggaaaugcaaauugaauuuggugauuggaauugaugugaugugaggaacggcacucaucagagucaguguaugcccaaugacuagagaccagaaggcuuccucaccaaccuccucagcugggccuuugguugguaacuuuuuaaucucugcuuucccuauucucugguugucuauacaguuuggcaguucuuuugauuuugggaugugugugcaugugugagugggcaccagaaaaaugugcaauaauaauuguagguuuuaagaaauggaauugaugguagaaauacagacagcuaugugcaaugcugagcucuuaacaagggugcuggggaaaugggcuccuucugaguuuguaucaggcugccccacugcaggacccagugcacagcugccacuugccuccuccuguauuugggauccuuaccucuccuacagauuccagaacuaccucauggcucaggcuagacauaccgacauaaccuccugagguuugcuccacaucugacugcccuuaggguccauugcaaaccuccuaagggugugccaggagcauccuuucaccagcagagccuugcccuuugguaaggacacggggacaguguggagcauccuagcucugccugcagacucaguaauauagguauggccaccucgccuugaugcugguagcacuugugagugcuaugugcucagugcuggugccuuugcugucugugguggaaguuguuuagaaauuaaauaccuuccuaggggguagcugggaauagacaacaguggccaccuaggaugugacauccacagggaugcagagcuuaugucuuaccacaucucuggcuggcgugugugaggggaguggggauggaucugucuaaccuggacuucucccaucuucuguugaauauguagcucucuguuggcuguuuuuucccugaaggccacaccuaccagaaauaagccugaaucacccagagucugguugucagucauacugacugccuuggaagguccuccugaguggugacuuagccuguugugagauuccugccaaacagccuuccuaccuaggguggcccugagcacaagguuucuaggcacuuuccuucuguuucuuugucuuuuguaaagucccaccuccuucucuuccaugucugcucacagggggcgucuuaucagaggaggcuaccuagcacacuguuccucuucugugugucuguaucuuggucuaagaaauccugucacuuucaaagcucuauuggcagacccuuccccaacucccugucuuacugucugagagcaucugacaucaugauggucacuggaaaaaacgcucacugaccacuacaaucugacucccuguggcuuuguuagggcuugcccuaauuacaugggugaguauuuccuggguuuagggauagggcccggugcagacuauagggcuaauuuauuggccugucaucuauuuacuuaucauuuauugucccugucaucuauuucuggggccauaacucugucucuggaaggucccuguuaauucuucacucacuggacaagcagauuucuguaauuuucuuucaguuuuuagagacucccuggugggcugggaggaagcauggacaugcugaccccuucuugcccagugcacaugguguagggacugaaggugacugcucagaugccuccgguuuggggauccacauuuugcacauuuccucuuaacauagagguagcgauugggaaccuauaggcaccugguggcuuaguuccugaccugagauguuuuaggucagugcugcaggcuaugccaggcauugugcccagcagccaggaggggcaagcaucuucuaguuuuccuggugcacacacaguggcuucgcagaggugacucagcggcuuaggucugcauugacucauccgcaaacuucaagguuggaaaucauuuguguuagcagguuuugaucuguguuccucagcccuccaaggauaaagaggugcuguagguuugaagaaaaauuuacuaauuuuuuuuuagcuucaugaaagagaugaauuacaaaaaauucaccguguacauggaaauuccauuauaaucuguaggagacgaccgcuauugguacgcgucagacugcuuugggcugucaccacaaaggcucugaagugucugugugacaccucuccucaaguguuacugaauugggguucuauugguguguuugggcuugucacaguugugcucuaguuagggcuccuaauuugcaagcuugucuuuccucaggggccugcagccagguggcugagguugcagugcuggcagaugugcgagugaggaggggcugucuuucugcuuggcaucugcuccugagagucuccucuaaugucccucaccucaucacaagugcccuccccucccuggccaggcuccucccaacacuggcauguuggugauuagggcuucacacugauccucaguucucacagagaugucaccuacuucagaaaugcccuuggccauggagcccuagauguccuagagcuagcucuguaguccaggcuggccucaaacucacagagaucugccugccucugccuuuggggaauuaacagcaugugccuucaugccagcuuuauauuuuauugcuuagacaagauaucauguagcucaggcccaccuugaauuugcuacauagccaagaaugaucuugaauucugaucuucugucucuaccuccuaagugcuaggaucacggguguauacuacuacaccuguuuaugcagugccagggaacugcaggcuaggcgagcgagcauucugucaauggugcugcagcaccagcccucagagguuuucaguguuuuguuuuuuaauuuauuuuuuuuucauuagguauuuucuucauuuacauuucaaaugcuauccggaaaguccccuauacccucccccccccaccccccuacccacccacucccacuucuuggcccugguguuccccuguacugaggcauauaaaguuugcaagaccaaggggccucucuucccaaugauggccgucuaggccaucuucugcuacauauuguuuugguuuuaaacauagaaccugggcuuggccaugaccguagagacacaugaacacacugucucugcaccaccuggcgcuccagcacugguuucuaugugguguggugaaugcccugcagaacucacacuuguggggguuuugguuuucguuuuuuccuuccagacagaguuucucuguguaauaucccccaucccuggcuaucccagaacuugcuuuguagaccaggcuggcuuuaaacucacagagauccgccugcucuugccucgcaagcacugggaugaaaggcgugugacaccacugcccagcuguacuugugauuuugaaugagcgacuuuauuaaguauauaacaagugacuggacaagugacagauacaugacccaucccuagggaacaaacauguaguugggugugcacaccguccagcagacaccacagcuggcaguuuccauugaguuuucucuuccuggcugaccuuuggcuucucuuucucacugaaggcauuuuuauaucacaggauaaacacugguaaccucuguuggcaaugguuccagccauuucaauaguaugacauuuuuacucuuagacuguuuagcugucacaaaguuaggugggccagcgcagacaagaggccucagaggauacucauagacagacaugccuggucugacauggagcaggaggacucagucaguuguuagagccagcuucucaaugagcucuacagcaugcgacaacucacuguauauggacacaccgugacuuggccgcggcuucuuucucggaugggcaccgagcucuuccuuagagcugcucuaugguagcacaguguuugggaccccacagcaucuguugauacagguaugcuuucuugcugcaugagugugggugcugggcucaaacuggggaaggcaggccucagggcuggaaaugcuaggucagacaaggaagagcuggaaggagcauucauugucuuggagaaguuuguuaaaaugucuccugccgcuuugcaguaucucuuggccaggccugguuccuugaaaguguauauucuuaguccuguguuucugaugaagcuaacaugaaagugagcggcagugucccgccacauccaaagauggcuuucaaaggccugaacucauucucucagcagaugcugccucagaaaggcagcgaucgauaaacacgcucagcuucuccuugaagcaccaagagcuucgcucugaagccccagagguucguggaaaugccgcugcccucagaguucagcacgcuguggagcaagaacuuuaauuuuuuaugagcuuucucuucucuuccuuggaagaaaggcuggaguugaauggagagaaccucccugggggccaggggggaggacaagagagagagacaacaaccccaagagaugauggggauccguguuagaaugaaguugcucaaauucuuccagcuguugaggcucucauagggccuguagacccaguaggagaaguccccauuucaauuugagauccauguuaacuugaugguuccuguaucucugcauccugugugccugguugucuaggccuaucugguaggugagacuugagaagccuggccgagaguguugagagccucuuuuggacaugguacugcggcccuguuuuagguggugcuuuaucuaucugcaggcccuuguccccuccaugggaugcccccaccuccuuuggagcuugccagucuguuuccuccauggaacuccuggauggagaauacccaccuguucccacacagcuucccauuucuaagcaggacccaggauuucuagagcuuugccccuucacuacugucuggcuucugcucacaucuguaguccaaggcccaucuagacagcuuuuguguccccucucucuuccuccugagguuuuuuccuucuuguucccguuccuuuguucuucacugccuccuggcaaaggacucugagucuccuagccaacuccuauuuccacacagugugagugagugugcccuggauauaagaguguuuagccuuucauccccuaagugucccacacaucuaucuucucuugugccuguggggaagagucccuucaggaucuuagggaucuaacccaagauaccaaauucucuucuuuuacuucaugcuuucugccucaccauggacuaaaucauuccuuucuucacuguuuuuuuuuguuuuuguuuuuuccuuugccauggccaguuaggcagcaguaccucagcucuggagagcuuggaccuguaguccauguuugccauaccagcugacaucuaguuagccugcugcagguaccagaggaugugcaggacccugugcuugccuggcucaccugcaggcuucccaucugcuuccuuccacacacccuuccuccugcacaccaucuacucaggucugugaugucuauuguacuuaaaauaccagccccugcaggcaaccccacccagugcuuucuccucacucagagaccaguauguauccugaaaucucagaagguauuugcugcggccuguuugcuuuaugugagcuguuccuuccccugcagucaccugguuggugauuuaugccuguuuugcagccaggaggaacucagccuguugaucauugugcucagggcuucacugaagcucugcaaaugaugcuccggagcgcccucucucugcuuugcucugaacugcaauuuauagucuaaccuuguccuguuggaaaccugggaaccuauucugucugggaacugaccuugggaucugcuguggccugcaauccugccuguugucuggcaucuucuauagaccaggcauuccucgauaucugcuucuggccuccacaguggaugaaauguguuuuguucuuaagcgagaggaugggggggcuggugagauggcucaguggguaagagcacccgacugcucuuccgaagguccagaguucaaaucccagcaaccacaugguggcucacaaccauccuuaacaagaucugacuccucuucuggugugucugaagacagcuacaguguacuuacauauaauaaauaaauaaaucuuuuaaaaaaagagagagagagaggauggggacugagaagaugacucaccgaguaaaacaccugcuacacaagcauuuggaccuaaauucaggucuccauaacccucauagagcugggcacagugcuguguuucuauuagacagaggcaggcagauuucaggggcucacuugcuagcuagccuggucaaaacacugagccacagguucagugagaggcccugucucaaaagauaaaaugaauaaaguggagagauugagaaggcauucugacauggaucucuggccugcacuggugagcacagacaguccauaugaaggagaggagcguguaagaaugagugauugauguagaccagggguagugccuaucuagcaagcacaaguccuugcauuagauaccuaauauuccugaggggacucuuuuuuucuugggaagggauaaaaaguuuucuuuauaaucugaaauauuauaacucaggccuccuagauacccuuaagacuccacccucuccuguggugccauagcacaagcaucucccuccgucugccguauguguagcauuccacauuguuaccuaggugcaaggcuggccuguguaccuguggcacugccuuccuuagguagcagagccuagcuucagagugaagguuggguagcuggcuuaggccaaguggugauuuccugcuauccagucuugcugccugguucuguuccgcugagcccuggucuucaguaucccagcaaaguggcuguuauggcauggccuugggcuuguuugcaucugggccagguggauaggguaaggggaaugcugccucuaaauuccacucuuggguuuggcagucuuccugcaaggcucuccugaacucccugcugaggacaguuuaucugagugaucccaaacccccaaucccacccugcguguaugugucaccugagaagcugccuugccaugucugucucucuguacuugguucguaaguagcagagcaaaugcugccauucuaauuaaauuacccacuuuggagcagugauuuaaggugcuugugaaccuccccaccugaauucaacgauucaagagucgauuucacaguucuugauuauuaaauuggucuaugaauaguuuucaauugaacuggaacucaaaauagccacuuucuaugucuguuucccgugaauauuugcucuugccugauauuugggguugugaugcaccuagggugcaacuggcagucagcugcuucucaguggggccaagggacagugcaagacacccugagauuacaggauugaagcccaccacugucccugaugucacaagguuggcucuguuuucuguggucaugcugguggccagagcaggguucccugugacacuucacaggacuaggaguaucgcaguccccugcugaagcaucauaaauguuugacucucauucacuuucaaauuacacuuuagcuguuuaaaugauuuuacugaguuauaauuuacaaaacccuguauucacucagaugugaaauagacauauuugcaggggugucugccugacaaaaguguuaucugccacccuugugaauucagauuuucuugaaauuguguaaucaaagcaaacaaaaauaauuggaugcagaaguaaucugagcugcaggugucucuugcaggccccgccccagauuguacauuuucaaaguagcuucaguguucuggucaugguuacuuugccugaugcccugcuugugugugugugugugugugucugugucugccugccugccugucugucugucugucugugcaugauuggccugagacauaaucaaguagucuagagagcuggccaacaaguuugcaggaucugucugccuaucucugcuucauaucuuucuuaacaucacugggcuuacagguauguccugccaugcccagcuuauugaucugugauccagcugaggauccaaacucagauguacauguuugaaaggcaaaugcuuuauccacugaacugucucccuagccccaugccucgguuugcgagagcuuuuggcaucuccucugggaagaggucugugacugacagugcacacucugugcuccugcaguggccaucuugguugggggguuggucggcccuucccccgcugcuccuaucaucugaccuguuucuuucugcugcuauggcccagugcacgugugacagggcacccuguggguauuugaugagauccuugcccuugcuuuuugugcuuugccagguucucuguaagaccagugacaacagaggcugcacugggccuagagggcugucacugugggacuagaggggugguagcaaggguacuuucugauggucuuugcucagccugggagugaccaguggcccuuagaagccuuaguccagaggucugggccucugauguuggcagagacaauugauuaaauugugaaguuguuggaaugucauagggaaggaaguagccaaaccaaagaggccacagggacgcaguaggaaagcagauauuguaaagggaagccaggcuugguggcacaaccuguaacccuguauuuugggggaauacucaaauaggagauuaaaagcucagguucagcucuggaggcuuagugagauccugucuuaaaguauaaaauaagaagagggcuuggaauguagcuuaguggcagagcacuuauuuaagacuguuccagugagggucugggaguguggcucagugguagagcaccugccuagcaggugaggggcugggggcgugguucagugggagagucccugccuagaaucuccagagagaggcugacagcccucccugcucagugacagaggucuugauuaguaugccugaggcuuuggcuuuaauccuuuauacugcaaaaacacauccauacauguauaaauagggaaagggaaaguagaggaggucagaugccauugucuggguauguucugacaucuguuaucacauggcaggccuaguacccagugugagccaggacuuucuccuucagaaacucugcaggcccagugcuugcugcgggggcuguucuccacacccgcccugugcugcacaucugugcagacugugacucacaugggaagugcuugcgcuggcaauuuagcucauucagaagugccgucuugaagcgccuguggcugacaaucuuucccauuguguguggaguugcgcuucccucccccucgcaccguguucugggaucacccugggugucuuugaaauccagaaccuccugaaaggcacuaaguagcuauucaggagcgaggaaacggacgagguauuugcacgugcagcucuauuuuaggaugccccuaugggauacacaguggggaguguggccuuaguuaugggggauggucaugccaggccucauggaucuaccaucuucccuucccugcagugcccggggucuggagaagguccagcagcagcuccaggaugagguccggcaggccaaugcacagcugcuggaggagcggaaaaagagggagacacaugaggcacuugcccgaaggcuccagaagcgcaaugcauugcugaccaagguacaguucacccagugugacugagcucacccaugcccacacagccaugcccauaccgccuggccuuuccucucugguugcucaucuuucugcagaccucugugaagcugcaugugcuugccugugguccauagcuuuacgucuccaguggguaucccaccuacccuggaccccaggccgggcccagugcuggcucuuccuagcugcaggcugcagcagaacaguucaguuaggcugugugcucuagguccacacuugagaacacacuuucgaauggcagaaggagccauccagagcccggagcuaaaguauacaaccauauuuuaggagacugaggcaggaagggggguggugaauugaagaccagucugggcucuguaccuugacucucucaaagcacaagaccaaaaccagucucccagacucacuuucucugcaugucuugaccuggacuggugcagcaccucaagggaguguuuccuguaagcuggucuucuuagugguggccagccuucuugcccugugcugcuagcaugagcagaggaagcaggaguggguuucaucccagcaugauguaaggauggccaccuguguacagaacuaaugguguggguccucacagugauguguaucucauggacuuugagaaccuaagaaaggaccagcugcaucuguccccagguacaugaagaucuagcauuuguguuggccucacacacuucuucccagggcuggggcagggcugggcccucuuuucagccuucagggucccugaagguagcccaggaaaagaaguggcuagauugucuucucauagcagcuuaguuccagccuuacaccuuggccuagaagaugcucagcguauuggcauaguuauuuuccugcccagcgccugucaguguuaagccuaugugaugggaauauguggucauggcccucagacuugacagugcaguggacaagagcagagcgcucagccauacacucaaccagcccugacaaagacaaacacugcugugcgcacugacacgggaggagcugucggaggugagacuuaagcaaagacccagaggauuuacuguuuaccggagcagugaagagagcuguccccauccccacagagauaugguucagggaagaaggcugucacagagcugcuguugaugccaacauugcaggugcaugcggggcaggagguggcggauguccuggucugcgggcccaugggcagcucacuguagugcuagugcaggauauuccuguguggugugaggagacaguuggccaugggaaagcagaguguggugggaaggggaucuacuugagagacguccuuagugggcgaagugcuugugucccuugacuuacugugugaugaagagagagaggucggugcugagaauggaacugcucccugugaccucagaaccguugcucagagggauaguccugcugcuccaagcacugcugaggcauuagcacaccagccgucugaagcccaaggaggcucugcagugcaggcccaggaggcgaagcugccuguguaugggugggggacauggaguuagcaccugcccuuuuccugcuucuagccagccugucuugcuuccacuguccugcuuccagccucuggacuucuguacccuuuccuggcuccuuggagaaagugcucuaggggccacagcugucucaucuacuuuguggagaaaucaaugaucugaucuggguaugugucuguagugugcccacauauguacacccacaugcucuggguguuucuugucgacuggguuccauaacauuuccauauguguaugcccaugugguugggacauuuuuuguuggcuauguuugucccguggcugcuguggcugcuguagcugcuguauuaucaccagagcugcugugaacuugguggcucuuuaggcuugguuucaggcuugggugacaggauugcugucaauggugcugaugcacugugaccuuuguugagcucccaugguuccccgaacagaugcugugaggcuugugccuaguguguuaugugggcaccucuguccuugacauuuccaccuggugcucccaagucaggaaauuuccacucuccucccugaacauggaacucccaacggcucucuguccacaguggccucacccugacccaugcugcacucuuggccucacucugagucagugggaagguagcuauugauugcccgacacugacugauuaucuauacuagcugucccucugagagauucaauggaucaauacccauugccuucccagcccugggucugggauguagggauuugacuugcuagccagccagaaugaugaaacuauucauuaggcucgucuggugaggcaccaaggguguugccugauuucacaggcaugguauaauguccucuguguuaccuacccguuaaacaccuggcugggggguaucuuggacuccagccuggcuuacuguagugggggagugucccgucuucacugucucaauggaaguugcuguuagaccucaaucucuaggucugcucacuucugccugaccuugccucugugcaccuccagcccagccuccugaggggaugauguggguccuguccaacacccaucugcacagccuggaaccagcugugcugcucuuucuuggcauccccuccaagggccucugccugcuucacauuccaguucagugcuuggcaugcgcaauuuugucucgagacuuuuauuaagcagcuccagucuaaggaguuaauuguuacugauagcuaagaguauaauuaccuugguaaaauaucaugacuauuuuaagcaauugaaaauuggcuucuggcacugggugaacacaaaccauuuuccuauuugaggcaugcuauuuccaguaugcacuaauauucuauaccauaguugcagaaucauauuuauagaauguaagcaagauuuuauuuuuauuuuuuuaaugaaagaaaaccuuccacuuccccuauuuggucauccaagguccccaggguagcagucacuagggacacacauucuagaaagcaggccuggaaagagguggguugcugggcccuugguggucagucccaucucaguuagauggcagcugcagaggucacuugauugucauggugauguccugccuuagggccccucaaauuguuuccauguguuuguauauguauugcacauguaaauucuuguucauguggaugugcauguagaggccagagaucaaccuuacugucuuuccucagguaccacccaccuugguuuuauauguacauacauacguguguuuguguguguguguguuacauuuauaugugugugcaaauuagaaaacaacuucuaggaauugguucucuccucccaugugggggagucaaacagagugucagacugggcugcagagugcugugagaccuugucucugagacagagucucccauuugccuggagcuuaccaaauaagcuugacuuaguguggagucccagggauucuccugccucagccuccccaaacaugaaccacugcacauggcuuuauaaauguggauucuuggauucuaacuugggucuucgugccuguaaagcaggcacuuuaccagcugagcccucuccacagucuggacuuuggacuguggauagugaguguucuuugccugcucugccuguguuguugugagcagguuccuguaguaagucccuuggaggugacagcugccugucuuuuuuuuuuuguuuguuuguuuguuuuuuucaagacagaguuucucuguauagcccggcuguccuggaacucacuuuguagaccaggcuggccuugaacucagaaauccaccugccucugccuccggagugcugggauuaaaggcgugcgccgccacgcccggcucagcugucugucuuuugugcuugcugggagacucagcuguucccuuuugugaaauauccuuuaaaucaagacucuucauagcuuccuacugucucagggucucugcugugguacuguggccuuaagugccacccauaacaguggagcuaauguggcaucaaugccuagaagcaaguggcagacuuguccauagugccucccuuuuugaguacuugcaugguacgagcugcuggcagacaggagggauucugugcucccucuguggagggcagacaccauaucucaggucagccccaaaggcuggggggauucccuccauuccucacucaaagggauugugccuugacccuccugugugugagagcuggagaucacauguacuuguggguucuucuggcccuggaaggacugugggcagggaaugggcaucaugcccaagggucuugucucggugaaggugaggagagguauggugccggggcagaggcucauacagcccaucuugcugaauauuugccuuggaguggcuugguuuucuuccugcuggaaugcugucacgaggucaaaugugcucccauagacaguagagggaagcaguguccgcuuaaacucucguuuauuggacauguagccaacauugccauuuuccuccuuggagagcuccauagcagguacaaugucuccucuguccagcgcugaugggacgcugucugcagaugaugccaugccaguaggaggcucccugggugaccaucccuguccuagucaccucuggagggugggaguagaaccaggcggggcuccucugcccugcccuuacacccuuugcuuuauggcaugugcuugugaagaaccuucuagaggcagaggggcugugaaguggcugggcgcuuccaugggugaaacagaaucagagcucuguggguugcuucucccuagcuaacaaguguagggaaauccucaguagggcucuguaggcuuacuguguauguguucauuguucagcuuccguguguguguguguguguguguguguguguguguguguguguguguguguauuuuacugguccagugucuguggcuucuuguguugcaacauugugcuuugaaggucuguucucauugacagagcucauucacuggccacuucugugauuaggggugaaaaucccacuauguacccauccauuuuccucugggcacaccuuuggccuuucccacggucuuagucagggcuucuauuccugcacaaacaucaugacaaagaagcaaguuggcgaggaaaggguuuauucagcuuacacuuuccacauugcuguucaucaccaaaggaggucaggacuggaacucaggcagggcaggaagcaggagcugaugcagaggccauggagggauguuacuuacuggcuugcuuccccuggcuugcucagccugcuuucuuauagaaccaagacuaccagcccagggauggcaccacccacaaggggcccuccgcccuugagcacugagaaaaugccccacagcuggaucucauggagacauuuucucaccugaagcuccuuucucugugauagcuccagcugugugacacaaaaccagucaguacacccaguaugguggugcuguggaauauuuuggaacauggcacuagguacuuguguccauugugccuuuauucugcuguguguauuuucuucuccccagcgaguuuugugcugaaggcuguaugcacccacuguagugcaagaaagacagaggcaggcugcugccuauccugauggccuuaugcuccccucacucucaggggacccaccugcuucugacuuugacuguggcccagcuguggagucauagggccccugcucuucuugucugcuuucugauaauccauagugagagugauguuguguuguguggaccucaaggugcuagacuuuuacacgucauguucuaccaugugaauaaacugguacuuuugugcacauacuugaacauagucagugcuauagcagacagcucucgugaccaucgacauccuugggaugguagacguccuaccaccugagugccaguugagggugccaccugcauccuucuucuuuagauucacaccaacaauccaguucuuuggccucucgauuuucccuaggggugagcagguaaucuggauucugggugugaccccuuggaucaggauaggacccucuucaccuguggcaugccuucacuugucaccgccucugugucugcaggugaacagacguuuuucauuuuaauugcaggccaguauaucgauuuucucuuucugccggcacucugggcguuuugauuaaguaucucugcugacggaagucaggcagauauuaaaggaaaucuuacagcuuccuucaagcaaccuaugguuuuaccuuuuaugcuugagucugacaggcaucuggaauuggguuuggagugugauaugaaacgggugcccagacuuguucuguccucugugauccacaguugaauggcucugcucuugaaaggggcauccuuugaccaguccauagugggcugcuguaggaucuauguugucagcuccuugugucugucugugucacccugucugauuuucuacuugaguauaaguauugauaucugccauggaaucauccagauauguuguucuuuacaauuccuuagcugcagugacccaggccugugagcuuagcuagagcucuagauuagcaugcucuauggagcgggcucaaggccaguuugagcaaaccagcaagacccuacugcaaaauaaaacaugaagaauugccugaguggggugggguguuguugcagacagggcuaaggaggcaaagugcagggaucugccagcaaccuucaggauccacaucagauacuggguaagugggcugcugaggggacccaguggcuaaagaugcucuuugucaagccggaugaccuuaaccccuagaaaccacauaaaggugaaagugagaacuguuucuacugacuaacacaugagcacuauggaguacuccccaaauaaauaaaguuggaagaaaagaaaacaagaaaggaaagaaggaagagagaagggcuagagagcuagcucagcuguuaagcacucuugcuguuucuaaaggauccaggcucagcuccagcagucucacugggaugcuggaauaacugcaugcaagccuagcuucaggggcucccucacucuuuucugagcucgguggacacucacacaaacguggcacacaugcaaacacaugugugcacacacauauaaauacaaauaaauuuuuuaaaaaauuuuauacuuccuguacauggguaacccuccacccacacacagauugcuugaccagaaugcuuaccccucauacauaagacccuggcuuccaucccuggggcagauaaggaaguaaaguacgugcucccacagaucuuuagguccccuacaccuccccaugugcagcugcuuaccgcccauaagacacuggcgggauaugauucagacugcuaugaguuuaugaaucauuuugaggagaaaucauaucuugguguuguuugguuuuauaaguggcauuaaccaucccucauuuacugagauggucuuuaauuuuucacagcaaguuuuauagauuuuacacuaaagucugaccagcauuggguuuuccucccuauucaaggugucugcucuuuuuuuuaaauguuggaucuuuaguuauguuugugucgggggcagggaggaggaguagacgugugaguggguguaucugaggggaccagagguguuggagcuggaguuauaggcaugugugagccuccugacacaagugcugggaggucaacuuggguccuuccuaagagcaagaagugcuccuaacccccaggccgucucuccagcccccacugguggauuugaaagaugucuuaggagacuuuucauuuuguucaucuucuaucuauggcuguggucaggccugggcaaugccucuuaugacucugcuaaccucagcacagccuggggagaacauguuggaggaggaagugccugugcacugcccagucugaggcugggcagcaugcgugcugugggguugguuuguuuugggcagcgcaugugcuguaggguuaguuuguuggucacgugaucuuggagucacgguaaguugugaugauagagaggugucccucaugccacugaccaagcuucuccuggcguauuccuggagugguuguacuacagggugagcauggguggcagacugugccauccugucauccaucagagcuuacguugauucaugaccuucaggauguagagcuauguggccaugccugugauccugguuccuaugucggcgagucucauguuccaagcaucucaucaaaguagagucaugauguggguuuuauugaaugcugcaccgguggaggccagagaacagccuuguuaauuuuuucuuucuaccuuuauuaaaggguucugugguucacucaggucaccucucuaagcuacuccgcuagcccauuuuaggcuuuaaguagugagcggcaagcaaaguguugcuggcaccuuuccucuuagcuuugucuucaugguaucccauuugcugacucuuagguucuguguucugugugcacugcuguggucauuguucuaguauggagacaccuuggcauugugagggucacuuaucgcugugucaucucuggggcuaggugaauguagaacuuccacacuauagguggcccagagagcuuucuccacccuggaugcuuugggugccuaguagcccagcccaccaccuucucccaggcugugccuuccuuuguauguuguguaccacguaguccuguuagaugauuugugauucucaucccucugccuggguggauccuugccuggauguucauuugcuagagggcaucacgguagcccauggguccaacaauugggcuuugugugaacauaaguuguaaguacccagaaauccuggugugacaaugcugugcugaguugagccuuuuuugugugauugugugcacgugcaggucaaaggacaaccucuggccucuucuuuaauugcuccucaccugguuuuagagacuggcucucucauuacccuggagcuucucuaguaggcuaggcugacuggccacugagccccagggcucauccuaggcacuggggcuacagaugaacuaccagagccagcuuuuauguagguacuggagaucaaacucaggucuuugcuugggcagcaagugcguuacuaacugagcugucuccuugaccccuagacuggugucuuuuacuuaggaauaugacuucaaauuccuccauauuuuucuugucuggauugcucaguuuaaaaagucauugguuaccauugcagugcauggcaggcagacugcaguuuacccagcauccaucugcuguacauuucaguugccuggauucuagcagauuugaauacagugcguuuacuggcauugugcucuccagcaguagcuggacagugcucagcucugaguucuucuggugcuagacccuucuacauaccucaugaugcuuuucauauacaggacuuuccuauccucuugugagaucuccuugaugcuaaggcuaaagaagaaaccgaggcacagagacagguggaaugggugggaauucagagcaguucuacuccugaucaccugcuguuacuaccuuaacaacagagucauggcugaauuucuuguuugguuugcccccaccccccugugugugacagauaugugugcaaggaugaauguacucagggccgaggauaucagugucgucccuccccccccccccaacaucaacucccugugauuuuucuaugugcucccacacauuggggcuauaggucuguguaaccaugcucaacuuuuuauauggguacagagauucaaacucagguccucguguuccauaagcaagcacucuuaaucccugagccaucuccuuggcccucuguagcuuguucuuguuauuguggcacuacucaccacucugggaccucuacugagccuuuugaguggcagcccccugucuccaaggcaagggucaauguuagguggagucucccuaggagcuggaguugugcuguuugcucagccacccuccaggcaguggcagcucuccuguggaccuggcuuggagcuccaggcugggccuuugcuaccauccccuucaucuucucacugccccuggggugggggacucuacccacauagaagggaauuauccuggcugcugccuucucucuguggauucuggaucacagggaagcugucgucgucauuugugaaaugguguucccccauaauucugcagccucccgggucuggcagccacacaagcugugccgcgguccucuuuuuagcucauccaauugaggucuaagugaggcuuagaggcuuggcugaggcugcucggcaggagcugaugcucuguccucuuauuuuccucucauugugagcccuccacagucucaagccaaaucugcaugauauacucuacacaguuguguuuguuccuauacuucugauguugagggaaacccucuuagaguaacgaggcuuaaacugugggccuucugccacugaacagcaucccuggcccuuuguaaaaacuuaagauacccagacuggccaugaacucaagauccuccugcuucucucucuugggucacugggacagcagggcugucuaauuaagcaugucugggaauccuuucucuugacugcuguugagacugcgagucuccuguucagcccuugggccaugagaggaucuggcuuccuaaacaggcauuaguuccugaagaccucaagauccuuuggagggugcggcagcuacccaaguugcagcucugaccucuuuuccuccuugggaaguuucagggccuucccugcuguccugggcaggccgaccuggcauaggugugcugacauaaaugugacuucauguggguccucaguguuccuuggaagugaacaaaggggcaggcucuuucugggguguagcucauuguguacccucuucucuugcccaugguaccugauauuucuccuuuuucugcuugcugcaaaggggaaagacuuaucauuuugggccuuccagaucugaucacacaugagagaucugaucacacagacuugauuuagagacuguguguguguguguguguguguguguguguguguguguguguagaccagaggugacauuggguuucuuccuauggcacucuccacauuauuugcugaguuaggguuaggguuucuuguugauccuagaucuuguccauucagcuaguccagcuagcuggcuugcuccagggaucuguuugcugacucugcguugccaugaccacuuagcuuugcaccugggugcugagggucugaacucugguccuccuugcugagccaccuccuuagcacuuuauaugacuucaaguaguagaaaugugagagcuaauguuggagaugugugcacucaugcacuugugcgcucgcguacacacacacacacacacacacacacacaggugugugcuuguguacacacucucucucucacacacacagaccccugaguacuccuuuuuauuuuaaggaagacugauauacagggaggguaaguggccauggggacacugcaggauuccuccgugcugucccuugcagcuugcuucaagauugauucagagugcuucuagaguggaaccauagagacccuauagcacucugaaggaagauauacaccaugggggcuggguaagaugaacagaguaccugaaucauugggguggagccucuacccugcuggccugggugccaugacugaauugagaauccuguucaccugagggagggccagaguucuagaacuggguacagggauguaucugaaccccacuucucugcucaagguuucuuguguggccaucuagcucugagugggaacauggcagcuauugcguuccaugcacauaccccuguucugauguuucuucucccaccaucagcggcuguguguuccuuucugucuacuguaagcacgugugcugugugccaugcuggggagauguggcuguacuaccucagcccugccauuguagaccccucgccuccauggcagcucugccucugcaccuggguaacaagauggccccaaggcugccucccuuccuuccuaaaaagauuuauuuacuuuuaaaguuuaugccaggcgugguggugcacgccuuuaaucccagcacuugggaggcagaggcaggcgaauuucugaguucgaggacagccagggcuacacagagaaacccugucucgaaaaaaaaaaauguguauguauauggguguuuugucuuauuuuguuuuguuucugccugcauguauguaugugcaucauguaugugcagugcuugcagaggccagaggccagcguaagaucuccuggaauuggaguuacagacaguuguuaguuaccaugugguagugggaauugagccuaggccucugauagaguagccaugcucuuaucuguugggcuaucugucuggccccuaagccugguuuucuccacucugcacugccagcccugagacacacugcagggaagcagggugcagugggaugguucugccauaaacuggcuacucaaccagguucaagcgucugaacuuuuaaguucagaaagcuucuuacuuaaaaguucccuccacuucugcuaaugauuccacauuagcaauccauuuggagcaccuggugggaugucccacugccucuguuccugcgggggaauuguucugugugcccugauguucucuucacaaccagcaggguccacagcauggauguucagggguuuguguauuaccugcucagcaggccauuuugggaccuauauccagucuuuuuuggcuggccucaaacuugaccuuaaauuuuuuuuuuuuuuuuuuuuuuugguuuuguuuuucgagauaggguuucucuguguaguccuggaacucgcucuguacaccaggcuggccucgaacucagaaaucugccuaccucugccucccaagugcugggauuaaaggugugcgccaccacgcccggcuuaaauuuuugauucuccuacccuuuucccucuuuggugcuaggauuacagauaugugccacuucguccaaacugaacucuggacuuuguggaugcccaacaagccucugccuuucuuccugcccuucuggguccuauuuugucugucaggaaggaaagcauucauuuggucugggaaggagccauuugcaaagucacuugaaagcuguccuuggccuuugcauugucccaccaagaaugccacuggagcuggguugugacaggaaaaaaguuuucaaggagaaaagcaauuuuaggaaauaaaaugagaucaaaacaaagugccuuuuguuccucuccaagcugcagaugguuauuaagauagggguuccuuggugcgggggcaggagggguuugccucuggccacugcugcugauccaugaaagcaaggugaccucaugcaggccaucccagggaccugauggggucccucucuaggucucagaucugccagaucuuuaccugaccacccuugcagcccaccguugccucagagccuucaccugcgcugcuccucccucccucggcagugccgucaccuugcccggucuggcucacugacuucccucugcccuugcuuuuaacaggcccuuuggcacagcuguuugcagccagucaaaaucuggcaauuguuuggcucccucuucugauggguggacaagcugaggguguagagaagucaccugcaaaggucaugugcccaggaaggucucugaccuggugaugaggauggcaagccaagccucaaugcucucuucugccaagggcagcauucauggaagagcacaaacauguugucccagccccaaagauugguggcccuguaccuacccuuacaggauuucaggggcaucuggagacacugcaaccagguagcaguuacagaugcuuugguuucugguuuguuuguuuguuugguugguugguugguugguugguuuggguuugguguugguuucuuggcuuaaaaccaacuauuuggaagauguggcgauugcccuuuugguuucucaacaguggaagaagagguguuaucagugggugguggaaaacaugguacccugucccugcuaucauccauccuucccugggcuucgcugacacauuuuggguaaggaugguagccacucaggaccugcuguggguccuggucuugguguaugaugucugaagauacugagccuaugcggucagugucugucucccauguaacuccccccaccccaugcugcugugccacuuuucaguacaucccacuccaguaucacuccaggacacuggccccuucaguacucagaacggcuucuggaaaugaguuggucuauaccuuggagaccacaucacccugccagcccugucauuguuucugaaacauccucauggggaugggggcaugagggacaacagagauggcacagugagucagguagguguagggcaagguagagccugcuucuaggggaagauguuaguaggaugcugguggcuuuguuuucuauuaaccuuggcuuucuaaaauacugcauucacgugcuauugaucuugguccucagagcuguugugaacacccucaaauccaagcccaggauguucauccacugcccugcaucauccugguccaggguacccuuucauuucuggguauucacaucacagcucaauuggaguuuacagugccagugcuaccacauguggugguacauuccuuuaaucccagcacuugggaaacagaggcagguagaucucugugaguucaaggccagccuaaacuacagagugagacccuguuucaaauuucaagcagcaaccaaaaccaaaaccagccaguaccuuagcugggauggguuuggagucucaacacaaggcuacacacuaaugagaagggaggaaccggccuggguaggugcccagugauggcuugagucugaucuccacucagcacagguggucuauggcuuagccuuguuggggacauguggccuucaauauccaggggaguuagcaagacaccuggaugccaccagaggcccagcuugucccugucacuuugguuccugucacagaacccucuuugccuacggugaagaccuuguccaacuuuuucacacaauuucgaagaaauccaaaucuuugaauaaccuugguccugaaaggaaaggcgcuggcugcaggugaaaauugaugguggugcucaaaggcaugguucccugccaagacagccucucgagugcagcuuccaaaaauagccgccacaacaguggcgcuggaacugcucccugcucugccuggagccugcuccaaagacggcgagugugcggcagccuccccugcugccuggccuucaugucugcccuuggccugcugcugggccaggucagcacuggggcugcugccuugugguuccucacauaacuggcuuccaaggauccugugagguccccaagauagaguguguacuggcucuaggucagaaaguacagcaggcugcagacccugggaggaggaugcacucgcucacucccucgcuuucucaggcuggcugccucaaacuguacucaguucuggucgucaugguuggcuucugguauguguguguguguguguguucucuuaguuugagagcucucaauguauuuuucucuguaguccuggcuggccugaacuugcuaauuagaccagguuagccuccaauucaaaagaaaucagcauucaggugucucugccaccugagugcuaggauuauaggcauaugucaacaugcuuggcuuggguuuuuuuuuuuguuuuguuuuguuuuguuuuguuuuguuuuuggaaacaguuuuaaccugugugugugagguacauguguguguucuugucuuuguugugugcuugugccuauguauguagaaaccagcaguuuguaccaggcaccuuccccccugagucauucugagccauauuuucugagauauugugucucacugaccugggcgaggcuggcgagcucccaugcaucauuugccguggccucccuucgcagagcugcaugugccuuacugcucucagcccuuagaaguggcugcucgggaucugaucucgggcccucacgcugauguagcugacuguuuaccagcugagccaucucuucaggcaaagccugucaugguuucugugggugaggucuuugcuuuacuuuucucuuaucugaggggcucagcuacgugcucacuaugaccaaagcaaccauggugcuugcuuucaucaaaacaacucucuuccauuaacuguuaccacuuuaauaaucccgugcauauguguggggggagaucacuuugaaaaugugacuagaauuugcagucuuaauuuguagaagaggaagcugcaucuggcucaggauggguugcuacccaggaauugagggugggguagggaaggggcaucucuggucaggagcauguggcuuuccuuggcagcuccuguuuccuccauguugcuaccccacuuauguccuggaggcagggcugccaguguuugcacacaagugugaggauguguguuuguguaccucuaaguaggcuguguugugcauguauguaugcaccuaugggugcauauguccuggaaagcaggcaucuucugcuguugcccuguuuuucccgugagacucccauggaacauuaaacccagaggaggaagacuggccauggccaucguaauagugauuaaauagcaauaaaacaggaucaguauuuacagaccuggggugcugcaacuagaggguauuaaauaucauccaucaccaaguggaaagcggucgauagcuggggugccguuuggaacuaauguucuuuggcuuaacuuucccagcaaagacccagacuggccccaguaaaaucccaggaaggaacaggggaagucccauuaaagguaacaugccaccagcuugcuucagaguccuuucugggguuugcaguacugucacaggggcuaagcugucagcuugcgcuggaugacauagcgugauccucagugcaugcucauuacuggcuuuugccuuaggucagcucaucuugagccugcagauccagggggaacugagaagugauucuagccagaaaggcuccaggacccaggaaagagcagcgugggccaaaggugguuugacuaaaugggggagcagaacgagagcagggcucucccuagggcccucccucaucuacugagccugacagugggguucguccaaucuaggguguuaaguggccaggcccaguguguggcugugcuucccagggauuugggguggggcuggagcacuccugcagucccucuuaaaaauguuuacacuuuuaccaggguggggcccaggggcuguggggugacccuagguuaggggucuugccucuccuuugagaagaaggugggauauugggccuuugcuagcaaaagacauugcuuugugccuuuaugaagccugagguagugucacuuugguguaccugcgguggucuccagaggccaucagccccagauaucuuuuugucagccuauauugauauucuucucuguguccagugcuugguuucuggacgaucagagagaaagauaaagaguuccuucacuuccaccuuccagagaucuucagcuuugcuuugcuaacguagacguuuccaguguguuaaagacucccucuccucugucucccaagucaggccaaggaggaaggugguccauggccagagugucugacauugccaguggaugggcucuggugagaagggugcuugggucugugcucuggugugcucugaaaggcuggcucucuagcuggggacacugcaaagcaggcaggcucugugguccugacuaggugauaucgccugcccgugcagcucuaguccccagcaugagacugguucuaaggcuuggugguuuguaagggacaccuccucucaggugcacuggguuagcaugcagccacacugccuaggagacgaccccccucauagugccaccaccccugggacagggagaaaguaccauaugacauagggagucugugggacugugccaccuucucuguggggaugccugggccucuuucuagggucucuaggucauuguucuuagcugcaacucagaucuccuuuaguuuugcaggucaggccuagcugaugucaccuugggccuugcuuuuggucaucucucugggacagguucugagguggcccuugcagagagaggcucaauuguuaagugauaaauuggcuucacauugcucucuucuccuuccuugaggaguucuguuaaauuuuucacuuugcucugggguccgcaaaucccacuaagugaccguugcucuucuggagccuccuccggcgcuguaauaagcccuuauaaagggcucuauccacagccugauggaagucucuaaauaaauuagauccacugguuagccuucgccggugauuuuuauuaaccuccgguuaaagaaauauugcuagcuacagcugcgugauuuauuccagaagaagccagccucauuuaagccgccgcgugcucccgagaggauggcauuauagaacaugcagagccagggcugacuugggggggugugcuuagggguagggaagccuuucucuagugaccuugggaggagggggcaggcucagucagagucuuguuucuccaagagcagagcagcacgugaauugagugggcacuccuuuccugccacugcugcccccggcauaccuccuuuguuauguaugugguguggcuccugguuuccugcccuucccaucacuuccugugugugccauugcccaggaucuguggucuggccccagguggucaagucaugcgcucauaagucauaagccugcauuucaggcuucuuaugaagaaugacacauaccauguaguugcugacuggacaggaagacaguccaaggugccugggacucagugugucagucccaccucuagccccaagcugguucugaaacugcugagcucacuuuugccagucaccugaaugaugguccacaggcacuugcaguucucuacagcagggucuaugauguaaagacaguuucaucucuaccuccucccagaggcaggccuaagauccuuccugagcccagauugcuguacuaggcccugacugugaacagcacucaccaccagcacacagcagccugcagaaugagugggcagcaauccucccaagaguucaguggucccggucacuuaguccucucuccggcagugucauggaugaagagugugagccagguaagacacugaccugggagucccuuguagucuggcuaauaggaacuuguguuggcuuggccacagguaggaguuggcacccagccuguagcugccccuccccagcugcagcuugcagagggcucuggaggagguggcugcauggauuuucagaggguuaaaguuaauuaaagagcucuuccaugcuuucauuuccuugucucugucagcuauuuacaugcaaaugugggccugccauugaggccugcaaaggugucagcuucucugcacaucaagggagaaaguagcccgagccugcccagcccaaugcauugcauuguguuuguuacacgccacuguggacagcaaggagggggcccaagcaugcuuggaagucagcagcaggcuucuaccccugacugucugugugucugacuugaauuuucuccauuaaggcugcaguucgcacuguguagcugaauacauuaugcaugguaauaucuucacauaagcaauuuuauaaauuaggaggaugcagagaggguacaaacuuucugaguucagggcuggugcuucccagggguccucuuccuggccagguuauccauuagcaguaagaguuagagguauccuugaggagagguagcugugguuugcaugguguccugaggugcaugguguccugaggugcaugguguccugaggugcaugguguccugaggugcauggugucuugaggugcauguugagugacuaaauguacugugugggauguacgucacugcagggccggaggccaugaugcugacaugagaaggugggugguggcugauaguguucauucuuuuuuuuuuuuuuuuuuuuuaaagauuuauuuauuuauuuauuuauuuauuuauuuauuuauuuauuauauguaaguacacuguagcugucuucagacacucuagaagagggagucagaugguugugagccaccaugugguugcugggacuugaacuccggaccuuuggaagagcagucgggugcuuuuacccacugagccaucucaccagccccgauaguguucauucuuaauaacagguagcccccugcuguuuuuucugaucucugacaaugggcacaaaccagcuuugccucucccuuagacaaagcuagguguacccuggggcuuguuuuaugggcagauugucaagaagacaacaagcugggguggcuuaguguuguguaacuuuuccuggagagacacauaggaacauccugucaaagcauauggugugagugacagaccaaaguacuacuucaccaaaaucuagcuuggugagaucaguucguuuauugagcuuuuuaaauagugcacaagugaaagguuauaggggcaugggugaccacagagucucaauccaucauggaugcaaccugucaugucuccauagaucagaaaagaaugaccucaguauugcacaaagaaacaaacaaauugaaaguagauagguaaggcaguuuuauuuugcaaaaagggugagaugugaccaaagcugggcuuuagcauaccagacuggaaggucacuuaguuuauuuaacacagugaugagagcggccaauccuggugggacuugacuuuacaggcugacaugauuggcuaguugguacaaaguggggagcacgcgcguuucucaggaucacuugcagggucagggaggggugggguccuagucagaaucucagguugaauuuagucaguagccccuuuaucaugacgaaggaccuagcuaccccuguaagguugugucuaguugccacgucuacagugacaggcaacacuugguucaguuuuaccucuuaguagcugaccuuagugaugcauggcgccuguacaccuggaagaaacccugucccugaggcaagggaagggcaguagcucuguucucugccugcacagccagauguggcagcaguggugaacaggcucauuccauucuccacugacaguggaggagagcucaucucuguuccauuugaugcagagaugacuggccuuuucaaagggauacuaggggaguugggagucuggaaaaugacaauuucaaaagugguuaagaagguuagucagggugaauacaaccagacaggccguaugcugucacacccaugagaguuagggaccccucacugaaccugggagacuuagaccuguucuucaggugaaggcauuucuaaaaaaaaugcucuuaacucuaggagaccagcccacugacuugucagagggacagauaugggugcaguguauagacaccucuuuuaaaccaugaggcugugcaggucaggugcuuggcuucugcuggcuucacuagcccaaugggaugcuccccuccccuuuuauuuguggugcuggagacugaacacaggacuuugcaauaucaggcaaucagucacugagucucaccugcaaggccagcauguucuucugcuaagccguuucccuaggcucuaccacagagcccuguccccugcccccugcccaaugcuugucacuuuggauucuaggcagacacuacugcugagcccagcccucuuucugacuuugaacuuguagcccugguaccucagccuccuaagcaggcaaacaucaccaaaggucagcugucucccacuggcagaacaugcuguuucauuauugugcuuuuuaaaaugaugaaaucuguuauuaaguacuggauagcagagagauaggaaccacaguccuaauagagauguggguuaaaugcucuggcuuucucagacaaaagaacaauuaccagcccagccucuuagacauccaggauaugggaaugcuggccugcauaccccagagugugacuagggucuuugccuggugacagcugcauuguguucuggggagagcauuguguccuugggaguacagacuauaugaguugaguggcauauguuuacauaguagugagcaguuaaauagguggguggcaggaggcacaagaccggguucccucugcuggacuuggacccauguggagcaagaguggucacugggcugcagguguagagccagagaugccacgaacauaugucuugcuuacuagagaggcagcugcauuuugaguagguaucccuacccagguuagcaugcacccuuccuugcccugacaucugagaacacccagaaaguggccuguaggacaaacuucugccaccaagacuaggcgagaaauguuaaguguuacugggcguuuguuggaguguuagugcacaguguacucacaccacaaucuucauaagcaaaucaaucaggguauauuacugcacccugccauuuccagaacaauaguguaagcuguggagggcugagaggcagugcuggcuggccccaugaaucacagacccaugugucuguguuggccagugugaguugggcaacagacuugcuccacucgagugucuagugcuuuauacaacuugguuguccuccuucgagcaugauccauuggcucucucucuguaguuguggcuuaagauaguagcuuccacuccaugccaucugcagugggaggucagggccagcuccaguuuucaguuacacugaagaggugucaccugacaccugacuguacaugacaaaacagugaauucagccuuuucccacugacuucugaccccaguccuccuguggagaaagcaccaagcaaauucuaguggugggguaucuucuaggccaccagagcuauccucagaaugggccaggucuccagaaauguaggaaagccaucaagguugcuggggcauguugcuaguaggccauguaguauggcaguguggauagaucugggaugaugcagggcaggggccgugggaaggggaauaaaaggagugggggaaaaccccaagucccgccagagguccagugcuucgggcaggcggacgaggaaggaucugccgcauggcuuucuacagcccgggagugggugggggggugucugggugucuggcugugggaagcuacagacucagcccgaggggguggacaaggggcaguccgcagucuuagguacgagguucucagucucgggcaucucagacacugcuggacaucucggaggagcugagaacagaaugggggucccaggaguggcuuggucagcccuggggccgaagggaggaggggggggagugggcgcuggaugguucucacacgggugagagucccugguccgguccguggcuugaguucaggaaggccuucuggugggagguuagacacggcuuguuaggugaaagccuaucccaucauucaagcacagcgggccuugaugagcagagacagucuaugguuuuagagcuuuauuguagaaaggcaaggagaaagagagaaaguagaaagaaggaaagaggcuggcuauggccacguggggagaggggagaagggagagagagagaaggagggcuagaguugauaguaagaaaagugagagcuuagagagagaggaggggccaagcagccccucuuauaguggcugggcuaucagguaacuggggaggagcauaccaggcuaugaucagguaacuguggggguggagucuagccagaaugccagaagcuugggacauugucugugugacuuauagucacagaauuauggaguugggggcucuguggugucagucaccugucucugggaacgugguuugcuuuuucaucccuuguagaguuuucuuuuuucuuuuuuguuuuuuguuuuuguuuuucaagacaggguuucucuguguagcccuggcuguccuggaacucacuuugcagaccaggcuggccucgaacucagaaauccaccugccucugccucccaagugcuggaaucaaaggugcgcgccaccacugcccggccuuuguagaguuuucuacugggucacaagagcaagccucauucaaccaaaauaggcugccuuucacagccccacagggugaagaauccuggagagcagggagcaggaggagggaggacagaggcagcuggaugucucugcauaaucuaggagccaucaucaccugugccccaagugugccaugaguaacacggaggcuggguguggcuugugacaugucugcuaucuuccuagucuuuguaaaucuaaaucaguucugaaaaauacagccuguuacuagggaggagaagccagccuggcucuuuucuggcagaggcuugggguugugcugucugcugaggguggagccuccucuguuggaaugguggcuuggggaagagggcacaugggcuggccacuuccuacaguguugaugcccacccagagacaaccuggcuuugggcuucuaagagugugacaucauucugacuauuuuccaugugcccuugcagcauguggccucugaacuacauccgggacacagcagcuguauacagagagcacuagaccagagccuugucuuuggggaugugcacaguguaccauaggucucuccaaggcaguuuuccaagccucaucuucuagucuccugugacagcuaggaggccagcaguggguugcaggccaaggauuuaccucuguaugggcugugagaagccuccagcagcaggcugggcaucuguggaugucgcaggugucaguccuagucagaugggaugcuuugucuaguuuguauacagccuuugacauuguguuaugaugccauuaucuacaaauuucagguuugcaguagaguuauaaaauucccccaccccaaugcacaaaugucauaauuuugaaguaaguuugugauuuguauuggguuguauucauagcugucuuguggugcacauggccuguggcuggacaagcacagaugcugacucauggguuaagguuccuacugguagcucccucucacccccacaguagcugauacccuugggccucacaccaagacauuugccucuuccaagauguggccucaaccuuuauguuugaucccaaugccacauaagccagaugugguaguucauacuuauaaucccagcacuugggagauagaagcaggaggaucagaaguuuaaggacauccuuagcugcaaagugaacuggagguuagcuuggacugcuugaggcccuguuugaaaaauaagcaagcaaacaaagaaaacaaccaaaaagaaguauggaagccauuuggaaagcccgucacccuuccccgagauggaacugaacacacagccgcuucucuccugucuccauacuuauucucccuacuauccaggugcuagggucagaucugcuuuugcagcagaacauggcaugauaaugagugcccagucaaugaugugcugcuucucuguagagaugugugccucgaccuuccuuguaauuuguggucucugacuuuucaccuuuccugcuggcaugagcaaacucugguaacuuccccugucaggcagaguugcuggguccaaggucugagugucucugaaaccuggaccuguguuaugugucuaguuuuccagaaggcaggagcuaguggguacucuuuuuugccugggguggggugcauccuccccacccaccaacagaggguuuuucuguguagccccgacugucuucaaacucucuguaguccaggcuagccucccaaguacugggauuaaaggcaagcaagcaccagcacugcuggcuggugggugcucuucugaggacacugccauuuuaccauccagcugucgugcuugagcaauggcuuuuacucaucuauucucacuccucucgugcuugcuugcuaguuugguuucuccuggugacuguuuauuuuggccuuugugauaguuuugucacuuggauaguguuugauaaggcacuugcuguggcccucgcaucacaguagugucugcuugugcugcuguuuccuuggccugcaccucuucugcuagcagcuguuaagggaggacgcggauucaccagccaucuuacucggggauuucuugucucacugguguucugggaccaguacccaagcuaccacagggacuccuuuugucaccuggcaguggaguugccagcagguucugccuggggccuuuaauucucugucugguuagccaaggaaggugaugaagggauggguugaugucuggcugccuucuuccacugagaccuuugcuggguuucaugcuggggugcauguuacuccuguaggcauuggaauugugacacagccgcaguguuggccauaauccaaggucacccugcugccagaagccucuccauucucucacccucaucugagguaccuggguuugagaagaagauaucuagaaaugugcaagauaggaugagucacccgucccuguggcugagcagucacccuucaagaucuuugucuccgugagaagagugcuccauaacugccaucccagugcuagugaugacugcaugggccaccgaggacuaagcuugcaugcuggguuugccgacgaaaagaggagcauaggaguucaagagaugguucccagcacuuguuugugguccugagaacagcacuguuugacuuggcccagccccccuagaccggugcuucucaaccguccuagugcuuugaccucacaauacagcucacacuauaaaauuauuuuuauugcuacuucauaacuauaauuuugccacuguuaugaauuguaaaaaucugauauggaggauaucugauaugcaaacccuugugaaagggucguuugggggcccccuccacccuuccccaaaguggucauggugcaguucgagaauugaugcuccaggugggugaagguguccaucaggaggaauagcuaggcuugggaggagccuugcaggagggguaagccugaccuaugcaguaaguggagacucucaggagggguggggcuugaguccaggcagugggaggagccuuagguuggguaggcagacaggcagucaccgagugaagacagaauugugauuuuggccagcacucugagguggccagaugccugugauggccccugguaaaccagcugcucagcaguauaaaacugagauguuacagaguuguccguuuuaggcucuuccucacugguaggagagacagaagcaaguggagccaagcugggcauccagggcaucaguugcauugacuacuguaggccauguccucucaccguccuccugaauggcguggaauaugcuugaguagcaguaacacuguucuuggccugaagcccugucauagcccuguugccaugaaucuuguuucucaccugcucucugaggacaccaagggaggggccagcuguuggacaguuagugugacuuuguuacuuugugccuguugguguuaccccaggaagaucagcucuaaugcauugcccacagagccacccacaccggcaugaagagucgcugcuugggagcccagggcccgcucugggugggugcugggaaugcauuauacaaguagaguaaaugaaaugggguuuguaauagagcagugugaagccugaguaagauugcuucgggaagucucaauugauucccucuccuuccuauauuagguguuauagagcuuuuucucaggagguugaaauggcaggaacacgggcugggggcucaugguacagagugcugaggaccuccuccccugucuccuccaaccgagggcuggacaggaaguaguugaggcagugacucagggagggaggcuuggcaggguguguggugcugucuguaucgguuccuagccagaagaagguagggggcauuugggcauggagcucucacuuugucccucuguaaucaguagcuaugcuagcuuuggucacccagagggagccagguacauuuacagguacagccauaagccugacugauguggguguggaauguguuggcuguuucuaaugaggcuccagagaagcuggugacccaggcgguggcucagcacacugugcacuuggaucguggugggugagaggagcacacuaggagcuuacuuaucacaguucagagaggagaaccuuagaacugggaaggaggacuugcagcuuugagggcuggcugccaggugguauucagcgagggugcugacuguccccucagcauguacaguauuugauguggcccacaagccccguugucuccacgccugcagagcauaguggcugauggucaccaaauaugcccaggagcauguguugacagcuuccugcacuguuggaaggguugagcuuccagcuccccagcccuagcccacccaggaagcacuacacaugggaacagaucagggaccuuguuuaauugacucuaauuggccuaagugaacggugugcuaauucuaaauuagccuuaucuacucaugaaagaaucgaagcaagaaaugcguuugguaacacuuuguuagagcuuuguucaagagacuauauggaaauuaauagaauugcauuuugcuaaaauuaucuucucguuccaucgucaucagugggacuggccucacccaauuaaccacauuuaaugagcuuugaugacugugaacacuuuuguccccagagauguuucucaacaccccuuguugagccauccacugggggcacauacucucauuuuucuccuaaguuuuuuugcuaagugcaggguauagagcagccaccuuucucugugcuccaccugaugucucugggcuccuuucucacagucaguguucugcggacacaggaggacauagcgaggccugguagccucaguugcaucuuguagacccucuugucugacacuugagcaucagaugucagaaaucuggcaagcggugaggucaagccuagccugggcccagugccacagcugaugugaguguaggcuggcuauucucagagcucucccccuuuccaccuuuucuugucucuuccaccauuagugaugaucuuaguacccagauuaauccuaacuguggucccugcucaacacccuugccucccaucuugcuggaucccacauugccuucuccuuucccuuugcaucccaccccccaccaugaaugcucgcugggcaacacugugugagggugccuaguccuuccagacuucauacugggacagugguugagcaagaaacuuagccucaaauggaugcccucaguucagccgacugcacagaugcuuccuaaauaaaaaguuucaugcuaaguggggcaugauggugccugcuguaaucccagaccucgggaugcugaggugggaggauuagagugugaucaaggccacccugggccacagcacucucucuaaauguacuguuuguaggugacaucagcaugucuguggacccugcaggucgagaaguaacuagucucuguuaucuuguucccuuuugccacccccagagccaaacucacuguuaucuuugccuggguuugaauuucauuuuaguggguaccuauacacauaacugcggugguuggcucuuuuuguuaauggugacauugcuggguccagagguuucauuccgcccucugagaaugccacgugucuuucccuccugauggugggucuuccuacccagcugcagugaaccaaccgugcugcugugaguuuucuggcccagggcuugggcgugggcacuggcuccucacaucucacaugcacuguucuuuaggcguccuccaugaugcuuccugacuauggcgcccugaguuccccacuguggggcugcauuccugaacuguggggggggggggaaccucucucccuucagcugcuucuguaucugucucagaaaacagcgaaggaaugaagacgcucaccucaugacuuggauacagugugaaugaaggggcucaccucaugacuuggguaguguuuucuuugaccuguggcccuucucuggggcaacagacauuccuuaugacugcccccuccucugaaaauggcacacaacaaacuccauugcccauucgauuugaugauucauaagguauuugauacauucuggucacuagccuuuuguuaaauaagugauuguaaaucccccccccccccgccccccgcccaaaucuggaauuuuuuuguucuuucacuuaauugaaguuuuuaguuuggcuggacgcuauucugcuuucagauuccucuaugauugcuguuugugcauguauguccugauuuagaagccuuugcuguugccugugccuucaguuaaaguuguggcuuuaucugcccugagagucacuuucacgucccacugacaagauuccugacuggagcaacuuaaaggaggaaggguuuauuuuaguugguguuucaguggauauaccccaucaugcaugguggcugcagcucgaggcuggucaccucacagugguaggcaggagggagaauucucuuaggacagaaugagaaguggauaucaccuucauugucuuccucuugccccuccacugccagcagccugccucugcuaggaagccacagugcuccaaguucucauccucugaagacagugccaugagcuagaaacccagcgcugccucuugagucuguguuggaggcccaggaagggagagguggagucagauauuaaugaaggguggcagaggcaucagaggaggcagccgaguacacucaccagcaggagguagaggggagcaggcaaaaagcaacagccuuucucugagaccccuuaaguuuggggauaguaguacuggaaaggauagguuuguguuggccugugguuccagagggaaguaguccauuggggugggaaaggcaggaaauggggcaggaguaggaaguugguugaguaauuuuucauccacacccaggaggcagagcacaagugcaggaaguaaggugaaacuaugaaccaccaaagccugccucuugcugcacuuccuccaggaaggaggaaccucuaaccuccccagaauacugccaauuggggcccaugugcucaaguacagaagccuaugggggacauucuucauucagacugccucauugagccacugccagaagguaccauguaccuugggggagggucuuucuccuuaguuaauuuaucuaggaacuacccuacagaccugccuugagucauguugauuccagauccugucaacuuggcagucaugguuccuucuuacacuugggcugcaguguaagaguuuuaagugaaugugccugggauucaucuagggccuugcucagcaaacuguguacacugaacugcagccccuguccucuugugcuugauuuugagacaaagacuuauuaacuuacccuggcuggccuugaacuugcccugccacccaggcagcccuugaacauugguucccccuuccuugauguggaaccgggcucuguuuguccuugaugaucuugcucuggcccagcggcacggcuaagcacacuuacuuuaguaaucguuuguagauuaagucggauuaucuguucacagugugucgugugcuggaaauccccaucaccuucuuucccagccuuuauacuucugagaagcucaacuacgacugcuuugaacagagggguuaguggcugagugucccucccuaacagucucagcuaagccagcuauacauagcuguuagaauucacacugcucugcaggaggaaauguagccauucagcaggcucgcuagucuccaugugcuaggaggcacuuuugaaauucucuuugaacauuuaccuuauuuuauucacuauguguaugcauguguauauaugugugugugaaggugugguguaugccauauagcauucacgugaagauagcuucugagaguuggaucuuuccuuccaccauggaguggaggguggaacucagguuaucagcuuuacagaacaagugcuuugaccugcugggccaucuugacaacccuauggaggcucuuuuuuauugccuuguuuccauggugaauacguaucaauuauaagcaaauguuuuuucugcaaauauugaaacuauaugacuucucuuacuucuucuguuaauguggauuagcuuucugacuuuccaaacaugaacccacacagaggucucaggucagagcaguucucucuugcgagcugugcauugcugguuuugcuuagccaucuagcugagguuccggaugagugaugccuggagagucuggccaucagguuuugugcugugaguuuucuggaauagucuguaagauacgugccuacuucuuccuuaaugaucugauggaauacaccaguguguaaguuacuggucggccucuagguuuuagccauccacuugccucuucccaucccaucccuggagucacagauucauguggccaugugaauuuaaguggaugcuggggaucuuaacucggaucuuuaugcuugagugacagacagguuuuuuucccguggagccaucucuuuagccucagcacuuaaauuauucuuugugugugagcaugcuccugucugugcccuaguaugcauguauguuuaugcauguagaggcuagaggauauuuucuugaauugcucuccaccuuuaaaagaaagauuuauuuuuauuuauguauauguguauauguucauagauacaucacauguguucagguacccucagaguucaacagagggcaucagauccccuagaacugaagcuacaggcaguugugagcuguccaacaugggugcuggaaaugaacucaggucuucugcaggagcagagcagccagugcucuuaagccacucggguaucuccucagcuuccacuuugauuuuucagacaaaucucucaccaagcccagcuuugcaugagugcuuaggauccugacucggguccucuggcuuguagagcaagcaugagccagcacuacauuuucauuuaaaacuuuuuuuaaaaaaacuuaauguguauaaauuuuuucccugaaugugcaccaagggcaacaagaagaagcugggaccagaguuacagacaguuguaagccuccaugugaugcuggaaaucaaacccagguucucuguaagagcacccacccagugcucuuacccgcugagcuaccuuuguagccccccuuuccuggugauuuuacuauucuucuacugugugcugcuuccagcucacuuuuauuugguaaucuauauuucuuuauuaacuucaucaaggguauauuaauuuuuccaaaaagauuucucauuuuuauuuuuaauuaugugaauauccaucugucucuguggguagguacauguaagugcagguuccuauagaggccagggcaggugccuguggugucuccuggagcuauggucacaggcaggugugagguacucaauacugaugcuaagaaccacacuuaagauccugugcauagcacuaugugcucuuaacucugugccaucucucaggccuaagggcuuauuaauuuuauuagucauuugaaugagucagcuuuuggcuuuauuaauucucuauauuuauucuguauugcucauuugcuuuuccuaucacucccuccuuucuaugguguuaauucguguuugaauuugaguuguguauguagccaguugagucucauucuucucuuuggauuucugcucuuaaggcuguaauuuaguugcaugcugugcguuugauauauuacauuuuucucauuguauuaagcagccuuccaucaugauaacagauugccaagauuguccuuaugaagaggaaaaugcuuguuugguaguucuaugcuguaacagauuauggcuuuagauuguggccaguccagacaucuugggcaagcagguggugaauccaagccauucaccuucaggcccugaagccaagaguugaaaaggaagagccuggcauucaacaguguccuucacgucauacccccagggaccucacuucuuuucauuggcccuaccuccuaaaaggccagcuagcuccaaguagcacagcagacuggccaccaagccuuccuucuauacauggaccuuuggugacacuugcaacucaaacccugaaagaguuuggaaguuuaucuguuucaauugugauuuuuuuucccuuuaauuuaaccaaugaguuguaaauaaaauucuuaauuuaaaacuacuugcugggucuuaagcucuugaauuguugaauucuacuauaauuuucuugcucucaaauuaugcuuugaaugguaucaguaaaaauuuaacaagauacauggcuaggaaugguggcacacacuuauuguccgagcccucuggaaauggaagcaggaggauuacugugagucuaaggccugcagaggccuagugugacucugucuaaaauaaauguuacgaacaccugcuuccuggacucucgugagaccucaugguaguguguguuugugaagcuucuguguacauggaguugaccaauaggucggugcugggugucauugcuugagaaugcugugucaguggcagguugcucuguucaacuccucuguaucccagagaagcuuccuuuggucugguucuuuguggucugccugacucucccauuagccaugucaguuggcauccugggucugcagaugcuguuuuuaggcgcucuaugcugacugaaagguucagccugccccaggaggcuuccuuuucuuccuaugaacucaucuucaccuguggguucuuccagcgauuaauuuucuagcagugaucagcuuccauuuuuaaaucugcaccuuugcucuuuccacuaucauuggaaaccucaucauuugguuacagacaguucucuuacaaggggaauauagcuuuaguggcuuucuucagccagacaauguuuuuuguacacuugaaauauuuaauuuagucguccuuuauauaaugagaaaucuacuacccugugaaugaaucagagagaauccaaggucuuccgaaugaaugguauguauuccaccacugagccacaccccagccucucacugggggauucuaggcaggggcucaaccacugagucacaccuuagcuccucacuuggggguuguagcaaggugcucuacuauuacagucauauuccagucccucauugcugagucaggcucccugucccuugcugggagauucuggucaggggcucuacugcugagcuauguccuuaucuuaacacauuugcauuuaaaugauauauuuuacaguugcuuuuuuuuuggagccccgccccuccuuuguacuuugucacagaauaaacuuuccuuucuguuuucucuccucauuauccuggucaccuggugugcuuuuauguguuucuucuuaguugccuuacugcuuaugagaagauaggcuguuauuaacugagucuaguaaaaauuaguacacuccucucuucccuguaucuggccaccuugagccauuugcuccugcuuuguuccucagccagaggcucccugauaagaagguguagauauacugauguacuuacccaguguuauguauacuuagagauucagaaagucacuguguuuuuagaaaaggaugucuggcucaggcuggccuugacuuuauguagccaaggcugaccuugaacuuuugguccucuugcuucugccuccugaguugagauuacagcuguguagcacuguauugauguuuauauacauuugaacuuggcaguuguaccuaguagcuuuauuguagucuguuuguuauaauuagugaaccaguaucuauauaaccuauguauuauuuaguuaacucauggcugugccaagaagcagaaagagugcuuuuagguucaguccguuaugguggugucaguaggugguggcagcugccugugguuguagcagguugaguauaaggcugaguguccacauaugcauggaucccagcccacaaagugcuacagucaguccucccugaaaacaccugaccagcacacccaacgcugugucucagucaggcccaggccaccuccaccccucucuccaggagaguggcuauaugcauuugauugcaguugccugcagaggucagagguauuggaucccugggauuacaggcaguuugagcugccugauuugguugcugggauuggaauucagguccucuguaagagcaguaguaccacagagccaucucuccagcccuuugagacuuuuauuaguguaauuaaguugauaauuggcauugacuaucauggucuuacuuaagguuaaaagcacauagcaugcauccuugugcuauguaauucuucucuuuuccuaaacacauggugcauuuauuguauuguccaagccugagucaaguaauccuccugccucagccucuauagaguagcugggucuacaggagcaugccgccauuccuaucuaguggugaggguuuugacuugggcacauuauagagcucuccuuacagcagcuguaggucaccaguuuugucuccugaaggcuugcagugaagugaucaccucccuuguggaaucaggagauaguagccaucuagucgcuagauucuaaugggaccuugugggucugcugcuuuccauuuagaaaacucguguuccuuuaaaagaaacaggcuauccugucacacugaacuccugucaggagucacuccaaaagcaggauggauuccagcaaggggcuggcugucaucaccaucuuaggucaggucagucagguuugcaaggaaagaggcagaggaugggacugaaugcauuucccccaugaccugggggaacugaugcaccacaacugcagucccuuugugacagugaagccuuuagcgagaagucagggugccauguguucaugaugcuaacaacucaacccagagccaggcugguuucuaugcguuucaguaaagaaacccagugccugggcuggcuggacacuggcuuggcuucaggcccacagggaugucuaacuggccugcucacagcacuacugcacucugugcgccguagcugggaccaaggaagagcaggcacuggaugagcccaaguguuguuccucccucuuuggguuuugguagccgggccccauucaagaacuugugcucucccuugugagcuccagcugcuccugcuucuugugguagcacucugaguguucuucugggcguguguguguguguguguguguguguguguuugcagaugugcauaugccacauacgcacagaaaggccagaggacaaucuccaguguuagaccucaccuuccacuucauuugagguggcaucuccuuuucacugcugugcaccccaggcugcugcucccugagccccugggauucucucaugcuccccucccugcuuguucuaggaacaccaggaucacugcaaugucuggcuuugcuuaguuucuggggauuugaagucagaucuuuacacuugccuacugagccagcuucccugcccucagucccuggcuauacuuucgcaggccuccuggacuguucagugauccagcccucacugugcucuuccuggguucugugaguuuucacucauuucuguucuugucuguauucuuuucuuuuucuugcuuugggcucacauuguucuccuuugcauaguuucucuccuggaagcuuaggugauucuagaccuuuguaaaacacacauguaaguuucucucugagccccgugcuuacuguuuucuacaacucucaguaaaguugcauugcuuucuuauuguuccaaaccauuguugaguuuuucuugaguaguuuuuuguuguuguuguuguuguucauuuguuuguuuuggccugugcauuaauuagaagugguuuguuaauuucuaugcauuugggggccucacccucagcucuuuugcagcugguacccaguuuaauucaguggccacauucuucuuuuguccauucccuguggugguguuucuggccccagugugcugcuuugcaaguguucccugugagcuuggggaauacgcucuccaucaccaucaggcaaggugauugauggcacaguuugggucagugguguccuuacugauuuucugccuguuccagauagagaacuguugaauuuuugacauguaccaggaaaucaucugucucucucugcaguucaaucuguuuguguugugugcaucuuugcauucuaguaucagugaauuaguguggagcguggucaugguuuucugucacagugacccuuguaauacuguagagcugggcuccuuucuugugcuuuuucccuaguccauugacaugcagaaauguaguguugggucugggugucuucaagugaguugcaggugucuuuggaugccagaagagggcauugauucuccuggaacuagaguuacagaggguugugaaaugcauuccaagcauugcgggugcuuggauucacugcugagccaucucuguagcccaauguuuccaaucuuccuaaugcuucaacccuuuuauacaauuccuccuguuguggugacccccucaccauaaaauuauuuuguuacuacucugugaugguuuguauauacuuggcccacugaguaguaauauuaggagguguggccuuguuggaguagguguguuucuguggguguaggcuuuaauacccuugugcuagcuaccuggaaacaaggcucuagcugccuucgaaacaagagguggaacucucagcuccucuagccccucaucuaccuggauguugccaugcuucuauuuugaugauaauggacugaaccuuucaaacuguaagccagccccaauuaaauguuguccuuauaagagaugccuuggucauggugucuguucacaguagugaaacccuaagacauacuucauaacuuuaguuuugcuacuguuaugaauuauaauguaaauaucuauguuuucugauggugcuaggugaucccuguuugacccacaagggaucauaacucacaguugagaacugcugcucuggccccuccaacucucuuuggauuguaguuacuggaguauaucuuccuccauuuaccuuuaauagaugugucuuuuuguucaaagaccacuucuugcagacagcauauaauuaggucuuuuuuuuuaugcacucugacagagucguccaaaguggccugcucagauuaauuggugugcuuagaucaugcacaguuaaaaugaucguugacaugguuuacaauaucccguguuuguuccuguuuugugcuuggucacugcucuuuguuuucuuucucauuaucuucucuacuucaucugccuuguuugguuuuaauuguacaguucuuaucauucaguuccccccacccccacuggcagcuuaugaauuaggcagcucccauacacccccuauacuggcuuggacccagggccuugcauauugcauaugcuauacaauuguuccaccacugggccauacccccagcuccucacugggcaguuccaggcaggggcucuaccacugagccauaccccagccacucacugggggagucuaggcaggggcucuaccacugagccacacacaucucagccccucacugggggagucuaggcaggugcuccuauacuaagccguacccaaccccucauuagguauuggugcaggugggaggaacucuagacaaguacuguacuuuggagccaccugcaacccccacgccucauuguaccuugcaguccacuucuuacauuuuacuuugagcaaagaucuuacuaagcuuuccaggcuggccaugaucauacucuguauauccgacuggucuugaacuugaagucuuucugcuuuagucuccagaguaaugggaacaacaggccugugucacuaggugggauuaauuuuguuuuagugguugugugaguguuggucauagauauuuaggaauaauuuaguccaggguugacaacacugagucacuuuauagguuaagggaugaucucaaucaggcucucugaaccauccuuacuuaccacccaggggcacugcagucaacuaaugcgcugacuuuaaagguuuacuuuuaucguauuuaggagggagagagggggagggggagugagagagagagagagagagagagagagagagagagagagagagagagagagagagagagugagugggugugugugcgugcgugcugugggugccugaggaagccagaaaggggcaccagacuuccuggauuugcaguuguucaaccuagguucuuggaauugcauucugguacucaaaaugagcaggcagucugugcuuuugacuguuuuugaucaucucugugaugaguggagcaaaggagagucagcuauuuuuuaccuugcccucacuuuuccuucuuguccuuguuccauaaagguggaacaagcuuuccaccuuuugugguggugaagcuccugggacuccugucaggcaggucugaugcuggcacaaugauccaggucacucugucuuuucccuugacagauaguuuuaccaggcaccugauaggugggcuguuuaaaguccugugcucaaauccucuucacacuugugugcuuccugacaggaagcugccucuugcguccgucugcuugcuuugugugugcucauggacgcaugauggucaguggacgaccauuuucacaagucaguucucuccuugcaacuugaugacacagggucucuggugugguuucuguagugauggcugguucucaggcuucugggugauuucccccauucuugccccccauuuccuaucacugugaauacaaacauuacaugugaauacaaacauuauaugugaauacaaacacugggauuacaaacauuaguccuccccuccuguguuuuuaccugaguucuaggggagugcauucugggcugaaaggcuugcagggcagccugcagaggcaccaugcuggcucuguccgggggugugggggggugucucuuuauaucaucauguuucucuaaggggucuuagucucugcuugcuaaaauguuuuuguuuuuuuuguuuuuuuuuaaacuucacaaauauauuagauguucacaaucugcagaauugcuucucaggauaaccauuuuuuguuuguuaguuuguuuguuuucugaaguaguucucaaugauucuucauuuggaauuuguguucugucuucuaugucauagcacuugcuaaauuucuuaacuguuaaaguuuuaaaaacaaguuaauuuucuuuuagucauucccuugagguuugauagcagcuuaccagccuguguuguuaugaggcaguaccccaugagggcuaggcuagccccaggauucagaucuagggaauauuucagcuccucauguuuguguggaaaguaucauaccagccacaccucaagucagauuuugucauguuggucuucacuuuucauguuuaauccuuggcugucaauucacuugucccugauggccacacugacaucuccacugugucagugguggcuuuacauuuccaggcuggcacugccccuuccuccucagcagcucauguuguuuuggugaauugagccuuugauggcugcacagugagccucuuugucuggugucccuccuccccagucucugguggcuagggguccguagaguaacauccagcucuggugaggccuuggccuucaguuuugucuuauucaauuuugguggguugccacucucccuggcugccugcaccgugcaucauuuauuuucuggaaauacucugcaguggacacuuguuuuucuuacacaguaugagcuucgucuuuuaaucagcguguuuaguuugucuucauugcuuauucuucccauuugaauuucuguguuccaauuuaguacuuuauauguaccacuuaaagauaucguggcgacaguuuccucccauuguuuugaauuuauuggaguuuccccucaggcccuccacuuucucccugcauaguuucuguugugcaguuaacuauaucuugaccccacuccugcugucuaaggauuuauuagacugguuuacacaauggucugggaaguauaguggcugccuuaacugaagagcugagggccuaauagcugugcagcagcccacagagcugagugucucaucagccucugccuggcccuggaagccuaggggauuccuggagagucacucuggaagccagaggaagcuggguucugauaccagugaaguagugcagcagccacaggguagaugaacuugccagugagucacaaaggcaagcuggcagagagccgagcucucuucugggaccuccuuuuaucugggcuacuacugggagggcagguguuuccacuucaagucaccucaagaacgucacccacaggucugucaacacuuuguccuucaguccauuugagaucaagccaugcugccaaccaagauuaaccaucacauaccucaaagcaacccugcuaucuuagugccauucccccuaaaucccgauuuaagguucucaguggcucuacuguauaacucacuagauugcacaguggugaaccgaguauggggaaggaugguuguuucuuuacccuccuugucagccuuugauucuccuuggcaggagggauggguguuuaaugagucaauugauucuucccucccuacaggacccaugccuucugcugguguguccgucuggacuuuucaugguaugugauuucagacuaguuaucucuagcucugggguuuugcauguaggcuuguggucacagacucucagcauucaacuuuuguggcuuuuccuaucuacccagcaucaaggcaggcacacauaugguagucauccucugugugaugguaacucuuguuggaaguuugaucccuguggauagggcuauucuacacagggccccucaucugauugccuugcugcucaggcaccgaaaucucuguucuuccccugcuagaguccugcuguauuccugaccuugggaguuuguggcuuugcagagguucucuugggcccagguucauucccuaccaauggcaccagccauggauauuauuggcugauugccucauguaguaacucaccguucccuuguguuaugguuggucuugggaucuguggacagugaggccccuggaauuugagaggccaauuccuugauuggguugagccgccagcccucacagagauggguggaggugcccuugaguugaugaccagugacagacuagaugcaccauggaaaggccucucuucugacccugcagguaagcuuucuuuaugccugaguuuguuuguaguucuagagaguuccagauggaaacgggccagacagagauaacagagaaaacccugacagaacugugcucuuggcucuggucaggccugucucugcugccccaagcacucacgggcagcuaugguuggucagaacggaagcuugugugggucacaaaagcaccagagcagugcuggcaccgucacccuccuacagaagugcauccagcaguaugauaacaugaccugucuuccuuucgggaaccucuuuccacuaguguggauguucaggguaugugccagguagagauagaauucuuccuuucccugguaccuaugcuccugaccuauuaggauucccucagaaugggcugcagagagaagccugggcccucuaaagaggauuugaagcucaggaucuugaagaguuccuuaaguggaggcaagugucagggcacaagcccagguggcagcgugaccagagcuggaagcaguggggccagaaugcuuggggaccuagggcaggggccacagacucucgcaucuauucagcuuucagagugggguacagcuagagccucugauagaaaugagccuguaaaagagggguuuuaggcaucuaccaggaacugauuuuguuguggacgcccccaugccuccagcucucauucaucugagggugaccagugaaugacucugagagacaugaugggagagugggcagggagcagggcugggaugcccagagcuggguggacuccagcucuuugugggcuguaggcucaugacuuaguuuuucuuaagaaagccguguggaguggcuacgaguugaguggaggaaccuagauaaggagaaaggccauggggcuugcgaaagaaccacaggagaugcccacagagagcagccaugcauacagcagccaugcauagaggcccucagaggcagaacuguggugagugggcggcccagugagucagcauuggcaggggaggcuggaaggggaugaggagaggagaagggaagggaggggaggggggaagcuaaggagggggaggggaggaggguaaggagggggagggggaagagacaugccugcaccaccuguaggcucuacuaucaggugcuucuguggggugggggacucugggucuagggagagaccccugugccaacauaaaaugccuccaacccaguucccuuuagugagggaggggagugacaaggguugccucgagcccucugucagcagccuuuccaauagccugagugggcuccagggcaucacauacaccugcuucucaggucacuuauauccauccaagcagggguguuugacacggagaaagcagcugugagagaauagaggauggcagugaugcccacacccacacagccagaaugauugccacuuggaggguguggccugaggccagaaccuccugcaaagggcuguauuugaauuuccaagaucaucaaagccauuuugccucuacacaguacaguauagucucuugaggcucagagaggcugauuauauucuucagguuacagagcaaaccgauguccugccaguguaggccuugugguguuuuugaccugagacagccugcaggcugguccucuaccccacauugacaccuccuucccacagugugcagaggcuggucaagaguuauuucuggacaaugagaagugggcuuuguaggcucaugcguuugaacauuugguccuguuugguggcacuguuuguagauguuguagaaccuuuaggaggugaagccuuucugaggauauaucacaggguacaaacuuugagaguguagagcuuugcccauuugcaguuugugcucuucuugguguuugcaguugaagaugcaauuguucaauuuucugcugcugugacugacccccuacccucacccccuauuaugccccucuggaaccuuaagccaaaacaaauccauucuuucauugaugcuuuuguaugugguguuccaucacagcaacagaaagaaacuaaccgcuuucuggcaaggcccucugggaacuauccacacugcccucuggcugggauauagacaggugagcuugcguacucugguuaccugugaccgccuacugucuuuuuagugcucuguccacuggucuguucuugcacucugccccaaggcccacugggcuguacuguuaugaccuccauugguuuaaguggggcuuucucuaugcaaauauggguuagugagcacacugguggaucaaagaugaaugacaggacuuccacgaauacaaugauaguuacauaggacucucuuggagcaugcaguuucugcccaggaguaagggauacccauguuggcuguugcuuguucugugauggucaucuauuuccccacccccacuccacucuggcugucugaguucauccuaaauguugucauggggaaaggacauugucaggagacucagguuccagaggcagugauuuggaguuccuggguccugagacaauuuauucuacacuuuugugccucaguuucucuucuagaaaacuacuaugaaccccuggccucagaauuuuauuuuuuacuaguuuuuugugcagcacuuucucuccccacugccccaagauuaaaacauugaccuguagaggaaggggaggaggcucagguaggacgugggguugagucuuggguugugacuaaugaaacucagaagacacauggcucacgaaccccuuucugguguuauguaagcaggaagcguuuucuggagagaggagacucauugguggagcugccugcaagcugggcagagaguucuaaggauguacucuguggggucaucuguaugcuugggugagguuuuuuggugaugcagcugcuuccccccccccccccgcccucaggcuaucuaugcuucuuuaaaagaacccacuaaacuuacuauuuagcuccuguaaacuaaacccaccacucuggacauggauggaguccuuucuuuggguuuguuguugcuuucucuagcuaggagugaauugaaaauguuaaugcaacauagcuguaguuauucucccucccuucucucuuuucccucccucccucuccccccccacccccgccuguauaaauacacaggugccuguguguauauguuuguguaggggcucauguaggucaggugagagcuuaaucccuccugugggucccaggaauaaaauugagauccucagauuuagcagcaaauguuaccaucgagcuaucuuggcagcccucaccuugcuuucuuuuuuagacagagccugucacugagaccuguagcucauuaaugugucuagucuggccagcccugggguugccaccucaccaguguuaauauaacaagcaaguuccaucacacuuggcuuuuuacaugagugcugggcccacauagauaacuuagguccuuauccuugcacagcaaacacuuacccacugagccauugcuccagccugucuacauuacaucauaccaacagguauuuuacucugaugucaccaccauugaugucugauggccacuggccucucugcccaagcagcugaccaucccucuaauugucucaggugguuucgaggucuccaucuucaguugauggcuuucucugugcgacugucugcagcacucucuccucgccauuaauuauguggugagcaaauuugauugcuuucaaacaggauuguucuguacccgaggagaagcauucaguggaaaauaccauuuuguuugguacuuggcaagcaggucuuuagggcucugugggugccaccuaggcgccuguuggugcugcagaaucgccugugccugcucaaguggagcugaggcaggaguggcacugcucauuaaagagccguuacccaguugcaccacacagcacccucgcugugauggccauuccuugaaaagauacaaacagcaaacuucuccaguucuauuuuucuucugugccagccuggagacacagagaagcccagagaaaggcagcaguggggagauuuaccgaucaauaaaagagacaauuacaguuuguugaugaaaggaaaucccccgcccggccucucguggcaucgacacucugcuaaugauaacuuggguaaccagcucgagacgauaaaagucaaugggaugauauaggauuucaauaaaguuauggcacuucauaaaccuucccguggaaacagaucgcccccagaccggugaccaguuccagcuggauuugguacuuuaauuucucacuuauugaauuuuuuggcacucacuaauuaugaauucuaugccagggugguaacuguguccccagcuugggagggaagagaucuccaaugaggcuuuggaggcccacaggcuaagggggagaggugggaggguguucucugcaccccagcaucccaauccacuuaaauagagggguuuaagaauaagcaguauugccgggcggugguggcgcaugccuuuaaucccagcacuugggaggcagaggcagguggauuucugaguucaaggccagccuggucuacaaagugagugccaggacggccagagcuacaaagagaaacccugucucgaaaaaacaaacaaaaaaaggaauaggcaguauuggugcugaggguggcuaagucuugagucagggccuuagccucaugggaaaguccuugguggcuauggguguugcuccuggugcccauguagucuaaaaaaaccagucuauggaagucauucuuuuccccacugagccucucccaggguggacagaccaugcaggucacaugggagggaguguguugugcuggccacccugaucuuuuccugagugugugauuugggaagggaugugcugcaacacauaggagacacauccuggccauugugccgggacagcauuugccaaugguaauaaaaauccuaauguuuucaugaguaaugguugucagcacgauagcucacuggacacuuuguccacagcaauauugauccacacagcugcccuugugaccacuuucuugcugagggaggcuuugagaccuggggugacuagauagcuggcuucagagcagagcuggaguuggaacugucccuuucuuccugagcugugcuguccccagcaucuucacugauggcuacaugaaugggcaaagcuuaagcagaaggcacccagcucaucagcucgucagcacauguacuucaggauccaguuagaggccagagcugggcuugcccacaccugcgggaugaagagccgcucacuuuccccaaggcgaggcugguuccugacacgccuggacuuccaaggaggauuugccacccucgcuugugcacuccauggaacucucagaaggugacaucaggucgaggggagucgccagccugugccugggauuuuggggcugggucuccuuucccuaggaguaauaucuaugucuaaaggagccuaauggcccuguagguuuuucuuuuguuuuguuuuuuuguuuguuuguuuguuuuuugacauacuuaagaaacaugggcaaagagaaugcagugagcaccccuggggaagauagucucccuaacaaugcuguacccuauauguggcccucacagcaucuuggcuccccacacagggcagguugcaugucuacagggccccuugcuggcaggguggaaggcguuccucuucagcuccugugaccccucucuaacaucuuagagaacuuggucccagucucugcagcaucucuccacugcuagcuuucugguucaggcugucaaccuuaggaucucuagugugcacagacuagcugaggagcguuagccacaacuccagcugucacucauacucuguguggaauauggcuggauaggcugguggccuccuacgucugugauucgcuguggaugugaggugcucgcugaagccacagcuguuucuggagccucaguguccaggcauuaggacagggucaaggauucugagucugcucaggaaggguugggccuuagcccccagcuuuguguucuugcucuggguggcacucgucagaacucacaccaaguuggugucuucccuggcaugguugaagugaguacuguuggcagggcucacucacccaguaaaacugagucuggagcucugcaggccuagaccucuggugcaggcucucuggagguaugcaccucuggcagauggaagcaugccagaguccugagcuuuuugagcaugugcagggacucuaaagcucacaucucugaugcuuccaagccaccucacacacuguccccacccugaccugaccaucuugucuauaggagagagauggcaugcgugccauccugggauccuacgacagugagcugacccaaacugaguacucaacccagcugacacagcgccugugggaggccgaggacaugguucagaagguacaugcccacagcucggagauggagguaggugugugccaugggcaaguggaggcuauggugugugugggaggagggcagccaaggggguuauuuugguaugugcucuacuuuacuucuuauauagcacuuggugguuagaggguuccaggcaaccccagccagcagaggugggugucaaggcacuucaaggcaaggcaaggcuucugccagguuguugccaggugccuugaagacagucugugcuguguaaccauguggucccugcggcagccugcuuccucuugcugcagguuccugugguguuccugucuagaggauggcacaguguuuuccaagcaguuuguggcuucuuguucucucugucaucugcaguauugugagcccccugugaagucucauguagcuuuguggagugaagguagagaaaauguuccacuuuaaagaagagaguaacucucaguguggacugcacuuggucucuccuucccggcuggcuuguaccagggcagagcuccugcaugcuaaaugcugcucucccuccagcagagauagagguuugcuuaauucucuggagaggcugcgugaccguacaagaugaggugagagccugccugucaggagaaccacacagccacauccccagaugccgccugcgcugcucuuuacccacuuuccaguuguaucucucagcuugacucuggcugugaccuuagaagcaggauugucgaucccuuuagcuccuuggguacuuucucuagcuccaauggaggagcuagagaaaguacccaaggagcuaaagggaucugcaacccuauagguggaacaacauuaugaacuaaccaguacccuggagcucuugacucuagcugcauauguaucaaaagauggucuagucggccaucacuggaaagagaggcccauuggacaugcaaacuuuauaugccccaguacaggggaacgccagggccaaaaagggggaguggguggguaggggagugggggugggugggugugggggacuuuugguauagcauuggaaauguaaaugagcuaaauaccuaauaaaaaauggaaaaaaaaaaaagaacuggcacacacaagacucagaauucacucuuugucagucaacgauaauaaauauauaaacauaaaaucagaaaacuauaaggccuuaugguugauaaaauaacuaauauuauugcuguuaaaaaaaaagaaaaaaaaaagaagcaggauugucauuguccgcauuucagugacaagaaaacugaaacccgaagacccaggacugaaccuaagccuccaggcaccuauguacaaacauaggacugcccuguagcauggccaaccugcagagcauccuaggcaaggccuuugucacacucugugccaucagcuuuuuugguuuugauugucacaucuauuuggcuuguccuugaccuuggugugaugcagacugccagagaggugcugcgagggccagucauucugugcagacaacucgacccucacccagcuagugcucuugguuguccacuuggagaagugucuaaaggaacagccagggugacagcauggcuauauguucuuuccagagagcacuggaguccacacugagcagggcccuuuccuaggcuagcaacagagccuuuggugagggggauguuuaguagacagcugugagcuagccugguggcacaggccuguaguccaccagggaauggggaggcugaggcaugaagaugcaaaguucaguacacccugggcuauagagugaguuuaaggcuagucugagcaacuuaaugucuguccuaaguaaaaagaagguggaggauacagcuuaacuaggggcaggggugugacucagugguagaucaccugccuagagucccccagugaggggcuggaaguguggcucagugguagagcacuuacuaacuuuuaugaguucuuauauuaaauucuuaguuauugaaaaacaaacaaacaaacaaacaaacaaguaaauauauaaaucaaacccaugauaacuacaaagugcaguagcauuuuaggugugggaucccaugaggaagcaaucagaaaugcaugacacugcuguaaccuaucugggaaagucaggaagcaccuuuggauucacagcucagaggacagcuauaggucucacuggggcaagacuggggcaugacuagagugggagcugcugagcuucagcucuggcgauggcuuguggcaaggcugugccauaugaagaggccacaauccaggcuggcugcuuguucuuucugcccaugagauucucaccaggcacauugggccuaugcugucccugcacggaggagaaucccucacugacacucuuggcagaauaaagcaagucacacgaguuguggaaccugccuggguccugcgcuuaucuccccacuccacucucuggcugcacacuuguuccaaugucucacagguggccaguagccaggagugcaauccacuggggcugcugugagcugccacaacccagcucuccagccucaucugaaagguuaacugggguucuagugagcugugccaucaucaauguaaguguguuaauaguuguuuuauuacagcacauuuagcuccaugagaaacgccaacgaggagagauuugugggucugcucucugacaccuugcagcucccugguauuuucucacugagagaucucaucugugcugccauaugcauuccacauagguccuuaggaagaugaucgucagggcacagccaauguuuugugucaagugaccaguguugucaggauucagcuccagcagauauaugcucccugucagcaucucgcugucacccugcucauggguauaugucaagcacccuaccuuucccugcaggauguaagguuggcagguucuuccuccuguuuugugucccaggguuaugggaaagccaguuggaggcucagcuggguggagcaaggugcucuugcuauuucauagucaucgucacugugaguguucaucaguuuaguccagaugagggagggugaggagccccccuccccaacauacacaccuuggagauuccuguuacaguugguccuccuaugcaugggcacucuggccucuugaagcaggcuggcccucagugaccuuccuccuuugggccuaggugugcugguaucauggcuguggugaguuaggcuccugugagcagagcccuaguggcuuuucuccucagccuguggcucugcuauuuaugcuggguaugcaaccuuugcugucuagaguggccauguauucagacacuugccgcauuuucacaggagucacugagagacaguugugcccagucaaucacagaauucccuguccccacuagaguccuccucauacuguagggcccuugaggagcacaaggucuggcagauccagcccuuugaggauggaauaguagcuggauuuagcagucuagaggaggaagccaaccaggggguccuaauucacuggaguggggaaccauacaccuucugccuccaccagguggcagcagacaggcucacugcuuucugggccucaccacuggccugguggggguuaggucagaugcaggaaaggauggccuggaggagggaauaauggggaccugggcacauauugaucagaggcaaggagcaggcaggugugagagucccacagcugaguggucuguuguggagggaguuuggaaggaccuuagcuuuggccaaggcuggccuuggcuuucgacuucccagcuaucuuggagcuuggauuuaggagguuacucccucccucagcacgacuccuuuccauucuguuaccugcucuguagaguccaguguacagcuggguuuccugugagucuccauuuagugagaagggagaugggcaaacagucuuacuuugucguagaaggcaagcuauacauaggccaaaggaagaagaaguugccucuggacaggcagaugugggcuccuggggccuuggugagucaggagggguauguccugagucaguucuggggauuuaaggugacuuaugaggaugacugguaggaaagaucccugccacagugagccaggaagcuguuccuacagaagccauacagcuugcuguuuaaagcccagacccuggucaucaccagccccugaauguuguacaaccacuuuaagcuuaucuccagcuagcuuaugaauaaaugagacucggacuaugguuauuuuauuuggcuuugacaguuacugggggucacccuaauuuacucuucuaacugcuggccuggcuaccucucuagugggauaccccagauacuugcuguuucuccugacuacgccauggccccaucuccucuuaugguggcuuccucuucuccucuuauucuucuuccuuuuccuccuggccucuucucacaccucucucuucuccacccccaacaagggaacuccaaaccuaccuacuagaaguuccuccaguaauuguccauagccaaucuuauuuaaccaauuguuuuaaaucaaggaacaagguuugcacagcaaaagcuuguaaacaugagaauauccucguaggccuagaccuuuggguacagaguuucucauuacaguacaaaacaacagaccaaacgccgggcaugguggcacacgccuuuaaucccagcacucgugagguagaggcaggcggauuucugaguucgaggccagccuggucuacaaagugaguuccaggacagccagggauauauagagaaacccugucucgaaaaaccaaauaaauaaacaaacaaacaaacaaacaacagaccaaacuccaacaacuguguacuucacaugaagaccuauggccuugcugucaucuccagccccuacccuuuugaggagagcacuacugggccaagacagccacagcuugguucuaucucauucugagguccagcagguacacucuacccaucuaaggcuacucuguuagucaagauggcacgcaucaccugccacuucugagugcccggcuuguagacacauccugcagccagcacagccuuagugagaaucucuccagguuccugggcacagggcuaaguggugaguggucccaggcaaaccuucccaucucuuguuuuuuucacucaugagcauguugccauccccgguagguacauucuagagaccucacucauugcccaggggucugagaaauacacccauagagggcuuagcaccuccuggguacugaaugcccagagaguggcugagagaagguugggccuuugucuugccacagguguguuccuaggccaaggggccagccacugguccugcuguagguggcggagcuacagcuacagaugguagcuuuccauugccuuccuggauagugaaguucauauaccagaugcuugcaaauggcucauaccuagagagcuuuaaaagucuugucgggaguuuauuagcugagcugcuuguauugacacaguaaaaaguuacauaacuucguggaacuccuuucuuaaaggucccuuagugccuuacagcuggguaagcaucgcucaggccugggaggcaagugguucuuccagggaaguuacauagcaagaaauggagagggagcccccacauugccuguguuguucagaucugaguugagaaggugaagaggugugagccaguguagggucugacugcaaauccccgcuuaggaaacaggccaagaaggaggguuccuaggaaagaggaagaacacugcuggacaugugcugauucaagguuucuccuggguguguggcaccaucucucugcuuucuuugucucuccaccccuuaaccuuuuuccuuucuacuucugccccuagucuucccuucucuuugccuguccucucuuucuguguguugucaugugcaugcauagguauacaugccaguacucauacauuuggcggucaaguggacauuggggcuuucuucucaccauaacccggagcuuagauuuggcuagauuggcuggccagugagcucaugggguucuucucgccccaccuccccacacugugauuuaagaugugcauugccaaacuuggccuucuccaugggcacuggggcugggaacucaggucuucauuccugugcagcaggcgcuuuacccucuggucucuuuuucuuucugauggcuuuucucaguugccuuucuuuacccacccucaccccaagcuccuguuuucucuggggucaacaggcacuuccauggauuccugugcacuggguguagcuuucccaugguugaccaaggagggaaugcucguugugugggaaggcaggugugccagccucagggcugccuugggcaggcaggcaggcagccacugccguccuccucucggcacagcccuggcccaggcuaacauccgucaucaguuccagcauggggcaugcuuugauuccagcaaaaucauuuucagcaaaacaaacuagaaauggagagcuggagacucccaguagccuaucuccaguggggcugcugccauuuugcccggauuuuauuuauuccauuuaauaaagcggcugcggagguuggaagcagaugucacgaguccucugucgauagagccauaaauacaaguguguggcacuuggaugccacgagucaccugaguuguguuuccagcauauuuaauuaaaacagauuacagcacgaccagcuacaugaagacuucuucccaaacacgcuggcgugcugcucuccagugagaagacuacacugugggagagacacaggacagaagcuccagagaguugagagagguagaugcaggaggaugcagggagcgauuggaggaugcauaugccagguaauugcucugcacugcacuauaguuccagcucacugggcccauuacauagauggaagacaaguacccuaagaggugaggucagagguuaagaucagccuuuguggaggucaccuaggugauaggcagccauugggauccuggccgcaugccggaagguugauuacccacagccgcaguucccagaucugagcucugucagcaucccugcgggauuaguggggacacuuauaggccaggauccucugccacuggcuaugggcuagagcugggaaccuccuguuucuaguuaaguggucucuguggagucacuaacccugaagagugugauggagcaggcuggggucauuugucuucucuacuccagcagagcccacuccugccuaugaugcuuuccacccccauagcccauaccucaguuugcagcuuugaauggcuaagcaugcuggcugccugcucaggggcuggcuuguucuauagcccccagaagcucuugcauccaugucuauacucacaccccaagggaaagccuagcacuuaagacccagccucuucaguuaaugugaccuuggguggaccccugucugcuuggguccaagugaggccgauggccuacucucuggguuuucccagccaaggccauacugugccaugguauugcaaaacguacaccaagccccugcuugggauggucugucccagccugucucuaccugcagguuuuccugcuuacuccgagcugucugugugccugcaggggugcuagaucaucaggcugccacuucucacuucaggauaaaaauagcccugcagaggcuucugugcuggauguaaugucacagguggcacacguccagggcuucugucugaacacacacaucuccagggguuggcuggaguagcaaaugugcacuagcccaccugccaccuuggccacaccugagaccaaggacaucugugcuguccucaugcuguugucugccuugccagagccugagcggggacugcuuuugguaccauuucuggagcaggcugccagccugucgucccugugcguagccucaaagccaggcucuguguccuuugugguaguaguaucuugggcagggcagauagcuggugccaugugaacagagggaugagaggugacugccuguguuagcugauggcugugggcagaugagggacagcugguggacugaggugccaugcugcuguuuuccugcauaaaggcugcuggucccucuuuagaagucuugggagaaagcaggagcauaugggcccugaugucaccgcaaagggcaggacacuuacugucaugccaugagauaauuccucagucuagguuccaguaauguggaccccugcacugcccaucucccacugcugggcauuauaccucauccuccgccuucagcucuguauuguaucucccagugaggccugguccaucaccuccacugucuaacuuuuguggcugaggcagcauuuucuggaggcucugugcucaagcugcagauagucccuucugagaacaguaugaugaucauggccaaccaucucuuuuacaccaggaccucagaggggcccugcuuucuagaugaggauguggugacugagaugucuuguucucccaacaucuuucuacaacaguacuauugcuaaccaugcuuggcugauccaagagaugagacccuucuggagugaguguuucccaguggucuuccggggacucuccugcugcagguguggaugggggcugguggagcugcaguggaagccagccccccuuuuaucuauagaugugguggucauacagcgcagguugucacuuaccacccuucuuucuuucuuucuuucuuucuuucuuuauuuauuuauuuauuuauuuauuuauuuauuauauguaaguacacuguagcugucuucagacacaccagaagagggcaucagauuucguuauggaugguugugagccaccaugugguugcugggauuugaacucaggaccuuuggaagagcagucggcgcucuuaaccucugagccaucucaccagcccacuuaccacccuucuuauuuauuuaaauuuaaaaaaaaauuuauuuuaugcacauaaguacacuauagcuguauucagacauaccagaagagggcaucagaucccauuacagaugguugugagccaccaugugguugcugggaauugaacucaggaccucuggaagagcagucagugcucugagccaucucuccagcccacuuaccauccuucuauggccaaggcuacagccaaaggcgcugaaguaagagugugugucugugugugugugugucccugugucugcaugugcucaaaugugcaugugugcaugcgugcugaugucaguggacagccgaaggugucaaucuuugccuucuacuuuucugaggcaggggcuugcauuccuguguaaacccagcuagcuguccagagagcuuucagagagucuacugucucugccuucuuucucaacacaggagcaugggauuuacagaugugugcuaccaugcgugucuagcuuuuacauggacuuuugggauuuaagcucagauucucggucacaggaaaagugcuuucucugcugagccaucuucucagcccagaagugccuuucucaguccuuugagcacauaucugggguugauaugcagacauuaaauccuaaggugaagccaggucugaacuccuucagucacugccacugucaccgucacugagacuugcuuaauucccauccuuucccuucagugccccagcacuuccugggcucugccagcccugucuuugcagagugguuucgcuguugguccugauuugcauuuggcuaauugcuaaccauguuaauuaccuuucuguguguuugccgccugugugcguuuccuuuuugggagaugucuguuugccucuucgcccgcuccucugucacacuguuuaucuuuuuccucacugcuuuguagcagauccauguguguccuugaagccagucagguggaggggauaucagucucugaccuccguccccuccucuaaagcaaugagagugguguguuugggagauauugugcgcccugguaauguaugugugggccuuacaguucuuccaguuuugagagucucagguuggaccuggguucaaauccugccaagcuugcugaccagccacucacugaauuauacaugguguuugacuucaggacccauuuuccuaagaaaagcucuucuagaggaggacaugguaugccaggagaauauccguaggcacugagaaccucugaugucugcagggcacuucagccugugguaguccccagaggaagaggggaucacaguccccagaucacaguagauggagaggaagaaggaguccguuuccuguugcagagccgacaguggagcgacuguugcucuggucugggcaguacccuuccugcucagugagggugauacauccuugcuguguaggugcuuagugcacaguggaaugcauuuauagauggcucacagcagccuaccgguggucaggauggauuucuacaagcaucuuggccaugcugcuuacugucugccagggaguugucuagcagggccugugagaaccacaguguauucgguaagugaggagugugugccauucuagagggggccaugcugugagcacaagagaacagggucuguggcauccuggagccaaggucuaugcucuuugaccuuugaucuucuguacugaaacugagucugugccugcagccuccaguagccugcuuuuucauggggaugcugaagcagagguugggaagccucaggaaggccauccuucucuggguguugagcccugguguggggcucuggguacucuuggucaguugacccuuuuguuaaccuuucucagcugaggauagcaggccagguuuucccugcuccuccacaguuuguccaaugcuggagagcccuaguguucugggccuguccuaugucagcaggaccaccucaguuggugauuccagagugggaaacuaggaugcaagauucagcuggcugacuuccuccucgcccuaacuugccccaguguuggaccacacagcagggauaguaugaucagaauuuuauuuaaccuagggccuacuaggguggccugacagacccagggggaguggaggcccuguaccccaaggcugacaggcaucuccucucaacucuaaccuucuuggucuugucuuguaggcucagcugucucaggcccuggaggagcuugggguucagaagcagagagcugacacggugaguacugaggugggggucacuuggugcuguguggugaagggcagccugagggcagaccaccuugaguccuggauccagacaaagggaaguccugccuuccuccaguaggacuuggccuucaggcauacgcuccuguguggccaugguguuuccccgauauuauuagaguggaggggucugagguggaaacugaguccuggugcccaccccuuugugauaccaaggugugagcccagugggagucuugggagccauuugggagccuauggcuaagggcuugggucaggccaggucagccuaaacaacauaggugugugagcacuuaggguacaggucagauaacacagguaggguuucccucugggacucggagaaugcggauuagaauucacaagugggauuggcuugcagcgaaugugaggguucugggucagggcugagauucugaucuagaggugggagagaacuucauggaauauagaaucauggaagguugugcaugcugggguuguccauugcccauuaccaaguguguugucauuagcaugggagucagacugugcccaagcagaggcuaagcaacaaggugucagucagcugguaacugacaguuaaggcagcguggaggagggaaaggugccuggggcuguggucagaggaggcaggccaggcaggccuguggccuagaauguggggagcacggagggaaugauuuuguagauugugggauguuaacgucccacagugaauguggaagagucuguggacuguggagcauggugucugucagugggcauugugaguuucuuuaacuuugccacguugucagguaugguaugaccugguuuuacccaggcaguguugguugugggcuggcuagagugguagcccucuucucuccacacauggccucuugggcuuugucccugugauuccaaguguuucagcuuccuuuagcaguggccugucugccgcugccauuggggaagccacgugcagggagugggggguuuugugagcugagugucagucuguacagcuuggggagacccugaugcucugcgcguugacaugcauggcuuccucagugucgaccugaauuggauguaccccagggccuuguuuucauaauguauacaaggccaaguagaauuagaaaugaguuguacuaagcacaugccaggccuagggcucuguggcuaagcaacuugccgucacccagggugcacuuugcacaggagcauggcugccuggcucugcucaugcuucccauggcacuguggaggaacugugagccuuguguuuguuuuagggguagguacagaagcuguucucgggcccuuagugcuagguagcuccuaagcuuagugaggcauagggcucacagcuuccacagcuuggugugggaauauagggugcaccaaguggcggagugcagaagccuaagcugguucucucaucuugugucccuggaaagcaguaguggcuggacccccacagagacugacuuagaauuccagggccuuggcagggugggauucaaccuguguugcuuuggucucaaugagcuuagccuucuaccccugccucaguuuuguuuuuaauauuuguuuguaugugcauuguaugugugugggagagaaagagggaggauuguggcguguagaagucagagggcguaaguccuuuccuuacaccuuguuugagacagugucucauugccacuguaugcccagcuagcuauccuaugagguugucuccaccccucacucucuguaaaaaggcuaggauuauagacacuugcuacuaccuccugcuuuauuggguucuggggaucaaacucagguccucuggcuuguaguucaagugcuuuucucccugcucuaucuugcuagcuccagugcuagcucugccugcuugcagaggcucugguuuuaggggacuugggagccauccuugugcuugguaguuuucuauccaucagccugacacaagcuagaguuauuagagaggagagagccuuagcauucccagcccauuuugaguggggccaucccuggccuggugguccugaguucuauaagaaagcaagccauggggagcaagccaguaagcagcacccuccauggccucugcaucagcuccugccuccagguuccugcccugcuugaggcccugcuuuugagaggaacucucauggaaccaugagugcaauaaaaccuuuucuccuagaggcuauguuguuucaucacagcgguaguaacccaaacaagguaauggccaaugcaggacucuaguuugcuuuugacccuugagagcagagcagaugccacaggcucuaagauacccaaucucugaugcugcugaauaggaugcaggcccuuggggcagcguuccuucauguuuguuuaggguuccauuuggaacugucuccucugcccaguuucugaucucugccuuugauugccuaaucucaggucacuucacaguguuuauuucucuuucuucuccuucccacuuaagaggaaaauaagaaguggcagugcuuggguaccuaugacacagcugguguuugucucccagccuccauccuucccacuggugcuggaggcuucagggccaucuuugccagcagaguaagcccuaccccggccucaggcaaggccuugaggaggagcagcaauggggccuggcagaugcauguucauguccgacuaucacugaccuuugaagcuuggcugccccagaugccucaccugccuccuggucacacugggcuuggugaggggagguuucuucagagcagccgaccugaguaucaggaccaacauucuguggaacaguguauuaaaugaguuacaugccuagccuuaccacaugucaggaguccuguugaguuuggggggguuauuuuaagaagcuguguguaacaguggcucccauguggucaccugagucauuggcuggcagaaacuauccucucugaaaacccuuuccacccucuuugcccucacagcugcaucugcugcugacacuacauuucucuccuccguuuuauuacuacuuacuuuguguuucuuugugucuguaaguacguauuugagugcaugugagccugugugaguguacacaugugugccugcaugugagaucaggcccucccccuacugucugagacagguucucucauugccuggaguguuggcaccuaggcuaggcuaccuuguacaugagccuccagggaucugacucucuccaccucccaucuccccacugcugggauucugaacaugcgccaccacaccuggcucucagagugccggaaucaaggucuuccuugcuguaaaucgaguguuucauugauugaaccuucaucucagcccuggcucuggcauuuugacuaagggucaagucuguagcccaggcugcuggccucaaacucaugauuccccuagcucagccucccaggcgcucagauuagagacauacccaccacaacugccuccuuuucuaggcuuaaacuugcaucuccagccuccuccuguguuguaagucccggacccucugcaggaccugagaugcagcugauguugccauucagugucccgaggaggccuguagaaggaagguuuccaguaggguuucccagggguuugcugaggccagcggagccucuuuguuguccugcuuuaccuucagccugugguagcccccuccccucugaucagcugugcaugggcacaggguccacccuccacgugacccuccccgccgcccccuuacugagguuccaagugaauugcuugugaaaugcccuugcucuuuuucuaauggagaagaaccagggagcaaguacacccuggaccuggcagugaggcugcuuccaaguccucucucugccuuccugaggcuguaugcuguaaagaaagggccagcugaaccagcuggcccugagaaggaggcucauguuaccugcauguagagcaaucacacaaguguccagcauuaacagggacauggcccgaguacuugccugaucccugcagcaucuagccuucugcccgcuggaaucugacuccaagcuuguucacgaguaguagaaggggagcugugccauauugagcuaaucgcuaauggcaggacaaaggcaguuugacuuuguguuauuaauuaguaaccucacacuaauuagugagcaugagugugguugugcuuccucuuuaaaugcaauuaauaccacaaggaacaacgucccgggccaggcuuacgucguuagcauaccucacccuaauuagauccggccagcaguggcuagagaaaugagguuuuugauuacaaccauaaaaggccuccaauauuuuauagacuucagggagcuagaaauguggauuuauuuucagucuuaacaggcaugcugcucccccccccccccccaauccaguguaauuaagcagucauuucucuugauuaccauuuuccccuaauggcuccuccuuacccucugugccguauucccaguggagcuuguggaucaggagagggguucugcccccaaagaggcugugguugggucagacuggagcuugcacucaccacucuucuacgcuccaucucugagagcaacugcaaauagugccucucucuguagccggaccgaaaggagcacaucacaggcauaugcucggugugaugaauugguaacaggggcugguacguaguagagcugucgccuaagcaggcacaaggccuuggguucuguccccagcacugcauggcaugcauuggcacaugcgcagaaucugggcauuauggaggugaaagggggaagauuagaaguucagugucauccucagcuucaucauaagcucaggcccagcgugugugagugagugugugugugcgcacacauaugcuggagagguugcuuagugguuaagagccccuguugcuuuuacagaggaccugggguucaguucccagcaucugcaagucagcucacagucaucuauaacacaaguuccaagggauccgauacugucuucuauuuuccacagacacuggggacauguggcacacaugcauccauguaagcaaaauacacauaaaaauaacuaaaucgggggcugcagagauggcucagugguuaagagcacugacugcucuuccaaagguccugaguucaauucccagcaaccacauggugacucacaaccauccguaaugagaucugacgcccucuucuggagugucugaaggcagcuacaguguacuuacauauaauaaauaaauaaaucuuuuuaaaaaaaaacuaaaucuuuuugucugcuuucuuugagacaaggucucucuauguaucccuggcugccugcuguccuacucacucuguagauccaucugccucaggcuccugagugcuggaauuaaaggcacaugcacccacccccaauuuaaagagcauguggaauccucuggaacaggaguuaacagguaguugugagccugggugcugggaacuaaacccugguccucugcaagaguagccaucccucugccucuuagccaucccuaaauuuaaauaaaagaaaagucccagcaguacagguccugugguugcauauggagaaagacauggauucugaggacuguguacagugugugguccccagcaugugugcauggucucuuagagcuuuggcugcucauuggaguuguucugagucacguggaugucacagaagugaguacuagggaccauagucuugugugcucuucgcacaugucugguccccucacaguacaugaccugcuauugggugacuccucuuggguccuccacaguacugguggaggggcuucugccuaucucccaaucugaguauguucuucuguuccuaggcguggcaugcagacugcguauguaccacagugugcaagcauauccuugaacacuuguuucccugugcugagggaauaggaaggcucccuggcaguacauuugggcugaucuuggugcaaauacaaaagcaagcagcaccaggcaucuuaagcaguagaugcuguagaucucagaggccaagagcccaguggccaauuaggugucuggggaagcuguuuccugguuuccaauccagcauugcagacugguggccugagagagcucuccgagggaacuggccccauugaggcucuaguugguccuuccucauacugccacccugagggaauauuucaucacauggacuuggagaacaccuucugcuuuacauggucaacucaguguucacaaccccgcuuucuaucugaaugucuuccccuagucccucuguaccugcaugaggguucaccugcacaugcccaccagaaggaacagaagccccacuaaaguauguuggcacuccccacuguccagucggcagaagcuauucacauugcuucuagaccuccacuccaccucucuucuuugcaucuaagaugcuggacccucaagccugaccucuggggcuucuaaagugaagcuccacagacucaguauaugcccugccacuugccucccagugauugaccauccaacccgucccuuguggguucagccagccugcucugcagcagccuacucccugagcugccuaccuauagagucuccagaaugcucuucccuguauuuggagggaugagcuggcugccuugcauagaaacuaaaagcuggccucucuggaugugucccauguaggagacccauugcauucagcagcaaguugccugguagcuagcacugguuauguagccucauguaccccaugucucucuccaggcugaaaugaaagugcagggagaguucagcuuaagacaccucucucccuuuaccaagaaguagcaucucagguacuuccccagguuccagugggcuuagagcuaagcugaauaguggccuccauucagacuuccuauugcugucucagaguuaccucuuagagacaugagacaucugccuggagugggcuuuggagagauggugacagccugagagcccuccagagcccugggccugguaccauccuaccaucuguguacuuggcccaguuggagacugguauguaucaagcauugaaugaugagacuacucaggcauagguauauggaugagcaugcucacacuggugcccagcaacagcuuuauuaauuggaaccgcuggcaggaagggcaaggugccgaaccacucaaaccacagugcaccguucccaaugggagguugugucuugcugagaaggcagccacagcauccuuagaauggaaucacaaugaugcuuuagggcaaagaggaaagcugguggagucuauagauaagagacacaggaggaggagcucagggcugggcugcacagggccagugaguaccugugggcaguuuucuuggaagggcaucccugguucugcuucagauuagauuugugcuuucuugagcugucagagagcucuggucuugaaguguuggggcuccucuugcuggggggggggugucagccacccuccuuuuuccugcuaucucuagcagacagucuccugcaguucugagggauauucaucucaaucacacgugagaggucaccucucuaaacacgaucaaaaucugcugcugugagagccacuccauugaguugccucuagccagacuagucagaaagaugaagcccaaauaccagggaugacagaagcggcuguuauuucuucucugccuuuucuucuuaauuggcaagcauacuacaaguggagcugcauccccagaccccucacccaacuuuaagcugugucuucugcuguaugaguucuucauguauucugcauacucaacuacuaucagagcucugccucagcaaagcuauagcucacccagcagacuguucccacuccuguauucuuagcauucagagcugugcugugacaaggcccuuggcaucuccuuuuguugcugcacucuguuggcacagcuuagacacuguugccugauccaaagcuaggaagguucaguccuggguucucacccauaugucuuuuauuucaucuuccuuugccuguaucuuccuuccgucucauguuuugauucugauccacuuugaguugguuuuuauuguggcaugaguuagggcucaaacccuguuccugugugcgcauauccacuugucucaauccugcccccuucugagacuccucuucuaccugguagucauggccaccucauugaaaaccagcuggcugugccaguuuguguucagugcugaacucaguuccaguuccgccuguggguccuuccuuaugccaccaccuaaguucuugucuuucuuauccuuugcucuuagguugauaugagcauucugccuguguguccccacccucauaaugcauuguuuagaucuugguugucaucaucacaggauguggacucaccuaggagacauaccucuguguacaucugagcggguuucuagauuggguuagcucagguaggaagaccauccaagugugcacagcacacucccuaggcugaggucuuggacugaaugaagaggaggaagugagcugagcccagcacccaccccuuuguguuaugccuguggcugcagugugagcaaccuccucacacuccuguguguuccuaccaccacccagcacccccaccccugccugccaugccuucuccaccguggugggugggcugcacccucagacugugagcugggguaaacccuuccuucggcugcuuucugucagguguuuuguugcagcauggagaaaaacaaccacugcaccccaucaagaucaucuugacuauucagagcaccuugcaauuccaugggaauuuuagcauaagcauggggggugggguggggggaaaaccaguuuugcaagaaagcccuuugaaguuguuggguuuugcugugcugaggaauccaacccaguucugagcgugcacucuccugagccacaccuccagccaguguucacaguuuucauagagcugcaucuauucuguugaccacuuuggagguuugacccagccaccagggacccaagcaucaucugcaccaaggcuuccuauaccaggcuggcucaagcuuagacuccaagaauuccacagacgcagcauucaccccacuucuugcggcuuccuacuguuucguguccacaccuuccaggccugaccuggcccaagcagagacgccagagucuuugcuucaacccagcuguuagagcagggaggcugcuggugucccuucuccacucugagucagagauugcaggaacuguccucagcauguguuaccucuggagaauggccuggcggugggcgugucagcuucugcagagcggaagucauuugcauuuacucuccuucagccucugcccaccugugucaaucagagcagacccugacagaaagaaguuagggcccugggacaaaggaggagugcaguguguguccuugucugugugaucagggcacagcaacaugaaguguauuaaugcuuagaaagcaaaggcuggugcuaggcucugcccugcauuuucuguaagugccuuuuguacuuuugagacauggucucaugagcccagguuagccuuaaacucaugauguagcugaugcuuguucuuucaucuaccacucuagggcugggguuaccccauguaccacuaggccccgcguacaccugccuuuuuaguggcuacuacuugagcagacggcauaggaguguggggcggggagaggaggugaaaggggucucccucccaguguagcagcaggaccagcauuuaggaguuuggucugauagauuuguuggucacugacacacgguguaguuucuuucuguggcagccugugauggggcuguuaggauggaagaagacagguccagaaaaucucugucauuugccuaggucagcggcagucugggacuuucacauucccugcccugauuuagaguguauccuggcucauccauccccaccuuagggacaggaauguccaugcuaucccuccagccaggccuggggcacccucccugcucugugauccugcaaucuaguugguauacauuauggugaacagcauuggaaugggagccuggaaguggagggccucaacuuuuaccuacaguuuaaauaaccagguaaauacuugcuccugaggaccacaaagucuuggugggcagugggcagcaggcagcauccccaucuuuaccuccaguacauaugagcauagccuccugcugagagauacaugcuguccucuccacaaccuggcuucaggucacaccuggguguagagagugucagggcacagucagcacuagcugaccugccagaaagugccaaaggggagaauauucacaugccugccagucuuggagaguggagugggcagaaucagcuucucuaggacauucaguuugaaaaaaacaggaggcggggcagcagcagguggugaagcaacccccacccagccugcacagggcuccucuucaccucauccccccucacuuggcaggcaugugcuuggggccccacugcucagcugcagaugagcccuccaaaaagcacuuuguguguaaaauccuuuuagcaggaugaguuuggaaucuggcccaugguuugaggcauuuggcagggucccugaagacgcaauccaauuagucccauguuuucuuguuuuuauaacugacucuagacccagguuuucuucagugaaguagaaaauagauagguacaggcuacaacauucacgcacaaccaaauuucuauuuccuucaucucaugucuaccaauccaaaacaugagucagcuccuauuggcuguaagggagcagaugcucacaaaagagagggcaggacuuaccucaugaggcuacggguccuggagccugaaaccaggcgaugugguuauauuggauacaugugguagagauaggaaaugaguguauggguguauacagguuuacagugguugucauuacuggggaggucuugagaaagggaugguguugguaguagagcccccgccuagaaucccccagugaggggcuggggcauggcucagugguagagcaccuuccuagaaucccccagugaggggcuggggcguggcucagugguagagccccugccucgaaucccccagggaggggcuggggcguggcucagugguagagcaccuuccuagaaucccccagugagggucuggggcguggcucagugguagagccccugccuagaaucccccagugaggggcuggggguguggcucagugguagagccccugccuagaaucccccagggagguguuggggguguggcucagugguagagcauuagguuccaucccaacacugcaaauaguaaaaacaaaggcugcuugcuauaccaauccuacaggaagagucauccgugugcuugaagagcuagguuugaaaugucucuggaucagaaacccacugugaguuuguggugccaaccauagucuuaugcugugggucaagggagaagaggcaaaagugggaagcagugcugaaguggggcuggugggccagccaccagcuagugucuaggaagcauggcuguugcaggcucaacaggggaggagaauguuccugggagaggcgggagguugagcauaaaccugaggcugcagacucagaggauccauguuugucugaaugcuguggugugagcuagcaccucccacuccuccccugaagacuauacagaugauacaggaucaaaacaaaauggcaaacuuguuuuggcaaaauagaaguggagcagaaccaagccacaagcagaaggcacauguccccugguggaggaucaaguguuaguuuaaacugcauaaaaguguuugucaggcucaggaaaagacccugggaaggggaggaucaggugaccugcuuacuagugaggcacuuccugacaggcaguccuaacccucugcagggccucaccucaguaaagcaagaaucaugugcuguccugguucucaagacuacaauaggcccuggggucccuguucguucaggcuagaagcagaucaugcucacugugagcacagcucuucccucucaauggaggaaccagugccugugagauugcauccuagcaagguuuguucucuaggagccuccuguagcaaggaguagagucaugcuuaggggaucagagggggaagcuauggaucaggagagagaaauccauugccaaagaaguugaccccaagcacacaguugucagaaaguggaguuacauuagaaccuggggcaugagcaggcccagagcagcaaugguggggcuggaugaggaguugaagcugucauggagggaguuaggauacugggagggaaugccauggcaaagucugaacagcauuggcucugagagucgucuguaauguggaagaugcagcucaugugggcaguuagaacauaagacuggggggcuggugagauggcucaguggguaagagcacccgacugcucuuccaaagguccagaguucaaaucccagcaaccacaugguggcucacaaccaucugcaacaagaucugaagcccucuuguggagugucugaagacagcuacaguguacuuacauauaauaaauaaauaaaucuuuaaaaaaaaaaaaaaaaaagaacauaagacugugagugccaggcugugcaggaugccgguguuuagaaaggagcacaaggacagaagaaggaauccagcaaagaugagggacuaaagcaagggcuguccaucauccgucagcaagggugggaagaugcccuggaaaauuacuaugaaguagaagcacauuuagcuguguuuugggaccuaccagagcacuagggcugauaggaucccucugucuaauagagagaggguaugauugguuaugggagucagguuauaagaacaaaaaggccaaggaagcccacagccugcauguguuuuaugucuguaagcaagagacauuuaaaagccccugguggauuuccagugguuugagguguguggaguuuauggaggagccuugcccaagaacacugagaugacgaacuaccaccauugugaucagaauggaaggggaggaguuccacugucaccuuccucuguccagggccacagaaauggauaccacuacccacaaugaggaaagaagucuuaagugugcuaaaucaaugcugagccaccagauggacugagucacaaggcuuuauuugggcauucgguccagcagguaaacagguggcauuguuacugugcacaguuaccaagugaggaggguaacguacugaacuagucaggcauuugguaggacaugucuuugguacaguccagcccagaaaaguauggaugcagcaugaagcagccagugcuuaacagcacaaaugcggaauaucaaaacacacaaaaggaaacacguucacaagccaggagacagaaagcacuggagccuaaugcaguagaaaucaauacagacagauagcaagauauaaaugggcuaaacucugcuaguaaaggggaaagacuuucugaugaguucuacgcagaaucaaagaaauuggaacaguuggcugccaaggccacuuggcauuuguaagcaucucagcaggcaucagcuauucaugccucaucugaauucaagccauaaagcauugcgggaaguaggcagauaugccucucaguacugaggugcacaaggacaucuguacuccacucuguagggaacauggaaguacacagagaagcaaauguuuccuugaaaucagugugugcaugugccuagccagccucucaaggcuagagagcccgcugaggagucacagaaaaccuugaugaggccagcaaggugguucagcagguaaaggcacugaacaaaccugacaacccgaguuucaucuccaggacccauauggugggaggauagaaccaauuucugcaaguuguccucgaccuacacccacacuuuggcuacaugugcauuuacaugcgugaacgugugcacacacacacacaccucucuuacuauagcagcaugcaacaggcccugcagccuugccaccuccuccaacaauaugcaacaggaaauuugcugggaucuguccagcacagccaguuucaggggccauucuaucagauucucaaagcugugagaccugccacagcacauaaacuacaucagaguguggaagcaaggggacaguucucugaaguaagcaccguguugcuuguuccucgccauggggaagcuguaccacaaaugacaaugucaguguguuaggaacaaaagccaguggcaugcuaagauggcaccauccuugaggcugggaagguagcucagcuaguaaagugcuuguuguacggggauaaggacaugagucaguacucagaacucaugcaaaaauauaggagaugggagacagagacaggucaaccccuggaauucacugaccagccugccuagauaaacugucagguuccaaguucagugagagaaccuguguccaaggucagugagcuggauggcucccacugaaugaccccuggacuuugcucucuggccuccauucaugccuguucccaguaugcauacacacacugggacacuuuguacuguuccuccccauccugugugcuuauagcagaauguauaaagaaguuaucuggcuugugguucuggaguccagaaagccugguauugggaagucaaguguggcaggagaugggaugugugaggggugugaacugcaggcagugauaucaacccauggcccaccccuaaggaggcuucuuuuuccuugaagucugcuagcauuguguuuucuaggccccugcacuaagccugcaacuguuuggaggguuggggcugaggacacucaagaagcaagggucagcucugggugaguuuucuguuacccaggccugggguuugucuugcucccugucugccacccccaccuuucccagcagaugugcagagcagcuugcacaccaaggugugcucgggauaggcagccaguucaugucacugucagaaaugcugagacuuuucauccaagcaaugcuaauucuagacuacauucucucuacuuacucuguccaucucuaucucagaaucucuauagcucucucagcaguacaugaaugaccaaccaugugucucccuaccuaaucuuacaucaagagcaugggaaaagagaaaggucuguguuuaucugacucagaaugccuuguggacugguggauccgggcuauggguuggccaagcaaacggcccucuucccccugaaaguaggcauccagccuggggaugcucagaugcagacuuuaggacuuuggggaucagagggaccugggcuguaagucccugugcauguugcccacuaacucuguguuuccugauagcuggagauggaguugaagaugcugaaggcccagacaagcucagcugaaucuagcuucucauucugcaaagaggagguggaugcacucagguacggcuccuuuugaccucuagcuaccucacuugucacuccuaagagcaccugagccccugccuucuuaccuucccaaggcuguuucuauugucugcggagacccuuguucccacuggguuuggccuuucuagugucaugucccaggucaucagaugguccccagccaucuccuugcucaagaggagcagacacuccugucagaguauccauaaggaccugccuuccugccagcaacaugaguuaccaggccuagcuccuucaaggggcacagggccaucaguggauugaagggugcaaacaggcaucuuucagagacugcugcuucacagaaaaaugaacagucuucucaagcuuugaggguuagagacagcuuccugcuuuugcuguguguaugaguauguguguguucaugugcuuguacagauauguguguguuauggguuauuuccuucaaauguuuucuuaguucuugagauagggucucccauucaaccuugagcucuccaguucaucuagccuggccagcagugaguuccagggaucuuccugucgcugccuccccagcacgagggacuaggggcacaugucugcacaccgagcuuuucacauaggggaacccaacucugaacugccuucagguucccccugaccugcacaggcucugccauucuagcuucugucugaaacagccgugggaugacugucaccacagcccuggcaucuugugagaggcagccgaaugaagguagugaguuggccacucccuucugauuugcauccagaacggacacucuagggucuguuucuagcaagugagaugugggccuagggaacaagaaagccccguagacauugaguggucuuuugaugaaaugguacggaucuugggguaggagaugcaguccucucuggcugggcuuuuggugucccagagacuguaaggaaguccugccucugugugaaauugcccuuggcucuguuaggcucuucugacgucugucucucuuuggguaauggcuggugacugacuuccugcuucacggggccuuugaggucaaagcaaggaaggcuucuuggcaccuuucccagaaguguccagugaguagcacugagguccuuugugggcucgaaguucccucucauugccaaagcacuucucacacagacccaggccugggaaggagcucuguggggauaccaggcacagagcuguuuguuugcauuugucccagcgugguguaugcugugcacugucagggcagaacggaguggauaauugacuggccaggagagccacacgcucugucuucaucagcucauagcuuaauggggauauuauucacguggacuuguggcuguuuaauuaugggugguguuguaagagcuggcaucuggagauaagggucccugggacauguaucugggugcaaaaggggagccugaugcuguggcuggcuggguucuuggagaauuagugugucccuggugagugucagcauuuuuaucccaugaguagugggaagccauuaggcacuuuaaaacagaagagugacacgaucugauuuguagcaucaggcaucaggcacugcuggcugccuaggccaaucagaggggacuuggcaaggccaggcagccaugacuuggcuaagugcugggaagcauucuuugugagccucagccaagcuggagaggcugcuccugggcagacacaccaaacaccucccacugauacuccacaauaucuacuuugugauaaagcaugcagucauguuugaaggcaggguaucuaaaggaccuggaaguauauugcaugcaggcucugggucccugaagccaaaaacagcagagucaggggagccuucauuugcauccgauugggaggugcuggcaagaggcuggggaacugagguaaagugcuugcuggccuuacagugcucuacaggguccuuagggucacagagauaacccuguguauccagcuucaugucagcugguaggcagaggacuugcauuugggugugggcaagugcaaguuugcagaguuggcuagcugcauggcccccagugcaacucuccucaugccgcaggcccuguguugucugaggaccuguccuccccacagccucuggugugguuggugcaaguguggaccagagugcaucacguuucuugggaagagaggcugauacauauacuucagguuugaugauuuuuaaauuuuaaaaaggggcuuuucucuuaacgucuuccacacuaagaucaaagccuccugucuucuuuggagagcacagcugugagugaggugccuuuguagcugguaagaaccaggccacugaguuuggagggacugcagcccccacugcccugcuggugcuuugacuuuccagcagagggcaagugagggcuuccaggucauuccugugggcuuggagcaugcauggcugagaaggccagguaagcagggccucugugcagugaacucaaauggagcccaugccuugggcagauggcuuaugcugggccaaacaugaaggcguuuagcguagcugccuagcucccucucuccuugagccuggcaugggucuccugaggccugcuucccacagccagucuucucccaucacuccuccuuuguccuaauuugauaccuauugcugugauaaaacuccaugagcacagaagcagcuuggggaagaaaagguuuguuuggcuuacaugucccagucauaucaccgaagaaagccaggggaggaacucaaagcaggaacccagaggcaggaacugaagcagggaccagagaggaccgcugcuuacuggcuugcuccuuguggcuugcucagccugccuucuuggaccuuccagcacugucugcucaguggugacacugcccacauuaggaaaauacucuacagacuugccuacaggccaaucugaugguggcaguuccagcaaaccaaacaaaaagccaacaaccagcacagcccuuccuguugccaggagcuugcguggucccauuugcccugcucucuaacccuccagcugugucagacauuguaucauugugccucaguuucccacgguuuggucaguggacuugucacuguuauuuugagcaaggggacugugcuaugcauggcaucuugucuaacugggacccaucgugcuguccuuuggcucgaggguauucagagggcagcccuccuaaaacuugugcugaggagcuggguccuuagacccauguugcugccccagcuucccuuggaagggacacuggcgauguggacucugaagucuuacuuucuucuagcugggcaagggugaugaggacccuuauugaggaugcccucuuggaauaagauccuuuugaucucucuccugauccugaagugccuuccugcugguccuucaugugacuccagaggaggaccacuucugaagugguugacuccgagaaagagaguugacaugagagcccugccucaggucagcuugccuuucacucaagaccauugcuaugaacauagccagccagcagaugcagaagacagggcaggguaggugcagguaggugcugcuaucuggggcgcugugaggaugaggaugagggguggucugcaacucuauguauuugcauagaacuauugguuacacauaggggcacaggacuggggaguaaacagcuugcuauaccagcaugaggaccagaguuugagccccaugacccauguuuguuuguuuuucgaaguuagguaauccuuauguaauccuaccccuggggagguggacaguuggagcccugggacucucuggcucagccugucuagcuagugagcuccagguucagugggagaucagaucucaaaaguuaagaucaaggggcuagaggaagacaccuguuguuaaaccucuggcuuccauaggcauacccaguaguugcacagaugccauauggcaugugaauugcacacaccuguggcauuggacuaucucugugaagccaugcuugggagcaacagugcaaagcuaagugguggcaacucagggccucucaccuggaacaaaucugggcucaucacuuuccacugucagacagaagcucugauagauccuaaaugucuguggguuuagcagcuggguagacuguggucuugcaugccugggccagaaccuguuaaucauacuuaacagcuucuccguucccagcccuccucacugccugcugggccccagccugagcgggcauuccuaggucuggggggcagagggguaccaugacagggacauuaaauauguuggccuuucucggggagaaagcaggaacucugugacuacuacucagugugcucuggcugggucacccucucuuggacaccuuuuguuuggguagcuugucacuugucauugugucuucucaaggggagcuugucuggaccauuugacugguacuacagcucuggucacugggcaaccccucuccuccuggacucucuuccucuaccugcagaucuguauauucaugguagacugagggagcagagguagaagcagguagccuaguaccaguagacacaaacagaaacaccuaaaauuaggccacagagaggaaggggcagccuaauguagguggccuucugacugccgauugaguugcugacugagaucucuaggaagggaucaugugucccuaacagcaaccaccucugccucaccagagcaaggccacaagugcuggugccugcucugcugagagggcauggccccagccucuagaccccguggggagcccugcucauagccaucaguaucggguucuugugucccaugauggaaugugcucucaucccaugcugcugccuguacuaagcggcaaaacucugggaugcaggaaggugguggaugcacaccacucccuguacuggguagaaugagcagacaugcacccggucaucaccauccaucagaguccaguaucacacacacauacacgcacagaagcucacacauuuaaggugcauagagaauauucaucugaccacaccaaacucaaacuagaugucaguaacagaaugcaagaggaaaagcuguacccacggggaaauugauagcaugguucugaacugccugcggaucacacaggauguguggcagagaagaggaacaagugaacgcuaaugaaaacacgcucaucauaucagauccguggagagaagagaaccugcggcgcccagcguuccagcugacagagcagaagccauggcccugccaccaggaggacauggcaagcaaaggagcccaggaugagaagcaaggaggagguaaugaacuugaaaaaagaaacacaauugagaaaaaugcagaagcaaaaggcuguuuuucuggggggaaaaucuauaaaauugacaaacugccaacaaaagugaaacauacucagagaagcaaacgagccgucucagguaugacacagggacacugcugcaaagagccuguggccucugaaggauggcauguacaggaacacuagcuugucacuagcaggucuagucagcccuccaaaccaaaauuagccccagcauggugccccaccuauaaucccagccuggggaaguggaggcagaugggucagaguucagucauuuugggcuacaugaugaguuuaaggccagccugagcuacgugagacuguucucaaagguauagacaaaacaaacacccgaaccaagauguacagugagguugaugaauacuuuaaaauugaaucacaauuaagaggcuccaaaggaagaagguuccaggcccauuggguugguucccauggagacccugcucacagccgaagccuaauggguaccaaccugacucacccgucuuccacaagacagaagagaucuacaaaguacagccaaagggagccuggcacucaugggaugggacugugucauggcagccagugacacaugcaugaccuacccugcagagacaaaucugcuggaacagacacugucacugaagcuguugccauugauucagagagcugagugaacuggaagaagcucugacuugcguuuccuuaaguguacaaaguuccugcaagaccuucuacucagccccagcucaaccuccccuacccugcuccuggaaccccugugggggcucugugcugccagagcccuuguagggucaguagcaggcaggcaucagcuguggaaggccacucccucccccacuccauccaucagcuuccaacuucuaagggaguuuuugaugcugucccuuuuauuuucuguggucaggcuucagagaaaugagacugccuuuauucucaacugcaguggcguucugagagauugcuccuaagugccguguucacauggccaucuuuaucagucccuaugcuugcuuguaugugggugggguuuguuacuguugcuguuucuuuucuaagguaaaguuugcuauauagcucaggcuagccuugacccuuuauucucuuaccucggccuccuauaugcugggauuaaaggcaugcagcguguucuaccaugcccagcucauuuguuguuguuguuguuguuguuguuguuuuguaagugaaacacacauacaagucaaaaaaagaaaccaauggaaaacaaagagaagccuguuauuuauacugucagcaaacagucuucacguugaaugugugcgcacuuccccaugucccuggcuuucugcaaucaucuguugguuuuguaucacuggacauagcacccagcgccugcuuccacccccaugagugugcuccugcauguacaagggaaccugugugugagggccugggggcacaugggcaggucugugucacaggcagcgggacauaaaucucauuuaacauuccucagaaacuacuucuuaucuugguguuuugaguccuggccugcaacuuaccaagcagauuaggugggcagagaacccgagguuccuccuguuuccacccagccuguguaaacacggccucuggggaucugacucaggcucuccugacugugaggccagcucuguaccuuugugugcugugcaggcuccuuuggguggcugugaacagguaguggauguggucauuuaacuaaauggcuugcucagcucugguccagcaugcccacuuggguggacucugugccugugaucucuuagcacugacaucucccacucagcauagcaccugugggggcaucucuuuaaaggaaugucuccccccauggcugaguccugaggcaggaggugcaucuucccaguuggcuuuucuuuuucugucugcuuugccccagguagccucagcucuaagcucaccugucccugaacacaaacaucaauaagauggcuuuuucuuauuuuuuaauuauauguaaauuuguguguguguguguguguguguguguguguguguguguguguguguguuugcaugugcaugugaaugcagguaccugugaagcccagaagugggcaccagagccccuggagcuagacuuguggacaguuguuagccagccccaguggauggugauucuucuggaagagcagcaguguuuguaacugcugagccauugaucuccacgccagguauccacgugcacaugggcuuucuuuucuuuuucuucccuuuaaaaaaugucuuuauuuauuucacuuuauuuuauuuuggcaaugcucugcaugucuugggggaucaucucccucugccuuguguaaauuuguccccaaauguuuucuucucucugaugcuguagcagaugaagugcacagcagagcucacacguggugguuuguauggugcuguuuugguggguuugugcaucagcagggcaucuugugaugaggagugguuugcugcuguuauuucauugucuugucuaauugcuuuggcaguuuagucagaugaacgcagucagagcaggcauugucucagaguuuuaaaaaauuacuuaauuagauugaugugugugugugugugugugugugugcgugcacacgcguguuucuguagacccccuggaguaagugcggaggccagaagauggcacucaggagugcguucucuccuuucauccugagcuggaucucagguugucaggcuugguggcugcaccuuaaucuugaggaaaucuugcagcugucuucccugcuuuuguuuuuuguuuaugugcauugguguuucaugugugugugugagggagggggucagauacucugaaacuggauacagacaauugugagcugccaggugagugcuaggaauuggacccaggucccccugaagaacaacugaugcucuuaaccacugagccaucucccuagccuuuuuuuuuuuuuuuaaaaagguuguuuguuuuuuuuacaucuuuguuuuuguuuguuuuuguuauuguuuguuuuuguuucagaaaugacauguccuguugagguugcugcccucuguguucaaggugacagguuuggugaagggauuuuccugugucaacugagagcggaguagaggagagcuucuuguccuugcucccuagagggucacacagcacaguguuagguguugagaugccuuggaucccugcuguuuucaaacccuuugccauagcauggaaagcuuucagggaacggcuggcauguggcuaagugaguccacaccugucccccauguuuaugugguuaggcuugucccccaaguuuacuggucucaguucuaguuacuucuuuuaaaaaauaauuuuaguuuuuguuucauauauucauuucauuuuaauuuuagguuugcagucuugcaguuugaacccauguccucacauguguuaaacaugcacgcuacagagcuaccuucccagccuuuuucuguggcuaccuuuuacauuuuggaacaggaucccacaaacugcuccuugaacccaugaguggcccaggaaaacccuuaauucuugauccuucugccucagucuccacacagcuagguuggugggccuauaccccaggcccagauuggccuuaguuuucuggaagugucuuugccucuauucaguguccgucagcugcugguuucagagagagagcuuccucauuccuuucucugccaaguugggcaagaccauaugauucuuugaguguuugcuugugcucucuggccuggccuucuuccuuguuugggagacucugacuucccuuuugacccucacagugaucucagguuuauccgcuucucugggggucaccuuggaaggucaucaguaggagucugccugugccaucuuggcuacucagaugugugcccaguugucccuagcauccuuuugugaccuuuguccuguggugcccucucacagcuuccagguucguggugagcucuucucucugguugguuuugcuugggaguuuccuguguaaucguucacacaacccaauccucauugucuccagccugcugucagcugucagcucgagcugcucuccuucccugcuuuccuuuuggacucaugugacaucuuugaugugacaucuuccuuguguuuggagcccucuguuuccucuuaguguuugucucuggugucuccuaaucuccccagugaauucuuuuuuaucccaggauaauuguaguuucuuacuuuuuuguuuuauaggugugugguugaguauguauaugugugagccaguucagcuucaggcaucaguccucauagagucuaacaucugccauuugagccagaaucucucaauggccaggagcucaccaauugguucucaaccuucuuaauacugugacacuuuaguacagcuuguguuauggugauucccaaccauaaaauuauuuucauugcuacuucauaacuguaauuuugcuaccauuacaauuccuaauguaaauaucuguguuuuccauuggucuuacgugaccccugugaaaggguuuuuugacacauaucccacagguugagaaccacugcucuagucucagucucucccgcacugggaucacaagugcgcaucagcauccccagcuuuucauggcagugcuggaacaauaauguagcugaauuuugcuacuuaguagguuuucuucuaccauuucccauccccuuuuuucccuaccauuucaacacccuaacacuagauaagagacagagaaagagacaaagagagacagagacucacagagagaagagaaaggcacacagagagaaagagagacagaaagagagacagagggggguugaaaggugggugguguuuucauuagacuacuaaccgcugguuaggggcacugaguuccuuggggcaacuuugaucuucuccaucaggaugucuaauuucuucuuguaguuguuucuucuuugcauaugacugcuuaacagaccauaacuaacaaccagccaacaacccacaucacaccucucaggaccuagcauuuauauacccucuaaggagucccaggaauuccaaaugucacacagucacagaaucuaucugcagcuggcaaaaucaugccccugccagagcacaaggcagaucauagucugcuaacguggacgaucugaagcagcucuauauccccacaccugggauuaaaaugaaaacauauucuuauaguauuucugugguuuuuuaaaagaaacuaaaauuccacaguucauggaauagaacucaaguucucaggccuucaaagcaaucacccacaaagccaucucccuaaccccuguugaauuacugucuuuacaguuccucugccauugaucuccaacuucauuuauggcaggcauucuacuaaaugaauauacuaagacuuguuuuguggccaugcauuaggucuguucuggaguguucuguguccuacuucaagccagccagaacuacacaguaagauccuagcucauaaaacugcccuugaauuccccgcccccucuuccuccauuucagcuggcucacaggugcauacccaucacgcucagccuuuccuuaaaggggaagccuggcuuguugacuugagaugagagcauuggauacauucugucucuaagccuggcuuuccuggauacgcuauguccaguucaauguguuugcuaauuuccuuuacuuucuuugagcaguguauuuaguguguguuguuacauuuccaaguggccaaagcuuugcucuuggcuuguucugguuucuccuuuaguccugaagugcucucuggacacuuccuuuccuuuuagccccuuguagcugucuggcuacuuuguuauggacucuuaaacuacacagauuuuaggaacugcuccauuuuauggucaguggucagcacaacaugaggaacuguauuaaaggguugcagcacaacaaauuaggaagguuugagaaccacaguucuaaagacuccugaguugcuuuuccauuugcaguuucuccucuagccuguggucacucuccagggugaaccagggggccugagacagauuccuuaccugauucuagccaagcuucagggucagccaagaaccccuggcuugaguccuuccuuagaccuaaguaagugcuguccacugcuguccucccacuagggccaugaccuuccaucugugcuggacugcaguggcaccugguuaugucauggucuccuugcagguugaagguggaggagcuggagggugagcggagccgucuggaacaggaaaagcaggugcuggagaugcagauggagaaacuaacccuacagguagguuugguggccagagagagguucccuguagacaguacuccuuccagccccugugaaugaaccugggcuuccuccuaugcaucccccccuuaccuggcugagagcuacugcuggguucugcaggaccacaggucugggccacucuggcucgcugugcagggaccgcuucauacccuugguucuugugcuucucagcacugaccucggccucucuucucucuggugcuguacccugucacucccauuucccuguggucaugaccuucucugcugucugcauuagacuguuucucuucuuuuuaguuuuccuccuccugaucacacugcucauggcaagaagcccacagguuagagauugccuggcuucuagacaggccauugauuuuuaccuuggcaccuauuagaggcaaucaaauuguguccccauuaccaaucuuggugaugggagaggugacaacuuugaugaagugagguguucugaaccuuggcuguacucaugccgagcccuaggaccugucauccuguucuguucuaauugggccacuguccugggcugagggcugcaggagggugaaucaaggcuaccuggcuacagaacugugucaggauggggugauaaauggauuucagugcagcucacagagacgucagggacaacacaacuagaggaggugccaguguucuaugccccaugugggugacauaagaaugggauucacaagaucuccuccccacagcaucacaagugugugugcuggcacuguucagcccugcagcucagagccuuccugagggccagagugcuagugaccauguccaccccugcucugugcugcuguguguacugugugcaggcaggcacuaagugcauacgucugucaaccauacucauggcauggccggagacagcauggagggcugagucuguggcccuggagagcaggguccaugucagcugauguucaggaacccaggaaugguauucccaguuggcauggaggccugaggugggggagaggcagcuguuguagaaauuucuagacagccccauagacccugccaccucuguaggcugugcuuauacuucagaaagggaccuuaccagagccagacugggaaagcgguuacucagagacugccccaugaggccuaacuguucugugugggcuucuccuccaccccaccuccacccccaccccacugcucuuaggccaggguugcuugcuguccuccagccucacucugaucucagagcuggaggcuguauagcaggacucccugacuccuguugcauccuaaaccaccuucuccccuagccaguacuggaccucugcuagacuccccagaugagcacauaucuggaaguccaggugauugccagagugcugggcucuuugcucuguccuguacuauucauacuaaaggucuuuccaugugaggcugugcccacuauuuuauuaguaaauaaaccauuuacucaagcuguuuggucaugggaguuuggcccaguucccucuacauaccagccuuuccccucugugucccccuauacccuugucagacaaacuugugggugaaccagccuggcaguugccugugucuugcauaauugagucuccuuccuaggucacuggccucagcuccagggccccaugcuaacugcaagucugacugugucuguucuguaugucccagcuguuggcacaucugggcagggaggguuuuuacaccaggauugaacugguucugcaagggggcauuaguuaccugcgguaaggaacagucccuguccaaucucagugucagcuggcuccucaucugcugucccuucaguguguucaggagcaccugugugagcagccaguuuguaacacugaaugcaggguggcugcaguuccugagcacaugggcacagaagcuaugacacaugagacugguccugagggaaaggcaaacgggccuggguuuggcucaguagugggcaaggaggugacuuggacacaugaaaagagaaaggccgccaccuaugaacacggugggugggcuugggcguguugguuucugaucugagcugcugcacuuuauaaggcugggugaugaggauucuugagggaauccugugcuagguccuuucucucccccaugccccacuaucccccaacugccuucaaggccuuguuagaugcucugacauuccuucuucaucuaagucaaagcccucguucccauuauauguuggucuuggaccugggcacccucugguacuggggaagaaacauucauccuggggcuucuccguauggccuggccauagcauuugaugccggccccuuugagacccagccuccucugcagcucuaacggggcugcuuggaccuggaaucuuguggucuagccuuugggcuuccucaagccuuacccaugugcucaguaugcaggcagccuccugcgcucccacucccgccucacucuucccucuagagaagaagaguggcuucaaguuggcgcuucaaggaagauugauuaaaaucagcugcgguucaucuuaauugggaacauaugcucagagagggagcucaacuaguuaggauuuuuuguaauuaguucacagcugguuggcggggaagcaaaacucuggugaccacuuagagcugggugugugggcgugcuuggggguucaguggaggggucaucacaguggcugaaugcagacuuaccaaguugacgcacgccauccuuccuggguuuccugggucauuggcuguuuguaccaugaccugugugcauugcuaggguagcuagggaauaggaaacggguacuaagguguacuugucuaauggacacacgccaacuggcugaauggacggcugacuuaugauagacagcccuggcagagcuucugggagguuagacacuguggugcaggccucgagucucagcacuauaguggcuguuccgaguuucagagccuaggcuacauggugagauccuguggaaaguaugggggcaggugucuauaggaagaccuuacuuagagauggggaaacuaaggcuggcacagaggcagauacagggauugccagucucuguccuuagauaccuugugcuuucccuaaaagcagggacagcugcuuuauuacagagaccccccauguuccucauagccucccauaaagccuccacauagugcuucugaugagcuaggucaggacagcuugguguagagucaccaaggagaggccugccaggggcucugcccacccugcauggugacaagugagguuccuccauuugaaacguggaugccuccugggucccacacuauaggcuaagggcagccuccauggacucgggcccuacugcuuuuccccaguguuuuaacugcaagcguuuucaagauagagaaguagaaagaauuuuacagugaaugcccacuuacccaccaccuacauccugucgggaauggcacacuuguggcuguaugacauuccuauccaucccucugccauccauuaguucguuuuauucuuuugaugcauuugaaacuaaauugcagacaucuguauacuuccucuaagcacucgagcaugcauguaauuaagcgaauucaucucuggaaucugacgcccgggcccccgccgucccacaguaucgccucaucauagagcagagcuccucccuccaccagugaggcugugccaguggaccccagugccaggccucugagcuggcacauuccucucacagucaggggaggcuaggcugguguccauaccaccuuacaguccuucuaaagugcugcucagaacagagcccagacggcugcccagugacauuuaaaaucagaauaucuuuuuuggaaauggagugggcagaaaauugcuggguuuccugcaagcggaaagcuuucugagccugcagacgucccugcuccugucugcgucacaagcagcagugcgguuagggugcccagccuuacuucuuccugugcccacaccugccgcacauaguucuacaauuucaggaugucacuuaccaugagacacccaugucaggcaagacccuaagauaaugaaaaaaaacaaaagaagaagaagaacaacaacaacaacagcauugucuggauccuugagcuccagguugugccagcacaagucccuuaccugagugcugagugacacuaaggagguggcaucagugcucccugugugaaggucauggaucaugggagacgucagagcagaguguuggaguguccucuaggagcaucucacacagucccugcccacugugacuucucagcccaguucuuucccaaagaccugcacugucugugaggcccacagagcaccgcccuucucuacgucaugcaguggugccaacugcacuggccaagccagacacuccucuugcugcugucuugaacucacucacucugccucacccagcuauggcuagcacuccuguccugcuuggcguagccauggccagcacucuccucucuagguguccacagagacuguguuguugcagcuuuugacccucaaucccugcccaggucuucagugcagcuccccaugggcaauggccuaccccucuagcagacuuggagucuugauuacagucgugggaguagggugaacguagaggcucagcauugucuacaugccuguucuccuugcaccagcaugucaacugauguuucuuagucuggagaccuccuuugugucccucuggaacagaccugcuuuugucuugugucaugcucuaugcacuauuaugcauggacaguuucugugugggaacuccuuguggaccuucgccagucuuuccuauuuuuucccuucccuuuucuucuuuguaguguucagauugugcccagggccuuggguaugcuagguaagugcucuacugcugacccaugcuccagccuuuacagggagauucuaggcagaugcucuaccauuaaacuauauccccagccuucuuuuucuuuuuuauugugagacagguucucacuauguuacccagguuggccugaaaaccugcucuguaggccaggcaggcccugaaggacuugugaucuuccugucucagauccuguguggcugugauaccaggucucaccucacacccgacuaugccuuaguauuuugcacaaaauaagcauaugucccuccugacucugccuuauaccgggcuugggagcuggccuugacagagaggugcucagcaucucuccuggcauggccuccaagcccugccuugcagaguaucugugagguaagaugcucagugaaaggacagagcacagaccgcagaggugagcgcaggcagcucauguuuauuaacgcuggagacuaaaaacagccggcuugcugauaggcauuagugugcugaauuuucacaggcgcugauuucuuuugauuguuuuugagcaacugauguacccuccauacuaagccccuccuccucuugaugucaccuccuacagagguuagucccuugggccuacaggcccuuaagcaccaacuacuucuugcuggagcgcugaacuugcuggaacccugccuucuaaugaauccaggguccucauacuccacagaucccaacuuggacccguagacccccgacuguugccucagcacccuggcuugcaguuagcagucucgucaggcgacugagguucucugacagucucaugugugcccaaugguuccaucuugcaguagcuugugccuuucuagcuuauucccauuggcaucucuaccugaagccugcucagcagcacccaugacccagaagccagcuacaaaaucugucuuccucucuugauacaucuaagguuuuggugaucucacuuuuacaugacaaguaaaagggaaagggagaaaaauagaaaagacuggugaagaugguaaacgcccacacagaaacugcucauacaugcagugugcacagcaagacacaggacaaaaccagagcuauuccagacggacacaaaggagaucccaagcuggcacagggaaggcagacauguagacaucauguaaacaaaacugagucuccuuguagaauggugguuccuccuccuccuccuccuccuccucuuccucuuccucuucuucuucguccuccucuuccuccuuuuucuucuugcuauucagaaauagaacucagccuuguacaucauaagggaucuacuacugagccacacccccagucccucacuggggucuacacaggugcuguaccacugaaccacaccccuagucucugguugguugauucuagucaagugcuuuauaacugagccacauuccaaugucccagcacuauagaaaccugugacuaauauuuuuugguaaauugacauucucucacacauuguucugcagaaagguacacugagaggugagcauaguggcaccaacauggagacugucuacgcaaacugcuuccauggggagcugauugaauggaacagcugccaagggccaggauaacuacauagaaagaagagcagugcucuauaggguguggcauagcuggcacuauucagcauccuuuuuaccaucugcgcccaaaacagauggucuagguugguccagguggccggcccuucuuucaguggcagccgguucucuguucaaaugaagcacucucugccaucacguaugguguuggcagauauacuacuggcucugccauuauggauaagacucugauuucuaggggaaaugucuugagagguuuuaugcugcuugcuguggaugccaugaccauugaaagaccccuuuggagccuucgaucuuagcagucagcagucugaagcaggaggacaaugaguucaaggccaccucaggcuauauaaaaaacucaguuuuuuaaaaaacaaaacaaaaacaaaauaaucugaaagcacguugauuugaccauggucugucaaguuuagaagguucagagacgggaucggaggaauauucauucacugcgcucacauggagcacuaauguucguggguagauaaguaaauaaauaagccauggucuuucuuuaucauggaauguuauucagcucagaaugaaauccugccaccuguugcaguauggagauacugaagacuuucacuaagaaaacuaaggaaguccaugcuggcggauucccuugaauaucagauuccuagagaugcaaagugggaaagugggagcugugcuggagugggggcagggaguuaguauugaauggcacuuucagcgggggaagauggacauucuggauggauggcagucaugguuauacaacuuuggaugugcuuaacuggcugcacacugaggcaugguucagugggauauuacacaguuaaaaaaguagugaucuggcuuaguugguagagcacucagcaugugggaagcuugagcuuuugucccagcaccacauacacuggguauugggugcacaccuguaaucccagcacugagcuguggaggaagaggucagcaucgaaagguucagggucauuuccuggcuuacacagugagagcaagggcagccugugcuacaugagacugucugauagagacccaggggcagggauggacguuccugccauacacaucaaugugcuaggggugguggcucucaggccccacccucacagacuccuacucagcccucauugacccuugaccaucaucucuuaguugauccuucuacugcugguucaugucuguagccuccuuccacugucaccaagaaccaggcauggagguugggcagcagccaguuauuauacagugaggaggucaugagaacagacacuacuugcuuuccagaguuucuucugacuggcccauugcgggguugcugagaaugacagccuaagcuauggccugguagacacaaacaggauaccuuccccuccucuaagaacaguuuccacuucauguccacacccuaacuaugcugauaacuaagcucagguagccaaccuugucacuggcagucaggcuguugucauucucauugcugugugucacaaggcugaguuuaggauccugaggacaguccagcucauggcugcuggagcugggccaacaguugagcucaguugaguugguccucuauguugguucucaccuuaagcaccaccauacaucaacuccggagccucagacuucuagacccaucugccuuccucauuugcuuuguuaagagcauuggguugcaagauagauagagaaaggagggagggagcauaggcccagggucuggagaucuguccugacaauucucuggcuucugcuguggccaacuaucucugagcuguguguagccuaccuaguucuccgcagugcuguccuguguuguccuguggugacuggugcaguuuguuggaaggcacacagcacugcauauccccagguggucacucucccgaacugcugccauagucccagagucucacuuuggcuuugccagcucugaggggauuuuugugugugugugguggggaggggugguucugagccuaucugaagcaaacugaaucagacaguuuuucuugcugaaagaguaaggaugaaagacggacuggugaccccagguccuccaggugacagagggcuuugggacacaagugcuugaaauguguggcuccuucuauuugcugcuggcagcacuucugauucuacucugauggacaaggacugaugggugucaucucuuuacaccugguagcucuugguaauggucucaguuugguaggcauucuuuauaguucuuagggguaucucgaggaaaccucagauccacggaccauugagagauagccaccugggcaugucuaacauggggcugggggcagggucaaauagacaggacuuaguuucagcacuuuagcuuuagggaugaggauggacagguggacaggcagacagacuuuaggaccuaaaagcauuggguugguugacccuuuggcuuuugaccccaugagccaccuaggugauagcugcccacccugcaaagcuguugcaaagaacauguucacaucugcccacccucuuguccuucccaaggacuuggagccacuaggugauacccacggcccaggaacagcugaagccuguagaggaagcagcccaguaggcucguuucagagcaugagggucugcuugggacuguagaucacugacuuccaggccaggccuggccccgccaggaggcccaaacagagcagcugaagagagaaggcccuaggcauccugaagcggccaccagccuccugcccuucuuuuugagcucuguccgagugcuggccugugcaugagaaagucagauacccccuuucccucagaucuacauugaccaguugguguugcccaagucuugugcuggaagccugaagugcaucccuaggcaauucauugagccugggagaaccugccccaagagcuucuugucccaguuuacccccucacaacacauacacacacacacacacacacacucacacuccaguucucucauguugcuggcugagcucacagcccaagaucuaaaggacuagauauagaagaggcuaaggucugguauggguagcucucuaagcuguccccugcaaagggguugcuaucauggaagccaccaacccuuccuuggauaagcaaggcuuacccauaguccucuaggacuguauacugaaguucagcaguccagccuggcaucugugcugugguaacauauccugucccguuuugugaucuaccauaguccccugaaacagguaccugaggguguagcccaucccuggaguugcugagggcagaucagaaguuugguccagccuggccuccugaauaagcagguuccacagacuguggggcagaggaagccacguagugaccaccugggguccucacuuguaguuucugcuccuuccucgauccaguucugccugcuacucccagacccacccagcagcccaacagaagccucacuuucacuauggagcugcagagcucagcugggagagguauugauuuaguuuugaguugagugacuuauaaauaugcaugaggaucggcaguuauuuaacugugcuuuuuaauucuccucauguugcugccucuuuccagcagggucucuugcuauuccagucagguacccaguggcaaguggucuuggcuugcugccuggaccuucccugggacaacuggacccagaggagugagguuaggggcagcuguucuccaguggggacauaguugagaaaucugguucuauuuuagggucaggagccagggguugcuuuccucuggacuuuaguuuuuaauuuucaucauguuucuauuauuuauuuauuuauuuauuuauuuauuuugugugucuguuuaugucaauaugcaugcaccauagcacacaugugugaacaaccugugggcaucacuucucuacuucuaucaugagaguccuagggaucaaacucagguugucagcauugacaaguaccuguucucuuuaccuacugagccaucucacaggcuagguugucuguguguguauacacucacuauauauaccuuauguguaccauguagguacuuacaggugcccaugcuggaugccuugcagcuggaguuacaggcaguugugagccgucugaugcaagugcugggaaccgaauguggguccuuuauaagagcaauaaacacucuuaacccccaagccaucucucuagcccagaagggcucuuuuuguuuuguuuuguuuuguuuuguuuuuucugagacaggguuucucuguguagcccuggcuguccuggaacucacuuuguagaccaggcuggccucaaacucagaaaucugccugcccucugccucccgagugcugggauuaaaggugugcgccaccacgccuggcagaauguuucuuaaagaccggauucacuaugacuggggagauaguucaguggauaggacccaaguucaaauccccagccgccauauaaaauuccagucauggcacauauaaccccagcaauggaggguaaagacaagugaagcccaagagcuuucuacugacuaaaacagugagcuuccaggucagugaaaagacucuguuucaagucaguaaaacuaagaacagcagaggaaugaccccgccccgcuccauauccugcucuggcuuccauaugugccuguacauucgauuauaugcuguacacugcacauacucagacacacacaaaaaggacuaaauuuaccauguucccuucacagaggaaaacugaggccugggggcucagagggccuguggaaggccacucacacucaucucugguuggagagcaguuggcuggucaccucagcuuaucuggauagaaggucacagaguggacaggaagagccaucugcccuucagagaaucugugccaugcccuggaggagccgcugcacagaccugccaguaccacuaucgauagaucugggcaggggccacagaaaguccccaguguugacaccuuccugccauacacacugucugucagcuccuguguauccaccaucauuagcagaaaacaucagcucgcucguucagcaagugagauguuuuuguuuagucaaugauugcaucgugguuucaaaggaagguuccagaauuuuccuuuugagauucuugucagugccuccaguuuccucagcugcgaaucaaacaaggcaacaaauuuuagcagcagauuacagccauucuccccuuucuuccucaaagcugucauccuguggcagacucagcgaaguugcucacuugcucccaucuguucgucucgcaugcucaccggcccccuggacagucuucuccauauuaguacugaugucccugggccugaaacaggcagcaggugugccugaaagccaagcagacacacaccaaugcugagacaggaucuggugcugugggcaugagcgaggcacuuuucuucucucgaguggucucuguugccucugcugcaguuagaagcaugugacugccuggucccucaauugcucagacaugcccaggcacugaagcagguaugucuggcaauaccuccugggcagguggauuggcacauuuuagaaggcacugaccuguuucccuggccugugguagccccucagggucuguccagcuucccucccauguuuguuauguaguucuuggcuagcccucccuugcaguaagggccuuggugugucugguggugguagcacugauagcucucucugguagucuugaggcuacacaagccuuaacaugggugacacccacccagcucaccuccugcaccauguggcccugaccucugccacucaguuuccuuccuaguccaagcuugaaaccccuucucucagcccugcuauaggacuugagcacagaaaccuaggugggugcugggugcacacaugacaguggacucggacgaugcccuuggcucugccuucucccuauaugugauagcuacacacagcugcuccuucaucuguaacccuugugccuccagguuaucauguaaggaagagaguucuuaaauuggggucacuucugucugcagcagcggccccauagcuacucaggaguagagaugccgugucugucacaggagggaggccggcguguuucucuggaccucuugguucuuuaugcuucaguuggugaucugauuucuaagcgugugaaguacauucuggcccgagaaauguucuauuuguuaagcauucauccgguagagucugugccauaccagacacacugucagugccagaagcacugugaagaacgagacagacagcccuguccucacggagcugaccucugcuaggggacagcuaauaaaacaaguguuuaagaugacgaaguguguuauaaggugcaggugcaaggguagugaugggcugucacuugucgccugucagugccuggcuggguacuuguuuugaguaagcacugaugcuucgcuguuggcuucuguuggcuucaugcucuacggagugagacgguggccugccuuggaacuccucauggcaggaggggcucaggcuggugccuccuuccucccuaggaucucucuggaucccucccucccucucucucucacuuccucccuccuugucuguguauauguaugugucugucuguuuuuugaaacagggucucacuuguagccuaagcuggccuagaccucacuguauagaccaagcugaccucaaacuccuagagauccuccugcuucugccuccugaguuccgggauaaaaagugugcaccaccacacccagcucuccccaggagucucacaaugucuucuguguugugugcucaguauggagcuacggaaacuguuccaagaccaguuauuccuccccucagcuugagaucucccagacccaaccugucagccucuauagcacccaaacuaaggguuuaguuguagguuuuaaagucuguaaaaagaaaaaucaggacuaucuuaggcuacauaaaaauuccuguguuugggugagcaugguuucauuggcacacgugaugcuuuucccugccaguucccacgccuauagucuguggcugcuuucucaccaagcugugcagugggcacuggaacaggcgguagcccugaagagcuggcuggcuccacaggcaguggcaggcugggcucugaucccuuacccagcucccagugcuuggccugggcagggaagccgagaugcguguccagccccagggcugucacagcgggcgugggugauggauuucacaugcuugguuaucuccccgacuggugaaauugcacggaauaacagacuguugaaauugcacaaguaacagucucaacccugaaagccagggaaucagcuagcguuccgggagccucuucauccccagggcuuuacaagauucuaaggaaagcucugaagagccugcccggccucccccucccuccuucuuccuaguucuggcugguggccuccuccuuccccuccuucugaugagaauauacucaggaugugaucugggaagccaaguuugcaagcccuacuguucccugcagguaguucuggcacucucugcuccccauucccuacacacacacacacacacacacacacacacaccccuaucccauaugaggaucuuacuguucugcugcuccucuuaagcccucgacgcccccccccccccaagcauaucuggagggguggcuaaaggcugacagacuguguguggccugggugagguacuccagguaaagaucauacugcccuucggcacuacagaggggcaguggccuacagcagcuuagcucaugguucauggaggcuuauuaaccaccggcugccucacuaaaugagucucccagcuucuuugcuccuuugugccugguggucuaaaugggugggcuauuuccuguucccucagcagauauccuaggagggagacuaaggccagaggagccaggaagccccuuuauguagacauggaguucaguuucccuugcugaacauccacuggcacuggggcuuugaagauuggaucccagauccaucagcuuagggcuuaucacaggccaguucucugccuccauuccacccucugugccagcccuguuacaugccuuagagcagggguaccugcagagagguuggccagagaagacaacuaacuccuuguuugacuuccugagucaccucagaccucacugaagucugucuugggcccaguggaggcagcagagggccucccaucuuuaaugggucccuucaguggcuuugcggucaccaccacauggcacacugugguccccaccacauggcauauugcagucaccacccauugucuacucagugccaugcaagacuauacaucccuucuucaugggaugccugcuucgugcuaggcauauggcugucucguugcugcagucugggcuuuccugauggcucauguguguaccauucugugcuuauuggcucuucggguucuaugaaguaucuguucauucauuuugccucuuuuucaggggcugacauuuucuugauuacuuuugaguucugaauaacauuuaggugugagcugaucaggggaaugaacuuccgagaacaguuccacucugagguucaccuccuucccuaggacccagaguauuuucaaauauaauguauccccucccccaugccgccgccacacacgguccuuuuuuccuuuuugauguagcccauauaaacuuaacaguucucagacucauaauucuccugccucaguuucccgaaugcuguugcuguaccugcuuccauuucuuucucucacaccaacauauggucuguccuaccugagacgucaucaccacaggaugaaacuguccuccauucucagccccguucagggcuggagagguggcugaagggcacccacaugggaguuuccagcugcaacuccaguuccaggggauccagcaccucuucugaucucccuggacccaggcacucauauaguacacacauauacacacaggcaaaagacucacaaaguaaaugaaucuauaaaaaauguaguccagucuuuuauauauugaccuggcuuucuggaauuggcaucugugugugagauguugaggucacagacauccuguccacccucuccagugccacuagucucagucauugccuuuggaacauguggggauagauaccuccuagaaucagccacauugcucuccugugcuugucccuggcuugaggaagcaaauguugguggauggcaguccugggcuaacacuguuagcuucuguuaggcacuggagugagucugugagaacucucuuugcugcagccauaguuucccuguaaagccauccuagggagcaagguacucuuguguguucaguucugggccucccuuuccuagaccucuugcagagagggauagauggcaggccucacagggcuggagaacaggcacuaugagacuagucacucaguauugacaucaggauucauuggguguggacaacugaaugggacacagguuauacaugcuaggcaaauacuguacuacugagccacacccucagcucucacugacugauucuaagcaaguguuucaccacuaggcuacauccugagcccugcccccagccccucacugggggauucuaggcaggggcucuaccuaaguguuguaccacugaaccuugucuccaguccuguuuauuugagacagggucuuaccaaguaacccaggcuucuccuguacucacucuauggcucuaacuagccuuguauuuacacucuuccuaucucgccuacaguguagcugggauuacgagccucuugucccuuccaggacaugacauugaauaugguauuuaggugaauugagcaggguguuggugugucuagaacaccugugauggcccgaggagaggaggacuguuucgcuuauuuucucuaccaguucugucaguggucucugcucucuaagagaugagaccccagauugguaacgggcucgccugcacacguuguacgaggguugucacagcagcugccacacugugucuuccaccaaauacucaugugcucugugcuccugagcucuucauccguacccggugacccugcgcucuguuugcuccucuagggugacuacaaccagagucgaaccaaagugcuacacaugagccuuaacccaaucagcauggccaggcaacgccagcaugaggaccaugaccggcugcaggaggaaugugagcgcuuacggggacuugugcaugcccuggagagagggggccccaucccugcugaccuggaggcugccuccagucugcccucaucaaaggagguggcagguaggucuacucacccaguccucugcucucuggaaagguauacacauggguugcauggauagccuagcgcacuggcccuugcauccagcugagauguauugcuucccugcagccuuagcaaacaggguuagucauccaaguuugcaagcagcuaagaucgucucagaccccccaaaacaaauuaauaccauuuaucaguuuauauguggcccauuaaucaugaguaaauccaauccucagagaaaacaggaccaucguucacuggccuaagcacacaucucagagcccagggcccuuugcagccaggcccaagauuccagggaagagacagucagugccucucaccaccuucuccagucaguaagucaagaugacagccaucagaacauguaccuggcacccuugaggcauugugguggccacuggcauccaucacugagccuugguaagcaagccccaccugcuuugcucuagagcucugaaguuuaaauuuguggguccaagggaggggcuugcacuaggucugggugaggagggaccuggggcaaaguaugcuuguggcagguccugcagcaacccugccuguccugagaccacucuuguucccuuacacuuaaggguguuucuggccccugggacuggggugugaguguggggcuucuguugucuugagguuuaugucuugcacgugguucucagcuacuucucguucuacagucacuccuguugccuuucuguguauccgucuucugguccuaaggaggcacuuggcguuucuagugagagucuuaaacuagggagggugaacugucaucagagagcccuuccuccaggacugaucucaggacagaguggcaaagacagauccuccugcacucuuugucccugcaguccugucuuggcuucuucuguuugcugccucagccugggccuucaugaagggcuccugaagacagugucgcuccaaaccuggggaccuggagugauugaaggcacaugucaggggccaggccccaagggcccaaagucugagcaagaauggcuggcugguguaccauuuuuugucuugucaagcagaagugcucugagacgcagucaguccugggcuucuaugcagagagccuggcauagagcagguacuccauaugacuuguccgugucguuacccauagucuugugaccuggcuuuagggacaccugccagcuuuugugcucuacucugacaggcauccaguuugccaguggccuuugugagucuugugauuccuguguugcuguaagggucagcuccgaguggcagauuguauaggucaggaccaugugucucuuggcagcguagaagauccuguuggcuuacacuguuucucuuuucaugaguagucggcacgagugugugcaugaagugcagauccucacucuccucuacccuucuccacgucagguuuucagaaugaaggaacuuaacauugacccucuuauaugccaugugucuguuuuuccgcacaccacacauguaaaacaacccagucuggaacccaguccuccuggguuacagaccacucacucucugcagugagcaggaauaagcccuagaagcucugaguuugcaagcucaacacgggcagccagacggaggcggccucuauaacagaugcaccugccugucacuggcucccagcagcccagacuccgucaagggagacaauucagugguuuucagguuccuucugaaaaaagguugaccauguguguagggaccaaaauccagacucccaaugcugccgguguucaguguguguggcccccugcuauuucuggccccugccagcgagcugguuaauugcaguuuaauuaggcaugcauuaaaauuaaaacaaucucaucuugucagagugacacauuggaggugaucaaauuuaucacugcuugacucggcacagcggauccuagaggugucucuggggaagagagagaaagagagcuggcuugugggcuccuuuaccuuucugccucagggccucuuuugggcuugagggugguggcggaacauagguuagcuccgguucuucuauguagcacaggcugaccuugaacucuccauucucuugcuucagccuccuuagggcugggauuaaaagcaugcgacauuaauaacugacugggguugacaccuguaaacacuugacacuugacaccugggccugaggcaccauuaacuacacuuggaccauguaacuuccgguguuccagccuggguucacauguuccccauaucaguggcccugguugugggaccuaggucagcuggaguggcaagggagggucagggauuccccagucaguuuggcagcuuugcuuugauacaggccagucacaguccuugucaucuuggggagagguagacugagcaguacucaaaugggaaagauguccgcuuuggggaaaugucagugacuggcucuaaagccccugaaccacagcgucuauagcauaaugcuggcugguuggguaugugcccagugcagcaaccucccuucccuuucccauguauaacagcaaaauaucauugaugcauaugaucuguguggcagggacagggacacaggaugaccauauuuaaagaaaaaaaaaacagaaacugacauuauuuuaaaaauaaauguauuaguuuucagcaagccacagaauacuugguacacuguagaaacuauaaaauccagaguuugguaccauaaauaaaauuuuauugaaacauggucuccuuguuguuaggaguacacagcugcagaguugagcucccagagacuaguagaguucuagaaucccccagugaggggcugggggcguggcucagugguagagccccugccuagaaucccccagugaggggcaggggguguggcucagugguagagccccugcuuagaaucccccagugaggggcugggggcguggcucagugguggagccccugccuagaaucccccagugaggcaugacucagcaguauagugucugucuagcaguuccugagggcacuggguuccaguggaguaccaguauuugggggcuggggccuucuuaauuaaaaguaaugaaauggaugagccuuaaguuaaacauuucuaaacaaaaucauuuauucuuaaaacaacaauccuuaaaguuaugcuccaacacaaacacuguaaggaaugaaguuaucaggagacaauucugacaagaguguaaaagcucucucucuccucaguaguugaagaaacacauuuguagaagaugugcucucucaguuucuagggcuagugcaguaauguagcaguuuggacuguauagauccauguggcacagcugcgugugcugaucucagucaagacucucagcaguucccucccaauaugagccgugcuuggcuccagguauccacucccaagacccaagaccuucauccuccucuaucccuccguguguacagagccauauccccagcauaguccccagcuuccugcacccggcagagcaccucagcucuaguuugcacacugaguagucucuuuuggguaacgcucacggugcucuccucaugcuuccgugauggaugcagcaggcuaauuccugggagggauagagaauaugagcauagugcugucaucuguccugcaccuggggagaacauggagcuuuccaccuucuagccuccaaggaggaggcugacaccacccaggacaccagccagacccuggacauagcccacugcuaagucaugugacuggcuacaaagugacccacccuccaucugcucaucccucuacucuccuguugcgauauugucuggcuuccaccauguucuguugaguugugcuagggaccaaauccauuuagggcaaguaaacagaaauaaugccacuacgcuuucgauuugggaugcuuguagcuauauuuaauaaugcaaacacacacuuggucauguggagugagcccagcauggacacaggaaacaagguuagccuuccaaggacuucagggagaccuggagaaggaacccaagauagccauugagggcuagagagcagggcugccuguagcuuaacuaccgggacaauuauuaacugcucacagugucuuuaaggcaaaagcaaaggccauaguuguuauuaaaacugauugcugggucagcuguggugguucacacauaucauuccagcacucaaggcgccaaguuacgggauaccuggagcuacagcgugaaauccuuauaaaauaaaggggagaaaaggaaauagaaaaaggaauaucauaauuuuugaaagaagauaaauggaauaaaaagagccaaacagaagccccugagcccagggucucuuuuguguaagaaauuaguacacaugaaaugagcagugagcagaaggccacagcgaccaucgcacagaugucguuaggacaguucuucagugacccugcucuugagccagcacacugaagagagccagaacagccgggaagaaaguagaacuguuaaucugcucacuaaggagccuuugaagccuaagccaagccuguugguacaggcugugaccacagcuacuugggaggcagaaauggagagcucaaguugacgggcagccacugucucccuaagcuguaccccuacaggagaugggaccuggaaacagaagccuugggaagcucacaguccagccagccugggugcucacugaggagcagagaccuucccucagacaggguggaaguggacacaguaaaacuggucagcugaccuucacgaauguauuacggcauguaugcaugugcaggagcacaugcucauaaguaucauacauguacaucucacacacuuuuucauguguuuguaugucacacauaucacauacauguguauacauacaaaguuggcuuuuuuuuuuuuuuuuaguucucaugaaguuuagcugccagcugagucggcugugagaggcccucccacucugauaccugagguaucgcgucagucauaaaguaguccccuucucacucacuucucuggguccagccagaacuucacaacucaagggccaguguggaaaauagauccugagcuggaaccaaggaacagugucaggggauuccccacagcuggaugggacucgggaguggggcuccuacagggagcauggcgcagagcccugccgugucaggcuucuugucccagguccgguagagcugaaagcuauucaucuagugagcguggcccuggcagcacaguagagugagcaagggccuagagcuggagugaaaggacugaagcuauaccucaaguuuugccugaaucccuggccuccucucagcugcugcaaggacugugccuuauaguggagagcugcccugggcaggguucucagcguagccuccucuuauaguggagagcugcccugggcaggguucucagcguagccuccucuuuucagugucucugaagugcaguccaggccuagccuugagacuugagucucgggaagccccucccucagccaguuucuacucuguggacaccaccugggcuucauccagagccagggugaccccagaccucuaucagagcuuaugcugggagcccugcucccauggugugcccucccuccucccucuccugcugacucaccucaccccugcccuccucuggguccuaggcaccuuggagauggagccuuaugcagaugcuuuagucuuguucuguuguguuguuguuuuguuuuagagaugccaaggagcaaacccaaggcucacauagcacuccacuacugagccacaucccuagacuuugagucuuagcccaaguuccccucggcugagggcaaagcuggccuccaucuggucguugugacaccuccccauuccuaccuccccgccccacccccgccucgccccuccccaaccccccacacaaacacacaccagucugcugaggcugcugaguaacugccgcauucccagcuauguugagcugcucggcucacugccuuguuuccuuuccuuccuggcaugucuguaaacuuugcuggguagcugaagccaaguacccaauuagggaucucucuccaguuucauucagccguaauugaagugggagcaucuuagugcaugacacaucaaacaagcgugcguccuggaaccccagccuggauguacauaguggcccugaccuccccaccugagaccugcagggccagacuaggccaggagguguuggcacagccagugcucaccagucaggugggggcagggcccuucagcuugggguccccaugggaagucauccagguguagcuuggcagcuaccacccacccguaguuuccugucuuggagagaggguggcuugcacaccugccugccugggcugucacagggcugacuuuaguagcuagucuguguuccuuggcugugacccaugcgcuguauucuauaccauggggaacauaaccguuugguaugggguccggcugacuuggggcugcuguggggucugucuaacuuaguuggcguaaguacagggaaaguccccagcucucccaggagucugcccugucugucuccccugugugucucaccacuccugcagcagcacccuccauccucggcugucuaagggaguaauuagcucagugauuuagugagcuuacagcgguauucugccuccacgacagccugccuggugauagaauguucccaucacccugauggguccccaaugcccuugcaguggucaacucccacucacagccccaggcagucacugaucuuuccucugccgauuugucuucucagaacauuggucuaaauggacccuacacuacauaggccuuuguucuagcuucugucccuaagcagaauacuguggagguucaaccgugucauagcauggauccauauuccuuuuuauggcugaguaauauuccaccacguggacaacccauguguuuagggaucaagucauugaugauggacauugggcuguguccaccugaggccacugugggucaugcuacuauggacauuggagauagugcccaugucuuauauguagaaggggauuucuggauuaucugauacauguaucaccuuuguaagaaaugaccuaauuguuuuccaaagugguugugccugcugacaucccuuugaggguccccugugcgcucgucacacuccugcaauucgucuuuccugguuucuggacgacaacauccucugugguugcauuucccuaaugacuaaugauucggagcucauuucugcagcuuauuagccauucauacaucuuccucacugagacgccucucacaucggugcccaguuuuuaauuggauuguuugucuucuaaucauuuucuuaaugcuuucgucugauaagcagcguuuuuaauuuugaugaaguguaauuuaucagcucuuccuucuguggcaggcacuuuguccuggggacuccauucacuaugguugccugugauuguuacagaagggcucggcuuuagacccugugccuugcccuguuagauugauaauggaauccaguuucauuuguccucuuugauccucagucaccccagcacaauaggcugcaagacgggcccuguuggcuugcuuucuguugcugugauaagcaccaugaccacagcaguucaggaaggacaggcuugguucggcuuccguguccuucucauagcccacagguacgucaggccaggagcagaggcugucgaggggcacugcucacuugccuucuccccacggcucgcucagccugcuuuccuaugggacccacgccugcacacccagggaugacuauacaacagugaccugggcccucucacaucaaucaguaguagaaaacaugccucacagguuugucaucugaugagggcauuuucuucauaauguuuccugcuuuucagguugacacaagccuaacuagcauacuugccuuccccaaucccagcacucuggagguggaggcaggggauuagaggauuuuuaguuuauccuuggcuaccaaguuguauagaggcuacccugaguuacaacagcagaauagcugcauuacugugacucugaagaucagcuuaugauguggccucuaguccacaaucacucugucuugauggguauauuuggucaacucuccacaggccagccaguccuagaaccucaucccuugucacacuugaagcagaggccaugcguccuccagucucuucuggggaucgcaugcccuuucauaugcuuuucuuucuuuuucuucuuuuucuuuuuuugagauaggguuucucuguguagcccuggcuguccuggaacucacucuguagaccaggcuggccucaaacucagaaauccuccugccucugccucccaagugcugggauuaaaggcgugugccaccaccgccaggcucaugugcuuuuucuaagucagcugcccuguccuugcaccuuuguaaacagguguguugugugauuggggcgggggggucuauuucuauucaccucaaauuuagguggccgugacagaccaaagaaauaauuguauccaagcccagcuuggugacccagugaguuuauuggggucccuuacaggguuguuuauaaugggugaugcauuacucacaggcaugcggaugaguccagcagccgugucauggcccauccagccugcuaaugacguuuguaugcuggguuccuggaauggccagcauaaagagucuccuuccccagcaacuguuuaccaugucugugaccuuggggagaggagggccauugagccuucucccuucacaugggaauauagaucugagagccuccugaggcuuaucacaguccaucugacuucaagccgccaggaccuugucucaccuccuggcccacuguaacacacgcuuucuggccaaccuucagguuuccgaaucucagggcucuuuguccuccuuguuccaagucacacugcaaaguugauuaucaguagugaguaauaggcaugccagucugaaggccaugcugccuugagauuucccaccagauacuacuuugaacacuuucugccaugguacagcaagaugggguggagcggccaugacacacagaucuggcagcccuagcaagacaccuggggcauggggcuccugcccuccuugcccacugugacaguuggggugcaauguguguugucucuauaaaggaccagggguucuuguuaaagugcugagaacuggacaggcuucagggaaacagugggaucgagggccgggggaaggcagggagaugguuuagcugguaaagcucuugucuugccagcaugaggucaguccucacaacccauaucuaaacauaagugcgcagugcccugagcuuaagaucccagcuuugcaaagguggagacguguggauccuuagggcucccugaacagccaccacccuacucgauggcuccaauguuuuuaacauuaugacguacauuuuaauuuauuuuguguaucuggcugugugugaguguagugcguguggauguuaugggacagcuuucacgagucaguuuucucuuucugucuugcaagcccuaggaaacuaacacagaucaaagugaacagcugagaaccaccacucaggguuguucuugaccugcaggaaggcauacacaggcacaugcaugugcaugcucgcgcgcgugcacgcgcgugcgcacacacacacacacacacacacacacacuuaugcaugcacauauauacucacguguaugcauacaauuauguacacaugugugcacacacaggcacacacacaugcuuauacaugcacaaacacucaugugcaugcacauacuuucgcauacguguacacacagggggcaggggauaccacaccugcccugucuaauagaguccaggcaaccuugacucagccccagcagcucuggcuguguuuagucaucagcuuguuauaagaaucaugcugucacaggcccagcuacaagccccaucuggacuccaggccauggggagcagggcugccuuugaugacucucuuugaaagcuaagcauuucuguacucaaugaacucagccaguccccguccccuccuccaagcuaguauguggcaggaagacagguauccccagcuccuuucugcuuaccuggggcuucuccauggucuaaccauggucuuucucuugcugugccugguuccucagcacccagugucuacaccacacccagcaucugcuccaccccagcguccuucccaaaccuucucugcacugcucuggcugcugaguugguucuguagccuuuuccuuaaucugcugucugaagaauugguuccauaucaagucugaggccauggcacgcauuagcagguuuuuaauacacugcuauaucucgaggaggagggacaaaggagauuuaaaacucuugucucgccaagagcagacagauugacucaagacugacuuggucaauaaaagaugagcucuaaacacugucccccccacaagggagcuugccuuccagggaauuaugguuucuguacacccagugucagaaauuaauaauacauccagugugcagaacggauugccagcucucagccuauguagacgugacuucaacacuguggcucugcugugacucguccucgcugccucugcucucuggcuccaucagaguuucuguucuaucuaguggauggcagaccacugccuauguccaaucuucucuuggcagaucaccugccugguacaucuguagaaggaagcuucuggaaguuuguacugaagcagcucuauucucuuguuugugacaugauucucugcuucaaguguuuugggcugggcagggaagagguauguguaugcacacaugaugagguuaugccuauuggucucugauugucucugugugugaacccucucuuugaaagcuguggcucuccuagaggacauaaauagguuuuguguguguguguguguguguguguguguguguguguguguguguguguguaaaauggaucuggacccuagaagaggauguccaaucuccuccuccaucaugguccaucuuaaucuuuugaugcagagucucuucugaaccuggagcuaggcuagcaaucagcaagccccggcauucuuccugucucuucccacaccucacagcucuggggucguaggcauguggccacaccuggcuuuuuaccugagugcuggggauuugaaaccacguccucacacugccauguaucuccccaacucugugacacacugucagaaacagcucucugccccacuauccagccuguugggaauaagaaugagugagugagucuaagcaaggcauagacugagucucguccuuagcucaguagcagcauacaagcccauaggcuguugguuuggauucuguagccucugaucuagcacucagagccuucauuucaguccugccagaggcaagcagcacaagagcucugccuaccaguauugcugaagcaacagcugccccuucuccugaggucacaaugacaaacugaggcacaguuccacuaagguacacuccggaaacccaauaaguuuauugggcuuucuuucagagauuagguuaggggcuacuuacaggaguacaugugcuuauuucugaacaccacucugaaaagccauacccaucagggaugagagcuuccucuuagccacaucaauggaucccucccuccccuuguuuuuccauccuauauauucuagcucaguaguucucaaacuuucuaauacugugacccuuuaauacaguuccucaugcuguggugaccucccccaaccuuaagauuacuuuguuguuacuucauaacuaauuuuacuacuacuacuaugaauuauaaauaucugauaugcagguucagagcagcugugcuagucccucccugaguucaagugcaauuaaggcacaguugccuguaacagguggcaggguccauggugggguauuaacagucaacaggcccagcugggccgguccauuugcaagggggcagagcugaacuucccaggaugguaguuacugagcuuagaggacagucacucacagcagccaggcugauggagcuccauucuugccagugcugucaaucuucugucaucaaaauuggccucacggccaauggcuuuucucuggguccccaaaccuucugccuaucuuggauugggaaugacaacccccaaacuguagcgugaaugcaguugugaccucuuagaaaugcccagcugagaccaguggagaggggucaucagcuccgggagcugggagcacagccuugaugaaugcucccauggcugauagagucaccacaugcaaggcaggacuugcaggagccugcagugcccuuucaccccagggauggauuccuuggggcugcuuccaucugacccucgguguuaccuuaacuguggcaugccuuuggcccauccccacucuccuuucuuacaucuguugccaccuucccugccagagcuucccaaugcagaauuccuaaagggaaauguggccuuuagccagccaagguaggaccccggccauugggauggcugccguuggguaagacgccagcuugugauccaguggucugucaaagaggcucacaugcugccaacaguggcuguggguggaaaauaauccuggugcagugcugacuggcaucucauacucugugaagugucucacccucugcaaugcaucucgcacccugcagagcuuuccagcagugggccagcgggcaugagcaccugcagccagccaggccuugcucuacaguguuucucccuuuuuuguuuguuauuuuuugggagucuuuuuuuuuguuguuguuuaguugguggauugguuugguuugguuuuuuuccuuugagacaggaucucauguaaucuaggcuggccuugaacuucugagcuuucuguuucuaccucccaggugcugauuaauaggugugcacuaacaugucugguuuauacugugcuggggauuaaucccaggacuucauguacgcuaggcaagugcucuaccaacuaagccacauccucagccuuucucucuguaccuucuaaugaccuguguuuccaaggcuacccagucuugguuuuccagucuucuauagcaaugcauacuagagaccuucaaguggggucauagguugcuucaagucacccagccccagugucuaaggagaauuuggacccaucugcucauuuaguccugcugaguuucaauggcuguguguccugggcauuguggaugcugggcuugccccaaggggagccagucucugccuccagggacuuguacagugguggaaguggacucucauccagacaggguucacaggacccucaaagcagggcagcaccagagguacagaaacucaagggaggucuggaaggaggacaccaggugguuuuagcgcuugucccagaaguauauauaguaccaagcacaguucccugugggaggcagaaguccagggccucuuguagcauggcagagaaccauacugcccaggcaugggugggugaaccugaugcacacagcaguguuggaagccaagccagcacuuaggcuggguuuccacaccaguggacagaagggaaauccugucuuaccccuaccuccugcaggaucuaagcagggcuaguccaugucaguggugaugggaagaggucaagcaucugauuggggcccucugggucaguucugggucuacagcaguccccggaacggcggcugcagagguggguagcaaguugacaagggcuacaacuuagagcagcuucgguuacucacaguagugguggucuugggugggagcuuuccauucacaugucccggaugggguggugagggaggccuguugagugguguucagaggcaaccagagacugcagauugaggagcacugacaccaaaaccacgguccuguuccagaugggguugcaugcagcuugaugcccaaccccuggcccuuauuuuccugagccaguaguaaugcagaagugugcaugacucuugcuugucacucacugaaagggccucugcugggcaccucaggcuugugccacagggcagaggccuacucugggaagcauugauguuggggaggaagggcugacucaacagcuaaagcugugaagucagcagcaggagacaugcaggcccauguagcuucagcccacuggccagugguccaagggucuuucugagcugaggccuggguugcugauggaagcuccuguucaagcaccagggcggggccugcaguaguaucuccuugcacccaguagguguuuguggguaucccuccggccuccggccuacuaugauccugaagacccggguugggugaagucaguccucugugccucuggcuugucucugcauccaucauccagggccgugucccucuuacccuggaggacaugcaaaaucaggggcugcugauucucuacugccaagauuacugccacagggacugugcagccuggugcucuagggccucucuugcucugucccuggggugggggagggagucuuacaagaacgaauaugauaucagcgcccgcuugucaccccgggacucucccacccuguaaucuggugggcuguaauugccggugucuuuucaaaucauuuuugugcaaggugacaagcugcuugcuggagugagcaguuaaucacacagagaugccccguuugaaaggcgcucagagcuuacccaggggcggcugccagcagccaggcgggugcgcaugagcugcucaucugcauauaauuccagggcgagcaagcaucacugaggcugguguaaaccaugcaauuuccggcccagcaggggaaugcaggcuggggguggggaccaaaucucuuggcucauggcauugguggaguuaauaguaaccccaucuccauagggcagcaggagaucugauuaguggguuuuaauggccucccacuuugggaaccacagccccucaucuuagaccagcagcccuaccugucacucuccaggguaaguuuagggaagaagguccuagcugggacugcacaucaccugucagccacucuacuggcuggcuuguugugguuuggauuuggggugggcuaguagucucagugcucugugccacacccacuggcuacuccacuuccuucugugugguguccccgaggguugaacccauaguggcccagcaggcccugggucagugcugugggacuccuccugccauccucuccaggcagccacagggaguagggcacagacacccuugucacagccacagcagugccuggccuccacagcugcuaauaaaauugcauaaauauuuuauggcuaauuauuaaauauuuaaaaauguaaaacugggaugguuugaaaguuagcaaggcaugaauaauucaguccuuagaugcacaucagcuuugggucugaacagggccagcaccuccaguaccugcagcagcugggggcauaagucucagggauuucucuggcuagccaccagucccccaggccuagaagccgauacucaagcagggucccuguuaucacauugcaggauaggucucaaccccuucccuuguaaaaugaggaggggguucaugucgccugagccguggccaagcagauaaaaucccuuuaucuuggugagucaguguucaugccucugcagagacuaaaagccaaguauuguccugccaccugaucagacaagaaaguccaaccaugccaucgaccccuggaucccuccaaggggagacgaggaguagacuacuaagcacggccaaagcaucaagaaagccuagagcauggcucucugucuguggguuaauccuucaggcugggcuuguuggaagcagcaccucugccucagguuugaaggccacaguugugcuagcugugaugcgugauauccuaguaccguggugguuuuagcaaggccugaaaaucccaguggauucuguuuacuuuucagaagggaaaauggcuuuccuaagaaucccuaaaguaauguucaaaacucuacuucuagcucuuaaucaggagaugcuggggacauugagguagucacugcuccacuggaccacaccauccugucuucuccuaccccauagcauuauagccaggaagggagagcccaucugcaaagaugggaagcagagaggaaggccacauagucaugggcaucccuggugaccacaguaaagguagcaugcauguuuccugcuggccuauaugugagcauguuuccuuuccaggguguuagagagcuuggcuguauuuccuucuagcaugcucacacucaaguguagguuauugucaugugagugucagugugguaacauacugucucucuguuucuuugccauaacacccagacguguacugccaugccuagcccccccacugugguuguuggaaagagaacagccuucauagguucacauauuuaaacguuugguuuccaguuaguggaacuguuugagaaacauuaggaaguauagccuuguuggaggaggugugucacuaggguggccuugaaagagugauagaccuccuuugacgugucaagaaaggcccaggcucuuucucugccuuccucugguggaucagaagcaagcucuuagcuacuacucuagugccaucccugccugccugugaccauauuucccaccuugaugaucaugcacacccucuaagacuguaagcaagcccucaguuaaauacuucaugaguugccuuggucauggugucuucucacagcaauagaacaguaaccaagacaugugcuuucuugcugcguggcuucuuagcagagagaaagacucuuccuccaguaagaguaugcucugguauguggauacacacaugcacacacacacacacacacacacacacacacacacuucucuacauucagcucugaugggacccauguucaguuggugcucuucugaccuggguacuuaagcacacacauccucaucuugccucggugucauugagguaagccacuaucuuuguaccauguucuuucacauguuugguuuuccgugcugcccgacaugcugacuccuccugggacccucugcagggccugucggugucaucucagugguuagaggugcagugggcucugcuuggauucuuauccuuggcuagugcgccugggaugagaacagggugcucgucucugauaggggucaugugggcucuugcugcaaccacagguaccugcccugauaguccccacugcuaugcagaugcuuccuccccagcccuuucucuuguucucucauuaugucucuugccugagccaagaagguccagugcucuaagaugcuguuguuugccacucacuggaguuggguauaccauucagacagggcucuggaaggccuaucucccaugcuauaacuagaaaccagagcuuugcaaaaccuguaaguuccuuaagaacuugccauggugagguuuuugguuuugguuuuuuuuggcuuuugguuuuugguuuugguuuugaaacagcauuccauguagccuaggcuugucagaacucauuauggagccaagaaugacuuuaacuucugauccuccugccccugccucccauaugcugagauuauaggcauguccugcuauguauggcuggggaucaaacccagggccucuaguugagccguaucaccagcccgucaguaguuuucuuuggaggucauguguuucucuccccaaagagaaaagaauuaggcuuuucuuuguccugcagagcugaccccagguucuccaucagagucaugacagaugucauaggggcugccacuguugugacccagagcuacagcagucuggugcaggugagcaugaggguuuaagacugguagagucuggucugguuugaaucccugcugcugggacaaaaugcugccuuaaaacaacuagggagcaugggggaaguguucauuggcuuacagguuguagucugucacugagagguacugagucaggaacuugacaucaagaccugaagcagacaggaaggcuucacauuaguuuguucucugggcuugcucagcuuccuugcuuauguaucccaggaccaccuuuuccugauggcacugcccauaguuagcuaacccuaccuaccugucuuagcaguuaagacagcacuccaucgacaggcacauaggccagccugaaggagacaguuucucaauugagguucuuucuuccaagguuuguguaaauuuacaaaaacuaaacagccuagggauuagagaaacagcucguugggucagagcacacacugcucucccagagaaccugaguucaguuccuagcacucacccacauuagacaacuuauaaccacuccaccuucaggggcaaucugaugccucuggucucugaggguaccugcauucacaugcacauacccacacuaggauauagacacacauauacauaauuuaaaauaaaaaaauaaaucuaaauaaagaacacaccaggcacccaccuuucuguccacagacuggcacagguggugugcuuacagugagcccuacagccaucuucucccuggauaccucuucucuguaucuaccucgcaugugccccucuggccccacuaguaucagccauccugcagacuugagggcaggagaucugagccauagacgcucauuaccccaacaucucugcucuugggcaggagugcaucaccacuaguuucuaccuggcagagcauaggcuauuuuugcccuguguccuucccucagaacuugcgcagaugccuccugugaguccaaaagggggcugagauggugagggugucagcucagaaacauccuguugccucccuagaacccuggaaccagccaacaggccaggaugagcuuuccacacagacauggaacagagagcagggguuugaggcaaggccucaggugcccgggaccacucuggaaacccccucuggcccaucacagucucugccaccaagucuggcuugaguucuaaugaacaauuacauccuuucccuggcucccaauugucaccugccauacugcuguccuuauaggacauccaggacuguccuugcagagagagccauaggaagggagggauggacagccuuggcuggggauacugaggagugugguucagagcuggaggaucgcagcaaccauagcugcuuccugugacaagauggaggggcagccagagagagcuucaaggaucucaguugccaggagcuagaaugaggccaggggguggcccuauagaucuacagaaggacuccagagcaaagcugcccuccucugggccuuggucucagaauacgcucagagccucuugguggcuugcagcuuccuggguuucaccacaucuaccacccuggcccucacuccuguguuguuaccugcaugcucaugaguggcuaaggacgucuccccaaugccagaguauguuaucacagacccccaaggcccuuugccuccugggagaaggccaaaagcaaccucugcucuuggucacuuugaaagagacugagugacagccugugacagaagaguaaugacacuuccaagguggaacccaucuuuuauuuauuuaauccaaaccaucgagugaauuauucauucuuguuuauguaagccacugagccacagaaguaacaaggaaguugaagcaucccaaaucaaaugauuguuuccaggccuugggcaucaccccuugcuggucugucugccccucccaacaauggccucacucuugucaugaaagaggugucuuccacucccagccgccaagggcaaugggcguuccuucuuuguagccacaaccaugccugugauugcuuggcauguggccagggugacuccucuccauucauccccaugaaguacacagaccuccuccccaggggccuucccugggccuucgcuccacaccuaccugccucugagaucggaauuacacaaaagccuguuaccuuccucaaggucagccugcauuuggucccaagauuuaaucgaccccauuggacaucugaggucuuugagcaguugucacagucucuaauggcugaaacauccuugggaaguguggucagugaauuucuucuccugaugaaggcccucucucagggaggaggggcccagggaugccaggaagagucuugagguuagggcugccaauuaaccuuucauuuucauagucucaucacucgauuaaucaaacuucugggccuguguccuguugaagggacucacacuguggagaacagugucugccaaggccucuguggggugauggaugaaagagccacaggacagggccaguggccaggcaacagccccgcagaagagccucugccuucaggcugggucugucgagccauuucuccucacagccacugguaccagcaugccuugcucaaagugugauuuccucccuagacugugggugggcuguccauuguagaauaugagggguggcaaagguagcagcugcccugcuggagcgcuucaucaguguggguccagugcuuguacucuuugaguuucaguuuccuuguuuauaaaaggggguggggaaauguucaucuggaggugugcauguaugaauuuuccugggaaaaaaaucuguucauucuagauagggcaccaacaacagagcagucugcccaagucuagguuaaugaagcagugaauuuauugggguuacauacaggggccugagugagcaguugcuuacugaagcacugacgacucuaaggagcugcgucaccaaaaagcccaccccagcacagguaacagcucggcaaagcugcauccugaaagcucccaggaaacucgaaggccacucggccaguuggagagucuccuuuccagagcaguugcuguuacccgagaaccauggccugggggugaugugguuuuugagacuuaggcuggucuccagggcucucccuagcuagauccucaaggcuggaucugagggcagccacaugcuaugcuccccugggagaugguguggagacacagaaguggcagaguaaauggggacccagucuucucugguccccguuuucuuccagauugcucaaagcuucuuguccccacauggcucucauaggaagcagucucuggccccacugaucccuagaaagccaucccaucugcgcgugcuaaucauccucuggggcuguggugcacaggacacagccucauccuccuuccugccucaggccugaccucaaacccuuucucugcuccucuuugacggugagccagcccaugaggaccugggacgggccccguccauggagccccuuggacucaaguuucucugacuuagggauaucuuugccacacaagcccaggaccacccuccucaaaagugcccgcauaucauggcugauguuaaguaaccccaguuccucaucacagcgagggagaggucuucagggcccaggcuugcggggcucuccuugugagaaaguuccacgaaggacuuucaggaagugcccagcuugagacagccccucccuguguguaaguggagccggcucaguaaugaacgggguguaaaucagggcuuaauuacucaguaggcaccuugggugagagauucaugguaauugugugugcuccugguggcuuuacgcagcuggcuucucccuaagcaccaguaaaccauggcgggcaauuggggagguggugcucugcccugaaugauauucccagagauauguggaaaguuggggaggggcuccuaggccugguuaucuggagcccacccaguccuugcugagggacaaggaggguccuuuugguuacagguggccagcauguggauccuauaccuaacagucuacaauauccaaacagccucucuuccaucuaccucugucugucucugucucugucucugucucugucucugucucucucucucucucucucucucucucucucucucuguccugugcuagcucauucagggcaaguggccagucccuggaaggaaggagcugaggcugcagccuagugauugucugugugcccagagcaguugggacucugacccucacugcagaacuggacuccuagugcuuccuucuccugcaggcucuagaaccuacugcccagcugggaccaguuccccaccccuacccccaaagcaugacccuguagugcuuuccaacaguaauggaggguggugucauucuacuagcaggguaucuaaucacagcaucuaucucucagagucacuguuguuuuuuguuuuguuuuguuuuaaguacuguuguuaauauaaucaguuuauuauggcucccaccagagggucacacugcuucucuggccucuuguccuuuuucuucuuauuccucagggcucacagauagauggacaccagccucaggcaucggcaggcagcaggaacuccaguuaggccauaguucauccuugcuuguucccccuggccauucucccugucccaccagugcagcaugggacccacgcugugcccuucucccugcagagcugcggaagcagguggaaagugcugagcugaagaaccagcggcugaaggagguuuuccagaccaagauccaggaguuccgcaaaguuugcuacacgcugaccggcuaccagauugacgugaccacggagagccaauaccgccucaccucccgauacgcugagcaccagacggacugccucaucuucaagguaggcagcacugugugugugcaucaagccagcucauucagccacaggcagcucagcucgccuccucauuaggaagaaggucagugcuggccuugguaaaugagucaugugcugagcagccccauguucacauagcauggucuucaguggcaggaggggacacacuggccccuuccuccccacuccugacagucacucaucucuggccacuuggguuuuuuuacuuuauacucugugagucucugccaagguccucccuaugaguuguggcacugugacuuuguccagagguaguaggugcccagaggggugaggggcauggcaggcaucuugcugccagaccucugccaaguggcacagcccauggaagggaaaggacaagcuguaugugccagcuccuugguggucaggccaaagguaccaaagcuggagcuauaaguagcugggcaaggccuucgagcuggggaggaucaguggucuucaggaagcauguaccuguuggagucucauagccagugugcucuaaagaggggucccucuuaacugaagcaagaucaucccagccugagggagggugcuuggaauguggcuaggccagacauguguacaaguucucagagugcccagguccaacagaagugaaguuguuccucaaugggagagggauggcauuguaacugaaaaucugggauuacaagggcuuacccaucacuggcagcaaccuuacuuccugucugugacauggccuuauaguacuagcauggcacauggcccuagaguggccugugaucccagugucgugugugacaggggaagagacucugguuaauaacuguggcugggaagcacagagguuggccagcuccacucugcaccauguguaucugggccacacacaaccucagcagccaggcugucucugcccugcagaaacaggaaccugucuaucuaaacacuguacccagugugaccuacauguuuuaugcagaauuucacagaaaaaaacaguccuggcccagagguuuucgcuguacagugacucacuuauucuuguucccauccgucugucugccuggccccuuucaugggacacugcccaucguggugccaucagacacagcaccuacuguuccuugcaacuuuguggugugucuuggagacuuucuggacuucucaaauuacaucccuccauuuuuacacuucuuagcacucucaaaccuuugacuaaguaaauaaauauuugaacgcccaaagucuuuaagucaguaagcuaucaggaauguauuucuuugcuucuguguaccuuugaauaacucaggaucacugauggguauuuaauuuaaugcaguguaggaauucugugugauuuuuuuuaaaagauugguaaaugaagaugugcugagcagcugucacaaugaacacaucacuuacaucccuguguagacaagaucuaauuugcauuccaaaguauucuaggguuuuuguuguuuugucuuuuggugguaagggaauggaaccuauggccuccugcaugcuagggaggcaagcacuccagucugagcaacacucccagccuuugcggaggccuaugcagcacugccacugaacuacacccccaguucucuuuguacuuuguauuuagagacagggacuuacugcccacaugagccuugaacccuaucuuguagccuuagacuuguaauccuccugccguggugugcacaaccaguuucaggccaggcuauucaagguuacacagugagaaccucacucuaaaaagcuuaagucgcuucuguucuggucuccaaaaggcaaacacagucaccacagugcugcuuugaccccaucacccuauuccaccgaguuccagucuacucagaaguucugcccaccuucuuucugucacuagcccacuuauagagaccuccuagcugucuaugagaccuagcacagccucuauugcacacaauagagugagggcaagaauagcugcuuacuguagcugguacacacuguucucacccucucccaguuccucacuucccauagaggcggaugagguguuccugcccaccaacuguccuugggguugccuagccaaccaugcacacacacagucaccauucuccaggugucagugggucagacccaaggggcacucagugacacuaacccagauaggcaggaaaagcaggcaacugcuuucaacucagggcucagaaacaggccagcuuucccugacuccaggcaggagggacaaggaggagccccguguggucugcugauggauacuucccccagccaaugugguuugagccucuccugggcuccuggcgauaacacccagggcucaaaacccccucaaccucaaaguggccaguguagccgcagcagggccuccucccccaacuucuggcaucagacaggcuagacaugugugccuaugcugggacacuguggaauggcuuggugaaagcugugcuaagugguggccagagaagagcuggcguguugcuguggucacccuugucacaugguggccaaacaagugaagaacuugguauguggugauguauugaaggggcugcauccugugacguugguagaguugggugguggcucauauuguagagagagaagacaguuguaucaugacucucugggcaguccuggguguguaaacucugacuuguacugugguuucuuuguaagaaugcauguucaugagcacauguguacaucuguguguguaggguggagacagaggacacugccaccuguuccucacuaggcacaccaucuaucuuugagaccgucucucacuggccuggaacuugcuaagauggcuagcuagugcuagcccggggcugucuuuuuuuccuccucccuggccugggguugcaagugugccaccaugucuggcuuuuccucauggaucugggugcuuguaaggcaagcacuuucccugagggacugucucccuccuuguagggggcaucugucucuccacagcagggucugaagcagccucuagagucacccguuugccccacucagguucuuguggcccaccccucugcaccaaggacaaugagccuugcaggcagcucagcgagaccaggaaauguuucuuguaggcuuuggcuacaguuuucuccaaagccuccccuuggcuagcuguagcaaccauggcuucagccugcccuucugacucacucccuccucuuaccuggcccuguccaaucgggagaguucuguuccauggccccaugcuauccagcuguggaaggaagugagugcaggaacucagugcuagacacacgcugguccucagagcacugcaguaugagcugguucuaaccagcugucugccuuuaugucaucugcuuuccucaucagucaaaugcagauaauuacagguucugugcaggugugggucacuugagggaccuuguuggugacuaagcuguuaccuacagaugcugcccuccugugugcagccuguggucuuuuuuuuuuuucccugcugacccuggcagagccuuuaaagcaguucuccagcguuguccacagugggcaagcuaggcaagcaagucucaaagaggaaguggcaagaccccaggcacacccuuuccuuacucccaaccccacuuacuccccuaguagggaacaugggugccccggcagcaaccuuagagcaucucuaggccauugggucaccuaugucuucucuccaugguaccaggucccuuccuaggguugaggcccuuuugugccauucuggccucuggggcccacacagcccugagaaaucccccuguacaauguaguaccaguaggaccacaguggaucuuccaacaggaagucucuccccaagacucccaucccaucccaucuuuggucauuauauacccucauacccucuauaauacuauuagagcuaaagcaauuuuauaacccucauccaccagccaauaccuggcuagcagauagggcacucacagaucuauuggagguugguaagagaagaaggaaaauggauagggaccaggcaggaggcagggcuggcucauacacaaguguguggccauggccagcucagucucaggcaaggccacuccaucccccagcucacauaacuuccgcucauuuucuuuucaccccaaacagcuucuaggcaggaggggucuguggcagaguuagaaauagcuggggccuguuuccagccaagcagguucugcaaaugugcgcugggauaauugaggguuggcucacggucccacauggcucugcuucccuucccagccuggacccagccucugccguguguggguggccgagcugccucccaaggcugcugugugggggaaggcaggagcucagcuccagcauacaucaggagucuggcaucuugcccacuccuccucucccaagagaaguuggaccccagagucuccaguuuccuuggaaagacuggaccuggaaggaguggccuaccaaauguccgcagcaauugugguguaaucucauucccugugguucauaaggacugcucagaagguagucagaaacaagaagccagacagcggccaauagaauugacugcauagcucuuaagauacaggugacucugaccuuggguccccuucucucaugccucugaccacuccacagucuagcauggcugggcccagcuuuuuacaugggugcugggauggaacucagguccucaugcaguuuuacuccagaccugucucuuguguuuuccuuuuuucuuuacauaaugucccacuguagcccaggcaggccaugaccaagauccuccugccucugccuggacuucugguacggucaguauccacaguauaagcaccauccuuuuacuagcacaucuugcuaaucagaggccugagccaaaggccaugcuauggugagggcuuuggaggcgccucccaggucucuaggcaaauggcuggacuacucauagcugccuguuccucccagcaaugcugguucaaggugcugggucaugguacugcuguugggauguguguuguggccucugcaccaccaaugggaugucuggcucagccugcaguaugaccauguugccccuuacugugguuuugucucugggcacagugugacauuuguugggauagaagcugcuugaacuaccugccucccaaaacugcagagcuccaccaucccccagcaaccuggcacccuacagugggcacuuccuaaacugugugcccagccucaggauaggcauaucacugugauuccgucugccgagcucuugcggaagcacacagagccuacgcucauagcagaaagagcaggugaggaggcagccagcuuccacacaccuguacccacagugccgggcugccaaagacugcagguguaugcacgggaaaugcaaaugucccagagacccauacccagggcccuucagccaugcagcauaugacuccugcugggugggcucaggagagccugggucaguuucuccauccacaggauagcugugcaaggaaaagaacuuggagucuuuuuccuucuguuuccuaagcaugcuucuuggaggaagggaucauguaucugccaaagcccaguuaauacacacgugauucauggacucaugggugcccaccccuaugucuacagcccagucuccaggagcucagcucagcugcuguggacuggcauaacaacacaguggcuauguuucaauaaaacuuuauuuauggcaccaagcuccgaauuuuauagagugucuacaguaugccaaguauucuuggggcuucuugaaaacuaauacauuuauuuguagaauagcauuagguuuauagagaaguugacaguaaaauaagcuuccccuguguccuagccugugccacaguuuuuuauacugcuauccaaucuugucuauguauggccugguggcuguagucucuaaacccaaucugucuaguugcugggaauugugaagucugugcucauugaauguucuguuugugaaaaugcauuaaaaucugugccaccacucuggugucccagagaguagcugcugucucugaagucuucugaguaucugucaucuccagcuccuacagaucuccuacccauagugcugccauucuuggaaugucccaaaggcaggacccucuguguacuggauucucacacuugagacuccucuggguccuuucugggcuguuuuuauuuuugcagagauagagauacaacccagggcuuuguucacaucaagccaaaugcucuaaccuugaccuacaucucgaagccccucacuagggguuucugggcagguacucagugaaaccacugaguuucaaguccagccuuuagaguuuuuugagauagaaugucgcucuguggcucaggcuggccuccagcuugccaucuucuccccucccuucucaguacuagguuuacaccuugccuauucauuucuuucuauugcugguguugguguauaccacaagugcuauguccagucaccuacugaaggaugucuucuauguccaguuuugauucauuaugaaugggcuccucuacacagagcuuuaaugcacuggcagcuugauaauauacagucucucgcaguucuguugaugcagaggccauagucugccagucucugacaucuacgcauggagcugaguuggggccucucugcggagcagaaauggcccuggggcuacucucaucuccugcuuugguuccugucacacauacacacacucauguacacauacacuuggccucugucugguccacuggugcuucccauauggcaccugcuucucagaagucagaagagcagggucagaaagugguggagaugacguggguuccagugggaacucaugcagcugagcaugugcuucaaagcugggugcuauaugcucagugucaguguuuggagaguggcugaugagcaccagugcccaguaguuauugacaaccccacaucuuccucaaugaaguguauaugggcuguguuaguuaauuuuucucauugcugcacagaauaccuaacagaagcagcuuaaggcaggaaggauuuaguugggcucacagcuucaagugauacaguuuaucaugguagaguuuaucauugugcuggggagguucuacccauagugcuaagagugugagauggcuucuccccacaucuuggugggucagggaagcagagagcucaggauggaaugagaauuagguauagccuucaagguaugggucagaaguagagcacuugccuagaaucccccagugagggacuggguuguggcucagugguagagccccugcuuagaucgccccagugagggacugggguguggcucagugguaguagccuacaaccaccccaugccuuaaauguucuauaaccucccaagagagugccaccagcuggggaccagguguucaaacaaacaaacuuguggggagcauuucacauucagacacuaacacagggugaugcugggcuggaaguaggaagagacccucaguuuacaagcuuugauuguucuccagccucccacagcuaugcuuaucagugguaaauacuucgguagcaaaguugcuggguguugugugccaggcaguaacugggcuagaggcugaguuacuuuauaacacacuuucccaucacacuuugcucaccagcugcugcccuccaaggccuuggaacaguguaugugccugguuccauguggugcagccccuuagugccucucuauauggggcugcagguuccuugacuggauaccauucuuaccagcccugugcucacuguuccaugaugagagcaggcugggugucuguggccauggcuccugccaaagagguguaggcuagccaggcaaaggccugcauccagccagggugguauaugggcaugggcugagauuugcucaggguuuaucgcucccugaugaagcuuucacauuuccacuguaguguagaugugaccuucauagcugccuugccucugccuuuugaagcagccuuguaaacacacagagcaaauuugccugccugcuaugcuuccuccauccaucccacacagaucaggcaugacgccccagguucccagggagguacaguugcucauagaagaagcucugaaagucuuguugucuuggcccuaagucaccccccaaugcccuacaggaagcuuagccugugagguguuccaaguccacugggguaaggugcuacaggacagacagcgauggggagcagcuccaguucucagagagcacugccuuggccuggggcccuguguggccauggcucugcuauuauauaccuagggauagcaugucuacgcuggcagguagcccugccuucagcuccuugucaucaauggucaggccacgggacaagugauaagaacaaaguaggggaaaccagguagugaucgacauguguccuuuguacuacucaggagucaggaagcgguccauccaucccagggcagcacauugucaggcccacccacagccccacuucauggauuagcccauauguaucccucagccuccugcagcuuacacucacccagccuccaccuggugcucacacagugggugugcacuggaugggccaagugcccuguccaucuuccuccauagcauagcagggacaaaagcuguggaagguacucaaagaacaaagagccugagaaagggacaaagcaaccacccucaacuuccuggugugggcagagauuaggcccagguuaugggcacccacaggaccucuugagaguuuguuagaggcccuuagugucaugcacaaaggaaagaucacuacuaccgggggcagcuugaagguccuaccucugacucaggcuaccacagccaaguccuuauccucuauguugcuguggcucccacuauggucugcccccucccucugucuuccuggcucccaccaugaucaaaccuuugucugcugccgugacucccacuguggcacccacuauagcccaccuucuccaccuccucugcuggcuguggcucaccccagccccagcuguucugucucacagcgccuuccuaagcaacagagcaagaggcugagugaggaauccugggcucaauaagggacaccgagauuucauccuggggcugucccuaguagaacagccaacagccuaaagagcaaaagccgggaacacauggccuucuuuagcuacuggcuguuauuagugcugcuguggaaguggcaaugguggcagagcagugcuauccacccagccagccugccagcaugcacccagcuuggcagauuucucacagcagugccugugucccggacacuccagggucacauucuagccaagcauuccugcuucugccaggucaccauagagcuuucucaaaugucaccagaucuaaaagaacaucauaaguggccaggauuagagcagaguuaggaacagggugggccaauggggaagugaaacccaaagaugggaaggguauguuuucugucuggugggauaaggagauagagccuugggcauugcuggcagcagcugggacacaguggacucugacacugaugggguuccacucuagagagggucuccuugcucacccagaagcugcccuccgugcacaucagacuucuaucucucuacccuccuccuacccucuuugcauucauaggaucauggaaacaauggggguggagugacugucugaucacucacagcuguaggccagugguucccaaccuuccuaaugcugagacccuuuaauacaguuccuuguguugugguaacauucccccgaccccccgcuauaaaauuauuuuuauugcuacuucauaacuguaauuuugcuacuguuaugaaucauaauauaaguaucuguguuuuccaaaggucuuaggugaccccugugaaugggucauuugacucccaaggggucacaaugcacagggcacaggccacugcuguaggccaccguggagcccagaaagggagauuuggaagagcagggaaaggagugcaggaugaagcagaccucuggauguagcugugugccacacccuacuuguacugcucuggguuugccugugcccacuuuaggagcugggauuugcagccacugcuuugggagcugucccucccuuggugcugaagcuggaaucaaaggugagguccuggccaguugaaugcuaucccagguaccaagcaccauguuggcuacugcucccaccccuggcccccuaaagacgccacugcuagaaggaacacugucugaagagaggcugccauggaagguuuauucuuucucagggcuugcagcuuuguaccgaugucucugugguaacucagcuuccucacugcuccacucugugccacaugcgaccugaccuucuguguaagcaagaagaagggcccucuggucccugugcgggggcaguucagccaaaagugggugacaggcagcuguccaacaggcccugggagagacagagcauuggguagagaaggcaguccaccgcucucgcccucccucuuuccccccugacaggcaaucaggcccauucacaggcuccuguuggcagaggccggcuucuggaggcuuccugucugccaagauaacaaugagaucuagauagacacuuuaauuugaauuugccuuuuuggguccccugaauuucaaauggaguuguuaagaacgcacgcugacuucaaaaccugccucauuccuucaguugaguuggcauugccuaccaggcucugagaucucaguggugcaggaggcagagugcccugagaccccagcagcagacacauccacucuuaggguggggcuagguucaagaacaguucugcaacagcaaucacuaggucuguuugaggaacagaccugucuggagcuaguuaguccucugccagcagcacaggacaggaaggccagugagcuuggcugaaauuguacaggugggcaaaggaugaguucauggugcagugagugcuaagccccauagcauacccacccaaaacagccgucuuccuccaaggucaacagccaugacccaagauguagcacaguagagaggaacaaacugguuuugguagcagcaguuugugcaaaggcccucuagucaaggaggcugugcauccuuagaacugaaucaaggcaccuggggugagccccacccccuggguauggguucauuucccaaaaccuuggggauccauuccaaagcuuuuaaagaacaucauuggugaugagauggggcuguccaaagaucuuggguuagccuaugcucagauugccucuuuccuagugcggccaucgucucuguauacauaaaugcccuguagagacugaggcaggagaauugcugcaaacucaggucuagucugagccgcauaguuccagaccagccuuagagaaagaccuuguuucauuuaaaaauggacagggagcuagggaaaagauaacccagucaaaccugagggcccaaguucaguucuuagaaccuauguuuuauugcacaugguuuuauuaccaacagcaaggaggcagagacaaagagaucgcugggguucacuagccagccuugccuaaucagagccccaggucccaggaagagagcugcucucaagaaacaaaauggauggcuccuaaggaaagacaucugagauuuccucuggccaccacaugcauaugcacacaugagggagcuuggaagucugugacaaaagagguugccagcccccagccccagagcuggaguuacaggccuugugaggccucacuuaggugccgggaacuaaacucugguccucuggagagcaguaagcuaucuccucagacccuguuagaacuuuguaaagagguggccugugguccagaaguagcccugugcuaaugguuugcagagccugcucuggacuugcaguaugcaaauuaccagccugggucccuauaaauagcaucgcagcacuuagcagauagaaagcagcagccuacugagucuucucacuuauguguaacuucugucaugccuccauauuauuagugugcuuuggagaacccauuaucuuuugaaucucucuuuucuucuucguuuuuuaaucuucugcauuuaaaugcuucacaaacaccuuucaagugugcacacaugcugacagucccgcaccucccugggcugaucuuugcuguuaugcaggaagacccuccuaacuguugcucguaggugggucugcuagcagcccauccccucccuuuguccacagugccuuuauuucaucuucacucacacuggaucugagaaccgauugacggucuuguuuucuuuuagcuucuugacuuuuuuuuuuuucucucauuuucugacucauggguucugaugagaaaucugcucacagaaccuuaccccaguccuugcacagauucuggcucuuccugcagcuggcuuuaugguuucuuuuguguuuaucuuguuuauuguuagucuagcuccuugaguuugugcauuuauaauugagcaaauuuugaagauuuuuaagccaagugugguggcacaggccuguaaucauggcuacaugggaagcugagucagagggauauaagguuggaggccaucuucaacuccagagugaguucagugccagccuggggaacuuaguaagucuuuguuucaaaauaaaaaguaagaggcuggggagauagcucagagauagagauguuugccuccaagccugaugaccagauucuauccccuggauccacaugaugaagagauuugaccuccacauguacaccauggagcuugugccagcccaguaaacaagucaguaacgucauuuuaaaaaguaaguggcgugugugugauacagugguagacauuugccuaaaauucucuagagaggggcuggggaugugacucaguaggacagcaccucuguagagucuaauagcaaggaguuggggacccagcucaaugauaagggguucaccuagcaugugugcagcccugggauccauuucagcaguaccaaaaaauaaugagaagaaacugggggaauucaaguauucuucacaccccucuuaacuccugcagcaccggcuuuagcucuaggcagcuuuggcugcucggcuucagcauagugcugcugagucagcauucuuucccaccuguccucauacuucacucuccaugucucugauaugagcuuuguugguguugaccuuucccucuggaggggcugaucugcuauuaaucucacucaguagcauuuuuauuucaaauacuguuuuucauguuuaaaggaccuaccuauaugguuagagccaggccugguggcgcaggccuguaauccccaaacuuaguagccugagucgggggaauccaaaguucaaggccagccuggacuacuuagcaagagcugccuugguacuggggagauagcugccuuagccagucacauucucgggggacucccagaaacuaugguuuuuaaaaagccaggcauaguaaagagcccuuuccaucccagugcugggaaaacaaacaaccgugggauccuugcaguuuccuggucugccagcccagccugugcaguaaaguuccaggcccaugagagacaaagguaggguggcacacaccuguaaucccagcacuuggaaggcagaggcaggcgaucucuuccaauaccaaccuggaucuccacaguucaguuauugcucauaagauugaaaggcaagcacuugcugguuugguuagaauuuguugggugguucuggggucuuauuggcugcucuugguagagucucugcaggccccauggagaccagagagccuguucucaaguguuccaugugguauguccacccgccacaaccccccccccccgcccucccccccacacacacacacagccgaacugcuucccagagagauugagggaagaaagggcugcaccaggaugggagcuguggcaagcacccauaagugccauccccgacucaaccuccuggcucagcuugucucuuuuuauaaagucaucagcccuauuaaaugcugccucucucucuggccacauuugccuccuuaaaggaccugcucccaaccaccaucauguuggaggaaaggaauugcugucagaauuucaggggauacagaauuucagguaacuccagcccugaccuguugcguguugcccauuuguaccccucagugucuauccaggcagacauucccuguguuuaagagcugcaugguagauagcacagggauugcuguaaaugggauuguagcguaacuucaagggccuuccugaaauguccuuuucuucacuuggacuucuggccgcacugcccacucaccacacaucugugucuacuguucuccacacaccuucucucuuccgcuuugcaaaucugcuggaagguucugaagggggagccaucagugagcagccccagaggauagagucagacccgcccguggggcuuaugcagcucaucugaccagccugcugcugggagaacugucuccugaccggcaggggacaguucuuuguuagucaguuggcccuugccucccucugagcugggaaauucuggagguggaugauagaggccguggcuucucuggaggacccagaauguuaggggagcugcuugccagugugagugggacaaagguagggccucagacugacaggacacagccuggacgacuggauaccgguuacuguggccugauagccauacucaaacccgguccucaggcugcugggcccuguccucaguggccguaccacaccucugccugcccuccaccacaccucugccugcccuccaccacaccucugccugcccuccaccacaccucugccugcccuccaccacaccucugccuucccugcugcaacuguccagugcucucagguucaggcagaaggcuccaacugaagagugagcaacuagcaucccaccagauauuuuuccuuccuggguaaauuuccagcccaccaggcaaucagcaacaggccacuggugcaggugacaucagucugugaaaguagcuugguacccuucuucuuaagggagauauacuccaccacagcccucugcaccaugcccugugacucuuggggucuagggcuuccaucuccuccucccccaucuugucacccaguacagcccuuuguacguguuguuuggugcccugaccuuagccaugugguagugccauuguguguacacuccagugaaaugguauccucugcucuguucuccagcaccauccucagccaaacccauuugcacccuaagcucgcaguucuugagccuucucuuccccagccacugugugagcagcaagcucuccccucuaucacacuacugauauccugacuaucagcaaagugucacccuccuauggguguucggaggccaagccccaaggccagccucaccaccuggaccauccuagcugaaagcugaaagcucagccaccagcaaggauuugggacucaaagugggcccucccgaccccuaacaugucugcccugcugggcucugaggccuccacugaagguaccuggauauacuuccaagguugcaguuuguagcuucauuaguucuaaaggacagcagaggucucugaaccuggggaagaacaggggcuggguucccauguagggcagggacacugcagaugucagccagagccugccuuccuuccuuccuuccuuccuuccuuccuuccuuccuuccuuccuuccuuccuuccuuggagacccuuccagugcugcuacaucugggcccuaguggcgcccaggccacuacagucccugaagaaagccaaggaauuuuaaaaacagcuggguuuugggcuauagacacccuugcuggccugagcaaggaugcaggagacagacagcuccguccccaacucugucauggugcuucugguggcucugggaaaggcugguaaaccaacuccugugcuguugccuucauuucucaugucugccccaggcugaccacagacuuuuuaaucccccugcuucagucccugagugcuuggauuccagguguacuccuguuuacucccugucaaaacagugaguuagcaaguaugguggcucagccagccccagcacagagcaagagccugucuccaaagaaaaaugcaaagaagcaauacccugcugcuucaguacaaauaauggcauguuugugccuaaguuucuuuucuguuguuauaaucaaauacccuugacuuaagguugagaaugguuguuaccacucauaguucaagggugcauauaaugauggggaagucaagacagcagcuggucucagugcaaaccacacagcaggaagcagagagaggugaaccccgugcuucucuguccuuucuccacuuauacaguccaggaucacagccaggugauggugucgcccaugguagguaaguaggucuucccaccucuaggcaaucaaaaagauccaacagacauuggagcccacaguuuugguucccuggugauucuagacucugucagguugacagcacuaaccaccucaguuaguaacugguucaauaauauacgaaaguugaaagaauaauuccagccaagacacaaaugcugguugguaggagaagacccauguuuuggcuuuguacuuggaguaugaugaucagggacugcucacaucauagagccugugguagaaggugcugaauggaaccugugaaggggucucaacagcaagucuucaguaguuccaaguguagaucuccuuaucaaaguaaaaguuugaacuauggcuauagcucagugauagaacccccugccuaucuugcugucuugaauaacucauggaaaguugggcaagcaggcagucccaaagagaugguauagcagcuucccuguugaggggcugggccuggagaacucagacuucucuguuguuucccacaaccugcccagaagugcuguuuggguuucugucuguauucuuauccugcccuccuccucaggaggacauuucccccucagcccccuccagauaucucucuuucugucucucucucugucucuuccucucucucucucucucucucucucucucucucucucucucucucucucucucucucucucucucacacacacacacacacacacacacacacaccccagcagcagcagauguuacuccaaacucuuugccaauggauugugacccucuccuaacuaguguaaaccaaagacagguguccagguguccaggugggccucaagcuuuaauaccagaacccaugcccugugcuguaugugagggcugagccaugugacucuucucaaggucacaggagccaguugcaugccagguaucaccugggcccggcguuggugacagucaagugcagccugcagaggccucccugcucggaguuuuguucugugguuuggcauauaagauucaccauacucugucauuuugaggucaggccugucuuuaacacugggucuuuaacacuucacguauagcagaggagugagaagcaagaaagguccagccccacaacuuccuuuuagcaacuccaucuugaacuuugcccugcccacugugguuaucagcaugggccugcagguaucccacccugcacagagacuggcagcccauccaugcagaggccaagacaagagcaggacuugggcucccagauccccucagcaacugugaucgaugauagugcuaauugacgauuguaacucauuacagacucaccguaauuaaaugacccaucgaugccugggagauuaauggcauggccagcuuacagcaaaguugcauuuagucuuaacucacauuccaguguaaagucucaggaauggugggaucuagaggagggaaccccguauccuuugugacccaggcuuaucccagaguugcccauuccuagucuggggcucccuggaaacaaggaagcuuaaggcucacccugcccucuagagacaaggggugaauuggugaggagccaaaagcauaugccagggaacauuggccugcauuuccccggccucauaugccugucagauuguauggugugaacuugcauacaccaagcugaagagcuuucccugugcugugcagcaccugaggugcucagucauucucucagggauuuuccacacauggccacggggcagcagcaaugguccccuugcuggucugagugccacugauucaccguggugacuccuggguguuccagggccuucccugugcaggguccaggaagcuaauggugucucuguggggugugaggcuaccacgugugcuagguggaaacucaguguguggaauaucaaaugugggaagggaccaccacacuucauaucuccuguguugcggcuuugcugugcagcguaugcaguguaccagagggucagugugcagaauaccaaauguucuggggagccaccccacuuacugacugucuugugugucagcagcacugugcaagguaucugcuguaccugagggucuucugugugcuguaucagauaugucagggucacuguguagggugucacgugggcuaggggucaugaugcagguugacagggcacauggaguuauccagugaggugcugauccaguaucugccaggcugagggguacuguguagaauuuggucuuuggggacaucacuguuuaaguauaccaggggagucacuauagaauagcagauuuucugggagccaaugcugccaacacaguggccacagcuaucugggccuugguaaaccuggugggcaggccagggagccacucugcucugcaggaaaggacuacuuggaacagaugacugagcucaguuuccaugucaccuacuguugccaccucagaaggcaugggcaguccccacagagggcuggcugguucccagucaucgacuggagagacacugcagugugagcucugccuuccucucccuccuuagaguuguggaaagugcuggucagugugcuuuugccagccugguggucagcacuauuggaagcuuuucuggguauagcuggaagacaccacagcccugccauacugaggcaucaccucugugucuaucucuguccuaggaagagugcugccauguauagacaagccaguccucccuugugguggcucugcccucaguguccuaaagcagaggcccagacaugccccuaguggcucuuaccaugaguggguuuaucuaucacauacuugaagucaagagcaucagagcuugggugaucugacaagggccacauuggcucugcacuuugucaggggagcagcaggacuuggcagcuggcuuugaaaaagcuuugaggggugcaagcacaaaguguggccccugggaagccuacuugaauccaauaacucauggaauacugagaaagagguaugcaggguaaggagcuuuugggcucaguauggcauguguguacacaugaccuuccaggauccucccagcugguacucuuaucuaccugaagcugugguuucugcuuucuuccuguaaacuugcuucuguagccaucucugagucccagccccugguuacuucagcauucagcaguauagaaacuggcuaagaguauggguucucagaaguccuggcccugcacaugugcuaugcugaccccagucaggccucagcugccucagguaguacugaaaaggaucuuggugcugagaugccagcagcuugcuguccuggccauguuccucuugcugugcuccgagugcaucccagggucagguucagaagucaugggauggcaugguguggaagguccuggagccuagcaaagcuccggagcucgggcaguccaguugcuuuucugggauggagccaugcaauucagaaucuccaauucaggcugccacaaaguggcauuugggucuccacccugccuucaugugaccuugggcaaauggucuacuuccuugggaaugcuguggugucagauacacccaugcguaagugccugggcacacuuugguaugagcugugugacaugcccuaguuaaggagucaaggcccaggacauagcagugacuaaacucagaaggguggcaguggaguucacagcuuucuuccuccaugcugggagcaggugugacagaagcaggaaggacaggcuggagaguuugccagagcucagugucucuccuuauucuaggaggugggggagaggcgagcaaggacaaugcuuuaauugugugauuuugaucugggcagagacucuuaaaugcuuuguaaucuauuuuuaauaagucauucaaacaagcccagcuccaguuaacguccagagccgauagccugccaugcccgccccacccaaucccuuugaagggagacugcccuucgcuuccccuucccucacacccugucuucagucucacagaaaccucugucuaaggagagaaacaauggacuuguggccauuucuuugccugacuuugggaagauuggacuggccgaggugucuagaaugcaaacauggcccgcugauagaauuucuaucaagacaugucugagaugagcaggguacacuggcaugggcuguggcagaccccaaaugucauccagucucagcccuauucgcugagugccuguaugagagacuagcuguucacucucuacugaaggacaaauggacaggcucccagaguuauccugggggcugccaggaacacagauguggcugcuggccuucuccucccaugcccccacucuguucuagacaggaagcuauugagcucugcgacuccaggcacugugcccuacugaccucugcgacuccaggcacugugcccuacugaccucugcgacuccaggcacugugcucuacugaccucugugacuccaggcacugugcccuacugaccucugcgacuccaggcacuaugcccuacugaccucugcgacuccaggcacugugcccuacugaccucuucgacuccaggcacugugcccuacugaccucugcgacuccaggcacugugcucuacugaccucugugacuccaggcacugugcccuacugaccucugcgacuccaggcacugugcccauuacucuccuccuccuccuggcucucaaucccaggaaauucugagagccccaugugggggccagcuguauuaugugucccuggccuauagccuggcuaugccaguuugucagaaaagguaccucaggacauuguuguggacagccaucuugcuuuccccuucccacccuggcuucacuaagacuccugguuucccacacuucaacuauuguggugaaccuuagccucagccccacuccucucauuaaugggccauaaaugcuucacugcuuccuauucuguagcccggaacacaggcaacaugggcaguggcaccucacaaagaccaugcugguuuagcaguucucucuucccacagcuucaacucugucuggugaaaggaggccuaagagggcaacaaugagguugcauuuaguugagccacgcacacaugcaugguguccaauauggcaccaauucugcaaggucuggccauggggcucccagcaucugucagcgugcccucacucggcagcuccagccauuccugacuagacagccaucccugccucuccucaccuguugcuugcccuccucaccagaugacuccuguggugcuaucgcaugaagggccucagaggaucccuguuagccugugcaguaacuccaaucacuuuccacagcauggugucugcugcccuuugccccuucucucacucaguucucuauuggugauugaacaagguacaggcucaaccagcagugagugaaucucagaaaaguucuaaaguaucacucaccagccaacgguagcagcacuuggaagcugagaagcaggaggaucacuucagggacagucuaagcuguaugaaacccuguuucaaaaagacaagaguugaggcuggggagaccaccuuguauuuguugugcaggcaugaagacuaaguucaauccgcagccccuaauaaaagcugggcucugagguguuuguguguaaugauauccagagcggggugauaggagucagagaccagcagauuccuguagcuugcuggcuagccagucuagcugaaccaguuagcuuuggauucaguaaaaacaucugacaucaagcccaguaugggggugcacgccuuuaauuccaucacucagacagcauauggauuucuaugaauuccaaggcuagccugguguauauagugaguucccagacagccagggauacauagugagacccugucucaaacaaacaacuuauaagcaaaaacaaccuccaugcacagaagaaacauagggcucugaaccuaacagagauagggaaaagccagggcacugugauagccuacaggcaggaggacuggcugagagaaagagcagucacuccauagcucacaauggccugucucugguucucuacauuccaagucuccaaggcagccuguucugauuagcugugcaaacuuaauuaguucacauccaaguuuguggaaggcaucccucaagggagcugugugaacagccucugguuaccaagaagaccagauuccaugccgagguggcaguauuaauauugaacauagccugcucaggcugccagccuuccccagcaaagucucaucuuccugguggcuucuugaacaugccaccuuguaaauaauauuaaagcaauuucuucuggggugucaggaaaagagaaggaguggguaggguauccaaaagcacccugucuaacucugugaggugagcaccagcucuagggacacaucacccuugccaagagccccagaucgagccaggucaccagcacugaaugaggcuggccucaccugcucuugagccuacaacauggggugggcuuggcuggauaaaugcccaucaggaguuuuucagguucccuccaguaugucugacugucuagaaaacacuucugcuccuaacaguugcccagcugcggcugccaacgcauuuugcggguguuucagauucacccuuuagagacucucucagcagggguuggggugcucaaaagcuagaagcaauuuggauaaugacacauccuguuccagagcuuccccaaucaaagggaauggccaggccuuugaucuucaguucccuggaguacugaaaagauagacagucacccccucugcugugcccccaggcccuacccagaacagggcccuagccugaccuccuggguauugaccuaacucugggggagacuguacccccuacucagaagagugauuccugcuccugcgcucuucuauaggugccauccccagacucccuccagggggagcaccuauccugucugcucacuccaccccagcucuccuuuggggagcaccugucuuauaggccccauccugggucuccuauguuugccuuguucacuucaucccaggccucccuccggggagggcaccuuacuguucgcuucacacaaccucaccccacucccccagaccaccugcucugcugacucccaaacugacagcuguauggcauacuccuugcugacugguuucucacuauuuccucuaggcuuucuucaauggccuagagcagcuagugucagugcacagcuagugagcucuccaggggugucagaaccccuguccaacagggcaaaugugggccucagggaggugacaucucuccaagccugaggcuccuuguucugaacccagcuagcuauaguagacacuagagacugccuacuacagcucuggcucagugcccuccagcuuccuguaggcuuggccccccaacagccauauguaggaagcuuguuacagacacugcccaggcugggcucccugcucgucuccugggucugccacuggccacacauccugccucgggcucauguugcugauauauaaugggcucuccauggacccuugauugguuucuaacuagguccccagcccaucucuuccuccgucccuucucugccugaauggucacaucaggcacuugccucugggccucuucugaggcccccucaauuggugcuaccuuuucaugaagcccugggucuggacuuagaacaggcuaguggucugagugugucccccuccacauccccagcuccaugccagaacugcuccacaauaagugccccuuggccuauaccuccccucccccaccccccuuguuuauuaacucagaucagcagacagaauuuuccuguuucuguugaauuuauuccauaauuacccccuguuggcagcaaacuguacuuauuccuuuuuacaauagagaugcaaagguuauuuuaugugaaguuuauuuauguuaaugagauguugaauauaucacagccugcagcuguugucagguaaccuccacuggugggcugacccuaaucaggcuagucaccgugcacauggggcuccgccuuacacaccuggcuccgcccugcacaccuggccccuucacugugcuugggaaacagguugcacugucuuuggaucaagugcagcccugacucaaguccucaggccccuguucuggcccccuggaagacuugggaugggggcaagaugggaauugagggcugaggggaaaggccagugggccucuaggcuaggacuucuaaacucccucucugucacugucuuuuucaacccaacaagaagguaagauagguacacaaaccauuguucauaauaaaucagaaaagaaauuuacuugaaaaaauucuuuguccuacauauaauuuuuaccaccuauuaaagcggaagcaaguuuacauacuaguagauggguuugucuguuuagagggugugggugcacaugggugcacauggaggucagaggacagccuugaugacauuccucaggcaccucauacuuugugauugagugagacuggaucucucauuggucugaaacaucaccaaguaggcuacccauccacagagccauccaccugugucugccuccaucuuuaccauaauaggauuacaaguguguauuacugaacccagcuuuuuucauagauucuggggauugaacucaaacacucacgcuuaugagaccagcacuuuacuaaccaagccguuuccuagcccuccuguuuuccauuguuuagugucugcugcucugggauguggaccaccuucaacauuugauuuuauaauugucaaggcuaagaacuccuucacauaaauaugccauacaaguggcagaugcauguuuaggcacauuucagaaauugguggggauucugcccuaaucaaaaaacaaaguuuugaaaauuuuaacaguuuugaaacccaagucagcagcuguaagagcaauuuuuaaaucuucaguacagugcaaagauaugcuaauuugauacuuucauugcuaaggacuggcaaucagaagauauaggaaagccuuugcauuccacgacuaaaccauuauguuucaagaagagcagaagacauuguaugugcagucagacugcaguucacaacauccagugguccugaaucuuaggcaguguuggaggcaccucauugguggugcuguggcacacacauaugcacugccacauguuaagagaagagacuacaguggugcugugagaugcagcccaggggagcucuguuggaaaaggcucucgcucauccaucacuugcugguuuugaauuacuucucagucuugguaccagcacaaaccuuuuacuguuuccauaauguuuuguggccucuacauccaguuacauagucuccucguagauggugaccccccagcugaagaagcugcuucuaggcagggcuucuccugccuccugggagauacuuggcaggucuggagaucuacauggagacuacugggacauuguuacuucuaaugaguuaaggucagggguauugcaauguaccaaagauuuccccaucuacuaaaaaauggcucacuguacagugagagcuuaggaccuguucuugggguagccuggucacugcuaagacuugggcacuaugcugucuagagaacacagagggcuuuguggguaaaugggcucaaucugucuacaugccccaugucucucccuuaccuaagaagacugccaucuuggcaccaucagaccaagagugaucauaucagcagaugacauggucuuguaggaagcugaccagcccaugucuuauuuauucucagccuagcuccagucucggucaaugggcaccuguucagagagguagagccucucugagguagggcacaugcuagccagggccuccaugaggaggauagacccagcuggagcccagagccucacccugugcugccuucauuggccucuucucuccucccugcuuguugcuucccagcccuccuugguguacuagcugagcaggccaggcuaccuccugcauccccacauuaagccccaacaugacucccggccaugcugcgccuugcuguugucccauuuuugcagcagagagcaccaugaagcaggcagcauagcauuucugucccugacccagggcagcccggcaguuguuguguuauucuuccaccuaaccagccuucugaguaguuuccgccuuaucgucagguccuuacaaagucccugggcuguggcuaguggacccugagagaggcugccccaccagguuccacuucaacucagcagcagcugucccaugcccuuugugacugauacccucuccuuagcauaaggacaacagagcucccaaguccagguucaucuccagcacccauagaagccaguccugccccaaagucaguggaguuccagccagguagccaccaccuccacuaguucaugcuagcacuaaaugccugccuguggccuguguguuucugccaagccuggagacuaugugccaggcuguguccuuccucugaguguuccugcuacugcaggcaguauaaacaggagggccaggggaguagcccacuuucggccauaugucgcuggccugucaguguuaaucaacugcagccuccaaccaaggccuccuagacgccucccaguggccugcacuacccacaugucaugugacaggguacaugguccuuuucaugaugaggucaguugagcaucuacaggagagggauacaucugggaacacccagcaugcuauuuguaccauacagugugccacacagaagacagacuggguuccccauggucuugugugcccaaagccaauacuggccucccuucuugucccaccuagcccuuauuagcaagacacagcuuaucuuacuugcaugaagucuuccugggcaacaggcuuuagaccaaccugcaguuacccauggagcugcagcuccgugaaggagggacagaggacauggcagcacauuagugcaaugcauggccucaaccacaccuauuaccugagaagccauuucuuggaaagguaacauggcccagggagcaaagccagcccuacuguggagcuagcaugggcuccuuggguuugguccaacccagaagcaggcauuuggcccacagaugccucucuucucaaauaugcauucuuguaggaagagcacagaagcccagguuaccucccuagaggugcugcugaguugaugacauuaacacagaggcauguacaucuguggggguggugcccucuuauggaaggaacaugcugugcggugagagggggccauuugugaagagcuuggggaaaacauuguaagaaauuauaggggcucuggccauggcugugugugcugcguaucacugcuuaucggcuguuuccccaagccuugguguuugacuacccuccaccuggaguuaaggacacuugcucugggggaucaggguuaucuggccucauuuccuuaguacuuuaggguacaggaggaguggccaugggaagacucaugugcuccagcagguggugcaccucugcaacccuggcuuggggcuaacggcugcaggcaaagcugucucaugcaguggguccucaggaacugcccuguagaagggugguuuacauuucugcuuuauuucaauuaaaugcuugggacuacaugugucugcucguauuaaugaaugccaaguuccguaccuugacaaucucuagcuccacagacaacccauuccccauuuucuaaacaucuuuucaaagacagcucugccucugcugggcgggugucucacacacacauugugugugugcuuuuuaacaguacaagugcccacugugccacaggucugguucagcucuucaaaguggugcuuccugaagccucuuucuucccaguggcugcccagcgagccuggaagccacugaaugcccagcuuucgcucuggaacgucaggucagugggcucccaggcagaauggcguguauguggacgguggaucucucugacuucucuacaguucgccuaagaucucaaugggaucuguggccccaggaagccaggccguauguuucaccuccuagaugcacaaggggcuugcccaguacccugggccucagaggguggaccagcugcugcagaugcccugggccagggugcaacacgugguacuuccagggcccagccaucagccacacacugagaaagacaagccuuuguuccuaccauggugcugacauuauuacagacauguguggacaaugcagacucuuaagucuuuuaacaagucaccucaccucuggcauccugucacucugugccccucauacccuguggguccacaugggaucugauguaacacagaaaggagcaggucagaggacuucaagguuuaaaugccuuguuaguuccgcagccugcaccccagugccuccuacccuggggcaggggucccuguaguccacgaggcugcuacuggucaggauuagagagacuggggaggaggccacagaggaggaauguggaugugucccucugugucauuguuggcugcuuaaggaaaggaacucugucucuguaggagggggagcuuccugcagaugcugcuccucccuucccccugcccacaccugaaccuaagggucugguaaggaccauaccaggagccucagcaggacucuggcuggcucuaggcucccaguggguauggccuugggguucuccaucaucccugguagaaaggcacaaugcaggcucugagaagcagacacacucaccgccaagcucacccuguccugucccauccuguccugucugaucccguuuuaggccuggccucauuaucccaaugcuuguacccacugugcccucagccugcucuucacuaacauauggaguguucaaguccagcagcaacacugauagaacucagaguucucuugaguggggagcacccacauagagaacuuagagccucagccucaccucucaguccuugacuucugccuaagcaggugacuccccagcaaacaagcaagugaaaacaccuguggaccagcaucucgcaucagagccagcauuccucaugugggccaggagggcuggggcuagccuugggugcagcuggagccugaaguacagggaacaggcaccugcaggaauagaccacaaaacccccauucccaggccacagcgaggcagcuaggaugcccaggggacccugugaugcucugggaccccccuuuccguuacugauggcacucugguaaugauuuccccacucacaaccugaccccaugcugaggaaaagcaaguugaaauuaaauuaaauuucaaauguuaaaccaaccaauuaaaaaaugcaaucacacggaaacaugcauuuuucaaaacaguguuguuuauucugucauaauuaauguaugcagagcggagagucuggguucccuagggcagccugcuccagcacaggccauagccuggacguggcaacacacuggcagcuccuggcacuuucugaccccaggccccaggauuucuacucugccuuccugcacccagcaaucccuggagaaggagguggugguggaggaagaggaggaggaggaggaggaggaggagguggaggaggaggaggagguagccagauugcaagccccuagcccuggccaucaguugggcauccuuucugcuguacccuuugcuucuucccgggccgcuuacccuguaccucccacccccucaggcuagcgcagagacuuuggcccgcugugcuuccccacauccuccaccagcccugcuccuucacauaaagagcuucucacaggaguggagcaggggauccguguuagcccaagucugugauggcagagccaacaagggcugagagagccuaugcuaagcugugcuugaggucucacuagguagggcacagaaaugcugucccucaugcccaccguugugaacgacucccuaacagggcucuccagggaccugauacuucuucacaggugucucagcucuaguucuauaugaggugcaggcagccacuuccacacauggccauugaugucucuguuacagggaaaggcaggugcggguccucuccccaugugcuucagaugaugccccuaguggucacugucaggaaggagacucuagcuccacccaggccuugcuucugcucugucucuccuuuccuuccuccuuggucuccccuacucaggaacugucugcaagugcuccuuggagaauguaugugugugagcagggaugacaggagauaugacaaggcaaggccuucagguggugaccagaaggaaacaguucuaacugucguacacagcuccaucugcucaucuugaaggcuacugugugcugggcuaggcauccacaggaaggcugugucacaaacagaaguuuauguccccaacacacacaguaguuuaugucuaccuuugaugcacaaggaaccuauggggguuugggggcucuuaaguuuccuccaggugguaccaggaucugccacauaguagacaacucuagaauauuccagagucaccucauacuacugaccugaaaguaccuacagcuuuucugcacaguggauggguggagcuauggcuccccucccuucugacagcaguuguuggggaaacuuucuggacuuggguaggagccaccaggcagcuccucccaagcuccucuuuauuaaugacgcuuaucgcugcucacauggagcucagcgaaugcagaaggugguugauaaacagccaggcaacagacugcagugauggauaaccugcucaauaauuaacaaaugagccaacagaugguggggguggguggggaggauaggcaggugaugcuauguguacuaaaugccuuguuccuccccuugucuccagccaacuggguguggccugcgccccugcaggaagguacucuuccucuaccugcuuagaauggagcuaggaugugacaggcagcugcugaaggccaggguccuccacccagucuagcuucuggaaucugggugguucuuuccccaggacaacgugggagacagagccucagcaaagagauucucuagcugcagauccaaugaguuggucucguugacuuggaacuaccuagggcaguuguuuucuuuuccauuucuucugggauggccauguuauuccagccugccacacccuuguacuuuggauuguguaauuugcuuggcuucacucugaagggggacuaggcugggggugggcguaucugaggcuugccugucuccgcuguagaugacauuuggugggacuccagcccugagauguguaaacuaaggaaccuccgcagcagacacugcucugccgggccucaaucuugguauuuauaccugagaacuaugacgguucuugucaucuuugugccaccugacacaaagcaccauggcagaagcuacaagccaggucuaccagugggagccugggcagucagaguuucggaagucccaggcucugugcuucaguaacugccaugggucagcuguguacggccauugccuuagcuuugaaaagugcgcagauaggagcagccaggagcuuggaggguaaggacgggacacagccucugugcuggugcaugcagcuucugcccagaagauaaagggggauguuuaugcagcaccaugacaaaucuuacaauuguucgucauauugagaugccucaauacgccauacuacagucagggagagcuacccuccuaccugauagauaaacagccaagagauagaauugcugucuaauuuccgcagagcuuuccgguggcugagguaaugagggagccccuguucuuggcugcuugguucuuggaacaaagucacagggagaggcucccaggugaucccucagccacuugcccauagacuuaacucauccggcugcuucucuccugaaccugaaugggagaugaaggaaaaaucacaugguaagcaggccugaaauaacagggccuccuugcaggcacaagaggacuugacagcagggguggaccaugucucuuggacagggucagaccacagcugugacucagagguaugacagaagagggccagggaaggccucugcugcagauauaguuacugcuuugccauccucccgucccaccaggacccacuagagucugcugagugagugcagcuacuccaugcucugucccuuguaggaaaagccagccagccucuguaauugugccauguguuacucacagaaccuucucaccaggccaccugacaguugucaugccuacugugguaggcucccaucaggucaggccugucacccuugcacaaagguggcaauguggacaaagcagagaugcccccaauugccagucuaccuggcacguccuuagugcuuuggcccagggacuucuuccucggggcuucuagguccuucuccaagaucuccaggguuguggauccacugagggacuuucugaccacaggcaucuuuacuacccauggcgggcccaucguuaguacucaggguguguggagagaagggaggaagaacugacuugugguguaggagggagcugccuucccugcaggcugagcccacaucucagaccucaguuuccgcuccuaccacucuucaugugucugcuccagaaaccgaagauggccgcucucuccacugccugggugaagggccagaagcaccagcagcagucauuaggcugccucagacgccuggugauuuagcagugugauuaccugcuaaugcaauaccucacaaagcuuuuuauuagauuuuucccccuuuuccuuccaaacacccuuuggaaauaaacaccugaggcuguuacacucuauaccacucauuuuaauuaacuuuuaaaucacguacugucacccagaccucccucaaauguuaacuccggacuggacugggcugggcugggcuuggagaccugcucucucugcuuugucucugcccacgggguggggacucucuggagcucagccucaaguggccuugaguggacauuugcugcuuuugugagguugguccuacuacccaguagaggacccgaugaacucaaggggcaccaccuugguccugggcacacauagauggcacagcagacaccaccgccuucccuacugccuacaugugggucugaacagcacacucuugccccucacaugggcccagcucauggcuaggacauugugggaaccuauggacauacaaccucggccuucucaggucacuucugcaugaucaguggaaacuaugguacccaccccuguaaucugucaguagccucugaucuugugcucaugccccgacuccugugccuuucccuagccacaccugccggcccucacauucugcauuuaagagccuguggcauucaggucuccauuuaacucucagucauagaggauggcucuucccaggagaggcagaauacagggugggucaucaugccauagcagaaggguggcucagacaagggugccauuacacauaacuacuuccauccagcgucccaguguuccaucuacuguagaggaauuccauccaacauagcaggguuuuacccagcauaccaggaucccacccagcauguuaggguuccaucuaauauaauacgauucuguccagcauaaagggguuccacccagcauguuaggguucugcccaguauacuagaguucuguccccagccuacugcauccugggguuucauccagcauacagguauucuaucuaacaugcuggaguuuguccaguuuccagcgucccaggguuaacccaguguaccauaauuccauccggauugcuggcgugcucucuaauauacugaggugccguuuggcguuguggagugccguguaauguaucgggagccaucugucguaccuuucguuuagcguuguggagugccguguaacguaucgggagccauccgucguaccuuuccuucuugugccugcucacuggcugguuuucuucccugcucuguggucacgugggacuggcaggcucauacucuuccccacuucauuuucauucaagcucuaaaaggccuggaguucuggugggguccucuugugccggcugcuuggcaugguagugguagcggccauuguagccaguuuuucuaggagcuuguagugcauuggacagggugaucagggucacaguggaccccuugcccuugucuguaccuuccccacagggcaccagacccugguucugucuggccuuccuccagcuaguuuuguaguuaguguguggucagcucuucccucugcccuauuggcuacuggucaggccacaaaggcugagauucugguguccccucuagucuccucuguggguuucagucccuuguccuucugucaucucugaaagguggugggaacuggaagguucccgguauauacccauagaacucaauuccagcugccuauaacugugaucaucccaccagagugcaaauuggacaugaggaucuuggcgcuagaugcaucuguaguuuuaugcuuguaaagauggguccccugcaugcccaaacauuguggguggguuugggaugacccuccauauacuuacuucacagucacagaagcaaguugggucagcgugccugcaaaggccucagcccagaacuugacacuuggagcacucuuauguacuagcuaagugucaugcugugugcaggggaagcauauagcugacugucaagugagcagugaagggaugguccucugcuucugagucaucccaaggcuuccugguccucuguagccuugaguccugggagccccugggccuggccucaaacugacaucaccuuuccugcagggcagugggugugggggaaagagagaauuggagaaaaccugaauuuugccagaguucuggugcucuagcagguggauucaggagaacugucgcacauuuuccacguggcccugagugggugucuggcugugggaagcuacuggaccccagcuuggcaaagagugaacaagggacagcccuaggaacaggcucuuagucucgggcaucccagacacagcuggacaccgcagaagagcugagaacaaaucggggccccaggggaggcucagucagcccuguggacgaagggaggagagggcaggggcagagggggugcuggguggugcccaugagggcgagaguccuugguccgguccuuggcuggagcgcaggaagguuagaugcgacucguuaggagaaagccuauccacauuguucaagcucagcaggccuugaugagcagagagcaaagacagucuauaguuuuagagcuuuauuguaaaaaggcagggagaaagagagaagguagaaagagggagaccaccagccauggccauggagagaagggggaagggagagagaggaagagagcuagagaggagaguaagaaaggugagagcuuaaagagagugaggaggggccaagcagccccuuuuauaguggccugggcuaucuugcuguugccagguaacuguagggaggagcauaucuggcuauagucagguaacuguggggguggagucuagccagaaugccagaagcuugggacauugucuguguaacuuacagucacagaauuauggaguugggggcucgguggugucaggcaccugacucugggaaugcuguucugucccauguagaguuuucugcugggucgccagagcaagccucauucgaccaaaauaggcugccuuucacggccucacacuuuccuagcccaggauaggaaccuguaucccuaggcucugggucugucaggagcccugcaggaauuugagggauucuaggaaagagaguuccuaacagcccccauaggcccugacauggggugccauccccgguacaggacaccugcaccaggcagccagcuagcacugggacuggggcauucuucaauacacauauguauugggaauggucgucugucuccagaaacaggaauaaagagggcuaguaaggagcagcucccgcaacccccaggaaguagagcucccuguuguugcugcccauggcauaggcccaucccaaggggcuuccaaaacaagucauccaggagcagccugugaugagccacccuacccucggggggaaggggcugcccagcuauuuagcccagugcuuggcaaaggugggcacugcccuacagcugugugucugcacugcucagaucagcaaaggccaagagagagaugucugcagcauuguucuggaaauuagcuuccccucucccugaaggucgugcacuccacuagaaaauuaaccaauauuuuccuaaucaaaugagacugccuccuccuuggaggagagguggcuguguccagaagcucauucaucuuggaaggcagcagcacccacgugggcccuuguuuuauuaaauaaccuuuccuguauggcugucucuccaccuguggccaagugcuagaacugaggggaggauggccugguguaacaaguagggggaggcuugccccauucuuggcuacaccaucaugacugccugaugucuccacagcacauauccucggguuuaauccuccuuccucauuaauguccuaugggccugauuaucuaguucugcuucccccuguguaugccaucaccuagugguccugcacaagaugcuguaauucagagcagucccccauccauacaaccugagccaagaagggcaugugcccagccagccaaccccaagaggucuuggaauucacccucauagcuugagccugcaccugguacccacuaccccucaagccaagugcugggcuaguccagcaccgguaaggcacauggacucuugaguuuucaaaacugugacccuaaagaguaaagaauugagccaggcauggcagcacaagccagucaucccagcugaagcagggaggacuuuggguucugggcuaaccuugccuauaucgugauagacuaacuucaaagcagcccagcuguggaggugacuaugaggaaaguacuugugagagcugaguucaauccauagcacccauguccagguugaccugaaacucacuauguagcccaggcuggccuuacauucauacagaucugcuugccuccaccuccugacugcaggguggaugaacaaugugccauugacugguguagaccaucuugcugcagauaaagugucauuuuacccagagccaugcuucauaucuguugcuaagagaggagggacaugucccauugcaacaucaacaacagaccguguaucacauagacccucaggcuuacauggcuugguuauguggcugaaaguucucuguaggaugcucacacuggaauggcgaugccuggccuggcauuugccuagaacgugcuuuguuauugaugacacauuacuucaugugugagaagacaauuguguauguaugcacaugcacaagcuggaagggaagugguugucacucuuacuguagagcucugaguaagcuaagucagugagggaucagugccuucucuguguuuuccuaaagcaacagaacaccuguaaaaaacaaguuuggagggcuaggggaauggaaugcaugagaaucugaguucaaaccccaaaauccacguaaaaaaacaaaaaaccaggcaugaugguguguauuuacaaaccuaaugcaacagagguggagacagaaaagucccugggguucgcuggcuagccaaaucaaugagccacagguucagugagagaccaugucucacagaagauagagagcaacagaggaagaucuccaacccugaccucuggcccccacacacucacaggcauuugcaucccugugcacacaccaaaacaaaaacaaagaugggggggggggcuagagagauggcuggggaauuaagagcacuuguuguucuuagggaggaugguucgccgcaccacaucaaguggcucacaaccuccucuaccuucagcuccaggggauccaacaaccgcuucugaacuccauagccaccugcacccauauccacauauccauaugguuauauauaugaucuuagcucacucagaacauacucucucucucucucucucucucucucucucacacacacacacacacacacacacacacacacacacacaagaacaagggcagguaugguggcaacaugcauuuaauuccagugcucagaggcagaggcaagcagcucuuguuauagcuugacacuagugaguucaugccagccagggcugcacauggagacucugucugaaagcugggagguguaucaucaaugccguuacccccagcagcaggaaacauugccauuuugcugaguaugacccccucucuugcuugccccaguccuuacaguuaggauagccugggaguguaccgcgccugucuauucagucugcuuauuuauucacauaaacacucugugauccaaagagcuccaucucauuccaccuggcccucacuuccgaggcacagacguugaugucugaagggucaggugaccugcccauagguccauagcugcagguucuggcagaugucaggauaucccaaacacccuuccauggagcucugucugcagccaccacugcgugcaacugaguuaugggaccaggggcucugucagugucuggguuggauguguguagcuuccuaagggcauccuccaaugucacaugacggcuguaugccaagugagcagccggugccuagccugccacuguguacgucacucagcccuugcccauccacacugcucagggguauccaggaagaaaaacagagcuugcuaaauggaaaaggacaaacucaguuggaaaagagauguggucuucaacacccuggacaaguagagagggugcuuucccuuuccugagacagaugacaacaucagaguccacucaaaaucauuuccuaaagcaaaucacaggaugguaccugccggaugugagaugauuuguauucuauucuuggggccaaggagcaaauugacuacagagcguguuuugcgauuucuuuuuuaaaugaaugccaucaaugaaacugcagcagcaacagcagcacacggacucuccugcugcaagacagggacagagacaaucccagcaccgcucaagccacaggauucgcuccaaaggcagacagcaccuuccucaugcugaccaaggauguugaccacccccucccuaugcccuuuucuacagagagcaagacacuuugagcagucugcaggugccaccuccaaagcaucugccacguccugagucagcugcacucagccauccuuccccucaccugcuuucuugcugguggaguuaggaggacacuugguuccaaagaccagguggauucagguggucacuuccuucuucccucaucuccuucaugguuagacacugcaucccccaucacccugugggucuggagcaccccucuagugcacacagugugucaguuguagaauccugggaguaaaggaacuaaugaaguggcaucagucacccauccugaaagugguuugugaccuucugaucucccccugaaacucugcauuacucaagggagagguggcacugguugcuaccagugcagccucagggcuggcuggagccugcggauaugaagccuauugggcaagugauuggccuggaaauggaggacugguucuugugucauguggagaaugggagaugggugagcgcugggcucaccauucacuaggucaccacacaugcugaguucugagccaacugagguggggcuggcaaagucccugaggcuggccaaggucagacaguggccucuucugcacuggaauucugugcuuugcaugugacugaucagggcucacuuugcauuagggcccugucucaagucagcaaggcugcaagaggcucugaguagagccugacccuggagggaagcagagccccuuuccugcuguucaacuccaggggcuuguagacccugugccuauugugaguuaguaugccuggggccugcccucacccuauagggcacaccucauagggaugguagguaaaaugaccauggcugcucaccagccagcuacacauugucuuccacaguccugacaagacccugggcagguauugucuccccacaccugagccuguguuccugaccucccugaggaagcucugagacaguugguggagcucaucaugagcagccucuguagggccuaugagcuggccccuccccaccaugcagccugaggaagucccucgaaagagguuuaagucugguaccuccaaugcugacccucaaggaaaggccacaagguagccucaggagagggcuaugugggagcuuccuggcuaggaucugcuguaaauacccaccuagaguccuguggguagccucccaucugagauccuccuggccacccaucucuacccuguaaagcacaaagucacaaaccacugugcucugucaaccacagaccucuccauugcucacagaugucaaaaggcuggggucaugggaaagcuguguucccugggagcaugucuagaugugugucaagcuggguccacccuguaggaggcucagugacacuggaugagacaccucuaaaauugcuggcuacuuucuaaaaucgccuuuuaaucccaacaaagacauaaauggcugugaacaguccaacaugcccuccuggccacccucccucacaccagucccauugacuuugugggcucaguccucuuacaaaagaacggaccuccucuguguuccucucucaccuacacucacucacucacugguccuggccaaaggcuucaacugugcugagcucagcaggagggaggggcagaucagugucaugaggccauggccucuggguaaagaaugacuuagcucuccugcucugugagcccuggccucagcccagcagagucuugcuggcacucucuaagaagacuggaccaggacaaagccugccauuucaaaaaugagccuggagccugggucuccuccccaaucuuuguuuuugacuccuucauauuaggacucccuguaggagacaugcacuuuggcagugggauguuuuaauugccucucaaaauagcuuacaauaaagaacacuaaacugugacuaaccaauuguauuuaaggaagcccuggcacagucagaggugggccagcugauggagccugcccacucacacagucauggagcuaccguguggccauguaggcccugacccccucugggcuuccugccacaguccccugggccgguuucaauugaguguucccgagaagggaguguuacucugcagcaucagugaauauccacaaucagagaaccucagccccaaagcgaaagcagccagcagcacgggcagcugaugcuaccagacucuccacacagaaacuguaccgucagagacucuugaauaaaacagccagggcaggaaggggcacuccucuucauggacccugcuucccuaagcaguccaguagccauuuucauccaccaucucuauguaacucagcccuaggggcgagcuucucccuugagucucacacuagucuugcuuucccuugacauuggaacuuucagcuagcuagcucucucucacccagaggaggaggcacugaguuggucugcaagcuaagccaugggaagugaucauggacaagugaccugcacgugugcauguagcauuugauccauggacucugcccuguucuauguccuagaggguccuggaugugcccugcacuuucaaggagcccaugagcagagggagaagggaagaucugaggcaggguccauugccacccucugagggcacaagaguauuggacauguggcggagauggauugggaaggaccuaaagaagauacuuugauggaucuuucuggcacggaggacaugcaucccuccucaaucauuccugaaggugcucgccuagagauggcaaggaacaggcacccaguacccuggggucuuucuuccagcaauugcaagauagccauacagauccugaguagagagcagagccaccccucagggcuguaacccggaagcuugcccaugcagggcuucagccagaggaagccgggagccaggugggaagggcugcauguggaucccagaauccguugccucaucucucuuaauuacuggcagggcaguugcugaguugaacuggagcuggaaagccucagugaguaauuacugucagaaacacaagaucuacaaagccguaagcucacagcuuggugauguuaccgagucuaauuaaaaaacaagaaagaaaauucucuuucaugaucgacuuucagggccagugaaagaugaaaagcaaggcagcuugcaguugaugccaacaccaaggguaagugagcaguccacacagagacaggcagacaugcuaggguggccagggucccugggauguccucagccaggaagcaccugugacucacaagagggcuaagucaccugacauaacaguguccaagaugaguacuaccuuuugcggugcuggggacauuccuaugaauagacuucucccuccagccagucucuacuguaggugguuggggaaguugacuucuaccagaagccccugcccugccagagccuccagcaggccugccugagguggggcaguggggcagugguuucugguagcauaggcaccuuugaaccuuagaccuucugagcagccucacuauucuggauuccuccuugggaagagguugccaugggcagcacaucucugaaaacaguuauugacuggaugcccugcuagaugccaccgguccauguggugggaacuagauggacguccgucaguccucgaugcagccagccuagaagggucugcacagagguggauucaguauggugagugauggagacuuuguggccuucaucucacggugcccacggcugucaggaaggccaggcagcugccuuguuaguucgucugcuugagaacucccagcagaggcacuggaugagucugaaguaggacagaacagcccaguccugggccaggcaccagcagggugugugugaggaacuucccagccauuuucugagaagcaaguggccugucccacuggggccacucugccacaugucagacuucaggcgagugagacacacagcgaggagagcgcguccucgccccuccaagccuucagagauuuaccucugaaagucgugucauucacaggauauuuuuaacccagaaccaacaaaucugccuuuuagcaucagcugcagcaacagccugcgccugcagcuuugagagcagaugguugcccggcugucaucuaugucccugggcccaccaggagcccugagccacaccugccacauaggaagggcagcugccuucagcgagguaugccagagccacugagcacaacuccccacuaagcacugguccugagaggccaucacagaucagagaagccuaaaccucgauccuggccacuuugccaacacacagucaaggccugguccucagagucacucugugcucaccuggccuucuucacuccuacuccaucccuggggacagggugggccucagcccuuuuccauucaagcugaguguggugccccagacccuuacaacccaaauaaagaagaccucaugguggagugugggucaaaguacacacuggcagcaccuagguucccuaggccacaggguucccaucacagagcaggcuggccauggaugacccaguaugccuggcuuugaguggaaugucacauguagcaaaugacaggcucucaggaaggaagccagccauggguagagauaaggcuuuucucuuagaaaauauuuucauaguguuuucauaauucccuccuuagccuguguuuagcugcauggugacagaaaucaggugaugggcugggcugugagcccugcgguacucacucugcuaagucccuagacucacagggggccuucccuuccaguguggacaguuggcagccaggcccuuacuguuaaaccacuuauuaagacacauuucccggggcuaggguuccacugagcuggagggcaccgacagagaugagggaggggugccaggggagcagauguugaugccaguaucuuccaccauggcucucucagagggagaugguagggauaguuuucuauuccucuccacucuuuuuaaauaugcauuuguuuauuauuacugcauguaugugguggggcaggggcugcauggcacagugcuuauguggacguuagcggauaacuuuaugcagugggcuuuccccugccuguggagguuccagggacugaacuuggauugucaggcuccugcggcaaacaccuuaguuacugagacaccuugccagcuccaugacuuuuguucuguuuuagugauucugggacuugaaccccugaucuugguugggcuugugaggcuuugugguuggcccuugcuaccuacuuucuaagacagggucucugacugaaccagagcucauagcuuggcuccagguuggcggugaguucuggggaugugccugcccugcagagccccuaccacugagcaagcauugcagacagucacccucccugcuggcuuccacaugugugccgggagcugagcccauacucaccagccagcucucggcccucuuguggaacuuucugaggucuguaccacuugccuuccaaaguuccaucucuccugauccuccacaguccuccucccugcuucaggaauuacuguggcaggguaccuguguggcaaacagaggacaucuuuuguagagugaguucucuccuuccaccuuuccgagggcuccaaguaucaaagucaggucuucaagcugcauggcaaguucuuacccaucuuuuuagccccuuggcucauuuuucaaaacuagguuguguauuuccuuguuacuggauuucaggagucuuuguauagcuggacacacaacauuuaucagccauaaaccaugcuauguucuccuaggccaggcuuuuuaggaaaaguaucagccuagggcccccaagaccaaguucucagugccaaggagauugauuugccccagagggacagaaggcaaggaauuagagacaaagacaggagauagaagauaagggagaaggggaaaggaggugaaggagggguauuuguccuggaggacaaaaggacugucucuggauagagaagagacagccacagucaauaagcaaaugguacaagaggaaaaccuguauuaggaugagguguaauuggacuuguucaagugaauuuaagggggcuuuugauugcuggauuuccguacuuugauagcugggccuugguagucagccucagaaggagaaaguggccaaauggggaaauaggccuuaguagccagcuucaggaauguaaucuaacaguuuuuuagcaagacagaggagaugggagagaagggcaaggccugccugagucauguucacuacacacuugagcuggccagagucccuucaacauuugucuuuuucauucucugaaagcauuuaggaagagcagaaguucuaacuuuggauaguucaucaguccuuuguuugugcagugugcaucugguguuagauauaaggaggauuucucuccaugcuuuucuucuaggaguucuauuguguacauuuuacaggucucauccauuggaguugacuuucagaucugauacuaagcauguuuugaaauucucucaugcaccuauagagggcuggggauguggcucagaccgaaaaguauuuuugccuagcacgcacaaagcccuggguucuguccuaauaccauauaaaccugguaugcugguacaugccuguaaucccaguguuccagaguggacaggaggaucaaagccucccuuagcuacuuagagaguuuaaggccagccuggacuucaugcgugucucaaaaaaugugugugaggugcacacauacuuucauguguccugguacagugacauugcuuagaaaauacugaguuaccuuugugcuuuggccaugaaccugagucagccucagggugagccaccaccaccccucuaucugugcuuguuacugcuucauccuugcccagcuagucaauuuuuuuuuuugaaaaaaaauuuuuuuuugcuccagcuuugcucuuuuucagaucaugugggaaucccaggguauguagaucuccuuccaaacucuagucucagccguucauauucuaugaagcgggaaggcagcucggguguugacugggcaugcaccaacugugcagauugucuggggaugcugcaucuuagcaacgcagcucccagccgaagagggcuuccucugagcccgucuucucaucuccauccugcagcugccucaaucuucucucaaucuuucccuaggugauucauguuucaguguuguuauaaaaaauauuggcuuacacuuuucauuucuguuuguuguucaugucgaacacccuaggaugccgccugcauagaggugguguguaggcaucuccaucuucucucuccugugagagagcauucacuccugccccucagggauggguuccaccgugugcuguucacaugcacuccugguccgauucuacuuugcaaggaugcuuggguuuguuuuguuuuauguuuguuuuugaaaaaugcauguugggaaagugccucacuagauaagaauacuugcuauagcuacaaggacuugcauuugagacccacaaccuacauaagaagucaggcacaguggcucacacuugucacaccaguacuggggaggcagacaacaguagguguuagggcuuuccaggcagccacauuccggaucuaugagagauccuaucucagugaugaagaaggcuguccucuggccuccacgugcacauaaacauacauacaccugagcaaacacccccuccccccacagagccacacacauaaaauguguuaacuuacacacucuguauaucugguuugaggugaaugugugcuuucuuuuucauggguaauaguugagucaccaugagucuccagugccaggcaaccuuguauucuuggagaagccugaguggguuacuguuuggaaugggcaggcacuuggucccagcagguuacucuaccuggggaagucuggagacuuuaggagguagggccuuacuagaggaaacaggucauuagguguguacccuuuagugcuauguggccuaugucguccuguuuggccccaguauucuccucugcuucucagccaaagggcucuaaggguucuauuuugccauggcuccugccaugacugagaaacuggaaaacaaagcaucuuucaguguuuuuuuuuuuuuugcagcuauauaaugugacugauguggaggcagaggggcuggggaguggcucagucaguaaaacguuugccuugcaagcgugaagacuugaguuuaauccccagaaauauacauuuuuaaaauuggggcucaggcuucuauccuugugcuggggagauagagacaggaggaucccugaggcucaugccagccuggccagccuaaucaguggacaccaggccagggagagacugucucaaaaaauaaaauccaaggcagacuguacuuggacuaacauccaagguugaccuguggccuucacacgugugagcauacaugugcaaagguaguuacacaaguggcucacacacaguuguaagguaguuucacugcacggugagagggcccuuguuuuguaguuugugccuuuucuuuaggaugucuucagauuuugauuucauaacagagcugaguaggguugacagguuuuugguuuuugguuuuucaagacaggguuucucuguauagcccuggcuguucuggaacuuacuuuguagaccaggcuggccucaaacucagaaauccgccugccucugccucccgagugcugggauuaaaggcgugcgccaccacagcuuuuuagaaaucaucuauguaaguggcuagagguauggcugagugguagagagcccagaguccuccugagccuggagagaggcucagcagaggcucuuacuguuaugcaugcgccucugggguccauccucagaaaugcaaaauggcuaaguagaugggugaguggauugaugaaugguugcuuuauuguauagaucagcuugggagucaggcuuguaggccuugugugucugaagacccuucaagguuguuaucccacagguguugaguucaggguugcugguccacucuuuguugcccccuguggugguuugaauaugcuuggcccagggagugucacuauuuggagguauggccuuguuggaguaggugugucacugugggugugggcuuuaauacccccaccuuagcugccuggaagcuaguauucuguuagcugccuucagaauaagauguagaacucucagcuccuccuguaccaugccugccgggaugcugccaugccuccgccuugaugauaauggacugaaccucugaaccuguaagccagccccaauuaaauuguuguccuuguaaaaguugccuuggccguagugucugcucacagcaaggaaacccucacugagacaccccauuaucuccuuaccgucauuguuuucagggagaaauacacugccgcucuuaucuucguuccucuguagagaaagcauuucugccccaccagcugcuuggagaucuuguuuucccugaaggugagcaagcuggagguguguguucugaugccguuuucuucuugccuuguuuggagugugugucauuuccucaagaaucuuuccaucccccaugucgguuacacaucacuggauaacagcucccaguggccaguucugaaggcaggaucugaggaggcacugcucaagggcucccuugaccgcagucaccuagggucuccugggaaggauggguacagacccuuacacagagccgucaccaggguguuuccuccguagcugcugccuggaagccucugucaguucucugucacacacggggcugcucacuuggaaguagagaguccagcagcaccaucagagcugagugugagguagcagaacccucccagcuuggugccacacagcuggucugaagccgaucccagccaaggguggggacugaugcggcuguguuaccuggaugugguuuguugagagcuguucacaggcaccacuaugcucuggccucugcuuuggacucuagauguauguggagcccugucauaugacccugucauguuacccauagaugggugggugauuucuccuuugucauuuugguaucuccuccccuggcgucucugagauuacucauccucucagggcaguguguggcccugcucauccuguuucuuggggccaugcucacuguggggugggcugggccuucuccugcuuuucugucucugagcuuuuggucacauggugugaaauaacggugagguaauguuacccaugagggcuguccccuaguccucauuucuuuucucugugagccgugcauuccugaguuuuccgguaaccagcugaccaucaguggguacugacucugccuugucugggccccagacuucuguagauuacaguaaauauuguugacuuugcaguagaguuaucuggaagcaguuugaaccuuggagaccuugguuuaagauuugugagguaggacccaacuguagggauuccuucugcccugccacugaugucaaaccuuuucagugucuccugaguccccacaagcuguccuggggcugggagagagggcaguuuucagcccugggagcuacaagugcuggcuggcuucccucuggucuuuuaauuuguucuggccagguggcuuuuuacaccaguugccagucaccauccaacagaagagagcacacuugaagucaucuccuccucucccacgucagcccucucccugcaaccucaggacccccauuucuauuugucccuuuaggucccuugacuugaaaacugugcuucauaguuugugguuugugguaccuuucacaugugugauuguaugagugacuauaugcaugcauauaugcacauguaguagguuacaggaguccauaugcuugugggggggcaucuccucaaugccuucauuuguuuacuuaugggguggggcacgugcacaacguuaguggggccagaggagaguugguucucugcuucuacuaugugagucugaaagaucaaacucaggucaucagguucggugaugcaccucuaccugcugagcccucuggccaacucucuaucuuauuuuaugaggcaggaucucucagugaagcugcagcuuacuggcucagcuaggcuggcuggaaucugccugucucagcucuccuagagacagggucacagaugugccaucccuggcuuuagagcaggguuauagaugcuuccugccaugucuggcuuuagaauaguguuacggaucugcacugcugucccugacuuuagaagcauacaagagaccuggacuuagcuccucguggguaccaugggcuuuuuacccaugagaccucucccuggcuccuugucucauuuggacuauuucuuaggguuaagugacucaauuccuauuccauugccuugaccgagagcucugcacguggguuggagccucugaaucuccuacggccccccacaaaggcaccagucccuguuuuauaugaggauacuagcucagagaaggaaaacaguguuacacccuggucacgcagcaacuaagagugacagcugggguguaucucaccaggugaugucaacgcucuaaguaugauggcuccaggaaaagccacucucagagacccagggcccuguagguggcagacagacgagggaggagaccagcucaacuuuugugucucccugccguuggcaagaugaccaaggcuucagagcagagcaacccgggugcccuggcucucccacacuccaguguccgggcuguagaaaagugacuuccugccuuuccccuuuccucagggcugaauugcacagccucccguccacuacuguuuuccucucugcccccucuucucuaggauguccugggcccccguagccuccgagcauauaggaaaccugugaagggccagggcucccuugucugcccuuuagauagaacccacaggcucugucccugcccuguauccuccauucccucccaaagcugcaggagcagcuguggaacucugaagcaaagcgcaagccugggggacgcagugcucauaaauagaaagcaucuaauaauaauaauuguggguuugagacucguuaggggcugcaaggcccagccucacccccccccccuccacacacacacacagcuccagagggaaaggucaccccuagccaggaugguaaauucuuuucaugcuuugucauuagcucacacuacauuggauacuuuccuuggcacaguucagcagggacaccaggcaagccauuugccauacagacaguuucuacucuuggaauuccacguggguccaucauuaucagcccuguccucaucauccugaacucauguccgccaguuccuucuggggucuagcaacuuggggcacaggaggaagauggaagccuggucauacuggaugccagcuauccuagagcacacuggcacagcacuucccaugagccacuggucccagguuaggugagagggagcucugguggguaaaggagggagggacuuggggcagguauaaaauggcugucauuaaaagggucccugggcugagcuuacugaaguaguuugcugucucuaccacccagauagcacaggcucucaaggccugcacacugcacacacugacagugugagccaggguggggauggcagccacuguagugucaacagagcagaggggacaucuaucccaaguauagaugcugaggaauagggagacuguggagggcaccauguucccugggcuugagcagauagggacucacccagugcuggcucauggaagguccuuagcaucccucuggccaugugcucagccaccccaacaucccugucuggaucuccuuggcuucacacacacaagucacauccccuacccaaagcccuacagcccugcaggccuugggaucagacuccugcuggagguggaggcaugggucaaagugcagaggcugacaaucgucagcagugggcaucuucaucucugcugcgcugguccccagcacagagggagagggagcuagagacggcacaugcacguagcccauaaauaugucuaaccgcagccagcacgucuaacugggcaauuugcuuuuuaaaaaauugcgcucuaauuuuaagugaacagccccuaauuauggugauuugcaggcaccugggaaccggguggcauuugaacacggcagaacagugcagggacugauuggcggggugucauucagcccgcacuugcugauaagccaggaccacuucacugggugggucuguaccaggaggugagccuacccgugccaaggcgggcagggcaacgggaggagagagagagugggagagggacuguggaaggaccuaacugggccaugcccaacuuguguacaaaccucagacuugguuuuguuugagacuugcaaagagagacauuuccugccccuccaaccuccagaaggaccugccaggacuuguacuggccacaaagagguuccgugagcagauacccaaccggguuggaguggguuucauguggccucuuuagcucuugccuauuuaucaggagaggcgaguggugcuggcagcugagacaggucucuuucagauaaagaaugggugugguggccugucaucugagcuacuuggaaaacagaugcagaaggaccauaguucaaggccaaccuggguaacuugggagaccuucucucaaaauaaaacaauauuaacaagaggacuggaguguggcucagugguagagccccugccuagaaucccccagugaggggcuggggguguggcucagugguagagccccugccuagaaucccccagugagggacugggguguggcucagugguagagccccugccuagaaucccccagugaggggcugggguguggcucagugguagagccccugccuagaaucccccagugaggggcugggggcguggcucagugguagagccccugccuagaaucccccagugaggggcuggggguguggcucagugguagagccccugccuagaaucccccagugaggggcuggggguguggcucagugguagagccccugccuagaaucccccagugaggggcuggggguguggcucagugguagagccccugccuagaaucccccagugaggggcugggggcguggcucagugguagagccccugccuagaaucccccagugaggggcugggggcguggcucagugguagagccccugccuagaaucccccagugaggggcuggggguguggcucagugguagagcaccugacuacaguucucuagugaaaggacuagagguguagcuugauguuaggguacuuaccuaaccugugugaugcucuggguuccauuuccaguaccacacuuagacagacacacaucuggggaggggcaggggagacaugacacccagaaguuccugcugaggggacccagaccaugggugggcugggacaggaaagaacccuggagguucuccuuccacccuaacccacccccacccagccagcucugccugcuccuucccaaacagcugccucagagucagccccugugacauuucaggaaaaacauugcgagucgagagcagaagggagaaaugaaaggauuuucucaagaaaaggucagagugguuucucuuauuuuuguuuaaagaugguuuguguugaacuaugacaaggcuaaauguauuaagggccaugggaacaggcugggggucggccuacgugagaaaacaggaggaaaacccagguaacaagcaagacaggagacagcuuggggaagcagugagacagagccucccauucccugauggcccuugagggauggggugaaagggaggugggggccucagcagcugcagucuccccagguccccucuuguucaugcuagggagucaguggcagucacagagugccaggaccuaagggaacagccugacuaucugugugacucucaggaauagggucaccugcagagccgcuggcaggagggaccucucagaacaaacuccuagaugccuugagccaugcauccagguccucauuagcacgcccacuaugcauuguucauucgcacaggcuaaaucacagagaaacacuauccccaaagcaggcauucucagcccuccccgugguacacaccaccagccuccugccacugcccuguugucuuguagagacgccucaugccaauggcaccacauaaacagccuacuaugugcaaagucccuagagcuuguuccuuuucauggcuggauuauuuauucacauauguguagcuaaacugcacuguguucaucccugcaucccugcaggucaugucacuguggacauuggugucuagguggccugggagcacuggagggacagcaguagaucucaugaccauguuugggcacugcgaggcucgcccacaggaacugacagcugccagugauucucagcuguucugacuucuucucauccuucccaugccugccuuuccucagacggcucuucugaugggcucuggccugguuuacaaccccagagacccacuuccuucugucagacccccaugcuucuucuuuggagaaccagcuaaucugcucugcuccuaauugggcccucugucuuucugagucuuaaguggggagggcuaccccacucagacccaagguuugcgagugguccuauguggaguugugacuucuugccuggccuugccagaaggggcuuuucucuucuacccaagugguccuucuauauuuugggccacuaagguauggcugggcaaauuggcaggggaggccccaggauaagugagcguugggaaaggaaggaugacgggaaggcccaggggcucugucugcuucucccagcccagccugcauagugaaggguagccugcccagacagccuguaaccugggcaaacccagggaaacugcgcucuguacacugcagcugugacccuggcuguaagcugcaaacccaccuccccuucacagcuaucgaucgcagagccauuguguccucccuucaguuacacaugacauaagaaaacagggcaagauggugggacucauggcucuagcugcauuuguagcagagaauggccuaguuggucaucaaugggaggagaggcccuugguccugugaagguucuaugccccaguauaggggaaugccagggccaggaagagggaguggguggguuggugagcaggcagaggggggaagggauaagggguuuuuggaggggaaacuaggaagggggauaacauuugaaauguaaauaaagaaaauaucuaaaaaaaauuuaaauugucaaucaaucaaacagggcaagaaucaguuagagcuccagaguucaccgucagggcuaaaccuccaucucaaugcccagcauccuggcuucagccuggaagaugcucugggcuugcuucaccucaccaggucaggcaagaaacagcugaggauccagguacuggaauggagguccccaggaaucuguagccuguuguaguugggauaguccugaggcaagacuggcucccugcugugaaucucaguucccucugccuugaacuuugccucagugggcagcucaagccuacugagugcaugaagcaagccagggccccuguagcucaggcuccacucuaguggcaggcaacaagcuuuccacggggggagcaugugaggacagacaccuguccaauagccaccgcugacucaacucucuucucuccuccugcaggccacaggacccucgggcuccaagaugcagcugcuggagacagaguucucacggucugugccugagcucauugaacugcacuugcugcagcaggacagcaucccugccuuccucagugcgcucaccauagagcuguucagccgccagaccucuaucuagccucuucccaugagcaucuucacuacagccgcuggaccucggccuagccuguaccugcagcuucucacaugcagcccccagaccuugagcuagcucuuggucuacaguugcccacaucauccccagaucccuuugccacccauagcugcaucaugucacaaacacuagccguggccucugcucaagcagccacugucucuugucccuggcuaggagcaagcuacuggggaugaccaagccagaucauaccccacuacucuccuccccaccccaccccauucuagagccgcuccacguacugucccaagguguaccccagccuccagucccaugcgcugguugcuuaggcuucaguggccagacuguagccuguguccacagucucagacuaaugaaauaaagugcuaccuuuaucuuccuucccggau

SEQ ID NO: 12107 - RNA, 13212 nt, Mus musculus
gggauuuggcgcccccccuccuaggaucucucuauauaaggcaagcaguccggacucccgauacacgcguuuccaacuugaguuggugugugucgaagaauccugaccaacuacgaccuggggagagcagccaaccgagaagguccaccgagccucgccuaggucugcugcgcgggcugcgguccggagccuucuccggaccgcggucacccaguggaccgggccgucgcgggaccccucauccuucguggcaucgcagaggaauccucguguggugaguaugguuaggauuuuuuuuuuuuuuuuaacuccaagaaaacggucacacgcaauccccguuuuacaucgggagcugcgggagauaaaaguagcgccccccaaaauaucuccucgcaaauuuugucaagccuucaguggccagauccugagacgagagcguggaaagcaagucuucacggcuucggguccgcgaauucgguuuccacgacucgcguccagaaauggucgguagacacaugagcugcggacagcgaugagcugcagacgcacaugagcuacugaccgaauugugaugagcuccccaaauacgcugcaaagugacuggcucugcacucuuaagugccgcgcuacgaacggauugcacugcagacggccgcgucuugcgcugugauaaacuaacgggcgcuucaugcgcuacaaaauccuaauaggcgcuucaugcgcuacaaaauacucauaggcgcuucaugcgcuacaaaauacucauaggcgcuucaugcgcuacaaaauacucauaggcgcuucaugcgcuacaaaauacucauaggcacuucacacgcuacgaacugaugggcgcuucaugcgcuucgcuguacuaaugggcgcuucaugugcuacgauguacuaaugagcgcuuaaugcgcuucgcuguacuaaugggcgcgccaugcgcuucacuguacuaaugggcgcuucaugcgcuucagcguacgaacgagcaaaugaaacgggcgaacaggcgaaccugugaacggggcgaacggggcgcuucaugcgccacaaaccagcccgaacuacggugauacccaaaaccgauucguguuucacguauucaauuuggaaagcugcaggagaguaaccaaacgcaaaagcgcaacaagagugaauuuagaaaaugcgcuacaaacugcggcacaggcauaagaccugcagccucuuaagugacacagaaaguagcguugggaagacgagagaacguaucucuccuuggugaggggacaacacaguucaccuuucgggucaaaacuggcuccguuuuccugucggacggcuaucugcaugauggugguggugcuggugguaaacaaaauggagcccugggaggccaaaauugguuuuaacauucugcccacguaacuccugcuuauggcaguggaguggaggggugcuggauuuuggagauggcggaauggccugccuugucuaguggugauugauugaggugacggugacggugcacuggacuuggggacacgaauggguguccagcaacaguuuguggaaacuguccgguuuucugggugggcacgaagccaaggugggaggugggagaugaugggaggugggagaugaugggaggugggagaugaugggacggugggaggugggggauucacucuugcugcacggaagggaucuggugguugggagcuggugggaggggucuggggagguaggggggcggggggaggcaugcagucauucugcagcccuguuguagccagucucagaccugccccgcccaucuagccuugccucaucugcagagaggccgcgcgccucgccugucgcgcgcuuuuccagaacaugcuuccacaggcccaaccucccaagugcugacgccuuagagccagccuaccugguccccacccccaaggcccgccuccucugagguggccugccuagcccccgcccccaaggccccgccucucuuacuguucagcuccucccagagcuccuccaagguggcccagagccccgccuucccccagccugcuugcgccugcgcaaugcgggcugcaaccccucccuucagguuugccuccagugcgcaugugcgccucugccugucugagccuggcugcacagccccgccucccugcgguuucucuguugcgcgguuuuauuuuuuguccacaggugucuaguaaauagaagaauaauaagaauaauuaacaacaauaauaauaaguauaccuaacaugcauaagcacuuuuaauaagugcauugcauuauuaaauaaaaagaucccacaauuaaaacuccugauagugggggauaugggaacuuuuaaaaaggccuaacugaugccuugaagcaaugaaggcaauuacuuauuuuaaauuaaaaauuaaauuuaaaaauauuuucauauuuaauuauuugaucaagacaccauuggacuuccuggaauuaaaugcuuuggaaaauacaaagccagaggugacuagcacuguguuucuuaggaguuuucaggggcuuuagugucauggcuuggcuucugagagagauguuuguuagaauagaaaagguuugucauuguuguuguuguuguuuuuguuauuucuuaaacauucuaggugauuagcccuggcugaccugccuacauauaguaaagugugcuuggcacauaguaaggauuuauuaaauguguguuaaauggccagaauaaauuaauuauucauugucuugcugcgggacuucaaguuuuuugaaauuuuguuccuuuuucuuaaggagcuuugcuguccugaguugaguugcuggcccuuuugaaaacacauuuaaaaguuucuuuuuaaaaaaguaugguuuugaacuucaguauuguaagcuguaauuauaauaugaaccaacuaaauuauauuccaaauaacuagcuuuuuucauaaaaagcuaauuauuuguuaucccaaguaauuagcuuuuuucauaaaaagcuaauuauuuggugucccaaguaauuagcuuuuuucauaaaaagcuaauuuaaauuuggggcaaguggguuauuaaugcuacauauugacauuucaaauucaugugauauaacagggugguuacauugcaggacagaaaugguuacaacuggcuuaauuaaacaucuguguaauuuacagagaagccaaauagaaauguuucuaaauuaaugaagaaauuaaaaaaaaaaaaucugguuccauauuauuuacuaugagccagaguuuuguuaaagagagaaauagggggcuuuugcucccccaaucuccugccuuccuagugccccucccuaguguauaacuaucugugggaaauauaugcuuauaauuacagcuugaaaugcaugcuuugcuuugggaauuuuaucugcauauuaaagagauucaaaacauuggaaaauauaugcaaauuacauuucacagauaauucacauaauauuaagaaaaugagauauauaaaauuucaaagcaacuaaaaguuccuuaaugguguuucauuucauaaugagacauuuacauaugauuuacuguuguugcucuuuguguugggggaauuaaaaauacuuugaagaagucauuguaaaggguuaauaauuaaucagauguauuuauuuauuuauucuuaacugauuaaaacuuaaugaucauauaugaagaugguccucucucaagcagcuggcuuauacagugugaacuuucaguucucaggaaugagaucucagcagccucauccccacacccaguccagcccuuuaagagggguuuugaggagccccaauuuuuaaaucaaauuaaaaugaaggcaaagugcuccuugccugucaucaaccuguccuucccuacaguaaacauugucauuacuuguuuaugguuacuguuaaccaguuugcccaauaccuuauaacuucuuacugguuaaacuacuuugggguaguagaguccuaccccaaaauuucaagcccacccccacaggccuaagccugaggccuagaaguggugaaggucacagaucuucaacuggugaccucacaagcuaaauaaggcacuuaauuuguuuaacuagcauuauauuauuaaaaaccaaaagcaaagccccuugaauagcuuggugggaggggcacaggccgaguauaguccccccgccccccaucaccuuaacuccaagcucaccuuaaaugaucuuacugagcauagugauuguuugcagcuuucccucgcaguuucggaccuauaguuaggggucuuuuauaggugauaauguccaccagaccuggcuucaauaaaucucaccccaguagggcaugcaccuuccugaccugagucaggcuguaccaggccaugcugagaccaucuuaaggaagguuuuaauuuuuauuuugaaguugucauucuuuucuagaugacagaagucacacuuuagucaccuguguguucugcuuauuggaaaggccauaggaacaacuuaggacaaaaggaaaaugucugcagaugguuauggcaggggaggggccuaaaggauggggcggggguggggguggggccuguacuuauuaagaaagcagggggaugggacaaaggugaugaacaggugucaugugggaugucaguuuuccucuauuuuuuaaaauauucaacagguuaaaauauuaucuaacuuugcuaauuaacaauuuuuuaucuuuuuguuucauggaauuuaacuagugcccauuuugccuugauugguaaaagaaaaaaauuauuuuaaaacuuauguuuguucaaaaguuuaaagcuuuauguccuuaaacuuuuauugagcuuuuuaaauuaaaaguuuguaacuauuaaaaaguuuuaaacuuuuugaaggaaaacaacuuuuaaaaguuucuaaagcuuuaagcuuuaaacuuaaaaguuguaaguucaauaaacuuuuaaauucuuuaaaaaguuucuagacuguccaauuacaaaguuuauacuuucuaaagauuuaagcuuuaaacuuaaaaguuguaaguucaaacuucuuaaaaguuuuuaaaagccuucaauaaacuuuguuaaacuuuuuaaaaaguuugcuagaccgaccaauuacaaaguuuuuaaaacuuuaaaguuuuaagcuuuaagugggaacuugcuuuuuuuuuuaauuuaauaaacuuuguuaaacuuuuuaaaaaguuugcugggcugucuaauuauaaagauuuuaaauuuuuuguucuuuacuauaauuauuuaaauuuugcuauuuugcgauccuuacaaauacauaaguauuaaucacucuuaauugcaccuaacccuauuucucaggaaguacauagguagucacugugcugugauugcacuauaaucauaaugaaaacauuuaaacuacucuuccccccccccacacacacacacaguuaccuucuuagaguucaugcucaguccaccuuaauuuuacaagccuuuggguggggccauaaaggcuacauacugucaaccuuuaaugcugaugacguucuguauuucuuuuacugauaaaguaaaaauuuaaaguaucuuuagauucaggaugcccaaguugcaauaguuauagcuccuccccacuuauacagaaaguagcuuucuguuauguauguaauaaccuuauuaguuaacaguugugauugagugauuucuaccuauguuaucuuuuuuaggguucuuuuuuucuuuauuaaauauuuuauuuguuuacauuucaaauguuuccccccuuccuggucccccaccccagaguucuucaccccaucccccuuccccuuugccucugagaaagugcucccccccacccucccacccaccacccccuacccuuuucucucacucccuacccucccacccccuuaccuauguuauguaauuaaaacaugaagaauuuaaauugugcuauuaucgggcauuuuuuuaaaaaagauguccuaguguauagcccauuucuuccuaguaggcaucaauuaauauuuguuuaauaauuuccuaauaaaguaaacugacauccccaugagcuguucaaugcuuuuuuaucccauagagaauucuccugaggaaguuaauuuguggucauaaaagcaauuagauaaucuugugguuuuugugauagugguuguugugacuuaauauucaggcuucauuguugagggugugccucugaugugacauuuggccaacugcuuugauuuuucggagcugaugaguacaggcauugugguuuuaauaccuaccucucaugugugugguuucuuauugauuaggguguuauuuucuccuaagguucuuauuaguaaaagguaugauguuggaaucaauuugcaugauuuugaaguuauuuugcauaauuuguuuucuacuuaucugccuuggaaguuucuugcugugugaccucuauacccaaacaaacaaauaaaacccaaacuuacuuaaagguguaugaaaucugagaaaucucuggugcucuuuuccaugaagagcuggcacugauacaugaaaggacccagcgugccaggguugccaucgaacuucucaggaaggucuucaaggcagcauaaagguguggcgcugcugaaggguuauauuauuaauuauaaagagcaagugaaggaguauguguuccacuauuuugugaaugaucaccucauccucuugaggguguguauucuguugacuaauuaucaggggcuauuugaacaccuaaaucccugcuaauagcgacugcucugaaugaauauguugaauguaugcuucuguugucauuuacaggaacaggcggguuuuaagaaccaaaagacgccaaccacgagggucccaggauccagggcucccuccccaggggagugaagccccucucaccgcagccauggcugcugcgggugguuccuccaacugcccgcccccucccccucccccuccucccaacaacaacaacaacaacaacaccccaaagagcccaggcgugccugacgccgaagaugaugaugaacgcagacacgaugagcucccugaagacaucaacaacuuugacgaagacaugaacaggcaguuugagaauaugaaccugcuggaucagguggaguugcuugcacagagcuacagucugcuggaucauuuagaugacuuugaugaugaugaugaagacgaugacuuugauccagaaccugaccaggaugagcucccugaguacagugacgaugaugaccuggagcuucagggugcugcagcagccccuaucccaaacuuuuucuccgaugaugacugccuugaagaccuuccugagaaguucgauggcaacccugacaugcuggguccuuucauguaucagugccagcucuucauggaaaagagcaccagagauuucucaguugaccgcauccgugugugcuucgugacaagcaugcugaucggccgugccgcccgcugggcuacugccaagcugcaaagauguacuuaccugaugcacaacuacacugccuuuaugauggagcugaagcaugucuuugaagacccucagagacgugaagcugccaaacgcaagaucagacgucugcgccagggcccugggccuguuguggacuacuccaaugcauuccagaugauugcccaggaccuggauuggacugagccugcccugauggaucaguuccaggaaggucucaacccagacauucgcgcagagcugucucgccaggaggcccccaagacccuggcugcucugauuacugccuguauucacaucgagagaaggcuggcucgugacgcugcugcaaagcccgauccuucacccagagccuuggugaugccuccaaacagccagaccgaucccaccgagccugugggaggugcccgcaugcgccuguccaaggaagaaaaggagagacgccgcaaaaugaauuugugucucuacuguggcaauggaggccauuucgccgacacguguccagcgaaagccuccaagaauucgccgccgggaaacuccccggccccgcuguagggggaccuucagcgacagggccagaacgaauaagguccccacccuccgaggcuucgacucagcaccugcaagugaugcuccagauucauaugccgggcagacccacccuguuuguccgagcuaugauugauucuggugcaucuggcaacuucauugaucaagacuuugucauacaaaaugcaauuccucucagaaucaaagacuggccagugaugguggaagcuauugaugggcauccaauugccucgggcccaaucauuuuggaaacccaccaccugauaguugaucugggagaccaccgugagauacugucauuugaugugacucagucuccauucuuuccuauuguccuaggaauucguuggcugagcacgcaugacccucacauuaccuggaguacccgcuccauugucuucaacucugauuacugccgacuucgcugccggauguuugcacagauaccuucuaacuuacuguuuacagugccacaaccgaauuugcauccguaucuacuucaucaugugcauccgcauguccauccgcauaugcaucagcaucugcaucagcaucugcaucaguuucugcauccagauccgcaucaguauccgcauccggauccgcauuaucaucaucaucagcaggcggauaugcagcaccaacugcagcaguaucuauaucaguauuuguauuaccaucuguauccgguuaugcaccaccaucugccuccagaucagcaugagcaucugcaugaguaucugcaucaguaucugcaucaguaucugcaucaguuucugcaucaccaucugcauccggaucugcaucaguaucuguaucaguaucugcauaaccauaugaauccggauccacaucaccauccucauccagaucccccucaggauccacaucacccuccacaucaggauccacaucagcauccggauccccaucaggauccuccacaucaggauccacaucagcauccggauccccaucaggauccuccacaucaggauccacaucagcauccggauccccaucaggauccuccacaucaggauccacaucaggaugcacaucagcaucaggauccccaucaggaugcacaucaggauccacaucaggaugcacaucaggauccccauauggauccacaccugcaucagcaccagcauccgcagccgcagccgcauccacaacagcauccuaaccauccucagcagccaccauucuucuaccacauggcuggauucagaauuuaccacccuguaagguauuacuauauucagaauguguauacaccuguugaugagcaugucuauccgggucaccgggugguugacccuaacauugagaugauuccuggagcgcacagccugcccaguggacauuuguacucaaugucugagucugaaaugaaugcucugcgaaauuucguggacaggaauguuaaagaugggcucaugacucccacuguggcgcccaauggagcccaaguccugcaagugaaaagaggguggaaacuccaagucacuuacaauugccgagcuccacagaguggcaccauccaaaaucaguaccuacgcaugucucuuccaaauaugggagacccugcacaccuggcaagcuauggugaauuuguccaaguuccuggcuacccauauccagccuauguuuacuauacaagcccgcauaugaugacugcgugguacccaguaggacgagauguacauggacgaauaaucguugugccuguuguaaucaccuggucucaaaauacgaaccgccagccuccggugccccaguauccuccuccgcagccaccuccaccaccaccaccaccuccaccgccaccaccaccuccaccagcaucauccugcagugcugcguagaaccugucauguccuuuguagucucugcccucaacuugauccugugcagcuucucaaucuaugacugugugguacuggaccuucagaggcgcacagagcucaagucaguuuucgucuugacugccacuuuauaaguugacaggccuggguuuuacuuguuaaaaccucucaccaucucaaucacaggcugccaagugucuuuacaaagaagcugauacaaacacaggccaugcugauuucuuacagagggagagaagaggaagagaagaagaaagaggaggaagaggacaugacuugcccauaugcugggcaccuuauaaaggaagccagacuuuucggugcaguauggaaaggcuuccgugauucucuugcugcaccccacgaaacuucaccaccuucaaacuccauuuucacgguuccguuaauuuucaaggagcagcaacucgacugguucucugcuacaugaaacaccucagcuugaaaaggaagugcucucucagacugacuugugagugugccuucacauucuggugcaaaucauguguacccaagaacucugacauagcaucuuaccaucaucaugccaggaauugguuuccuuaaagugugacacuuggcaaccagaagcgucugguggcuucagguguguuaggguuuuguagaaaguuguaaccaccucucagucaugcaagaggguacaucaaaaagacuucuaaauuugguacccagacuuugacaagagccugugaguuaguucauuguaaccaacuugucaggaacuucagcaagaauuuucaugaauguuguuaauuggcuggagaaauaccagcaaaguuuugcaaucauccacccauuugucugccauugugcaucuggacauccaucaaccgcccacucaguggcaucuaccaugaagauguuuagagacgggaaaugauuuugcacccagauccacacuccucucaugucagauauuuggaauuagagcaccgggaaucgucuugaagauaugaacuucuaagaauggagucucuugcuacuaccuugaaacauuuguuuauccucucuuucuguuugauucuacuacuaccauuaacccugcugcaggauuugucaccauucugccugacugcugagacuccauuuugcugcuaugcaaggagaugaaagaggcaggccuaaaggagcaguaggacauaacaugguuuuuauuucuaucugucaugaucuuaauggugaaguuuccuuuuucgucagcauuuaucucuuuguuauccugacauguuuuaauuaguuuaguggguuuuuuuuuucuauugguggugguguucuuuuguuguuguuuuuuguggucgucauuuugauuuuggaucacuucguguuuuacaguaauuacuuuuaaauggugcauuugcuucugauuuuuuuuuuuuaugaagcaucacaucaguuuaccucauaucucaauuccauccuucaugcauuuuuuuuuuaacucauuugaucuucaagcugcagagggccuagcaaugggucaucaccugcagcccuggcauguacacacggacauuugccaccacugaaagcaaacaguuggagaaguuggccaccugagucaaggagguggugcuggugugaguucacagcucacaggggacggugaacguugacauugacuuuggcaguguguacuaugcucuacuccuauauauacucuauagauguuaggcauuaaggauaagugaucuuaaauuuacugaaauuuuguuaaguugauuagauuuacauuaauuguuuauauuguguuuuuucuuuuauuuuagcacuuccaacaaaaaugccuuuauucauuuauuaggaagaaauuggaguggcgaacacaaacuagcaaaauuaauuaauuggcugugggcccaaauuugaauuccuuauuaauucaaagugaaggaagugugagaguuucuauugcuggucaugaaguucaccacgaagagucaguuuaguuuguaccgagaggcauuuagcugagagugauuugaguugggcaucucuaugaugcaguccagacuuguguuuaaguuuacagguaccucuuggacuccugaauugaucucgaugucacacaucaucgacaucccgcaucccacacaguuccaagauuggcgacagagagcauccuguuggagagaccugaccagucacgaaggaccgccugcagacucuucugcaggaccaugcuacauauucagcuggagagggaacacgcaucugaugggaauggauuguuuuugcuuguuucagaauuuugcuguugagauguuguuaaacuuugcauuguuuuucuuuuuucuuuuuuuuucccuauagucaauuaagaauaagggguagauaaucauaaguauuuugggcugggagggauuguuaaguaaucuuagguggguggguaauuuaggaaauuaaguuaggauaagauaggauaagauaagauaagcuaggauaaguuagauaaauuaggauaaguuagauaaguuaggauaaauuccauaagauaggauaaguuccauaagauaggauaaguuaguucacauaggauaagcauaggauaaguuagaucacauaggauaaguuagaucacauaggauaaguuagaucaaauaccucaacaaguggacgaguguacuuauuggucccuuaccccuaccaacuuuaccuuuaaggccgagcucagagggaacuacagggaaaucaguguuaggagugaauuggacauggaugacauucuagugaagguuaggacgauuagaguaaucuaauacaggcucugggaauuaacucaagggauuuuaggaaugccagaugacagucaucauuugauaaaacuguugcuggaauaaaguuuagaauguugaaugguaaauguuaauggaaauuguacgaaaaugaauaaaagcucuuuccauaccccucccccucccuaccccacucuuucuuuccucccccccuccauaaccuaccccuucucccaaacacaccccuccauuuccuaacucaccacgucuccccuuccacucccuaacccaccccuucuucccucccucccuccagaacccgcccccaucuucccccucccuaacacaccccuucuuccuuucccccuccaaccccacccuucaaacuauauuacuguauucucuuuauuauauuucuuuguauuaauaaaacuguauugauguuacaauaaaaauucaauaaauaaagacuuagugguuaaggcaa

SEQ ID NO: 12108 - RNA, 4265 nt, Mus musculus
ccauggucgaaauaauuuuauuuauccagaauauacaguuuaauuccucuaucuacacuuauuuacacgguuaaaauaacauugaaaaaagucuuuugaaaaguugaggucauagauuucaaggcaccauugauaguguccacaguugcgcaaaaaaaaaaaaaaaaaggguucuuuucguaaaaaagggggcggggcucucugaaaugcaauaacuuacaugcaaaaaaaaaguuuacacaugaaucuuuuuuguuuccauuguucaaacauccccguaugaauuccuuucuuucugauuucuaaaccagcacaacacuguagucccaaaacugagcaagagaaaguagcccaucuaauaaagcgucccggaggccagugccagcgggugcugcaaggagcccggcgguggcaggugggaauugauugagcuggcugcgcuuggguaccaggaagccgaguucuccagguagcuggacgcgggggacugguuggaggucggagggugggcaugagggugguggcugagagagcgggaugagcccuggggcucccacaccgcuggugacuguggcgaguuacacgccauagggucgcuggagcugggacugugcuccgggggcaucuccccguuuuucaugaucuucuugaucuuggaucuuuuguucugaaaccagauuuucaccuggguggggaacaaaggcacacguuaccgggacacucagagguugcacgcgccuuucccugagcgacgaaugaaggcucuccuggcccuagacuauccugcccugauaacuaacuaccagcagcaagccgcccaucgccaggagguugcaguuucagccuaggcaaugggagggacgcacagagggagcucuguccagcucagcgggaaccagcuucugcuaccccaaggcuuugucuuuuauucacucuagaccuggucgcacgugugggccugugcaccaggucacuggggaggauaccucuccugcucgaaggccagaguccccgauggggaggggcuugggccaaacuguaggugcacugugccaagggaaaggagagauuguccaaucuccuguccaacucccuucaguccccucggcacugggaggccagacucugccugaagcucugggcugcgacuugaacauuccuuauucuaggccccagcgggcgggguugggagggaaaagaaggggacaaucccggaggguuuccccguacaacagcgccccccaccucgcgaccuucaggcugcugaggcuugaucugccucagggauagggucgaccgggacaggacgauccaggccuuugcauggcuggagacucaucaucaggccaauaguaaggcaagcuucucacugugaagggacccagaccuuuuucaagagcgcgaggcagauucccccuccucccagaaauaccccuucucuuguuuucacuauggaaccuugguccccagccuuuggugguuaaagcagggguggguuugggugggaggggauggcggcaacucgggacaaacgacgaaucccgcgcccaccgccacgugggccuggcucauggagggaaagaugcaucgguuggugucuuucuaucugugaauuucugcaaagugcuagagaaucggcuccagccagucgggaccgaaccuugcagccgagcugggcuugcaggcgaggcggggccgguacuuggcggcggccggauuuaccuguguuugcgucaguccuagagaggcggccaacuccgcgcguucuggcagggcgagguacugagucuucugaaaccuucucuguaaagcggccagcugaaagcuggaauaaauaguccuggguuuacgaacuuucuuugguuuaccauucaccauccucaccucuggcuccgccacuucuuucucuaaauaaccaaaacagacuagguuagagcuuccuggcagacaauggcucguuugcacaggcccucaaaucagcgagauuuuguuuguuuugaaauauguagucaucuuucucuuucccaauaucacaaucuuggcuuuucaaaccccagagaaaucugucccauccucagaucauacauggaagagcuggcgagucucugacuacuagccacugugugcguggggcacuuuguacacaucaaguucuucgcuuuagggauggaacccuuuggagaugcuuauuuuucucauuauuuuuucccucccuguauucaccuuguguguuucugggacgcgaauagccacuccaaucccugggcgucacgcgaggaggccccugggccaugacccucugucggcgucuguucgggcgcccgcagaggcuagacgcuugggcagggaagacgcuagccaagggcuccaaaguucaaagaccgacaagcaaacuauguuccuucacuacagcggcaagcggucggucggggcugcggcagacagagagccgauuauguaguccccauaaucucacugcagaucugagagggcacagaugugucugguuucuuucacaaauagacuuaauauguucuugaccaaaaaaaaaaaaaaaaaaaauccucucccuaugcaaggauacagagacagcaagaggagcagacucaaacuuccaucaacaauguauugcaaaggaaucuguaguaaggauauuuucguaguaaaggggaggaaccaaggaagaauucucacugucauaaauguaccccgcugggguccugugaauccguguuuugcuaaugugccccuaggccacauggccccuuuucccccuucaguccugaaaggaguggaagagucgguguaugaagcugcugccagaggaaggguggagaaggagggagggcugcggucuccgcucuacuggaguaggggaugcuaauauuagcagccuuauuaaugugucggugaggggagaucaaaaucgacuaguaaaauuucuccacugagacuucacgccucucauuuaccgcccaagcucucuaccccacuguaacgcucuaaggaaguuucacaguggacggaaaggggagucuguggggaagaaggaaggcagacaaauucuaggcacuuacggagagagcacucgauggagugugugugugugugugggggggggucccucuaacagagugaacucucggcaauccuccgcuauuuuaaaugacuuuuuguauuuggaaauaccuuggauaaaccgcaaaguucccuguucgcuuuucugucaggcugcagcccuccggcccccaggucacccggugugcugcccgcacccuccaugagaggccucggggcgcuucgcuggcuaauccagacuagaucucaccaacucagcacgcucacccagaauuccaacuaacuuuccuuuuauuacgcaaacaccacuagggcugcuugauuucacccaccccccgccccccaaaucccuuagccucuuugcagccaagcuggcuuucuggcuaggccagcuaggaauccagcuaaggagggauccucgagcagcgccagaggcaaaacacccgauuaaaccucuucaaaaguccuccacugcccccccccccaugccggugugaggugcuguccuguuugcagucccaggcccccacucgcuucugcgaagcacccuucuaugggugcggacagcguggcccucaucuaccacccaacuuggcgcccgcgggguuacggaugcccuggguaccugccucccgcccccgcgcgccuaccuggcuggcugguggcacucgggacgcgguuguaggcgccgccguacuggugguaggggcuggcguagccguagucggcauaagccuuggccggguagccggcugcggagccguucacgccgugguacugguacugguagggguugagcgcuuugccauaagaagcagagguaggagagcaguagccgugcggggcggcccccgcgggacuguaguagucagaaucgguggccgaggacucgggcaaaguuggcgauuccugagacggguggugcauggcggcggacgucgggaacggagcuuggaagucgccggaucggaugcuugggacucuucugucaaacacuccugucauagcucccgggcgguggcuguucuucuacugcggcggccgcugcugccugaauuggcuguggagcugcucuggucuaagcagacauggcugugggagcgagggaggaggaggaagaggaggaggcggcggcggcggcggggaggaggaggaggaggaggcugggagucguggaggcucugucu

SEQ ID NO: 12109 - RNA, 25871 nt, Mus musculus
gccagcuagagcaacaaaggagcccgguagucggcagggagagcucagggggcugcggcgcgcucgcgcggagguggcugcugggccgcgggcuggcgugggggcggagccggggacccacucccgcaccccccccccccccccggccggcgccuggccuccaucgaggggcugggagucgguuuuaauggugggagagggaauggggcuggagaucggggccccggaggguucccaggguugaagacagcuucgaucuccaggccagggaguccggggucugugcauccuggcccgggccugcgcugcucaacauggggcccggguuccaaaguuugcaaaguugggagucgaggggcccggacgcgcgcggcgccuggcgaaagcuggccccagacuuucggggcgcaccggucgccuaaguagccuccgcggcccccggggucguguguguggccaggggacuccggggagcuccggggcgccucagcuuuugcugaguuggcuguuuggccauggccgcuggccgccccgugcgugggcccgagcuggcgccccggaggcugcugcaguugcugcugcugguacugcuggggggcccgggccggggggcggccuugagcgggaacgugaccgggccugggccucacagcgccagcgggagcucgaggagggacgugccggugaccagcccuccgccgccgcugcugagccacugcggccgggccgcccacugcgagccuuugcgcuacaacgugugccugggcucggcgcugcccuacggagccaccaccacgcugcuggcuggggacucggacucgcaggaggaagcgcacggcaagcucgugcucugguccgguaagcgcgcgggagucgggauugcgacgcggaggugaugggaccggccacugacggaaagaaaaggcucaggccucaaacuguugggcgggcgcggcuugcacccggaauaguuggagaaacgaguccggaacuuuugggacagguugcgugcgggaaggagacucugcguguuggagaaggggucggggcaagagaccagggaagccagucggucacaaagagcccgaguaaggaugggguuagggggaugcaaggagggagaagagauguauucgugaagcaacaguccauggggauucugggcaguguucagaccuugaggcaaucugaguuguagagaagaaagagaggaugaagguggaagacauuuaaggauuuggagggaaggggcgaggaaaacuuguacauucugagaaggaaaaaaaaaaugccuccuuguaguaacuaaaaagccaaacgaaccaccugguaaucuugauuuagaucagcccagggaaccaaugauuuuugucuuguuuuuacccguuuaaguuuccuuaucugaaaaauggaagcucugauccacucggguuaagaaggagggagacgauuuaaacaguuguuuguggcucuguggaaaugugaagccucacgccaguguaugcuguggaggaacauuaagucugggguguugagagccugugggcaccguccagaguggcagaaaguccuuuccuugggguaggauugugacagagccugaaaacagcagacuacaucaaacaaguccuuccuaggcuauuuaggaugguuuaucucucugccugucacccaguuggacugagagccuguagggugcuggggaggggacaguccuugucauuuucccaucccucuuccccaccccgaacccccacuucggugugauguaaaagcuguccuugauggaaaaagaaaauaaaauugagagcccggagcaaaccagagagccugacagugucccuagcuuuagcucuuccucugagguugugaggcuccgacuaggagguagugugaaccguaggcugacugucuugggcugagguguguugucaacuugacuacuagaguucucaguuguagcugagugcugccugggguccuaagguucuuggcuugaugcagauguuggagcaggaacuuggaggacggcggguaccgagaagauagaacuguauucuauggagauaagguucuaaaguaaccuauagguggagaccucucgagggagucgaaugacgcuuucacagggguugucuaagaccaucagaaaacacagauauuuacauuaugaacuauaacaguagcaaccuuacagucaucaaaauaauuucaugguuuggggagcgggagcgaacuguauuaaagggucgcagcauuaggaagguugagaaccuuagaagcuaaacccagaaucuaaggcagcagcuauauguaaucaacaguagcuuugaaaaaaaaaauccauaaauuacucuaauguaaggucugugugauuucacacaugcacacuuaugauaauauguuugcauaaaugcaguauagaagauauaagaauggacauacagagggaauauaauuguagucuuuaaagcuauauaugugcaaaagacugacagaaugaaaacggaacaugaaagaaagauuacgagcccucggauggcucagguagaggugcuugcuaugcacaccccaugaucugagcagcaugcccagaacccaagagagaagagaccugugugcugacagcuguugucugaugcccgggugugcccuguggcacccauguuccugcucacacacccccgacuacuaaacaacaacauuuuuuuaaaagauucagccagauaugauggcgcacgccuuuaaucucagcacugaggaggcagaggcaggcagaucucugaguucaaggccagccuggucuauagagcggguucuaggacagccagaacuaccuaguggaacccugucucaaaaaaaccaaaccaaaccaauucaaauaaaaacaaacaaacacccuuaaaagaauacaaaaaggaaaguaaucuucaauaagguauggccugaaaugagacuugaauuuaggaggacgccauaugaaaaauccugaccucucagcacaagacaaucaucaaguuuuguguugcugaaaggaugcucucccccacuuccucucucucucucucucucuuugugugugugugugugugagaguugauucacagggccuaugacugaauucucccaagugacaguuacccucugaagcuguuaucagaucaaggaggaagggugcaccuuucccagcccaugcgcccaagaguggcugcugagcugcaggagugucugcaaguuagaaccaugugcuggguguucagguuuuggucgcucuagcugcuuaaucauggcgguacaggggcacaagcucugagcccagagcuucugacucacacugaguucuuuccuguugcugcccauuuacagcuuuccucuucuccguguguggacuagaagcaggugcugacacaggcuggaucaguagauggggaaggugaaagggagccgucagugagaaucacaggcagguaggagccaggagcuaguguuuguccuaucuggaauuauagguccugauuuaguguuauuuauugucucacuuuggcaggugguuuuguggguaauaaagauauucuagcuuauguucauuauaaacuuuguaggguagagauucaaucuuuauguuuuucagagccucucugggcugaguauacagccuaaauccacacauucaauuguacugaguacaucacauccuggggcagggaucgagguauaucaagauggagauuacagaaaugagcucuccgauuucaagaggaggaaggacaauuaaacggguuggcaauaccugugaaaagucuggucacaucguaggugcugaaggcacacgaagagcuuuggggagcaagagaagauacccagagaaacugacaucucaccggugacuugagaaauaaacaggaguguccagggaguugagccagagaacgggaagaggcaaaggcuuuagaggaacagagaaugguacuuagagauacaauguuggcauagaacuggaccaaggcacauuagaagcagaacuguaagacucagggggacuagauugcaagggcucacccuguaguaaguuaagaugcuaccaaucaaaagaugacaaggagccuaugauaagcaaggcuuuugaaacaagguagaaauguaauuguaucugcauuuugaaaagauuucuuugggcuaggugugguuggugauacacgcucacaauuccagcuuuugggaggcugagacaggaggaugauugugagugcuaggucaaccuguguagauagugaguaccagaccaguucaagauuucaacucuaaaaacagggaaggauugaagugauuguucagggguuaagaauacucccugguuuugcagagcaccuggguucgauucccaucaccuacaucugguagcucacugcagccuauagcuccaguuccaggggagccaaugcucucuucuggccuuagugggcaccugcauaugcgguguauguacacacacuugggugcacacauacgcauuugaggggcagggguugcuauauaaaacagccgccagagagaaggaagaaccuggaaccugauuauuuggucaggacauggaugaaauggucuuggggugggggggugauaguggucaggauggggguaacaggcugaaguuugggaagauuauaaugucggaagcagauuugcugauguguugggugccaggcugagcaggaggaagagugagaugcuggggaugguggugcccuuccuuucuacuggugguaguagagguagggugaggauggaaguguggcuuugccuuuggcuuuguguguuagacagucaguggauaucuacauggagcucuguggcagaucugggaagaguuuccauagagaacaggccucuauaggcuuucuuugcccagacuaccaagucugccagugaugaagucucuaacgaggucauucugauuucugcgugugucuagaacucaggucucucccaugguuuucaugucuacagacucgagcuucuuuauucacucagagucucccccauuacagcuggaaaugucuccuaccaugcaugccaagcuagccagacaacaauggccaagcugugcgugggccaccuugggacaaaucugguuuaguaaguggggccagaaagagaggcuugcaucuggugaggggacaggucccugagagucagcacauagacuccuaguccacugcuaugccaugucugcguauacauggauauguggcucuguugccuagccaggguccagccagcaggaaaaagaccggaaaacugggaggaauuucuuacuggucuuucagaccucaaguugggauguuguuggugauggguaauuugcaaggauaguucuggaaaauuuuuuccuucuggcuguuuccaaaacaggccgagggcaauuaaaaauucucucucucauucucugugugugugugugugcguguguguguguguguguguguguguacauugugacacaugucugaguccagcaauugagaggcuaagacagaaguauaguugaaaguuugaugccagcuuuauauauauauauauauauauauauauauauauauauauauauauauauauauguguguguguguguguguguguguguguguauguauguauguguguguguauauauauauauauauauauauauauauauauacucuguuucaaaauaaacacauaaauuuuguguguguguguguguguguaguauacaagcacagaaaauacacaguuuucauuuuugcuucauuuuuuuuuaaagauucauuucauuuauuuauuauauauaaguacacuguagcugucuucagacacuccagaagagggcaucagauuuuguuacagaugguugugagccaccaugugguugcugggauuugaacucgggaccuuuggaagagcagucggugcucauaaccacugagccaucucacgagccccccuuugcuucauuuuuaaaaugguuuuucgagauagggcuucucuguuccuggcuguccuggaacucacucuguacucuguagagcagguuggccucaaacucacuccugucucugccucucaaguaugguuuuaauuuugaguuuucuugccaugcugggauuugaaccuaaaccauuaguccuuauuucuaugauuugcauuuccuugauugcuuguaaggagaaaccucuuugcaguuguguguuaccguuugaauuucucuugugaaguaucugcucagauuacugaucuauuuucuaggagacuaucugucauuucuguuagauugauggggauucuucauauaugcuggagaugaauguuuuguuuauugugaguguuaaaaauauccucauggcuuacuuucacagucucuucuugguguugucuccaguugaacggaguauuugaacuucaauguaguuaucaaacauuuugugauucauucuuuuuuugugugcuuuauuuagaaaaaaaaaauccucuucuccucccaaaucaugaauuuauuacucuuuuaugagaaauguuauagauucccuagucacuuuuaggcacagaauucaccugcaguugauuucuuuaagagcuuucaaaagcauuuguuaaaaucaauuuccgcucucuacuacuguaccauaaaucuaauaugugcguguguuucuggaucuuuguuuuguccauaucacauugucucaguuaccaugccuuuacagcauggucuucaccagcgugacaacugguaaaccugcacccucccucgcaacauaguauucuuaaaucuauagaguaaaauaugugggauuuaaaacaacgugcaggaucauagauccagaauacaguaagaacuucaaaacucauuccauuugauagaagaaccaagccaaaugaaaauaaacaagcuggguugaaaaggaggcuguagaucuaaauagacauccuuaaaagaaaagacagaagacguaugccaaaaagcacuugacaacucgcucacucagaucgcugaucaccaggaaaaugccauucaaagccacagugaaaugucacuccaccccaggaagaauggcuaauguaaaaaaauauaaaauacaacaaagugcuggugagaauucgaaggagaaaaaggaacccuuacaaguuuuguguguguguguguguguguguguguguguguguaaaauuaguuugcccuuuguggaaaccacuauaaaaacuccucuaaaagaaaucccuuuacuagauauguauccagagggagugaagucaggaggcugaggagacagcuucaugcuccugcuuacugcagaauuacucacacagauaaaaacagccaaagcauccaugaauggaaagagaaacaugcccugugugguggcccaugccuugaucccagugcucuggaggcagaggcaggcagaucucugugaguucaaguccagccagagcuacauagaaauacuaucugaaaaaccaaacagagcaugaugcccauucagaaugaaauacucuucaguccuaaggaggaugaaguccugucacgugaacacauggguggagucagagaucacuggcacuaaguaguaaguaaguagccacuauacugucaggugcugaugagcaugaccugugaugugacuccacugagauggagcgacauccuagguaaaccgaaagcuaagagccucuauuuuauaguaucaagaggagcgcuugggcuguucuugaggcuccccccccccccaaaaaaaacccuucugugugugggugugcgagugcuguguucaagacaaggucucauguaacccuggucugccuggaacuuaucaucauguagucuggaauucaccauguuaacccaagcuugcuuugaacucucagcaauccuccugucucaucagccuucuggguucuuuuuuuuuuuuugguuuuucaagacaggguuucucuguauaguccuggcuguccuggaacucacuuuguagaccaggcuggccucgaacucagaaauccgccuaccucugccucccgagugcugggauuaaaggcgugcgccaccacgcccggcgccuucuggguucuugauuacuggugugaaccaucacauuuagcugauacauagacacuggaguguacauacacauauauuucaaaauuaaucuuuuauuguuuuuuaaauauuuauuuauuuauuguggggugugcgcaugugcacacccauaccugaugaccugaguucuguuccuaggucccauggggcuggaaaagacaacugacuuccccaacuuguccucuaaaacauccacaagugcgcugucgaaugcacacaauaaguaauacaaaucugaaucaaguuguagaaauguuauuuuaaaauucuauccauagaauuuuuugcauagaaaguucgcauggcaacaccgccuuuuaauccccgcauuugggaggcagagguagguggaucuucaugagagauccugguguacaaagcaaguuucgggugaaccagggcuacacagugagauacugucucaguaacuaaauaaaaaguaaauaaauguuaaaguuccaugguuauaaaaacacaccuauacuaauauuguuauuaugaugguggcacuguguuccucuuuuucuuuuuguuucauauuuuauuaaacuaaaaaaggaguagguguggugguaaaugcuuguaauuccagcaugaacugggaggauccugaguuuagugccagccugggagacguagcgagacucccaccccuaagucaauaaauaaaugaacuaaauaaauaaauaauaaggcuggugcgauggcccagggggugacggugcugccugccaagccagcugaguuccauucccagaacccacaagcugaaaagagagagccaacuccugcaaguuuuccucugaccacacuugagcucacacacacacacacacacacacacacacacaccccuuaaaaaauuaacaaugaauagauacaacuuuuuucuuucuggauucauuuuauucucuaggaaguuuuccuuguccuaguaauaauacgcauugcauuucuuuauuuuauuuuuaacuuaauugucuaaaacaauaaaggaaaaaaaagcacaaaaaaugaaagccagauguggaggugcacaucuguaaugccaaccuuugggagauggaggcagagggagcaaguguucaaugccauuuugacuaugccagacucugucuuaaaaugcccaaaguaaauaaaacuaaaaaccaaacacaauccacuguauagccuugccugucuggccuggaacuuucuauguagaccaggcuggccuugaacucucaggauugggcugccucugccuaccgagugcuaggauuaaaggugugugccaccacacauugcuuuaggaacaggcaguacaugugacauaaggcugagaagaaacaagauaaaccuuacuuccacuugcuaauacccauugccccucagaggcagccaugaauguuggcuauuuuuguguguguucuuuuaaauauucgugacagauugcugguugucuuucaucuucccccagguuccagucaaucguguucauuuaacaaugcaugucggacccuauuccauuuuaguauacaugguucaguuccgaguuguguucuauuguauauuuaaaauuuuuugugcgguaucgauauguccuugguuacuuuucgauugcugugaagagacaccacgacuggggcaauuuauaaaagaaagcauuugauugggggcuucauuacaguuucaggaggugaggcuaugaucaucguggcagagagcacggcagcaggcagacaggcuggagcaauagcugagaacuuagauguugagacaaccaccauaagggggagagagcgagcgagcgagcgagcaagagagagagagagagagagagagagagugagcgagagaacacuaauugggaaaggaguaggcuuugaaaccucaaaauacccugagugauaaaccauaucuaacaugggcacauccuaacccuccccaaacaguuccaucaaacagggaccaacagggaccacacauuuacauauaugaaucuauuggggcugucaucauucaaaccaccacaggguauuuuaucuguguguauguguauccacugugugcacaccggagaugguugugaucugcuaugugggugcugggacucaaacccuguuaugugcucuuaacggcugagccaucuuucuagcccuuuguguauuagauugguuuuggugugcgugcgcguaugugugcaugugccugugcaugugcgugugcgugugcguguguguguguguguacauacguacaugcacacaugcacuuugugcugggacuggaacccaggacguuguacauaauaggcauuugaucuaccacugagcuacaucccagccucugauguguguguuuuuuggcuaaucuauguaggauauggacucaagcuguuuucccuucuuuugcucuugcagagaguacuaucaagaguaacccuauauaucaucaacuugugaaguaaauuucugauaauguuaaguggccuccccaagauuuagcaauauuuguuaccucugccuguuccccccucucuccacgugcuuggugggucaguauuuuacaaauguuuucaucuuuauuagucuaaaggacaacauguuauaucucacuuauuuugcauuuaucaugcuaagagugcgguugaugauuuacauuauuaaaagccacgcacuccuucucugugugauuucuucugccauugccuguuauuccacaggguugugcauugcuuauugaucuggaagagcuuuaaggagauuagccuuuuuaacauugauauguauuaaaaauguauuuucccaguuugcuaguuuucuuaagccaggacuacacagagaaacccugucucggaaaaaacaaaacaaaacaaaauauuuuuauuuauguaugugugcaucacaugugcaugggagcccucagaggccagaagagggaguuggaucuccaggaacaggagcuacaggugguuguuagucucguggugugggugcugggacauaacuuggguuuuguggaagagcugcaagugaucuuaccugccgagccauugccaagccaugucucuguccccaagguuuuccuuuuuauucuauugaauuuacuagauuuuuucuggaguuuuuuuuuuuuuuuuuuuuuuuuucauuucauagcuuuaacaguuuuguuauuuguuuggggugugugugugugugugugugugugugugguguggugugugugugugugugugugugugugugugugugugguaugugugugugugugugaguguguguguguggugucuguguguguguguguguguguguguggugugaguguguguguguguguguggugugugugugugugugguguguguguguguguguggugugugugugugugugugugugugugugugugugaugcaucaaaaggucauucucaccucaagguuuaaaaaaaaacauuuuccaaagucaggcaugaugauuuuaaaauuccagccuugggaggcucacucacgugaauugucauaagguuugaggccugguugaacuaccuagugaguuguaggccagccaagauuauauaaagaaauccugucuuaaaaauaaacaaccaaauagggcuagugucuuaguuacuguccuguugcugugauaagacaacugaccaaggcaauuuauagaaguaaagaauuuauuuggggcugagagugucagaaaguuagaguccaugaucaucaaggcaaggagccuggcggcaggcagacaggcaugccugaagcgguagccaucuugaucuacaagcaugaggaagaaagagaaaaagcuaaaugggaauaauguaggcuuuugaaaccucgaagccugucccugauccaccaccuccaacaaggccacaccucccaauccuuccaaacaauucuggcaacuagggaacaaguguucaaauauaugagccuauggguggaauucucauucaagccgcugcagcuagagaggcaacucagugggaaacgugcuuucugcacuugcugagauugcugugcugugcugugcugugugugcugugugugcugugcugugcugugugugcugugcugugcugugcugugugugcugugcugugcugucugugcugugugugcugugcugugcugucugugcugucugugugugcugugcugugcugucugugcugugugugcugugugugcuggcugugugugcugugcugugugugcugugugugcugugcugugugugcuggcugugugugcugugcugugcugucugugcuguguugugcugugcugugcugugcugucugugcugugcugugcugucugugcugugcugugcugugcugugcugugcugucugugcugugugugcugugcugugcugugcugugugugcugugcugugugugcugugugugcugugcugugugugcuggcugugugugcugugcugugcugucugugcuguguugugcugugcugugcugugcugucugugcugugcugugcugucugugcugugcugugcugucugugcugugcugugcugugugugcugugcugugcugugcugucugugcugugcugugcugugugugcugugugugcugugugugcugugcugugugugcugugcugugcugugcugucugugcugugcugucugugcugugcugugcugucugugcugggcugugcugugugggcugugcugugcugucugugcugugcugucuguacugugcugugcugucugugcugucugugcugugcugugcugugcugugcugugcugugcugucugugcugugcugucugugcugugcugugcugucuuugcugugcgugcugugcugucugugcugugcugugcugugcugucugugcugugcugucugugcugugcugugcugugcugugugugcugugcugucugugcugugcugugugugcugucugugcugugcugugcugugugugcugugugugcugugcugugugugcugucugugcugugcugugcugucugugugugcugugcugucugugcugugcugugcugugugugcugugcggucugugcugugcugugugugcugugcugugugugcugugccuugcugugcugugcugugcugugcugggcugugcugugcugucugugcugugcugugugugcugugcugucuguuuugugcugucugugugugcugugcugucugugcugucugugcugugcugucugugcugugcuguuugugcugucugugcugugcugugcugucugugcuguacugucugugcugugcugucugugcugucuugcugugcugucugugugugcucucugugcugucugugcugugcugugcuguguguucugugcugugcugugugugcugugcugucugugcugugcugugcuguugugcugugcugugugugcugugcugugugugcugugcugucugugcugugugugcugugcugugcugugcugugcugugcugugcugcgcugggcugggcugggcugggcugggcugugcugggcugggcugggcugugcugugcugugcugugcuugcugugcaggugcagugacaugaguucagauccccaucucuauguaaaaaucuagacaugaguggacucauuacauggcugcuguaaucccagcccugggaaauagagauagcaggaucccauaggcuuaggagucagccagcuuaccaagucagugagcucucgguucagugagagaccccuggaauuuucuuucauguaagauagggauuaaaaacaaucuccccuagauggcuccuuaauuguucguaagauucauuauguuuugcuagacauacuggcgcaaaccuuuaaucccagcacuugggaggcagaggaagguggaucucugugaguuccaggccagccuggucugcuagcgauuuccaggccagcugaaccacauaguaagacucugguccuuaaaaagcaaaagcaaaacaaagcagauuuggguuuuuguuuguuuguuuuugguuuuuguuuuuuugagacuugguuuuucuuguaucccuggauguccuggaacuugcuuuguagaccaggcugggcuggaacucagaucugccugucucugccuccugagugcugggauuaaaggugugcaccaaaacaaaaccuugaguuugucuuuaaacuauaaaauaaaauguuuaaaaguaaagggguggggggacagcgucacaaaaauccagaagaacaguaacugcuuggugcuucuuacaauacuccagguggcuucccccuguguauuuuuuuuuuaagauuuauuuauuuauuuuauguauaugguacacuguagcugaacagaugguugugagccuucaugugguuguugggaauugaauuuuuaggaccucugcucacuccaaucaaucaauuccacuugcuucggcccaaagauuuauuuauuauuauauguaaguacacuguagcugucuucagacacgccagaagagggcgucaaaucucaguacgggugguugugagccaccaugugguugcugggauuugaacucaggaccuucagaagagcagucagugcucuuacccgaugagcuaccucaccagcccaucucccuguguauuuuaaauguauuauguaauaaacauucaauaaguucuaccuuccucacucugaggcaaggucucauauauccaaguguaaccuugaacuuucuauguauuauuguccagaaugagccugaacuucuugucaucagccucccucuuccagacgggcacugcaggccagguucguguggugcugaagaucaaacaggauucaucugagcugggcaagcacugggacacuugagcuaaauccccggcaccaugcucccuuuuuuuguauaguuuugugaauuuggacaaaagcguagaguuguauguuauuaaaaccuuuuuuauaaaaaguauaguacgggguggggggagguauggaauguggaacagucagagggcggagggcugggauggggauaaagacuggacuauaaaaaaaaaaaagauuaaagaauuaaaaaaaaagggaacuagguggccucagcaauggccucuuuagcaauagccaagauuaaggcuugggaccugcucggcaaggaggaacuguugaaacaacuggacgauaugaagguggaauugucccagcuucacuuugccuaagugacagacugugccauguccaaacucuccaagaugcgaguuguaugcaaauccaucacccgaguccucacugucauuaacgaaacucaaagagaaaaccucaggaaauucuacaagggcaagaaauacaagccccuggaccugcgacccaagaagacuagagccauggcugccggcucaccaagcacaaagagaagcugaagaccaagcagcagcagcgaaaggaguggcuguacccacugcgcaaguaugcagucaaggccugagaugacaacgacaauaaauugcaagacugauccccccccccaaaaaaaagaauuuaaaaaaaguaaaaguauaguauuguguaacuaacuagucaccauauucaagacggagacuaguuccaucuucuuuuaaaacaaaauuuuauugcacuuauuuguguguguguguguguguguguguguuugaaugugugcauguguuucaugugccaugguggacauguggcaaucagaugacaacuuaagggaguugguucugcccucucacccagaacugagucucagcuugucaguuggaguggcccagcuccuuuacuacugagccauugcacuggcuccucaucugcacuuaagcagacaccccccaauuuauagugguuugacuuaaacgauuuucuugucuuaacuuaauucuuuuuugcauuagauagaaaucaagccacuacuuuuacauuuggauccucucccagaccagcaauaugaguucuaauuuuuuuuucucuagaugcuggguagcagccaucagccacagcucccacucaguccuuugaucacauggggaaguagccaacauguuccacacagcauacuggguuguuaaaucugacugcuuaguaguucugaacacauuugcuucuuaggcugccuuuacuucaugauguguuaguggggacauguccuccuuacaagucaagacacauuacacagcccucucacaauggccucccacuuaaaccuaccagcucagaauuuccaggacuggguccucccucuaggugauugagguucccaagugauggugacuuggaccagaggagaugcuguuuccugaggacauugcuucauaacuggcagggacucuuggaaccuuggaguauucuuggagcugugaagccuaagacuagucucggacugguaaugagaacagcuagucccucucaaggacauaguaccugauaggugcugugccaaacacauagacuguaccauuucucacucugcgcaggguugcacaagguagaucugucgucuccauuuuacaggcgaggagacugaggcuagagauaauguacuuuguucaagaccacgcugccaggguaugguggaccaggcagacuaaucacaguguccauacuccuuaccccuguacuguauugugaacucuccaccgaaagaguggugaccugccccuagucggaggcacaguuaugcaaaauggcucucacuuccucagaagauucuccuggagugcugguguucccaaaguagaggugauuuuaggggggccaugugggcagaaagcagagcacucugggcuccuggggugagcaagucgagaccuaggcuggguuggggcuuggggagacgacuguguuucugugcugacagcaucuuuccucccucugcacuggacagagccuccucuguuucucuccaucugaccuguuuccuccucuggcucucgaguucccggcuccucugagcaccucuucuuaagcccccaccucuucucucucugccucagcuugguaagagugacaaagggcucuuggggcugggcauggggaaacaucucuugguucuggugaaugggucccacaacccuucuacauuagaagagagaggcccauagaaggguuuagaaaacacccugaagagacaaucccaaccugagagucucagucagaggcagggcauucaaaaguggcagcuguuuuuaagaauguuaacugaacuaguauaggggugcacauuagugaaggaaccacaaguuugacuuguacaaagugaaagcacucauguaaccaaccucugaccaagaacuagacaguguggggcuggagagauggcucagcaguuaagagcacuuacugcugaggacccuguuugaaucccaccacccacauggcagcucacaaccaucuguagcuccauuuccaggggauccaauacccucgcugaccucugaggacagcagacauauacaugguauauaugugcagacaaaacauccucacauaaaauaaaauauagaaauaucacaaaauuauguuugaaagagcuagacuacaaucuccccuuucagcccucuuuuaguugacaucccuggaguugggggugcauauuuuugguugucacaaugacuuugggauucuguugguauuuagagagcagagucuuguggugcuaaguguccuguaaugcauaaggcaacccuuagcacaaaggcuguccuguccagaaaugguaugacaaaggcuuaggggcagggguuacaacuguaucaguggguaagugaggaggggucuuugccacgaugucccauucuaucaccacuucacaggccuccggaaugccccccgcugcugggcagugauccagccccugcugugugcugucuacaugcccaagugugagaaugaccgaguggaguugcccagccguacccucugccaggccacccgaggccccugugccauuguggagcgggagcgaggguggccugacuuucugcguugcacaccggaccacuucccugaaggcugcccaguaagugcccuguggggcaagagagggucgucuagccuuggaaaagagcagcacuguacuggaugcuggggagccagaggugucucuccuaggagacccugcgucugcagacacagggccaacaaagcaugcauccaagcuguaacccacagucugggucucuguggaggcuucucuguugaccugauggagcaugguugucaagcaguuuucaaaugcuugcuuuuaggguugugagugacaggagccugucuugagagauuucugucacauguagagaagucagagcauauacacacgaagcacuagaagcaggaagacagaggggugcaaggcaguguggguuggaagaggacaucuauagggauaacagaaugauagugauacuaauuaucauuuacuacauacaaauaccauuaugagaacuuuaguccuuuuauuaaucgaauccuuacgcccuaugagguaggggcuacucucucagaugagaaaaaugaaauagucaaauaauuuguccaaggauauagagccauugagcagcagugggccuccagucaguguaucugcucuugcccaguuucccagacccccuuaacccugauuuaaucucuccccgugguauuuucuuuuuccuuccccgugucagaacgagguacaaaacaucaaguucaacagcucaggccaaugugaagcacccuuggugcgaacagacaaccccaagagcugguaugaggacguggagggcugugggauucagugucagaacccgcuguucaccgaggccgagcaccaggacaugcacagcuacaucgcagccuucggggcggucacuggucucugcacgcucuucacacuggugagcagugcuuuauggacaaggguauaggauugacagcccaaggagcagggacuugguaggggacccacagaagcuuaugaggggggcuuggguucagaucgaggcaucugcagcagaacagacccucacuucacugcauggccgcuucucccuuuaggccaccuuuguggcugacuggcggaacuccaaucgcuacccugcgguuauucucuucuaugucaaugcguguuucuucgugggcagcauuggcuggcuggcccaguucauggauggugcccgccgagagauuguuugccgagcagauggcaccaugagauuuggggagcccacguaaguaucuuggggacccagaggugagggugggaggagaaagccuguaaugcacauuuuccuuagaaggaaggaguuggacuugaaggcagccauaauggguaggauuuagcauugcccuguuguguucaguguugagacuugugauucuccagagaugauguacccugcagccucuucaaauccgaccugugucccaacuccuggggacccuccucauuuuaguagacuaggaccuggggacaaggugcagugacugguaggaaggauacaaagugacucuccaagugacacccuacaucuucacagcuccagugagacccuguccugugucaucaucuuugucauuguguacuaugccuugauggcuggaguagucugguucgugguccucaccuaugccuggcacaccuccuucaaagcccugggcaccaccuaccagccucucucgggcaagacauccuauuuccaccugcucacguggucacuccccuuuguccucacgguggcaauccuggcuguggcucagguauaguggcugggggcuggggaccugaauggggugagcuugggggaagggucauaccuaacuaucccuuccacaccuuuccgcuacagguagauggagacuccgugaguggcaucuguuuuguaggcuacaagaacuaucgguaccgugcuggcuuuguccuggccccaauuggccuggugcuuauugugggaggcuacuuccucaucagaggugagugacucagccagggccagccagguaacauagugugcugagcaccuacucuguggaagugggaugguagcuuccagcuccacugccuuccucugauaucuaccuaaaccuuggugcaauauagaagaugacccuguaggcugaacagcacuuuuaugaggacagaaaaauguaccucuuccuccaaagccaugaccaagguucuuggcuuuuuuugaggggaacuuggcuagauuccagacccucuuucuucgcccuugucaggauguauuugcauggugaaugcuccgggacaccuagcuggcccacaaggagcaucuuggggccauugcuuaugucuguucacacuaguuuuauagauacugucauauuuuuggagcuugguuuccaagucaugccaaccccuaacauacacaaacaguuuucauaacauauacagauuuacuggucccuaauuuccccgucucaaucugccagcccaugauuugccucgguuucuagcucauuuugcuugguuuucuuugucaguuuugguuuccucccacugaacugucaaccuucuguucagccuucuucccugccuuucuggcagagcaucugagccucugguguauaguuugcaucugcgccucccauacgguaaccaguagccauggauguugaaacuaggccaaacugagaugcuuaaguguaaaaaacacgauguguuugagacuuagcaugaagaagagaaagaaaaauaugaauauaaauuaaucacuaauaguuuguuguaugggaugcagaggugguucuauuugggauauauuugguuuauaaaauaaaauuauauaauuuuuuaauguggcuacuagaaaauuugagauuuuuuuuauaugucacacaauguauuccuauugggcaauacuauuguugauucuguuucaagcuuucaccaucagaauagcuuugaccugguuuccucucucuguccuugacuguugucuaggcucugucccaguuaccgcagcccauagcacauuugcuaauagcuguucucucauucucugguuccccaagcuuuauguaauuagucauaggaauccagcgccauggggccucccuccaugcaccccccaccccagaagagugucuucuguccugcuaaugucucaauucucugucuguuuaggggucaugacucuguucuccaucaagagcaaccacccugggcuucugagugagaaggcagccagcaagaucaacgagaccaugcugcgccuggguaaguggugcccaggggacucuggacaucucaguacugaauccugauggggccuccaggaugcagaaagacaguguggagaguuaaauauucagggacagagccaagguauagugauaguggaggaggcaacucccucugagaaggggaagaacccagguuagugccaggaccgcuaccacaggccccucgcccuuccuguggccucccauaguauaauaaaucaccucuggauuuauuuuggaggaugcaguuucugaccugagccccgauguagccacccuggacucagcugccuucaguauuccauacgcaguugcccuccucccgggugcugcuaccaucucuguucugguaacggaucccgccccugaacuccacaggcauuuuuggcuuccuggccuuuggcuuugugcucaucaccuucagcugccacuucuaugacuucuucaaccaggcugagugggagcguagcuuccgggacuaugugcugugagugaggggccccgggcuuggcugugggcgugguugggacuggagcuccggcuauaaugcagcauugcaucugcuugugaagugcuuguuccaccaucccgccucagcuaugaauagcuucuacauugcuguucaacuccacaugucugucugcgccccugggcaggauguccuguguguuugcaacuguucagaaaccaacccauguugugaucugugugccuucuaccaucgguggcucucccugagucaaugcacaggagcagguccuuggacagcucagcaaccuggucaaguuugccaguucugcuugaguguuucuggaucucaguaaaggugaaccagggcaccuguggcaucuccacugcuaaaaggaugccugcugcuacuggggcucaugguuaaaacuucccuuaaaaggagacucuggcuggagagauggcucuguuuuuaggagugcuuguuacugugccauaggauguaaggucaguucucagcaucuacaccugguagcucccaaaugccuguaucuccagcuccagagaucucucccucuccuggacucugcaagcaccuggacauaaguggcacacacacacacacacacacacacaacacacacacacaacacacacacacaucucugacugcuuuuggcucauucuuaaguuucccccuuucagucuaggaagauguuaccugcggugaugcucgauucuuguccccgaaguuugaugugaggcucagacagcagugauuuauaaaagcucucuagaugauuccaaaguaugucacuggggucuagugguacagcucagugguagaaccuaguauguguggguuucaccuccagcacccgcuccaugagaaucacgcaguggggcucagcucucuccuauauggauucauguugggugccuucuuacuggaucccgauaccuuagcuguugaccguuccucaucauagaugccaagccaacgugaccaucgggcugccuaccaagaagcccauuccugacugugagaucaagaaucggcccagccuccugguggagaagaucaaucuauuugccauguuuggcacuggcauugccaugagcaccugggucuggaccaaggccacccugcucaucuggaggcgcaccuggugcagguggggucagcagcugucugaucuuguccuuccucucuuacccucagccucacgucuucacuugagggcuuugucuuacaugcuuccaaaacagacuggggcaguguuugccaaaagcaagucuggauggcuaauugcuuagcugcucaccacugcccucuaggggacagugagaaccagcgcuuuucaaguaggagccacaggagcccugcauucugggcauguuuuguugcugugaaggccucagcuccucaggacuuaaaccuagaaucccaggucuuucgauagauuuggaaggcagcggcugcucuugcacuugccagccccaccccuucuguucucagguugacugggcacagugaugaugagcccaagagaaucaagaagagcaagaugaucgccaaggccuucucuaagcggcgugagcugcugcagaacccgggccaggagcucuccuucagcaugcacacugucucccaugauggaccuguuggugagccucaguguauuguccugcggagacaccugaccuccacaguaccaggccgguuuccgucuggauacacggacuguuugacaaacuagggaaugaggcacucacucacacucugccuugucgugucucacugccccccccgacccccaccucuccccucuacccccuuuccucccucggccuguucacgguauugcaguucucugaggacuuugcucucucuuccuucuucucugccaucuccagugacuuuucugagccagaguaagucagggugcuggcccuagacuuaugaucucaaguuuuacuuuuugggaaucagaggcugcugcacucggauuuugaaugggcacuggcuccaggguggaaucucucugccagcugcagugggaaggacuggcuaggaaagaugacccauguuacauaaggaggggucauuguucuuucuuuccuuucauccccaaagcggguuuggcuuuugaccucaaugaacccucagcugacgucuccucugccugggcucagcaugucaccaagaugguggcucggagaggagccauauugccccaggauguguccguuaccccuguggcaacuccagguaugagggcucugucuucugcaggaaggagggguggguggacacuuuggaaugaauguaugggguuguagaacuaggggaaggaaggaaaggccccagaggaccugaaggagaugccaaggcuugggaagccuggagggacgggucccagaacccaagaacagggauucugggagggaaggguggaaagaacagaacaaagcccuaagcugugcucuuugucccccugacagugccaccagaagaacaagccaacauguggcugguugaggcagagaucuccccagaguuagagaagcguuugggccggaagaaaaagcggaggaagaggaagaaggaggugugccccuugaggccagccccugagcuucaccacucugccccuguuccugccaccagugcaguuccucggcugccucagcugccucggcagaagugccugguagcugcaaacgccuggggaacaggggaguccugccgacagggagccuggacucuagucuccaaccccuucugcccagagccuaguccccaucaagauccauuucucccuggugccucagccccccgggucugggcucagggccgccuccaggggcugggauccauucauucccgcacuaaccuaauggaggcugagaucuuggaugcagacucggacuucugagccugcagggcagguccuaggaugggaaagacaaauguacaccuuucuauggcucuuccugagagcacaccucugggucucaucugacagagucugugggccaagugucugccuagaagagcuguguaugucuggcuagaagcagccaggccauggaaacaaguugaauacagcgauugguaggccucaugucagaaucaggacccugcacuucaggacccuugcuucugcccaccaaucagagucugacuggcaguguuagucuccgacagagcuuguacuagggcaggaauggcagagacagggaugaugguacccagagugggcugugguggucugugagguaaccaagcccaugucuggcagaugagggcuguuugcccuuuucugugccaaugagugcccuuuucuggcacucucagaccaaaaguguuuauugugucauuuguccuuugucuaggagaggacaggacucucuuuuuccucuuccugguaguuguaaugaccacucccauaagggcuauaacuguucuucacagguggcccugcucaaaauacauccucucuuuucccguucuaucccuacauucacaucucaguuccacuaggccaaccucuuccugguuagcaccuuaaaacugcagugagcacacacagacacacacacacauacacucucacacacacagacaggcaugcacacacacacacacacacacacacacacacacaccccuuacuucugagcucugucuuaagagacuacugguucagcuccaggccucugaaagacauguuauuucuuccucacauccauccaguggggaggacccucugacuuaagggaccaccuugggaagcuucuguagcuucagccaggcaagaaagcuucuuccaacuucuguuucuggugggagcggggggacucccacuuuuuacaaugucuagucauuuucauagugccccacauucaagaaccagacaacaggaugccuuagaagcuggcuggguuuugggucaggggcucaguaugagaagaagaaauaugaacagcaaauaaaacauuuuuguauaagcucau

SEQ ID NO: 12110 - RNA, 23678 nt, Mus musculus
uggggcgccggggcggccuggccuggcuggggaccgcggcgggcgcccggaccuggaggggacucucgggccagcccggggcagcaugugacuccgaccaggugggugcucucuucucuucugagccccggacucuggguggucguggagccggguggagguaaggcaggggcgggaaagaagagagaacuaggccucccccgggaccagucccggccaggucccggggcgcagacuccggaaauggggggcugggccagugggccgggcuccgagugaggggcugaguaccuggucgggaccgggaagggagcuggaaggaauggccuccuggcaaacuuugcuuuccaaccaggucugagccuuggaaaugggcacccugccccgcaauguucccgggccaauaaucagaacuuuuuuccacccggaaagucggggcccuggggaaagcuaacuccuaugauaaagaauucuugagauucaguuucuagacgguuccuuaccuggaagugucuuuuuuuuuucuuuuguaaccaggccugggccuugcuucguuaucuucgcggcauuuacaugccuacguaugugugaaucuauguacacaccucucucuccgcuguuaacuaaggcucugaaaucugaaucagggauccuugcccugaguucccucucccccauuuaccuguguauagggaguuucuuguuggccucggcacaagguucuaaggaacguguaagagagcuauucggaauaucgcggugcgguagcccauuuucagagcccuaguuuggggcaucuucuauaaaugccuuuuuccagaacugauccgggagagcuagcccuagagccucaguuuucaagucuucuuccccucccccuuuccuggaucuuggguucucuggacaaucuuguccuccugucggccuagcagugaacucuggccagcgcugugucagacugagggggaagggcacaccaaacuggagaguugagagggugguuuuccuuucagcuuccuuccucccuugcucucccacugugcucucagcuuuacuucaaaagcaccaagucccagagaaacagcccccaguguggccucuucccacacuuccugcuuuaucuacaccugggguaugcaagcuucuggcucuaucaaaacagucaucauuuguuaaccaguccucgggucuaagacagaacccauggaccuuaaaaggacuuggaggggacaagggggaggcugaguagaggacagacagcuucuaaauucuaaguuugugguaaaagagagauguaagcauugggagggacaagucagaaggaaugugaagggguaccucuuuucaaaagaauacagaaauugaagauguagccaaaguuuucauauaucuguuuucccuggaggguauggcugcccauaaugugguuugucugaaguuguguguggucacguuauggacuugccugucuuugggauagacgucauuuguggugucuggaauagucacuuacccugguguggacagaagugcgaucuccugagauaauguuguagagaaugguauagacacaaacagguguuagccuguguuguaaacaggacccuguaccugcaauguguguagaguaagcuggccacuuggagugucuguaaaguacacaaugucauuuguaugccaaugacaaacaagucacaccuuguuugacuggauggccccauagucacugguaggccuaagggcauaagcauccucacuuaagagugcucuuauauaagaccaccuggccccuaagacaacccaugauauugucuaagacauuggacaauagguaaaaaggugcuuauuccauucuuuacuggauugguuggacaaguuauaacacuggugucauacuauacuuauuucggugucuggaauauugaggguaguaaugucaaacacuaaaucaaaguacauaucuauguggugauuauaugagcuaaaugaaaugaagaggguaucuuuuggauuccuccaaauuccaagugggagauuuguuuucuuacuguaggcagaaguauagaugccauuguaaaugcagaagcaaucccaagagguaaggaaggguaucuuugaaauccuuuuacaccuggauaauuagaaauggacaagagcuaaaguguugguuguggagucucugugagacuguggaggucuuacuguguucugcacuguucuguuaaugggaucacuuggagcuuugucuauggggucuugaagaugugaaaugucucuggucuggagagaaaccaguucccuguggugcugugcccugucucucccuguaugcagauaaauagugauuagucaucccagaugagagggauaugaggauguuucaucucuuaacggaauagguagcuuaaaaaaauuccguucuaaugccuucauaugaauguuuuacagauuuccuuuagcuuuauccauauucuagcugggucaugccuguuugcauaggauuauuaaguuagaauuaaauauaagaacuaacaguaugugcuaacuuugggguauaaacaauuaaguggcuuucuuucuuucuuucccuuuuucuccuuccuuccuucuuccuucccucccucccuuaucucucucucucucucucucucucucucucucucucucucucucucucucucucucucuuuccuucuuccuggguuuuugaaacagaguuucucuuuguaguucugacagaccuagaauucacuuaguaaacuaggcuagccccaaacuuaaagaucuugcuggcuccaccuccugauugcugggauugaaggggcaugccacuacccuucuucuaaggguaugaugauauuggagagaggguuccagacaguacagaugcugaugaggaaagauaacaggguuugucacauaguuuucugaggcagguaggagcaaguuucagugagcaaauagguuauuuaacauguggcugagagaauaaggucacauuauguaucauuuauacauuuuauauuuaagagcuagauuagaguaaaucacauacugcauuuucauaacuggaaaaggacauuaaaguccuucgauccauaugcauuuauguuaaucacauauacuugcccuauauagauaauaucugcaucugugaggugaccaggaacuugucacagaccacaucugcaagaugccuagggaccugcuuguuugguuauguaggauuguauugcauagagacuguaaggauugauuaagcugguguguguguguauguguguguuuguacuuggaaacucagcaugacaacaaaaggcauucuuacaaguggcuuuuaaaccaccuuuaaaccuggaagaaaccagaaaguuccacaguuggguauagugagggacccacagcccaugguguccucucggguguuguggcuggaugacuguguacuuacaauagacucacaucaggaguccuuguuucagauuuacauggauccuuuccuuaggaaauggagucugugggcuuuaguuugugaucugcaaguugagcaaaguuuuguguuucuaggaaugucucugcagccuuacagucuucuauuucuuuccuacacauauucagucucucagaucaauaauaccuguacuuccuaugacuuuuaaagauaacaauucacucuuuguauuaugcuaguuaaucuucauuagaacugugaaggaaacauuuccccaucucuucaagaugaggaagagauauuuaaauagauuaaaugauuccuacaguucacuuaaauaguagcaaagaaucaaaaagaacugaaaaauaacucuuguaacugcccaucuuuaccaagaaccauaaaacuuaagauagagaggacugcacaguuaacaugguagaggguaugcgcucacagagauguaagauagcugggaaaaaugacuguaaaaccuuagguaguggggauugcacaguuaacucaguagagaguguaccuucuugaagauccugauacagcugggaaaugcuagacaaguucuauguguuuuucaggagaagcagagaguucucugggaccaaauuccagcaguggaccaccacauaugaaggcccauagcugagcgagaagggguggagagcugaggguagaggcaggugcugaaaaggaaggcaaaggccagauuguacaguguguaagaccauugcugaaauuuugagauuuaucuuaagucuaguaagaagauaccaaggaauuucaacuauaagugguauuuuauguggaaaaugcacuguauguguggaguuugggacuaggcugugcuccagguauaaagauaugaguauaauauggagaaucuuggccaggugggaaacaaaagguuuauucuuuauguuuaaaauguuuauugagcacuuacuaugggcugauguugugcuagauguaggcaacugaacaaauccuaucucacacugcuugccauuuuuuggugagacugaaguugaaucagaacacauaguuauauaguugaaaugguauaaaugcaaggaaaaagugaagugugucauguauuuuuuuuuaauuaccugaaauaggaauguaguuuaagccauuugaggaauuagaaacccaaagcgucaaccaaagcaggauaauggcauaacuacaaaggaaauccugaugugaguagugauagucacaaccugcaccaaagugugaucuagaggaaccuggcagaauggcaccuauuggagcugguggagcaggugggcggggacgcucugaagacagcucauaggcagaacucgguuuagauauucagaaguugccugcugcugggaacucuuagauacugguuaaguguuagagcacagguucucaaccucuuguuuuugaccucuuuguggggugcugaaugacccuaucucaggggucaccuaaggccauugggaaauacagauauuuauauuacaacucauaacagugacaaaauuacaguuaagaaguaacaauaaaaauaauuuugugguuggggguuaucauaaugugaugaaauguuuuaaagggucauagccuugggaagguugagaaccauugguuuagagagauaaucauggccuagaggagacaagguaacgagguggaacaugggaaagagggagagugggcaugcaagcuucuuuugaauuguauaaauugaagcagcaucucuccauuguuugcugauugcuuguuuuuuguacaguaggauaugaggugaucuguuggaagugggaaguagggagacaggguaaaaggucacaauguuggcaaguaguaagaggaguuagcuuggugaggaggagagaaucauaaggaggguggcccagcuuuaccugccaugucgaauauaguaggugggguuaucuuagcuagccauuuuaaaacagcugucucuauaauuuaacacaaaauuguucguuaguuauaaauaacuacagacacuguagaaguaggaagauaguaaaauccagaaccuguauaaaggauucaucuguugcauaucggcuguaauagcuugaccuauuuuaaucccacgucaacagcucaggaggacgguucuaccucugacacugcuucucugggcuguuagauguagggugugucagccaucaugucugguaguuacuugaagcugacucacacugagaguccagagaguugacugggagaaauagacaauggcauaauagaaguuagagggcagugaccacugggaguuccuggaacuccuugacaauggucuuuaaugcugauugaauuauuuauaaucaguuuuucccacaggggugcaagaucaaacaggagcuuugucuuggucacugcugguugucugauacuuuaaagggucccuaaguagaugugugugguuuguuucuguguguguguugcacgcgccagaauuuaugccagauauuuuucuggaaagcuuuccaucuuaucuuuugagagaaguucucacucaacugguacucauugguugacuagacaggcugaucaggaagcucuggagaucuaccugucccugaccacacccacacauauuaggguuacagacacacaugauuauuccuggaauuuuuauggccaugcuaggguucuuaugcuuguacauuaggccaaccaaacuauccuccauacucucuugguaaaucuucauuguacuuaccaauugaaccaucaccucaaucccucuaagucccuaaugacuacagagaugacuuuagcaauuaagaaaacuugccacucuuucagaggaccaggguucaguuccuagcacccauauuaauaguucacaaucauauaacuccagucaggugaucuggugcccucuucugaauucuguggucacugaauguacauacagauauguauaaauaaaaaugaaauuuuaaauuuuuauguaaaauuuauuuauuuaaaaaaauguauauagcucaguuuaauuuaaaaauaaguaaaguuaaaaaggucacauacaaaggccagcacuuguaucacuguauaccuguccagaaugauccuaaauggaaccaaagaaguuuuccauucaucuuauuuggaucuuuucuuguauacauacacauagaagaggcauuagaaacuuuuauuuuguauccuucuuuaggauucagcccugauggaggcugaggagccugaauauggaguaucuacagaagucccugacauagaagaauugaaaacuaucccugaagguaucaugaggagcagucagaucccugccuuggauccugaagcucaagaagaccgagacccauccuauaaguggacagauggacacagacccgugaugaaccagucaaaaguguuaagggacaugggugaccauacaccuaauaguauggcaauuuucuucaagaaagaaucuucggauauggagacaagccaggaaauccuucuggcugaggccuguaacacuccagaccagcaggaagcuguaauccagagccuuaaagacagacugucaagaacaauagcugccccugagcucuuggcaugugcuguccaggaagaauggcuagacauacccagcaaacuagacaacagagugggggcagaauugcagucagaacuuaugucuuugacuuuggcaguuagcaaagagaaagaagaggaagaaaccuccccagacaccucaaucccuagaggaucuuggccucccugcaaaacucacccuggugagacugagcagacccagggcaguggaagugaacugcuuaggcaggggaaacagcugcaguuggaggccacacaagaaaaucaagggcaagaaggcuuccuucaaucucaggaagcccagggacuggaggagcaggagggacaggaaguagaaauucaggaggaaggaacucugaacgaaggcauuuguuuuggugggcuccugggagagcaggaggagguggaagagggguuuaacggcaacgaggaagaacagaagcagggacagauccaaagcuauaugcuacuuggaggacaaugggaaaaugaggggcucaguggggaauuagaaggucugaauuacagugagagaggccaagagaacagggaaaggaggguuuggguucugagagauucagaagaggagggacaggaccaggaauccagggagguggaagagagaaggguagccacucaguauacagagaaucaaagguuaguagagaaaucagagauuguaaagagaaagcagagagaucaugaucaaacaggaaaagugaugcccguaagggaccagaaggagguuguagacucaggugacaggguccaagggaauggggauaguggugggcagacagcaguggaagggagcagaccaggagaggacagcaagccuucucuuccaguggcuuccguagauccugagguucucuccccagguacauuguucccagguauuucuuccucuguggcugauauuccacagauucagaaggagccugugugugaggaacugagcccucaagcuccugcacuggagccaacagaauggucucaccaacccauuucucccccugccucuuuugcuccugaagaaucucuugauaauaggacucacaacagccagcaagaagaauucaggcuaaggaaggggauugagguugucucugcuaguacaucuguggcuccuucagggacacgagauucaccuccuuucaguccuccuaauguuuucuccagcacugccaccuugucaccuguuagcucuucaguuauccuuccugaggagaccccaacagccucugccucagcugacacuccacaucauugugggccaugugagacuccuccacuacccgcaaaauccuccagguacccaugugccaccucugacacagccaacccucacagcccucuuagcagcuacacuggaguuacccaacaucuaagaagcaacucguucccaggcucucacaggacagagcagacuccagacucucugggaaugucacucucuuucucucauuuggaauuaccucagaggccuccuaaaccagccaucuauggcucucugaccccaagaagaaacagaagaaguagggaugguaucgucuuuucagacuccucuacugcuuuguuugcuuugaaacaggacucugaagaauucacuucaaauccagagaggcccagcaguccucaugguaguccgacauggggcuccccacagaacucagccuuugccauaggcucuccugcaaauguuucuucaccacccacugucuccauggauaugacgauacgugaagcuuuacucccuauucccccagagaagagacauagcuacagucacauaguggagagggauggccuucuucaugaaguagccucuacacugaagcggcauagucauccuccuccacugacccuaaguucagggcuccauagaucuucuaaaggcucauuuucccuaguuccugacuccacuguggcaaggcagcaccgcccucugccgucuaccccagaaagccccaaccauacacagaccuccaucccuuccagacugagauacaacaaaccauuacccccaacuccugauaugccugaguucuaccaucccuccaucucuuccucuuauaucucaaggauguauaggccucuacccccagucccuaucauagauccuuccucugaaccaccuccauugcccccaaaguccagggggagaagcaagaguauccagggaggaguuauacauucaggaggucaagccaagccaagaccuaauaaucaagacuggacagcuucuacucucucuguuggacgaaccuccuggccuccagccacaggcagaucaacagaaucuuugccucucaccaguagguguaauaaugaaguguccccuggccuggcuuucagcaacaugacaaaccuucuuagucccucuucuccuacuacuccuuggaucccagaccuucagagaccuaccacuaaggaugagucagggcucacugaagagucugagccaccagugagaggaucauuuagacgaucugccccucaggaggaauuuaauaauacaaggaggucagcuuuaggaucaagaaagaacucagaaaaaccccuccaccaccaacuggagaaggcauccagcuggccucacagacgcgacccagcaaggacaucagaaaguagcagugaacagguuguucugggccagguacccaacaagcaaaagggcuggaaccggcaaggccuucguagaccuucaauuuugccugaaagcucuucagguaaguaaggagcagagacucuagaaccauuuauguuagacaaagcuuuugauuguacaucuuccaucugcgaggucucuauugcucucucugcagcuucauucaccugcaucaccuacaucagcucagaaagucaugacccaccaugauccugucagaauguuccgccacccuucuuaccuuuccaucuucugcuuccccugaaacucacuucuucuugaaauugccagacuccuucauuugcuguaucuuucgaaaaucuuaaaguacccuuacuuugugcauuuccugucuugcaugaaggcugggggcauagcuaauauaucuucuggaauuucuacccugacaugagcgccagggacacaguagguacugggcuuuagaauaccuuuggaaucauugucuucucuuccagauuccaauagaacugucuucccuuugcucagcuguggcuccugcuuauccuuucaccuacucuaaauguccuuguugugccacccauuucacuuuucagauuuacgaaauccagcugcgggaagacuuccuggcucuucagauucuguuguuuuccggugaguugcccugacucuucaguaauucaacuguacugucuucauuuaugacacuaagauuucucuaguaagaauucaguggauaaagauccuggaaucgagaauugcuggugcuuuuaugucuaaaaaguaaggagaggaagaaagaggcaccacaacugcggagaaggaagguguuuguaccuacccaguucugccugcugugucagagucaccuguuguccuccuaaggcauauggcuauaaagcagucuccuucacauacuaucccaaagaccccugaguuacaaaguagaguuauuguuugagaugccccacugcauuucuaaguucucccuaaguccuaagaucucccuggacuaugagauaaggaagaaggguugaauggaaggacccgugauggggacggcugaagcaacuuuccuucaguccugucaucccagcauguauauggaagguuagaggauuuuaaaucuaaagucacucagggucugcugucucacagucaguaagcaaccucaaauccugccuacuccacagggagaagaaaccaaaggaggggaugggaggcuuuucaagacguugcuccaagcucaucuccugugaguacuuuaaagcagaucuauaggcuugugugugcuuucugucuaaaaugggacagggacucaugacugccagcaauugaauggugguguucagagaaaugguugccagaggucagccauagaugccaguuucuguuggugggcuucuacucacuucguuuucucaggauuuucuccuuuuccuauguaucuucacccguagcccagcuacuuuaucaggaguacagugauguuguucugaacaaggagauucagagccagcagcggcuggacagccuggccgagccacaugggcucucuuccccacggcaucgucgaaaggcacuggucucuucagacuccuaccuacagcgccucucuauggccuccaguggcucccucuggcaggaaaucccuguggugcgcaauagcacagugcugcucuccaugacccaugaagaucaaaaacugcaagagguaccaccagggcagggcaagggaaagcaaggggaauaaagucagauucgcuaauguuuuaucuccuccucaccucugccaccaagagcagguucuccccaccccaggcucaccuggauacauagugacugcucagugccacacugaagaaugugaagugcucugagaauccagcauauucccuucuucccucacucgugcaugugccgucuacucuuuccuguacuggcuugaacucauacagagugaccuugccuuggaaucuguugggaggggugugagaguaacuucaucgagauaaucuccucuccacaucuacaaguguuucacacaagccauauacucauuuuugcuggucuuuugaagaggacagccaaaaguuuuccuuugguucuuugaucucacuuaggcuuuacuauauccccgcuuggucaucauccccaggacuaggacugcaggagacacugcuugucugguucuaagcagugagcauuaguaaguuuuucuugggcagauucugcuuuuauauuugucugaaggaggagguagaacauuccuucccagggagaaaauagggcacagugggguagacuuaauaucuaagucauuguguucuauaacagugauggagacacgaugccuuuguuacuaucuguuucuugacuuuggccaagucaccuugcugucucuaagcccuuuguaaaacagauacacagaguuacugggagaauaagaaagauaaaugguuacuacagaacagucagucagaaaauauugacuauuugaauuuagaugauguaagccuggcuucaauuaaugggauaaucuuggauaaguuauauaauuuaacuggaaauuuuaaaauaccagugucuagaaaauuacuaaccuguccuguguuuauugaucaaauaaugggaagaugacaugaacucucugaagucacaaggguccugauucuagccuugaucccucuugacuuugcaagaagagccaccuaaguaucaccaccucacgcuacauauucauuucauaaaauagcaucuugggaaucugcaguguucuuccacagacucucuuccuauugaaaacuguguuugcugaagugucuuugugguggugggguggucacucuauauaaaaagacaaaacaauaacaacaaaaacccugaguuucugaguguuaaaugagccacuuuaagccauguggucuuugaugguuauguugagaauaaaccugcaguaucauaguuugggcuuguauauuaaguucagcugugguuggcuauuucagugaucagcaagggaugccuaucuuacuguuuuccaaguagucugagugaccaugcugggaaaaggaguccacucaucauguguaugaguuauugcucccucugcuggagccuucaugcacauucuuaagugacaauuguagcaucuucucucauguauccuguuucuuuuuauucccaucucuccucagacauaaaauugagcuugucaucuuccucucucucccugacacagaccucucuggcuuaguccaugauuccaccaucuaaccuauugccuaaccaaaagcagggugguggcuuuggcuccuccucuuuacaccccacuucuagcaaauaagcaacgccuuccaaguccucuuugaugacuagaguggugcauuuuuccacaugccucugagugauaggccuucaucucccaucuagacauguuacccaauuucccagcagggcucuuacgucuucuggccucuuccacacauugcuaaaagguauucucauucuaagaaacgaaacaaaacagaaccaagaagcaacccagcuaauuccugaccuuuuuacauuuucacaucucuuuaggcuuagauccugcugugcgguugacaugauccaccaggccucgugccucauugcuacuugucccuccggcuuuauuuucguuuuuucuuuucuuuuaaauaaaagcucuacaagugcucaacuuaauuguuucuuuucuaaaaguaaacuucaucguguuuaaaauauuaaccaccuuauuacgagauccagcacagucuauuuguugguaaaauguuuacuaucgcaugguaaauuaacauaacuaugauaucacaguuauuuguguauagguaugaauguaucuuuaaguuucuugaaaacauaaaggcucuguucacguuauugggccccuaaguugacucuggcauacucaaauacuccuuguguuccuccuagacuaaguuucauuacuaugacugaugaaaagauauagcuaauucagugaucaacccuaaaccauuguucagcaacuuuuaucuaccagacaguucauaaaaguauucauuaaucuuccucuuguccaaucuucuaggccaaguuugagcugauugugucagaagcaucuuaccugcgcagucuaaacauagcuguggaucauuuccaacauucagcccagcugcggggcacccuguccaaccaggaucaucaguggcucuucucucguuugcaggauguacgagaugucagcaccacgugagacuucuuccaaacuccauucuaucaaccuugcugugcuuagccauugagauugcagcugauuuugucccacuuagaaaccuucucuuugucagagucucuggauaaaagugggccugggcucccuccaugaccuucagggguagaaagggggauaggaaaaacuaagaagaggaggguauggaaggucacaggucuauugauauagaugagugagaagugcuuccuggauugagauuuuaucuauguucuggguuuguaccgcagugaacacaagcuauaagaaccacuggaagacuggcaaaccagaauagaauaaaaaaaaaaaagaagaaaaagaaauagaauaguagaauucuauuuaauuuccaucagaaauaaacuaguaucaaccuagggguugguugguacuacauagcaagggcacagagcuaaggagagucaggagaaguuagugauucauggaauuagcugcaggcucagaauauacaggacucagacagaugcugggcugaggacccaguagcucaugagacuguuuaaauauuacacagguuccuuucagaccuagaagaaaacuuugagaacaacaucuucuccuuccaagugugugauguugucuugaaucaugccgcagacuuccaccgugucuaccugccuuaugucaccaaccagaccuaucaggaacgcaccuuccaaagucuaauguaagaaugaucccucuccauucccuuaguggacauugcagugaccuugacucaauccccagcccagagcccucucucaugaguauauguucuugugccugcuaugucaucugaaguuucagcccauugcccauaucagauccucucugcagucauaucuggacccuguacauggauucuccucauuauuuccuaaucccagauccuccacuaauucccacuccccaugccuucacugagcccccuuuacucucuaucuugcuucuuacuugcuacucauacaggaauagcaacagcaguuuccgggaggucuuggagaagcuagagagcgaccccaucugccaacgccugucucucaaguccuuucugauacugcccuuccaacgcaucacacgucucaagcugcugcuccagguauggcagauacuucuuugguucaauugccuugacucagacauggucuuggagagauuggaggcaaagugucauccauuugugaaguuuccacaucauguggaggaugggaacagauuuccaacuguucacauuuuucuuucucagaacucauugcuuuuggaacuaugucccugacuuguccuuccucuuaucuggcucuuguccacucuuuguuccacagaacauacugaagagaacucagccuggcuccucagaagaggcagaggccacgaaggcacaccaugcccuagagaagguaggcagccaauauauccaguaaccuauaagggcuauguaaccauucagggagaagucuucccucuucccccaauacucaugacugaaaaaugcaagggagaugggaccacacuaaggggagagcucagucaccuucugucaucuaccagaacuaauucuucacauuccauaucuggcaaguguguuccugauaccccaggcccucauccccguauguucucucaggggauauaaaguauucccgcaucccagcgcaugacuuuaaugcugcuuugcacaauuccagcugguagaaaagacugagcuuuucaggcauccuuccagguugccuuuaagggggcuuaaagggcaagacucaaugaucuuccccuuccuuuccccugcucuguucacagcugauucgagacugcaacagcaaugugcagagaaugcggcggacagaggagcucaucuaccugagccagaagauugaguuugagugcaaagugagcugucccugcacaccucccugccuaggcgucucauuaacauauccuacucaccauccucuaacacagucauccagccuccagugguucuaccucuccuucucuccauuuccggaauaugcaaaugaucacuucauucuacaagacauguugauagguggaggcauagaauuauaugcagauuuuauuacauauugguguaaaaguagaggaugccgaucuauaauuauaucuguguguaugugcauacggaaaugaucagcaauaucagaaaagagggaggggcaguaguuacuggaggaggaggaacacccagcaaauggauagaagcaauuuuccagaauaaggauauauaaaaauuuaggggugaggaaugcuugacucacauauuuuaucaggucaccuucacccuaaccaaagcaacaugucauaaaccucaaauucucuuguccaaacaaaugugaaauugauccucgacauuuuaauugcagugcauuacagaucauacauaucauuacuccucuaaaagagaacagauuuccuugucuaaguuuuacaggagcucuuucccaggccgcagcuccaggaacaccccaccuaaaauccuuauccucaacuccagccugauucgcacucugccugucuugguucugaccaucauuaaggggaaagcagauaacauaacugccccugaucuuuggcuuucaugaugcuguguugugccuugacuguucauugacauguucuccuugggcucacagacauuuguucccacaucaucucuuguuaaguuagagucacaccuuccuuucaccauggguccacacagagaacaguguaguuaggggauuccaagagaaacaaucuggauggcuugauuugcagugguucucaaccugugggucacaaucuccuuaggagaauuuuuuuagcacuuuuuuuuauuugacauuuucuuuauuuacauuucaaauguucucaccuuuccuaguuucuccucugaaaacccucuaucccuucccaccuccccuuucucaccaaccuacccacuccugcuucuuagcccuggcauuccccuauaaugggcauagaaccuucacaggaccaagggccucuccucccguugaugaccgacaaggccacccucugcuucauauguagcuagagccaugagucucaccauguguuuucuuuggauggugguuuagucccagggagcucuggugguacugauuaguucauauuguuguuccuccuauggggcugcaaaucccuucagcuccuucacuggggacccugugcuccguccaaaggauggcugugagcauccacuucuguauuugucaggcacuggcagagucucucaggagacaguuauaucaggcuuccuuaggagauuuuauauaagauauccugcauaucagauguuuacauuaugauucaugacaguaaaauuacaguuaugaagugacaacaaaguaauuuuaugguuggggggucaccacaacauaaggaacugcauuaaaggguugcagcauuaggaagauugagaaccacugcuuuagagcaagagggaacaucuggaauuggugauugggaaguugggcaggacuaacaggacacucaucaccugcguccucucucuuuuugcucuguagauuuucccacuuauuucacaaucucgauggcuggugaagaguggggagcugacggcccuugaguucagugucuccccagggcugagaaggaaacugaccacucguccaguccaccuacaucucuucaaugacugucuguugcugucucggccccgagagucaguggcuggaaugggaguccagggcauaccaaagagugggaaaggaccagagggacaucaaaugaccugcugccaaggaaucccuuuucaauuagacaacucacagucugagucaugagucaacuuagaggacagaagugggaauaguguuaccaaaccuguccuguguuauagacaugaguaaucuauagcacgagauguugucuuuucaauacguuuauuuguggcuucuuuagguugugcccagcauaauagcugauacagcuacuuggcuaauuucagagcugaaacccuggucauuaggacuuuauaaaguuaauauugguucuuaccucuucaaugccuuaaaguagugaauaucacgaaugcaguaaauaguugguugagacacauuauauucagaguaaguugaagcccucauauggcuuuuauaugauacagucuuuuauaugaauacuuuuauauguagaagcuagggcaggggaauggaauccaagggugagggugggugaaguuccaaaacucuagacucagacuuaaaagacuucugucuugcaggggcagccgguuccugguauuugaccaugcuccguucuccuccauccgaggggagaagugugaaaugaagcuucauggaccucacaaaaaccucuuccgucucuuucuccugcacaacgcacagggcacccaaguggaauuccucuuccgcacugagacucagugagacggggcuggacacaggaguuggggguggaugucccuggucagaaccauaugcagaccaugacucagcacuucuggggucguucauagagagaaacccaaggaucuagagcuaagugauaacuugaaaaagauucaguguggggugaagaugugaaguugccaccacagcugaacaucugcuucauagccaguacucaaaacgcacaaggucugugagguauaagggagcugagcuugcauggaaugagcugagaacuggauuacuguguuuaugagugaucagcucaucuaugcaacccagcuccacagcuggugggcacuuaggugaauaaaaaacaccuugugugcuaucugcuuuuccucaaucuccuagcuuuauccucuauugagcagaaauauguaguguuaagaaauaugaguugaaaucuuucugaugauaauaacaaacgaaugaauacauucacauauacauacaaauguugagaguugaaaugguaacuagagaaucuggcaugcaauauagcaaacuaaagaacacgcaguagcuuugcuggugccuugagagacacaggaagagcuucucuguaagauuauuaaaccuaucuguggcuuaagguuccaugagauauggaugcuuuucagauugaucccuuggaagacaguucaagugggaucaauaguuucuaucucuccucauggaacggagaagguagugcauggguuuguauucuguauuucacccaagacaaauaaccaggagcagauuuguguucuuuuguagagauuugguagcauccuuuuggaaaagugaaaguaccauucucaauaaccuagguacauugggaagcagaggauaagauaggcuaagauuacauuauacaacaacaaugacuuggcuuaaaaauaguauuaaauaguaauuuucaacuuagguauuugauugaagggagguaggugacaaucaagagccaugcgaaguggucaugucuaaacagaugagcgauuuguuugguaugauuuccagacugaaaaauguucaugugugugacugacaguucaccuguugacucuuucuuggagauaugccuggagggagaaaggaaggauaacuacgauacacuaacauauaacgcaugguaacacuguguuuccagccaggcagggucccauugcuuuuucggagucauuagauuagacagguccuuccuguagccaccaccugccuucuccgccauugacccucagccugugugccccuagucugucacugaggcuaagucuuuccuuuguuuugucagaagugaaaagcuucgcuggaucucagccuuggccaugcccagagaggaguuggaccuccuugaguguuauggugaguaaggcuauaacggagaaaauggcagcgucuaucuggucuccuuuggaugaaggguagugugcugggugguaacucuaaaaggcuucuguuuauugcuuuuccuuagaauuuuauaguagauugcugaagauagaagcuuaaauucucaggauacagcugauuaacaacuguccuucaugauggcaguaucuuugcuugagcauucacugucuuaggcaaauguuuguucuuuguaaaauauauauuccuuuaaaggaauaucugcugugauuuugauuuaauuuuaccgauugaagauguaagagggaaacggggguggggggcacuguagacauaauggggauagcagaagagcugcacacacuuagucugacuacagcuggauagcuaaguuugccuacccagaacacacaggaguagccagagcccagaggguaugaaauuugcgugcugugcaguuuguuaauuagcuucguuugugauggguaaagaggguagcagggaacuacuuuacuuauagcauuucacuucuguggauggaagaugcgcuuuagaaaaaugaagugcacugcuaauacguggcauucauuccacuuacuuucugcaaaaucagugcacgagaguaaaguaugaagucaaauccaucucagauagauugcuucuagaauagguauacucugaacuucguuaucuugaacuuaauuacaaucuaugguaaugcugcccagcucuuaagaaagcauauagaauuaccucaugaaucauuuggaucaaugaucaucuuugaucaauuauagaugaggaaagugaggccaaaaaggagcaaggacacauaugccauccagaaaguuuaacgguagaaggcuauuuuuaaaggcaugggaucccuuaucugguacaagcaagaaaaugaugcaagauauauagacuucaauuuugauucuuguuggaaaggcugugaauuaaguucugaguucuaugcugaagauaccaguaaucacuugaaauuucuaguugugaagaugcagugucacagaucaagagccaaaauuaucaugugucaccuuuggucccaauaguagccuuuauugccagccccuaucuggccugauggucuugugaccgauauguaaaacuuguggauauauuguuaaacuuaguauagaccguuagcuucaccagcccugaagcuaagucuguuaagauaaugucuacaaccuauaggagauauguuuccuuucugcuauaaccugccuacccaaggaccucaccaguguuuucucaaauauauuauucaugccuugcuuuuguucucugaccauagaaguaaccccuuccacaguggaaugugucauucuaugcuuccaggucauggucacuuguauuuagcucagaacauacuaccucuugcucccuuuagaacaggaucugugcuuugaacuagcaaaguaaaucaugugcauagaacgguuagauaagggauaccuggcuccccuucaacagucagaucuaaggaauucaaacuccauugaagacagaagggucaggaaacaucucagaaggaagccggaucuucagccuaaccucaaguauuugucaugaugauuaauuaaacguggucacacgauguguuccaggcuucuucccuagagaagcagaacuuguaaaaauuagaucccauacugauccuagaucgcauacugauccuguguuucuuuacugacuuguuugauuccuggcagauaaagauuucccaaaugccucguuguuauuguuguuguuauugucaucauugucauuuguuuucuggcuuuuauuuuuguggguuuuuguuuguuuguuuguuuuuguuuuuauauguuuguauuuuuaaacaggguuucacuauguguccuuggcugaccuuacuguguagagcaggcuguguagaacucacaaagauuccccugcaucuacuuccuaaguguuggguuuaaaggugugggucaauggcuuccuuugucuaugaucccacacuugucuuuaccucauguccucccauacuucccucccuauuccucguuuguccuacacugcuccuaaccuucauucuucucuucuauagacuccccacaaguucagugccuccgugccuacaagccucgagagaaugaugaguuggcacuagagaaggcggauguggugauggucacucagcaaagcagugaugguaagacggaagaucccugagcuucaggugggccagcagacucuggacagagauacaccagcuuucuagggcugccauaacaguacugaaagcuuagugccuaguaacaacaguaauuuauucucucaagguuguggaguugagaagucccaaaucaaagugucaacuuaagcuucuaggaagggccuuuaccuugucuccaucucacagguuucaaaauggcugcauaauucuaaucucugcaugcauauuuuuguggcucucuuccuuucuguguacaucucaauuacccccucuguaaagagaccaauucugacugauugauggacuccaggguggccucaguguaacuuuaucaauuguauuuggagcaguuucguccccaaguuucauugcugugaagagacacccauaaccaagacaacucuuauaaaggaaagcauuuaauuggggcuggcuuacaguuccaaagucaauuaucaucauggcaggaaacaugguggcaagcaggcagccauugugcuggagaaggagcugagaguucuacaucuugauccacaggcagcagaaguaaaugccacaugagggcugacuugagcuucugagaccucaaagcacacuucuuccaacaaggccacacuuccuaauaguuccacguccuauggaucuaugggggccauuuuuauucaaacuaccacaccaaauaagaacaaaugucaaguuaccaggguauuaaguuauaaauaaauacuuugaugggcaaaauucaacugauagcagggaagaagacuguagacuucagcaggccuagagcagccauuuccauaauauacauagcugggcuuuucauggcggaggacccugguccauucagccucaggaugucgauuaauuuucaucaaggagguccaagaaguuagcaugaacccuuaaccucuaacucuucuuuccucuuacuguguacugcaggcuggcuggaggguguaagacucucagauggugagcaaggcugguuuccuguccagcagguagaguucauuucaaacccagagguccgugcucagaaccucaaggaagcccaucgagucaagacggccaaacugcagcugguagaacagcaagucuaacuguucuugaugaggagucuucugagcucaugaacaagcauuccuggaaauggcugguccuagaaaccugcugcagaagcuuucuagggaucaggaaccuggccuucugaaaucccaaggaugagcucagucccuuguuccaguacuucuuugcguuuuugugcuugguagggaauauugagugacugcacacuggauucugggaaccuuucuucauaggaaaagggacuguggggcaugagccuuggugcuguacuuccacuaccagaugguacuuguacaucaucugcuacuacagugcagauucagagcuggccggauguaaguuguggacagaccuauguuaccagauagaccucagcccacucaauggagggagguguuuaauggggauuggcgcaucaguugggaaggugaaccugcugaccucuagaauagcuuucaaucggagauuguccucauugcaugugccccugcaguccuuguuucuugguggcaaugugaggguggcauucucucacucuaauaaacuuggcacuucuucacgug

SEQ ID NO: 12111 - RNA, 23678 nt, Mus musculus
cacgugaagaagugccaaguuuauuagagugagagaaugccacccucacauugccaccaagaaacaaggacugcaggggcacaugcaaugaggacaaucuccgauugaaagcuauucuagaggucagcagguucaccuucccaacugaugcgccaauccccauuaaacaccucccuccauugagugggcugaggucuaucugguaacauaggucuguccacaacuuacauccggccagcucugaaucugcacuguaguagcagaugauguacaaguaccaucugguaguggaaguacagcaccaaggcucaugccccacagucccuuuuccuaugaagaaagguucccagaauccagugugcagucacucaauauucccuaccaagcacaaaaacgcaaagaaguacuggaacaagggacugagcucauccuugggauuucagaaggccagguuccugaucccuagaaagcuucugcagcagguuucuaggaccagccauuuccaggaaugcuuguucaugagcucagaagacuccucaucaagaacaguuagacuugcuguucuaccagcugcaguuuggccgucuugacucgaugggcuuccuugagguucugagcacggaccucuggguuugaaaugaacucuaccugcuggacaggaaaccagccuugcucaccaucugagagucuuacacccuccagccagccugcaguacacaguaagaggaaagaagaguuagagguuaaggguucaugcuaacuucuuggaccuccuugaugaaaauuaaucgacauccugaggcugaauggaccaggguccuccgccaugaaaagcccagcuauguauauuauggaaauggcugcucuaggccugcugaagucuacagucuucuucccugcuaucaguugaauuuugcccaucaaaguauuuauuuauaacuuaauacccugguaacuugacauuuguucuuauuuggugugguaguuugaauaaaaauggcccccauagauccauaggacguggaacuauuaggaaguguggccuuguuggaagaagugugcuuugaggucucagaagcucaagucagcccucauguggcauuuacuucugcugccuguggaucaagauguagaacucucagcuccuucuccagcacaauggcugccugcuugccaccauguuuccugccaugaugauaauugacuuuggaacuguaagccagccccaauuaaaugcuuuccuuuauaagaguugucuugguuaugggugucucuucacagcaaugaaacuuggggacgaaacugcuccaaauacaauugauaaaguuacacugaggccacccuggaguccaucaaucagucagaauuggucucuuuacagaggggguaauugagauguacacagaaaggaagagagccacaaaaauaugcaugcagagauuagaauuaugcagccauuuugaaaccugugagauggagacaagguaaaggcccuuccuagaagcuuaaguugacacuuugauuugggacuucucaacuccacaaccuugagagaauaaauuacuguuguuacuaggcacuaagcuuucaguacuguuauggcagcccuagaaagcugguguaucucuguccagagucugcuggcccaccugaagcucagggaucuuccgucuuaccaucacugcuuugcugagugaccaucaccacauccgccuucucuagugccaacucaucauucucucgaggcuuguaggcacggaggcacugaacuuguggggagucuauagaagagaagaaugaagguuaggagcaguguaggacaaacgaggaauagggagggaaguaugggaggacaugagguaaagacaagugugggaucauagacaaaggaagccauugacccacaccuuuaaacccaacacuuaggaaguagaugcaggggaaucuuugugaguucuacacagccugcucuacacaguaaggucagccaaggacacauagugaaacccuguuuaaaaauacaaacauauaaaaacaaaaacaaacaaacaaacaaaaacccacaaaaauaaaagccagaaaacaaaugacaaugaugacaauaacaacaacaauaacaacgaggcauuugggaaaucuuuaucugccaggaaucaaacaagucaguaaagaaacacaggaucaguaugcgaucuaggaucaguaugggaucuaauuuuuacaaguucugcuucucuagggaagaagccuggaacacaucgugugaccacguuuaauuaaucaucaugacaaauacuugagguuaggcugaagauccggcuuccuucugagauguuuccugacccuucugucuucaauggaguuugaauuccuuagaucugacuguugaaggggagccagguaucccuuaucuaaccguucuaugcacaugauuuacuuugcuaguucaaagcacagauccuguucuaaagggagcaagagguaguauguucugagcuaaauacaagugaccaugaccuggaagcauagaaugacacauuccacuguggaagggguuacuucuauggucagagaacaaaagcaaggcaugaauaauauauuugagaaaacacuggugagguccuuggguaggcagguuauagcagaaaggaaacauaucuccuauagguuguagacauuaucuuaacagacuuagcuucagggcuggugaagcuaacggucuauacuaaguuuaacaauauauccacaaguuuuacauaucggucacaagaccaucaggccagauaggggcuggcaauaaaggcuacuauugggaccaaaggugacacaugauaauuuuggcucuugaucugugacacugcaucuucacaacuagaaauuucaagugauuacugguaucuucagcauagaacucagaacuuaauucacagccuuuccaacaagaaucaaaauugaagucuauauaucuugcaucauuuucuugcuuguaccagauaagggaucccaugccuuuaaaaauagccuucuaccguuaaacuuucuggauggcauauguguccuugcuccuuuuuggccucacuuuccucaucuauaauugaucaaagaugaucauugauccaaaugauucaugagguaauucuauaugcuuucuuaagagcugggcagcauuaccauagauuguaauuaaguucaagauaacgaaguucagaguauaccuauucuagaagcaaucuaucugagauggauuugacuucauacuuuacucucgugcacugauuuugcagaaaguaaguggaaugaaugccacguauuagcagugcacuucauuuuucuaaagcgcaucuuccauccacagaagugaaaugcuauaaguaaaguaguucccugcuacccucuuuacccaucacaaacgaagcuaauuaacaaacugcacagcacgcaaauuucauacccucugggcucuggcuacuccuguguguucuggguaggcaaacuuagcuauccagcuguagucagacuaagugugugcagcucuucugcuauccccauuaugucuacagugccccccacccccguuucccucuuacaucuucaaucgguaaaauuaaaucaaaaucacagcagauauuccuuuaaaggaauauauauuuuacaaagaacaaacauuugccuaagacagugaaugcucaagcaaagauacugccaucaugaaggacaguuguuaaucagcuguauccugagaauuuaagcuucuaucuucagcaaucuacuauaaaauucuaaggaaaagcaauaaacagaagccuuuuagaguuaccacccagcacacuacccuucauccaaaggagaccagauagacgcugccauuuucuccguuauagccuuacucaccauaacacucaaggagguccaacuccucucugggcauggccaaggcugagauccagcgaagcuuuucacuucugacaaaacaaaggaaagacuuagccucagugacagacuaggggcacacaggcugagggucaauggcggagaaggcaggugguggcuacaggaaggaccugucuaaucuaaugacuccgaaaaagcaaugggacccugccuggcuggaaacacaguguuaccaugcguuauauguuaguguaucguaguuauccuuccuuucucccuccaggcauaucuccaagaaagagucaacaggugaacugucagucacacacaugaacauuuuucagucuggaaaucauaccaaacaaaucgcucaucuguuuagacaugaccacuucgcauggcucuugauugucaccuaccucccuucaaucaaauaccuaaguugaaaauuacuauuuaauacuauuuuuaagccaagucauuguuguuguauaauguaaucuuagccuaucuuauccucugcuucccaauguaccuagguuauugagaaugguacuuucacuuuuccaaaaggaugcuaccaaaucucuacaaaagaacacaaaucugcuccugguuauuugucuugggugaaauacagaauacaaacccaugcacuaccuucuccguuccaugaggagagauagaaacuauugaucccacuugaacugucuuccaagggaucaaucugaaaagcauccauaucucauggaaccuuaagccacagauagguuuaauaaucuuacagagaagcucuuccugugucucucaaggcaccagcaaagcuacugcguguucuuuaguuugcuauauugcaugccagauucucuaguuaccauuucaacucucaacauuuguauguauaugugaauguauucauucguuuguuauuaucaucagaaagauuucaacucauauuucuuaacacuacauauuucugcucaauagaggauaaagcuaggagauugaggaaaagcagauagcacacaagguguuuuuuauucaccuaagugcccaccagcuguggagcuggguugcauagaugagcugaucacucauaaacacaguaauccaguucucagcucauuccaugcaagcucagcucccuuauaccucacagaccuugugcguuuugaguacuggcuaugaagcagauguucagcugugguggcaacuucacaucuucaccccacacugaaucuuuuucaaguuaucacuuagcucuagauccuuggguuucucucuaugaacgaccccagaagugcugagucauggucugcauaugguucugaccagggacauccacccccaacuccuguguccagccccgucucacugagucucagugcggaagaggaauuccacuugggugcccugugcguugugcaggagaaagagacggaagagguuuuugugagguccaugaagcuucauuucacacuucuccccucggauggaggagaacggagcauggucaaauaccaggaaccggcugccccugcaagacagaagucuuuuaagucugagucuagaguuuuggaacuucacccacccucacccuuggauuccauuccccugcccuagcuucuacauauaaaaguauucauauaaaagacuguaucauauaaaagccauaugagggcuucaacuuacucugaauauaaugugucucaaccaacuauuuacugcauucgugauauucacuacuuuaaggcauugaagagguaagaaccaauauuaacuuuauaaaguccuaaugaccaggguuucagcucugaaauuagccaaguagcuguaucagcuauuaugcugggcacaaccuaaagaagccacaaauaaacguauugaaaagacaacaucucgugcuauagauuacucaugucuauaacacaggacagguuugguaacacuauucccacuucuguccucuaaguugacucaugacucagacugugaguugucuaauugaaaagggauuccuuggcagcaggucauuugaugucccucugguccuuucccacucuuugguaugcccuggacucccauuccagccacugacucucggggccgagacagcaacagacagucauugaagagauguagguggacuggacgaguggucaguuuccuucucagcccuggggagacacugaacucaagggccgucagcuccccacucuucaccagccaucgagauugugaaauaagugggaaaaucuacagagcaaaaagagagaggacgcaggugaugaguguccuguuaguccugcccaacuucccaaucaccaauuccagauguucccucuugcucuaaagcagugguucucaaucuuccuaaugcugcaacccuuuaaugcaguuccuuauguuguggugaccccccaaccauaaaauuacuuuguugucacuucauaacuguaauuuuacugucaugaaucauaauguaaacaucugauaugcaggauaucuuauauaaaaucuccuaaggaagccugauauaacugucuccugagagacucugccagugccugacaaauacagaaguggaugcucacagccauccuuuggacggagcacaggguccccagugaaggagcugaagggauuugcagccccauaggaggaacaacaauaugaacuaaucaguaccaccagagcucccugggacuaaaccaccauccaaagaaaacacauggugagacucauggcucuagcuacauaugaagcagaggguggccuugucggucaucaacgggaggagaggcccuugguccugugaagguucuaugcccauuauaggggaaugccagggcuaagaagcaggaguggguagguuggugagaaaggggaggugggaagggauagaggguuuucagaggagaaacuaggaaaggugagaacauuugaaauguaaauaaagaaaaugucaaauaaaaaaaagugcuaaaaaaauucuccuaaggagauugugacccacagguugagaaccacugcaaaucaagccauccagauuguuucucuuggaauccccuaacuacacuguucucuguguggacccauggugaaaggaaggugugacucuaacuuaacaagagaugaugugggaacaaaugucugugagcccaaggagaacaugucaaugaacagucaaggcacaacacagcaucaugaaagccaaagaucaggggcaguuauguuaucugcuuuccccuuaaugauggucagaaccaagacaggcagagugcgaaucaggcuggaguugaggauaaggauuuuaggugggguguuccuggagcugcggccugggaaagagcuccuguaaaacuuagacaaggaaaucuguucucuuuuagaggaguaaugauauguaugaucuguaaugcacugcaauuaaaaugucgaggaucaauuucacauuuguuuggacaagagaauuugagguuuaugacauguugcuuugguuagggugaaggugaccugauaaaauaugugagucaagcauuccucaccccuaaauuuuuauauauccuuauucuggaaaauugcuucuauccauuugcuggguguuccuccuccuccaguaacuacugccccucccucuuuucugauauugcugaucauuuccguaugcacauacacacagauauaauuauagaucggcauccucuacuuuuacaccaauauguaauaaaaucugcauauaauucuaugccuccaccuaucaacaugucuuguagaaugaagugaucauuugcauauuccggaaauggagagaaggagagguagaaccacuggaggcuggaugacuguguuagaggauggugaguaggauauguuaaugagacgccuaggcagggaggugugcagggacagcucacuuugcacucaaacucaaucuucuggcucagguagaugagcuccucuguccgccgcauucucugcacauugcuguugcagucucgaaucagcugugaacagagcaggggaaaggaaggggaagaucauugagucuugcccuuuaagcccccuuaaaggcaaccuggaaggaugccugaaaagcucagucuuuucuaccagcuggaauugugcaaagcagcauuaaagucaugcgcugggaugcgggaauacuuuauauccccugagagaacauacggggaugagggccugggguaucaggaacacacuugccagauauggaaugugaagaauuaguucugguagaugacagaaggugacugagcucuccccuuaguguggucccaucucccuugcauuuuucagucaugaguauugggggaagagggaagacuucucccugaaugguuacauagcccuuauagguuacuggauauauuggcugccuaccuucucuagggcauggugugccuucguggccucugccucuucugaggagccaggcugaguucucuucaguauguucuguggaacaaagaguggacaagagccagauaagaggaaggacaagucagggacauaguuccaaaagcaaugaguucugagaaagaaaaaugugaacaguuggaaaucuguucccauccuccacaugauguggaaacuucacaaauggaugacacuuugccuccaaucucuccaagaccaugucugagucaaggcaauugaaccaaagaaguaucugccauaccuggagcagcagcuugagacgugugaugcguuggaagggcaguaucagaaaggacuugagagacaggcguuggcagauggggucgcucucuagcuucuccaagaccucccggaaacugcuguugcuauuccuguaugaguagcaaguaagaagcaagauagagaguaaagggggcucagugaaggcauggggagugggaauuaguggaggaucugggauuaggaaauaaugaggagaauccauguacaggguccagauaugacugcagagaggaucugauaugggcaaugggcugaaacuucagaugacauagcaggcacaagaacauauacucaugagagagggcucugggcuggggauugagucaaggucacugcaauguccacuaagggaauggagagggaucauucuuacauuagacuuuggaaggugcguuccugauaggucugguuggugacauaaggcagguagacacgguggaagucugcggcaugauucaagacaacaucacacacuuggaaggagaagauguuguucucaaaguuuucuucuaggucugaaaggaaccuguguaauauuuaaacagucucaugagcuacuggguccucagcccagcaucugucugaguccuguauauucugagccugcagcuaauuccaugaaucacuaacuucuccugacucuccuuagcucugugcccuugcuauguaguaccaaccaaccccuagguugauacuaguuuauuucugauggaaauuaaauagaauucuacuauucuauuucuuuuucuucuuuuuuuuuuuuauucuauucugguuugccagucuuccagugguucuuauagcuuguguucacugcgguacaaacccagaacauagauaaaaucucaauccaggaagcacuucucacucaucuauaucaauagaccugugaccuuccauacccuccucuucuuaguuuuuccuaucccccuuucuaccccugaaggucauggagggagcccaggcccacuuuuauccagagacucugacaaagagaagguuucuaagugggacaaaaucagcugcaaucucaauggcuaagcacagcaagguugauagaauggaguuuggaagaagucucacguggugcugacaucucguacauccugcaaacgagagaagagccacugaugauccugguuggacagggugccccgcagcugggcugaauguuggaaaugauccacagcuauguuuagacugcgcagguaagaugcuucugacacaaucagcucaaacuuggccuagaagauuggacaagaggaagauuaaugaauacuuuuaugaacugucugguagauaaaaguugcugaacaaugguuuaggguugaucacugaauuagcuauaucuuuucaucagucauaguaaugaaacuuagucuaggaggaacacaaggaguauuugaguaugccagagucaacuuaggggcccaauaacgugaacagagccuuuauguuuucaagaaacuuaaagauacauucauaccuauacacaaauaacugugauaucauaguuauguuaauuuaccaugcgauaguaaacauuuuaccaacaaauagacugugcuggaucucguaauaaggugguuaauauuuuaaacacgaugaaguuuacuuuuagaaaagaaacaauuaaguugagcacuuguagagcuuuuauuuaaaagaaaagaaaaaacgaaaauaaagccggagggacaaguagcaaugaggcacgaggccugguggaucaugucaaccgcacagcaggaucuaagccuaaagagaugugaaaauguaaaaaggucaggaauuagcuggguugcuucuugguucuguuuuguuucguuucuuagaaugagaauaccuuuuagcaauguguggaagaggccagaagacguaagagcccugcugggaaauuggguaacaugucuagaugggagaugaaggccuaucacucagaggcauguggaaaaaugcaccacucuagucaucaaagaggacuuggaaggcguugcuuauuugcuagaagugggguguaaagaggaggagccaaagccaccacccugcuuuugguuaggcaauagguuagaugguggaaucauggacuaagccagagaggucugugucagggagagagaggaagaugacaagcucaauuuuaugucugaggagagaugggaauaaaaagaaacaggauacaugagagaagaugcuacaauugucacuuaagaaugugcaugaaggcuccagcagagggagcaauaacucauacacaugaugaguggacuccuuuucccagcauggucacucagacuacuuggaaaacaguaagauaggcaucccuugcugaucacugaaauagccaaccacagcugaacuuaauauacaagcccaaacuaugauacugcagguuuauucucaacauaaccaucaaagaccacauggcuuaaaguggcucauuuaacacucagaaacucaggguuuuuguuguuauuguuuugucuuuuuauauagagugaccaccccaccaccacaaagacacuucagcaaacacaguuuucaauaggaagagagucuguggaagaacacugcagauucccaagaugcuauuuuaugaaaugaauauguagcgugagguggugauacuuagguggcucuucuugcaaagucaagagggaucaaggcuagaaucaggacccuugugacuucagagaguucaugucaucuucccauuauuugaucaauaaacacaggacagguuaguaauuuucuagacacugguauuuuaaaauuuccaguuaaauuauauaacuuauccaagauuaucccauuaauugaagccaggcuuacaucaucuaaauucaaauagucaauauuuucugacugacuguucuguaguaaccauuuaucuuucuuauucucccaguaacucuguguaucuguuuuacaaagggcuuagagacagcaaggugacuuggccaaagucaagaaacagauaguaacaaaggcaucgugucuccaucacuguuauagaacacaaugacuuagauauuaagucuaccccacugugcccuauuuucucccugggaaggaauguucuaccuccuccuucagacaaauauaaaagcagaaucugcccaagaaaaacuuacuaaugcucacugcuuagaaccagacaagcagugucuccugcaguccuaguccuggggaugaugaccaagcggggauauaguaaagccuaagugagaucaaagaaccaaaggaaaacuuuuggcuguccucuucaaaagaccagcaaaaaugaguauauggcuugugugaaacacuuguagauguggagaggagauuaucucgaugaaguuacucucacaccccucccaacagauuccaaggcaaggucacucuguaugaguucaagccaguacaggaaagaguagacggcacaugcacgagugagggaagaagggaauaugcuggauucucagagcacuucacauucuucaguguggcacugagcagucacuauguauccaggugagccugggguggggagaaccugcucuugguggcagaggugaggaggagauaaaacauuagcgaaucugacuuuauuccccuugcuuucccuugcccugcccuggugguaccucuugcaguuuuugaucuucaugggucauggagagcagcacugugcuauugcgcaccacagggauuuccugccagagggagccacuggaggccauagagaggcgcuguagguaggagucugaagagaccagugccuuucgacgaugccguggggaagagagcccauguggcucggccaggcuguccagccgcugcuggcucugaaucuccuuguucagaacaacaucacuguacuccugauaaaguagcugggcuacgggugaagauacauaggaaaaggagaaaauccugagaaaacgaagugaguagaagcccaccaacagaaacuggcaucuauggcugaccucuggcaaccauuucucugaacaccaccauucaauugcuggcagucaugagucccugucccauuuuagacagaaagcacacacaagccuauagaucugcuuuaaaguacucacaggagaugagcuuggagcaacgucuugaaaagccucccauccccuccuuugguuucuucucccuguggaguaggcaggauuugagguugcuuacugacugugagacagcagacccugagugacuuuagauuuaaaauccucuaaccuuccauauacaugcugggaugacaggacugaaggaaaguugcuucagccguccccaucacggguccuuccauucaacccuucuuccuuaucucauaguccagggagaucuuaggacuuagggagaacuuagaaaugcaguggggcaucucaaacaauaacucuacuuuguaacucaggggucuuugggauaguaugugaaggagacugcuuuauagccauaugccuuaggaggacaacaggugacucugacacagcaggcagaacuggguagguacaaacaccuuccuucuccgcaguuguggugccucuuucuuccucuccuuacuuuuuagacauaaaagcaccagcaauucucgauuccaggaucuuuauccacugaauucuuacuagagaaaucuuagugucauaaaugaagacaguacaguugaauuacugaagagucagggcaacucaccggaaaacaacagaaucugaagagccaggaagucuucccgcagcuggauuucguaaaucugaaaagugaaauggguggcacaacaaggacauuuagaguaggugaaaggauaagcaggagccacagcugagcaaagggaagacaguucuauuggaaucuggaagagaagacaaugauuccaaagguauucuaaagcccaguaccuacugugucccuggcgcucaugucaggguagaaauuccagaagauauauuagcuaugcccccagccuucaugcaagacaggaaaugcacaaaguaaggguacuuuaagauuuucgaaagauacagcaaaugaaggagucuggcaauuucaagaagaagugaguuucaggggaagcagaagauggaaagguaagaaggguggcggaacauucugacaggaucauggugggucaugacuuucugagcugauguaggugaugcaggugaaugaagcugcagagagagcaauagagaccucgcagauggaagauguacaaucaaaagcuuugucuaacauaaaugguucuagagucucugcuccuuacuuaccugaagagcuuucaggcaaaauugaaggucuacgaaggccuugccgguuccagcccuuuugcuuguuggguaccuggcccagaacaaccuguucacugcuacuuucugauguccuugcugggucgcgucugugaggccagcuggaugccuucuccaguuggugguggagggguuuuucugaguucuuucuugauccuaaagcugaccuccuuguauuauuaaauuccuccugaggggcagaucgucuaaaugauccucucacugguggcucagacucuucagugagcccugacucauccuuagugguaggucucugaaggucugggauccaaggaguaguaggagaagagggacuaagaagguuugucauguugcugaaagccaggccaggggacacuucauuauuacaccuacuggugagaggcaaagauucuguugaucugccuguggcuggaggccaggagguucguccaacagagagaguagaagcuguccagucuugauuauuaggucuuggcuuggcuugaccuccugaauguauaacuccucccuggauacucuugcuucucccccuggacuuugggggcaauggaggugguucagaggaaggaucuaugauagggacuggggguagaggccuauacauccuugagauauaagaggaagagauggagggaugguagaacucaggcauaucaggaguuggggguaaugguuuguuguaucucagucuggaagggauggaggucuguguaugguuggggcuuucugggguagacggcagagggcggugcugccuugccacaguggagucaggaacuagggaaaaugagccuuuagaagaucuauggagcccugaacuuagggucaguggaggaggaugacuaugccgcuucaguguagaggcuacuucaugaagaaggccaucccucuccacuaugugacuguagcuaugucucuucucugggggaauagggaguaaagcuucacguaucgucauauccauggagacaguggguggugaagaaacauuugcaggagagccuauggcaaaggcugaguucuguggggagccccaugucggacuaccaugaggacugcugggccucucuggauuugaagugaauucuucagaguccuguuucaaagcaaacaaagcaguagaggagucugaaaagacgauaccaucccuacuucuucuguuucuucuuggggucagagagccauagauggcugguuuaggaggccucugagguaauuccaaaugagagaaagagagugacauucccagagagucuggagucugcucuguccugugagagccugggaacgaguugcuucuuagauguuggguaacuccaguguagcugcuaagagggcugugaggguuggcugugucagagguggcacauggguaccuggaggauuuugcggguaguggaggagucucacauggcccacaaugauguggagugucagcugaggcagaggcuguuggggucuccucaggaaggauaacugaagagcuaacaggugacaagguggcagugcuggagaaaacauuaggaggacugaaaggaggugaaucucgugucccugaaggagccacagauguacuagcagagacaaccucaauccccuuccuuagccugaauucuucuugcuggcuguugugaguccuauuaucaagagauucuucaggagcaaaagaggcagggggagaaauggguuggugagaccauucuguuggcuccagugcaggagcuugagggcucaguuccucacacacaggcuccuucugaaucuguggaauaucagccacagaggaagaaauaccugggaacaauguaccuggggagagaaccucaggaucuacggaagccacuggaagagaaggcuugcuguccucuccuggucugcucccuuccacugcugucugcccaccacuauccccauucccuuggacccugucaccugagucuacaaccuccuucuggucccuuacgggcaucacuuuuccuguuugaucaugaucucucugcuuucucuuuacaaucucugauuucucuacuaaccuuugauucucuguauacugaguggcuacccuucucucuuccaccucccuggauuccugguccugucccuccucuucugaaucucucagaacccaaacccuccuuucccuguucucuuggccucucucacuguaauucagaccuucuaauuccccacugagccccucauuuucccauuguccuccaaguagcauauagcuuuggaucugucccugcuucuguucuuccucguugccguuaaaccccucuuccaccuccuccugcucucccaggagcccaccaaaacaaaugccuucguucagaguuccuuccuccugaauuucuacuuccugucccuccugcuccuccagucccugggcuuccugagauugaaggaagccuucuugcccuugauuuucuuguguggccuccaacugcagcuguuuccccugccuaagcaguucacuuccacugcccugggucugcucagucucaccagggugaguuuugcagggaggccaagauccucuagggauugaggugucuggggagguuucuuccucuucuuucucuuugcuaacugccaaagucaaagacauaaguucugacugcaauucugcccccacucuguugucuaguuugcuggguaugucuagccauucuuccuggacagcacaugccaagagcucaggggcagcuauuguucuugacagucugucuuuaaggcucuggauuacagcuuccugcuggucuggaguguuacaggccucagccagaaggauuuccuggcuugucuccauauccgaagauucuuucuugaagaaaauugccauacuauuagguguauggucacccaugucccuuaacacuuuugacugguucaucacgggucuguguccaucuguccacuuauaggaugggucucggucuucuugagcuucaggauccaaggcagggaucugacugcuccucaugauaccuucagggauaguuuucaauucuucuaugucagggacuucuguagauacuccauauucaggcuccucagccuccaucagggcugaauccuaaagaaggauacaaaauaaaaguuucuaaugccucuucuauguguauguauacaagaaaagauccaaauaagaugaauggaaaacuucuuugguuccauuuaggaucauucuggacagguauacagugauacaagugcuggccuuuguaugugaccuuuuuaacuuuacuuauuuuuaaauuaaacugagcuauauacauuuuuuuaaauaaauaaauuuuacauaaaaauuuaaaauuucauuuuuauuuauacauaucuguauguacauucagugaccacagaauucagaagagggcaccagaucaccugacuggaguuauaugauugugaacuauuaauaugggugcuaggaacugaacccugguccucugaaagaguggcaaguuuucuuaauugcuaaagucaucucuguagucauuagggacuuagagggauugaggugaugguucaauugguaaguacaaugaagauuuaccaagagaguauggaggauaguuugguuggccuaauguacaagcauaagaacccuagcauggccauaaaaauuccaggaauaaucaugugugucuguaacccuaauauguguggguguggucagggacagguagaucuccagagcuuccugaucagccugucuagucaaccaaugaguaccaguugagugagaacuucucucaaaagauaagauggaaagcuuuccagaaaaauaucuggcauaaauucuggcgcgugcaacacacacacagaaacaaaccacacacaucuacuuagggacccuuuaaaguaucagacaaccagcagugaccaagacaaagcuccuguuugaucuugcaccccugugggaaaaacugauuauaaauaauucaaucagcauuaaagaccauugucaaggaguuccaggaacucccaguggucacugcccucuaacuucuauuaugccauugucuauuucucccagucaacucucuggacucucagugugagucagcuucaaguaacuaccagacaugauggcugacacacccuacaucuaacagcccagagaagcagugucagagguagaaccguccuccugagcuguugacgugggauuaaaauaggucaagcuauuacagccgauaugcaacagaugaauccuuuauacagguucuggauuuuacuaucuuccuacuucuacagugucuguaguuauuuauaacuaacgaacaauuuuguguuaaauuauagagacagcuguuuuaaaauggcuagcuaagauaaccccaccuacuauauucgacauggcagguaaagcugggccacccuccuuaugauucucuccuccucaccaagcuaacuccucuuacuacuugccaacauugugaccuuuuacccugucucccuacuucccacuuccaacagaucaccucauauccuacuguacaaaaaacaagcaaucagcaaacaauggagagaugcugcuucaauuuauacaauucaaaagaagcuugcaugcccacucucccucuuucccauguuccaccucguuaccuugucuccucuaggccaugauuaucucucuaaaccaaugguucucaaccuucccaaggcuaugacccuuuaaaacauuucaucacauuaugauaacccccaaccacaaaauuauuuuuauuguuacuucuuaacuguaauuuugucacuguuaugaguuguaauauaaauaucuguauuucccaauggccuuaggugaccccugagauagggucauucagcaccccacaaagaggucaaaaacaagagguugagaaccugugcucuaacacuuaaccaguaucuaagaguucccagcagcaggcaacuucugaauaucuaaaccgaguucugccuaugagcugucuucagagcguccccgcccaccugcuccaccagcuccaauaggugccauucugccagguuccucuagaucacacuuuggugcagguugugacuaucacuacucacaucaggauuuccuuuguaguuaugccauuauccugcuuugguugacgcuuuggguuucuaauuccucaaauggcuuaaacuacauuccuauuucagguaauuaaaaaaaaauacaugacacacuucacuuuuuccuugcauuuauaccauuucaacuauauaacuauguguucugauucaacuucagucucaccaaaaaauggcaagcagugugagauaggauuuguucaguugccuacaucuagcacaacaucagcccauaguaagugcucaauaaacauuuuaaacauaaagaauaaaccuuuuguuucccaccuggccaagauucuccauauuauacucauaucuuuauaccuggagcacagccuagucccaaacuccacacauacagugcauuuuccacauaaaauaccacuuauaguugaaauuccuugguaucuucuuacuagacuuaagauaaaucucaaaauuucagcaauggucuuacacacuguacaaucuggccuuugccuuccuuuucagcaccugccucuacccucagcucuccaccccuucucgcucagcuaugggccuucauauguggugguccacugcuggaauuuggucccagagaacucucugcuucuccugaaaaacacauagaacuugucuagcauuucccagcuguaucaggaucuucaagaagguacacucucuacugaguuaacugugcaauccccacuaccuaagguuuuacagucauuuuucccagcuaucuuacaucucugugagcgcauacccucuaccauguuaacugugcaguccucucuaucuuaaguuuuaugguucuugguaaagaugggcaguuacaagaguuauuuuucaguucuuuuugauucuuugcuacuauuuaagugaacuguaggaaucauuuaaucuauuuaaauaucucuuccucaucuugaagagauggggaaauguuuccuucacaguucuaaugaagauuaacuagcauaauacaaagagugaauuguuaucuuuaaaagucauaggaaguacagguauuauugaucugagagacugaauauguguaggaaagaaauagaagacuguaaggcugcagagacauuccuagaaacacaaaacuuugcucaacuugcagaucacaaacuaaagcccacagacuccauuuccuaaggaaaggauccauguaaaucugaaacaaggacuccugaugugagucuauuguaaguacacagucauccagccacaacacccgagaggacaccaugggcugugggucccucacuauacccaacuguggaacuuucugguuucuuccagguuuaaaggugguuuaaaagccacuuguaagaaugccuuuuguugucaugcugaguuuccaaguacaaacacacacauacacacacacaccagcuuaaucaauccuuacagucucuaugcaauacaauccuacauaaccaaacaagcaggucccuaggcaucuugcagauguggucugugacaaguuccuggucaccucacagaugcagauauuaucuauauagggcaaguauaugugauuaacauaaaugcauauggaucgaaggacuuuaauguccuuuuccaguuaugaaaaugcaguaugugauuuacucuaaucuagcucuuaaauauaaaauguauaaaugauacauaaugugaccuuauucucucagccacauguuaaauaaccuauuugcucacugaaacuugcuccuaccugccucagaaaacuaugugacaaacccuguuaucuuuccucaucagcaucuguacugucuggaacccucucuccaauaucaucauacccuuagaagaaggguaguggcaugccccuucaaucccagcaaucaggagguggagccagcaagaucuuuaaguuuggggcuagccuaguuuacuaagugaauucuaggucugucagaacuacaaagagaaacucuguuucaaaaacccaggaagaaggaaagagagagagagagagagagagagagagagagagagagagagagagagagagagagagauaagggagggagggaaggaagaaggaaggaaggagaaaaagggaaagaaagaaagaaagccacuuaauuguuuauaccccaaaguuagcacauacuguuaguucuuauauuuaauucuaacuuaauaauccuaugcaaacaggcaugacccagcuagaauauggauaaagcuaaaggaaaucuguaaaacauucauaugaaggcauuagaacggaauuuuuuuaagcuaccuauuccguuaagagaugaaacauccucauaucccucucaucugggaugacuaaucacuauuuaucugcauacagggagagacagggcacagcaccacagggaacugguuucucuccagaccagagacauuucacaucuucaagaccccauagacaaagcuccaagugaucccauuaacagaacagugcagaacacaguaagaccuccacagucucacagagacuccacaaccaacacuuuagcucuuguccauuucuaauuauccagguguaaaaggauuucaaagauacccuuccuuaccucuugggauugcuucugcauuuacaauggcaucuauacuucugccuacaguaagaaaacaaaucucccacuuggaauuuggaggaauccaaaagauacccucuucauuucauuuagcucauauaaucaccacauagauauguacuuugauuuaguguuugacauuacuacccucaauauuccagacaccgaaauaaguauaguaugacaccaguguuauaacuuguccaaccaauccaguaaagaauggaauaagcaccuuuuuaccuauuguccaaugucuuagacaauaucauggguugucuuaggggccagguggucuuauauaagagcacucuuaagugaggaugcuuaugcccuuaggccuaccagugacuauggggccauccagucaaacaaggugugacuuguuugucauuggcauacaaaugacauuguguacuuuacagacacuccaaguggccagcuuacucuacacacauugcagguacaggguccuguuuacaacacaggcuaacaccuguuugugucuauaccauucucuacaacauuaucucaggagaucgcacuucuguccacaccaggguaagugacuauuccagacaccacaaaugacgucuaucccaaagacaggcaaguccauaacgugaccacacacaacuucagacaaaccacauuaugggcagccauacccuccagggaaaacagauauaugaaaacuuuggcuacaucuucaauuucuguauucuuuugaaaagagguaccccuucacauuccuucugacuugucccucccaaugcuuacaucucucuuuuaccacaaacuuagaauuuagaagcugucuguccucuacucagccucccccuuguccccuccaaguccuuuuaagguccauggguucugucuuagacccgaggacugguuaacaaaugaugacuguuuugauagagccagaagcuugcauaccccagguguagauaaagcaggaagugugggaagaggccacacugggggcuguuucucugggacuuggugcuuuugaaguaaagcugagagcacagugggagagcaagggaggaaggaagcugaaaggaaaaccacccucucaacucuccaguuuggugugcccuucccccucagucugacacagcgcuggccagaguucacugcuaggccgacaggaggacaagauuguccagagaacccaagauccaggaaagggggaggggaagaagacuugaaaacugaggcucuagggcuagcucucccggaucaguucuggaaaaaggcauuuauagaagaugccccaaacuagggcucugaaaaugggcuaccgcaccgcgauauuccgaauagcucucuuacacguuccuuagaaccuugugccgaggccaacaagaaacucccuauacacagguaaaugggggagagggaacucagggcaaggaucccugauucagauuucagagccuuaguuaacagcggagagagagguguguacauagauucacacauacguaggcauguaaaugccgcgaagauaacgaagcaaggcccaggccugguuacaaaagaaaaaaaaaagacacuuccagguaaggaaccgucuagaaacugaaucucaagaauucuuuaucauaggaguuagcuuuccccagggccccgacuuuccggguggaaaaaaguucugauuauuggcccgggaacauugcggggcagggugcccauuuccaaggcucagaccugguuggaaagcaaaguuugccaggaggccauuccuuccagcucccuucccggucccgaccagguacucagccccucacucggagcccggcccacuggcccagccccccauuuccggagucugcgccccgggaccuggccgggacuggucccgggggaggccuaguucucucuucuuucccgccccugccuuaccuccacccggcuccacgaccacccagaguccggggcucagaagagaagagagcacccaccuggucggagucacaugcugccccgggcuggcccgagaguccccuccagguccgggcgcccgccgcgguccccagccaggccaggccgccccggcgcccca

SEQ ID NO: 12112 - RNA, 64741 nt, Mus musculus
aacaaguucaaguauucuuuauucaaauuugaaaaauguaccauacugcauuauugcaaaaacucacugguacaaaacacuuugcagcuggugagaaggcaauaaaaaguugauuuuaaaacauuacuauaaauuacuguuacaguacuuugcaaauucagaauuucaaacugcauuuccguuuucuaaauugcccacaguacucaagguuccugaagcuaaggcagcuguuucagagagaaggggaagagguaguagaugucaagggauuuccauuucucguucgaugcccacauacuucagggcaucagccuggcuguaucugaaacaauaugaacaagaagugacaaccuauccaacaucaggaaaaccaagccugcugauagagugaauuaugucucuaacauacacacacccgacuggcuuuacauagacagcugcauacaugaaggggaggcaugcaucugucacugguaaccuaccugcuaguuauaauagccugugcuagaagcauuccccacacccucccugugccccugcagcacgcugcucugaauggcaacuccacacugucaugucugggucuaaugcuacaaaagcaaaaccaugacuuguaaagaaugcuaaugccaaagaauaaccccccauugagagugcugacucagaaagauaccaagacaggcucuugagggucccacuacuagagaagcuggacagguuugcuucuaacccuggccauuuagaacaagcaugggauaaagccacaggauccuauuccaguuccacagguuucaguugguucucucuagcuaugcagcuaaaacugguuacacauagcgagguuccccccgccccauuucaacaacuuaaguuucuggguagaauggauauuaaacuauaaggauucuuuaacuaauacucuuuacuggaucacauuuaaaugacuguuugguuccacagagccagguggcucuaugaauaaauccacacugccagccugauccuuccaauggaguugaacacagucaaugguugugaguagcuuccuuagaaagaacccagugaccacagggugauguuaacaauuaaaacaaugaagauguaaauguucuaccaauaaagauauauaugcugcaccaaugagaaggugcuguagaauacagauguguacgcauagauuaagccccaggggucucugucaguuauaucaauagcagggugcuagaugcagcuuucugcauagguuuuguuaauuuuuuucaaaucaacauuguauaauuaauacaugagaacuucacugaggaaacauauaacucucuacuagugcccacagcaaauagugacuggucaguuaaaagaaugcacccuccaaugauggcagaccugucaaaaaacuuacaaacagccuuugacccaagccccauaguuucagaagggaaaaccuuuguguauuuuaccaaccuguaaucaaaaaacaacucuucaccagucuggauagcccucuuagcaaagaugccuauccuguggucaccauuaaccaucauaacugcaaagagaaacauuggcagcagugagcaggaagacaggccauagagguuaacuaacuguuucacguaaguacuccagagguacugaaguuugcugucacuuggcuggaaaaauggaacuguugcaucaaacugucaauuccaacuuaaaagcuuaccuuuugcauagcaguuuggauuuacugaaugauuagcaaaacgaauuuuguugcccuuucggguugcauccaccacaaaaucuaaagugaaaaacauagauaauccagugacuuauuuucagucauagaccaagguuauuauggcuuuagaaauauacuuccucaggauucgacuuaaggaaauaaagcauucaacuucauccaauauaaaaaaaugucauuuggaagaaaaugcucuucuagauuaaagugaauccuugguuguuaaauauagcucuuaaacgccaugauuuuucaguuauauacugcugagcaaaacauggcuuaaaagauguaaucuagccaaauuucucugggcaucaagaggugggcauguugacauuugauauuauaauauuucuauggaacauuuucaaaaaagaaaaaaaaaagguuuuuuuuugguccagcugaaaguuugucuggaugugugugagcacacccacuuacacagggcccuccacagacacaggcugcagcagcugcugcuuuucucacaauauauggcaacaucaucaggccacaagaugcuuucaaaaugcucaaccucucaggucagacacugaagagguggacagaaacuacucagcccacaaguuccaggggacaugaggcaagccacagcagugggagacaauguccacucauagccagagcaugaggcaggcccaucugcaagugguugggacucuagauuguuuccuguacacagccuuucugcucacugggacuuccccucuccuuacaagugagcaacacaccccugaagcuaggccugcugguaaauaccaggagcuguucuugcagacacgugcccuugguucuggaaucuugcugaccucuaauuugaaaaccuugccuuacagcucagaacauaccauuguucaaguugaacagaaagcugcacauguauuugucauacacuuuuccucuucugucugcuucauccugagaaauaaucuauaaggaagacacaggaggagauuguacuggaguaaguggucaagacuguuagaacacaaaaaagccaauuaagagaauuuuggucccucaaggcuaucaaagaguagcuaaauugucuucucuauuuagcagauauacaguaaagaaguuaugggggaaagugcuugugcacgcaaggacaccuugugggagguauuacucucuuuccaccauguguguccugagauuaaacucaggucaucaacucugcagcaggugccuucacccacugaacugucacaccaguccaaauaacacuuuuaagaacuccaaaucagagagauuucuauguccuaagcaacaugucuagagaaagugacaauaauauugucuuucugcugaguaaaaaauguaaacugugacuuucuaaagcuuuguuuuuuccuagcccuacaacuaaaacagccaaacuaauaaaaauauugucucaggguccccaucagcucacuggccaaguaaguaggagcaaauauacacagcaaaacucuugaucccgaaccccuuguucuccagguaauaaaagccaaacaugacuagaacuaaaaguaaucuugcuaguuacuauguaaaccaaaacuucuaauacaaauaaguucaggcuaaaggucauuuauuauuaaucuauucuaaacuuggccuuguccagugaaaucuauccaaaacaaugcaagcugcuacuauaaacaagucaacuggaaugcacgaguaugucuuaccuccccacaguauucugagaugaauucauuuuucuguacaggaucuuugauaaagaugccccagccugccacaucagacggugccagcaguaagugcuagagaguaagcagucacauuagaacugaucgcaaguuagcagaguuaaaccucagaccaccugaggggaaucacuagacccccaaguguaucugacagauauaaaaaaaguugcugagugucuggaaaacuauuaaaguaauauuucuaaggaaaauucaagauaaagauccucuuacaggaaagacaagcaagccucuccaucugaggucaugguacugcagcaagggagacguguggaucagcuucucucacuucuguuccaucuuguccuggaacucacuuucagucaucacccuccaaaaggcucaggugccccagcuuguggacugacccccaagaggcaacugaauugugaggcuaugaacaacugaagagcggucucaugacagacucaauuuguuggcauuacugggaggugaugcacucagugagugggagugggacgaagucguuccugacaauguaucucuuguucuugagccuuccuggguucccucugccuccugugugcuguggauugagcuacuauugcccaccacaugcucucugccucacuaugcacaggccaggccaggagcaagagaagcaagugaccaugugcugaaaccaacagccaaaaucuuaucuucuuuacaguuuuucucaacauuucauuuuuguauguguauguauaguguauacaugugugagcacaugugcaggucagucagcaacuucagguaccagaucuaugcucgccacucuacuucuuuggagacagggucuccuucccugaaucuggagcuguuucguuucaguuagacuggcuggcagugaagucccaggccuagcagucugucccacagccagaccuccaacacugagguuauuaguacaugaccacacuugguuucuaauggggcugcugaucauaugaaugucaggcuugcacagcaagaucuuucuuuacucuuaguuuuaagaccugucacuaugaggcccaugucacuaugcccuuaaacaugggcaucccaacauacugaaaccaacugaaggugagcauaccaaccacucuccccucgacguuucuguuucccaaaguacauucuuuuauuuguuagagcccuuagcacauucuaguucuuuacugguauuuauuccucuaaagacccugccauuuccuccacagcuuuccucuagaaacuucucaugauaacacaaaaaacauccuuauuaugaaggauaugaugauucaucaauccuacagaaggccaagaugacaaggaccaaauaugauaacuuuucuuuuuuacuuagauuuuuguuuuguuuugucugugugucuuucgugauagagugucucuguguaguucuggcuguccuggaauucacuggcuggucucaaauucacagaaauuggcucugacuccugaguacuaggauuaaaggugugugccgccacuacuuggcaacauaguaacucuucaucauggaucuuuaucaugcuucacucaagaccauucuugugaucuuuaaaggucauccaagcuuuucugagccacucuugucaaguaaacuucccaaucacccuccugaucggaaacaaaauuagcuaaacaaugggaacaagcaagugcuaagaacuauaugcacaguguucuauuucugagagcuaaaauaugccacagagaaggcacgucagcaugagcauuccugcccacucugugaacaagcggaaggaagggaacauagauccuacaguggcaaauauggcuucaggauacagacgagauguaggucucagcaaauaugccaaaggaaacugaagcaggggucugaugaccuaaaugaauaugcagccaccuaaaguaaaaugauucgagagcucagcuaaucuagaucagauuuuccaugaacaguggugguucaaagagacagggaagaaaaaagaaagccacgagaagcugaaaguuccaccuaaggcagaauuucaaagagggucuacaguagagugaugaggcuggagagaugauuaaaggcacuagccacucccgaaaaggaccuggguuuaguucucauacagugcuaacaaccaucuguaaaucuaguuccagggaauuuaauacccucuucuaaacuguggguaucagacauguauuaagugcacauacauacagguaaaacacucauacacauauaaauauaccuuuaaaaauaaaaauaauagggugcuaucaacuaugugauagcucaugagaugugccuacacugcccacagggcagaagugguaguauggggagggcagggacagcaagaccccagauuguguuucuugcuccauuacuugcaauuucuuuuuaaaaacaauucauggcaugcuaugauacagguauggaaggcaccuuaaggaguuaguugucuacuuguaccaugugagccaucucaucagauagugugucaugugaaucuggguuuccuuacuuguaauaugcaguaagcauucaaaccguguuucuacauuagacaguuaauaauauaacuauuguuacuaaaaggauuaguuaaagauacugaaucaucuggugucuuuugcuuagugauuacucccuggcugcuacauuuaaaaucaccuaugugcaauucgcaggcuucaaauacauaacugcuaggugguucauuuuaaggcuuugagguugguagggaacugucuugugauacaguucacauauaugcuccgaccucacuaagucucuagaguucugguaacacaggcauguaccacacaccuggccuguuuuaaaggucgcuaaagaacaagaacaaagccuauagaacguugcuggaggaaauugcaucuuguacuguacauagaaagcauccuuuaaaaaccaccaugagaaaguacauuuguaucagcguaucagaauacaaaucagcaucuuuuuuuucuauugaggagacacaaccucguuguggaacaaaacaaaaacaaaaaauugagccaacuuuuaaaauaauuccuauuucaagucugauaacauuaauggcuacuucucagaacccuggguuuaucuuacuacccaguaauuacggcacuuauuuuauagaaaauuuaagauugcauuaggucuuuuuguggcaccuccuaggugugucaguguguuaagacaaagcugaauaucugcucucuagccaccagcugucagaaagucacggaaggagaugaugaaugcuaacuuuauacaucccagaaguucauaaccacagaaguacuguuggugcucugaguguacagcaggauuauguagccugaaucagugguggagauacugucacuccauguguuguuguacaauuccaacaccacuauacagcucugacgaaauagcacacuaagaaaaacaaagagauccugggcauauauccagaagaugucccaaccgguaagaaagacacaugcuccacuauguucauagcagccuuauguauaauagccagaagcuggaaagaacccagaugccccucaacagaggaauggauacagaaaaugugguacauuuacacaauggaguacuacucagcuauuaaaaggaaugaauuuaugaaauuccuaggcaaaugguuggaccuggagggcaucauccugagugagauaacacaaucacaaaagaacucaaaugauauguacucacugauaaguagauauuagcccagaaacuuaguauacccgagauauaacagacaauuuguaaaacacaugaaacugaagaaguggacacuuugugccuucuuagaauuggaaacaaucacccauggaaggaguuacagagacaaaguuuggagcucagacaaaaggauggaccaucuagagaccgccauauccagggagccaucccauaaucagccuccaaacgcugacaccauugcauacacuagcaagauuuuguugaaaggacccagauguagcugucucuugugagacuaugccagggccuagcaaacacagaaguggaugcucacagucagcuauuggauggaucacagggcucccaauggaggagcuagagaaaguacccaaggagcuaaagggaucugcaacccuguaggugcaacaacauuaugaacuaaccaguaccccggagcucuugacucuagcugcauaugaaucaaaagauggccuagucggccaucacuggaaagagaggcccauuggacacgcaaacuguauaugcuccaguacaggggaacgccagggccaaaaagugggaauggguggguaggagaguuggggguggguaugggggacuuuugggauagcauuggaaauguaauugaggaaaauacguaauaaaaaaaaauuaaaaagaaaagaaaaacaaagggaagucugaagaacaugcugaacauuuggccaagagaaugaaggaagccaaagagaaacggcaggaacagaacgccaaaagagguagacuaucuucacugcgagcuuuuacuuagaagucugaggccagccaaaaauaagucuuuaagaauaauaaaugacaccaugccugaccuaaagcuuuacuacagagcaauugugauaaaaacugcaugguacugguauagcgacagacaaguagaccaauggaacagaauugaagacccugagaugaacccacacaccuauggucacuugaucuuugacaagggagcuaaaaccauccaguggaagaaagacagcauuuucaacaaauggugcuggcacaacuggcgguuaucauguagaagaaugcgaauugauccauuccuaucuccuuguacuaaggucaaaucuaaguggaucaaggaacuucacauaaaaccagagacacugaaacuuacagaggagaaaguagggaaaagccucgaagauauggguacaggggaaaaauuccugaauagaacagcaauggcuugugcuguaagauugagaaucgauaaaugggaccucauaaaguugcaaagcuucugcaaggcaaaagacaccgucaacaagacaaaaagaccaccaacagauugggaaaggaucuuuaccuauccuaaaucagauaggggacuaauauccaauauauauaaagaacucaagaggguggaccccagaaaaaucaaauaaccucauuaaaaaauggggcucagaacugaacaaagaauucugaccugaggaauacugaauggcagagaagcaccugaaaaaauguucaacauccuuaaucaucagggaaaugcaacucaaaacaacccugagauucuaucucacaccagucagaauggcuaagaucaaaaauucaggugacagcagaugcuggcgaggauguggagaaagaggaacacuccuucauuguuggugggaugcaagcuuguacaaccacucuggaaaucaguuuggcgguuccucagaaaauuggacauaauacuaccggaagauccagcaauaccucuccugggcauauauccagaagaugucccaaccgguaagaaggacacaugcuccacuauguucauagcagccuuauuuauaauagccagaagcuggaaagaacccagaugccccucaacagaggaauggauacagaaaaugugguacauuuacacaauggaguacuacucagcuauuaaaaggaaugaauuuaugaaauuucuaggcaaauggauggaccuggagggcaucauccugagugagguaacccaaucacaaaggaacucacacaauauguacucacugauaaguggauauuagcccaaaaacuuaggauacccaagauauaagauacaauuuguuaaacacaugaaccucaagaagaacgaagaccaaaguguggacacugugucucuucuuagaauugggaacaaaacacccauggaaagaguuaaagagauaaaguuuggagcugugacgaaaggauggaccaucuaaagacugccauauccagggauccaucacauaaucagcuuccaaaugcugacaccauugcauacacuagcaagauuuugcugaaaggacccagauauagcugucucuugugagacuaugccagggccuagcaaacacagaaguggaugcucacagucagcuauuggauggaucacagggcccccaauggaggaucuagagaauguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacuugcaaacuuuauaugccccaguacaggggaacgccagggccaaaaagugggaguggguggguaggggagugggggggguguguauuggggacuuuuuggauagcauuggaaauguaaaugaggaaaauaccuaauaaaaaaauuaauucaaaaaaaaaaaggauaauaaaugaucagaacuuaaaucugagagacacacuccugcaauauccagacaauacuugauugacuacuuugcuuucaucacgcacauuuaagagucacuuuuauuuguucccagagagaaucucugagacuaucaguaaacauccaucuucuggaggaugaggaugaagucuaguugcugguagugugcuuaccuagcaugcaccaagcccuggguuuacuccacagcaccauauaaaaucaggcauguaccuaccuguacuccagcacuccggagguagagguagaggcaggagggucagaaauucaaguucguuuucagcuacagaguaagucugaagacagcagaacuuaacacaagacagugacauaaaaccaacaaaguuuccagauauaacuguuauuuaccuuuuuagagccccgcugaaugcuacaguucuuacaggauacauuuuuacugucccaauggucagcagcuccacacgugagacagaggucagggucacacucucggacagccagguagcauggacacuguuugguguugcauugugcuuugcaccgacauccaggaaagcgguuuugaccuuuagggauaaauguaucaucaccaccauacccaagaaucacccucaucauccacauccuuuccaggaaggcagucaaggucuugcugagcacacgagucacucacuuaaacccuuaccaccuuuccuuacuauuccaucguaacaaggaagcaggaaaccacaaacaugaagcugauaggacugagaaagaucacugcugguuuugcuguccauuucauauuuguuaaauagcacauggauuuaaagcccuacgguuaauuaaucagguaaagggaagucuuggacugaaugguauccaugacccuaaaucaugccaguaaaccugcgguucucaaccugugggucuuaaccccguuggcaaaacaucccuccaaaugcauauacauuaugauucauaacuguagcaaaauuaugaaaucauuuaacaaaaaucauuuuacagaugggggucaccacaauaugaacuguauuaaagggucacagcauuaggaagguugagaaccacuauaauaaagcauauuucuaauccauucuuugguauccacacucuguacagcuuucuuaagugauuaugaaaaccuacugcgcccuuaccuacuucccuucauucugaaaaccaaaacccacuuaacucucacuauuucugacacccacaaaaggaguggguagcuacuucuagauucgccuuacagucuaugccucuuuacuguacuucaaaugaccaaagaggaaaaacagaaaaauccaauccauuacuacaacugccuaacuugugcaugagcauacacagucacauugcccaagaggcugacuagacauuagcacaguacagggcucaagaaauacuuguaaaauaagcagcuuuccuaaagcaagcaauaagagcacucccaguccuuaugucuugauuuaaaccaccauuuucagcugcugaccaaaagccuauucaguucucaugcaauugcaccaaagcaacaaauacuuacacucugaacuacauugacaaaacuuuucacaaaaauuuugugcuaucacacaagggcacgaacugucacaaggcugccguggauggucacaggguugauaguuguaaacaugguuagaggagccgucugaguaaagauaacagcacgcagccaaugaauccagggagaugggaaaugaucaucacaauuaacaagacauucuuccccacuaccucuggaacauccuugacuggcugccuuuacugaaguauacaacacuccuguggagaaaaaaaaaaucaccucccacccccaagagcuuaaacacuuggugccacauuucagccccacuucugcuucucucugacucgcuccguccaguucacuucacugcagaucaacagacacaguucauuuaaacugauuugcuaaguaaaaaucaaaucagaagaaccaaaacuucauccaguuucuauucuaaaacaaaugaggacaacagacguuugggggcugauaaugagguuagaugggaggaugcugacccuuuuucaguuguaucuuucugcagugugcagcccacaaccuguaaaagauagaaaaaguucugugugagauacaacaacuggcuacaacucugaguccuguuuaaaugagccuggcugugcaauucaugcaccagugcugaaaagccaaggcuggcuuuauacucccuagucucuaugggcuugccaguucagacugacucaagaaccuacucacucaggauacugugucaugcccggaagccuggcaaggaaauucuuguccauauugccugguuaagacuauaaagccuugugcauaccuacugauuuagucccgucugaauuauauggauaccaauacuuucuacaauuuucagcaucacuaacuacucaguugaauugcaugguaagaaacuguucaaccaaaaacucagaagcauauaguaaagccuaaguuucuaugccccucaacagaggaauggauacagaaaaugugguacauuuauacaauggaguacuacucagcuauuaaaaacaaugaauuuaugaaauucugggacaaauggagguaacuggaguauaucauccuuaguuagguaacccaaucacaaaagaaguuauuagauacacacucacugauaaguggauagauauuagcccaaaaacauagaauacccaagauacaauuugcaaaacacaagaaaaucaagaagcuagagaaaguacccaaggagcugaaggggucugccacccuauagguggaacaacgauaugaacuaaccaguaccccggagcucgugucucuagcugcauauguaucaaaagauggccuagucggccaucacugggaagagaggccccuugguauuacaaaccuuauaugccccaguacaggggaacaccagggccaagaagugggaguggguggguaggggagcaggguggggagaggguauagggaacuuucgggauagcauuugaaauguauauaaagaaaauaucuaauacaaaaaaaaaaguacuucagcacauucaaugugccuauacaaaauuuuuggagcauaaucuaacugcauccuuacccacuuaacuacacuucucauuuuaaaacacaguggguugagguaggaggguccuguacaguuauucacuauaagucuuugugagagguaauauccagacuugaaggaggcucacuucaaauaucagaauguaauggcacaugcuuagaaaauccagacuccuagacuaaaagccacagcuaaacacuggcccagggagcacagcagaagcacaucuuauauccacaccaaaaagaaacauuucuguagcuuuacugcaguauguuuuucucaauccaaauccaaugugguugguaaaacaaaauuucuaugacuugauaugucaacuauacugaaguggcuguauauaaaaacuaacagcagccauaagggagaaaugagauuucuauacaucuauaacagcuguuuagaaccuuuuauaucauuauucaagugaaaacugacugauguucuuaggaaagcccugccugcagauccugccucacugcuucucuaagggcuccccagcagacucaccgauguuuccuuuucuucuuucuuggaggagugucuacauccucagugggaacaggugcuaugauacuggacuccuugacucuaaacucauacaccuacaugagaggcagaguaauaaggacacugugguuuaauggaaacauuccaugcuuuugcaaacuggagaaauguuuuugucucucccaucacacugccaguauauggaguagggcaagguacacaguagaaaucacuauuguuccaucacauugggaauguagcuauauuuaaagucuggccaaaguucacucuauguacauguaucacacccaaauugaauucuaaacuaaagaauuucugaaacacggcuaaagaauaauacugauuuaauuuucuuaagaggaggggaaauuaauucuuuucagaagaugaacagaaugaaaucaagauucucuaugucuggauaaugagcacauguuauuccuguguuuaaaccucugaaaacauaugcuuaccugucuacauguuuuggucccaauuagccuagcaauggcacaaaaguuaucguaguaaguaccaaugaggacucuaaacauggaggcuucagcaccacuccacuccacauucucaggagguucaauauuuggcuucaucuuuauugguguuugacaccgagaauuugcuucuagaaaaccaaauguuaacacuagucaagaaaugacaaagggacuggggagaugguucacugggucaaagcucuuaucaugcaagcaugaggaccagagggcagguuuucucaaccacauaaaaaucagacacauaguauaagcauguuaucccagugcuccuacaaggaaaucagagacagagacaggagacucuccagaagaucacaggccaacuagucuaguauauguaauggagaaauaaccaaaaggucuugucucaaacaagauggacagguaaggacccauacucaggauguuauucuuugacauucauauguacaccaauggcauauguguguauacugacacauaugcaaagacgacugaucaauacgaacaaguaaaauucaagguaggcuaaggaaaagcagaaggcacuuaauuguauuuuagaauuaguaagguuagaaucaacaucacaaagauccuaucacacuugccaaagaacccagaaguucugcucccuuuaucagacuuaucaaauacacacaaauauuaucuuuuaugguauuguuuagaguugaaagaacuaaaauucaaccaauaaaauauaaacucagcaguaguacuuguuuucuuucuaacugaaacuauucauuggucuuuaagauuaaaacagaacuuucuuaguuccaucauccuccaucaaagaaagauggaacaggggaagaggguacaaacagcaagaacaauuggaucagagcuuccagcaacccagacagaugagaauaacagaaggugcacuugggagacagcacaaacaauucagcuaugccuuacugagagaacucuccaaucuuagccacaaaaggggagaaaggcaaggguccuggagagaacacucggagcacccugcucauacagagaaccugagauugguucccagcacucgugccuggcagcucacaccugccucuaaccccagcuuucuguaccuacacacauuagauagucuuaacccuuagaaagguaaacuuacaaagcaauaauaacccaacaacccagcuguaagauaugucuuaccagaggagcuggacgucucaucuuuuuucucuucuucuucuuuaucauuguucucucccccaguuucagucccugcuucucugucacugucuguauccuuugacuccagcacacugauggugggggugcugggucugcuacuguuauucggaagucuuccucuucugcggcccccugggcguuuagguggugucuuuauacgcucagcaguaagagcagcagcaaacuccuuagcucccuccuguaaaaugaaaaauagaggcaucagaguaaaguucuaaauauuuugguggaauagaguaagacgacauugcauaacacaaguugcucaagacucuacacaguguccauuaucagucauuagauagcaacacaccuaucuauuuuccaucugcuuuugauacuuucaagauuccaaaaauauaaaaauagauucaauauuuuguuccaaugaugcaaaaucaggcaagacaguucuacauggugaguuuguaaaauuaaauuaaaauauaguaaaugaaaauauauuucaaaaaauaaagguauuuuucucuacauauacauacaguacguuuaaaagagaauaucaaaagacauauugaaguguauuaagucagacuuccuauuucaaggcuuaaaauaauacauaccucuuuaaagguacuauuuaaagaaaacaagaacacaaaacauauacaugcaugacuuagucacuucugaucuuacuauuaaaacauccaauuauuuuuuccugugaaggaugcaaagccacaggaagauaugaaagaacuuugagguacaagauuaggguuacauuuugcauucggaaguaccacaauccaaucucagaaaguauaaaacaaugguuagagcaugguuuauaagagaccacagaaacauuuuagaugagccaauaaaguucugccuuauaaagaauauaaaacagugcucaggaauuccuuuauuuuuauuuuuauuuuuauuuuuuuaguggagcaaagagcaaaguuugaaaggagccaacaguuuuauacuucacucuacaaaaaccaaauugcuuaaaaauaggauaccuucuguaggugccauucauugaaucuucuguccaaaauccaacaggcaauauauacccacuuaguuccuagguaggaguggcuugguucaaagaggggaaaugguaaaaaauaagauaguacccguaaaaaaacaacuuuccugccucauauuuuccuaaucccuuacuccuaaucaccaucacuuaaaaaaagaaaaccuguuuaggaccuaugguacaccuuaaacuauaaguggccuaaagcauucacagaagggauacguccaugauaagacuuaagaacgucugcauaagacuacaaguuucugguguuuaagugggcuaucuguaccucauacucucuuaaacuuuguggagagucuuugauccuaagaaccgugaaacguugcugaagaaauaacacagauaaacagagaguaauacaagauuaauagacuacacugugcaggacacagcucugaaagaaacaaggauaagaacacugccugucauauggccaauguaaauaugaauccagacagcauuacugcuggcuuuaccaccuccaccaaaauucuuaagagcccuccagaguaacaaagcacugaaucucaccagaugcugguaacacugugguccacaaggcuuguuguccaaagcuguuucuguguucuuccucuuauauguguuggguguugcauggaaggcuguaaaauaagcacaaaguaccugaauauggcuauaaaaaguuuacuuuuucauuuccccagagccauuggaaaauccaguaucucccacauauguaguuuacuuucuacagcuucccccaucucucacaggguacccuccacucugccuccaaccuccaagaaaggugacgacaugguaaacucuggaaugauucauaauucuuauuuucccuaugcaaguaugaucuaugggaauaaaguaugacuauagacauuuacuugagucuuuaguaucuccaacaagugaaaaauauuggaaaaaaaaaaaacacaacagacuuucuaauuuuacaaaaauauucuggcaucuacaauuucccugucuagggaggcuuuuuauguuuuugguuuuugaacuuuggggguggggguggggaggaggggugagauagaagggugguaucuuucccaggcuggcuuuaaacucauagcaauacucuagccuugcccccugagaacuacaauuauagauguguaucaccacauccagcucugacauaauuacuugauuucuagcugaaggaucaacuuacuaaacaugaacuagaaaaugguucugcuuauaaaauuucuagaacaaagaagcuucaauaucuggaacucaauucuaggguguguuaaccaguuguuuucucacacaauggaaaaagucaaugcuuaaaacuaacuauucaagucgggcgugguggugcacgccuuuaaucccagcacgagaggcagaggcaggcggauuuccgaguucgaggccagccuggucuacagagugaguuccaggacagccagggauacacagagaaacccugucucaaacccccucuccccaaaaaaaccaaacaacaacaacaaaaaaaccuaacuauucaaaauuauacaaugggaaaaugaccuuaauuuggcuaaaaaauaggugauauucacagaacuauguaggguuuuggugguuuuaaaaaggccuuuuucauaaaggcuccacucuuuaucuucuccauuuaaguacaagagauccaauccugggccuagcucagcaaaggcucaagcacugagcuaaaaucccaagcugucuccucacaaaaaaaacauuuuaacaaucauaccuuuuuuaaacaacgguugugggguuuguuguuuugguuuaagguuuuguuguuguuguuuuguuuguuuguuuguuuguuuguuuguugagacaggaauucucuguguuguauggccuggcuauccugaaagucacucuauacacuagcuggccuucaacucagagauacaccugccucugccucccaaaugcugggauuaaaggugugagccaccauauccaacaguuuuugcauacauacaaaguuuugcuacauaagccuagacuggcaaucaucuugccucugcagaaauaauguaaaauuauguauauauaguaacaccacauauccaacuucaacaaguugacuucuacauucacaccauggcacacauaugccuacauguaugcccacagacaaagucaaucacucaaccaaugucauuaauaaaggcccaaagacagagaaaagauaccuaaaacuaagaaacagaccuaggagcugggaugcuggcuccgugaauaaauaaauacauugauaauaagcaaugaaagaaguacgauaucucaaagcagggaaugauuugaacuccauaaaugauacuaagacauuuagauaacuuugugaaugaggaaaaguuagauccauguucauaccauaauaaguucuaaacaggaagauacacaaguauauguguuuuuuaaaaccgagaaguaggugugauggggaggcucccaggauaccaggaaaggcgcuagccaucaaguuucuccaccugaguuuaauaccuagacuguggaaacuuguccugaccuccacaagagcaccacagcaagcauauccuucaaccuccaaaacaaauaaauuaaagaaaagcuuagaaaguguauguggggaggggagcuuuauagucuuaaaggugguggaagccaugugauuucuuuuuaaaaaauuaaacuauacuuaaggacguuuuauugaacaaacuuuaaauaauucauuucaagggaacuuaucucgggguggggaauuacuucaguaaggaaaguguucacauaggcaggaggaccugaccucugauccucacaccucuguaaaacagagugugguaggaggcauccaagagcagaagggaagcagagauggggagguucccagaagcucacugucccaucaaccuacgcaaaaagcugagcucccaguucacuguaagaucuuagcucaacaaauaaggcagagaaggauaaaugacaaacagaaccuuucaaaugucauauggaagccuaccuauuaccauaaaagcccccaccacacacccaaaaaacaccucacacagaauuaaucuagaguuacucuauaauguggcaacaaugccucuagaaaacccacagguuuacaaaucaaaagccaagugcugggaauacguuaccucuuuuggaguuguugaccagugagaucccauaggcccccaaacauuauaagcuuuugccaaugcuauugauaagaccucuuacugaagacaucacauacuugggucauagaacaugaagguaucaggcuggcacugaacugaauacuucaucccuaucagcuagcauuccuagugcugaaaggugcuaugcacacuaaugagggagaaaagaaaucacuaacuagccuuccuaccuuccuagcugugaaugaugcaagaugaaguaaaaaaaaaaacuggccuggcaagaucugcacugcugcaguaguaccaugaacaucaugagaguagacaaccacuuucugauuggauuuaagucccacucuacaagaugauaccuauaucuggcaucauuguugagccaagaaucuguagcuagacaaggcauggauggacccuagggauggagagagccuaauaguauuauuccgcuaaauagacauaguauuaaaucaauugcuaauaacaccauuauacccacaaguuaaugcauuucuuaaucguuacaagagaagcuucuauuugcaguacauggugauuaauauaaagacccacaacuggucaacgugcagagaauaggagacugaagaaugucuaggccuaaugggaaaucuauaucacgugcugcuggguguuugcggcacaugcauuuaaucccagcacucuggaggcagaggcagaguuugaggccauuggucuacagagcuuguuccaggaaagccaagguuauagacaaagaaaccggaguggggggauggggguuggaggguugggggguggaaugacugauacuauuuauucacugcaaauuuuaggaauggggauguggcuuacugggaguauaugggauguauuuuagaguguucagggaugggggugugucuuaaugggagagugugcagggauggggcuguggcuauauagucuagugugugcccagcagaggcaaggcccuggguucaaucucuaacacuacagaaaacaaacaaacccacacaccagccuguagagaauuccaacuuuagugggauauggugguaugcuccuguaauuuuagagcucaagaaguugaggcaggagaaucaaaaggaucaugaaaaucaacaguucaaggcuagccucagcuacauacggaguaugagacacuauuucaaaaaacacaaaacaaauuccaguuaccuggaaauuuuaccaagaaaccucauuuucuagaaaugccaaaggaaaaaaauuaguuuucauacugacauuaaggauauuuuauguuugcuuguuuugaaauaugaaguacuuauaaaacaauuauuugaaggaucaaaaugaaacaaaaauauuuuaacacuaggcaaguaauuguuuguguaaaugccuuuucaccaauucauuaacuuaacaaaauuuguucauaaauaucuguaauacugcucugcgcuccuucacuguaauaacuucaucauaaaacagccuuguaaagagucacugagcuucaaguuaaugggaagcagcgaauggaauaaaauguguacaaaagaugucagaggaauccucagaauguaaaagucucaguacagggacgugacauauuucucaauccucacucuaagauuggccgguacauuuugguugugguaacugacagcaaguugcuuuacuacagauuucaacaacaaagauagaaaaugaaaacguacaauaacugcacuuacgauguaggaagcagucauacuuaaaacaucgucgacagaagagcguaugaaaugaaugcaagcuuugcucccucugaacagauuuggcauuugguccaucgauguuuggaguacauucaggaggcagagcaccugggagcugcugcuccgugaguucuuuauaucugacaucagacaaacaaacaaacaauauaaguaaaacacaaagaaaaaucacuuucuugaaaguuucuaaaagguuuccaaggguuugauuuuucuuaaaaguuuaucuuaucuaaaacucaaugaaaaauauccaaccuacaauaaucuuugcugacacuaagaaucaaucauguauuaugcauaggaaacaagaaucaagcucauuaauacaacugagguacacugcagaagaggcuauuaacauuaguuuggauaaacuauaaaaaucucuuccagcguccagaauauacuaguauaaacuguacacagacaaauaacaugcaugaauucucauauauauacucaauaugaacuaaaaauuuccuaauauacaguacaaguguguauaugugugugugugugugagagagagagagaauacuuaaaauaauaagccaagaugauaagauucacgacuguaccaaauuaaaaagaaaaaaaucuuacuuuucuuucaguucuucugcggugcccuuaucuggaaacauugaggaaauggcuucaaauauuuuaucagcaggaaauuuccgaggugggcaaguuucuuuaucuaaacagugaauugugauaagggaagagauggaagaaacaaguuucaauuucauuuucucuguaucacagcaucucaacaaagcugauuuucuaagaacuuguccccuuugguucacuuuuggggggcuguugggaagggaguaaucuuugagacugcguagucuuaauuggccugcaacuaaguagaccagcuugacuuccagccucugaugauuacuuuauuauuauuuuuguauguacauguaugugugcucaugugcaccugagugaagacacauggugugcacaccagugugcacgugugagggucaggaaagaacuuuugcgagucagugcucuccuuccucuuuggaacuaagaaauugaaaucaggucaagacuugcucagcaagcacucuuauccacugauccaucucgguagccaacuuuucugucuuauugucucugacucccaagugcuaguaugaccaggaugacgcacuaacacuggcuuggggggagguuugccuaguuuagcccaagauggcauaaaacucguuauguagcuaaggaugaccuugaacuucugacucuccagcuuucacuuucaagcacugagauuacaggugucaccaaacccuguauuacuuacuucuaauggaaaagccugucaaauacuagaaagacaaauauaaaauucaaguaugagauguuaagaguacaggaagacagaucccccaaauuuggauuauuugaaacuaauagcuuugugucagagcugaccauuaauccacuuucagaucuguccaucacauggaagaacuuagcaaucacuuauugacuccuaagguguguuucuguuauaaagaauacaugucuuuugaugcaauuccucccacccccccccccaaacucugcuaugcugucuuaacaguaagcuugcuaaauacaagacagcauuauggacucucuacuauuugggguagacugcuuucuagcaacaacuaacaaguguagagacaauagcacagcucucaggucagaccuaggucaucaacuuggggcucagauucuacuuuuucccaauauagcuaucuuaaguuucuuagccuuuaaccucccuaaacccauuuccaauauauaauggagcugauaauaauauauacauuguaaagcuguggaaggauaagcugguauauaaguauauuaguauacaacuuauauaagauacaugauauuauuauaaagauaauuaugauaauugaucagcaaagugcaaaaaaggauuauguccuuuuccuaggcaaaggaaacaaagaagcucuaguggagaaugaaaugcugcagaaaauauauuugaucauacacuuaacaaaaaggggguaguuuaauuauacccauacauggguggcuuuuacauuauuuacauguauuaauuagaugguguauguaugccaccguguacugaugugaagaucaggggcaacucagcagagucaguucuuuucuucuauagagugggcuccagggaucaaacucgauuuaucaagcuuggugguaagcaccuuuacccaccgagucaucuuaccagccugauagguuuuuuuuaaaagaauuauauaaagcugaaacaaaaaacuaguauuaaacauaccaucucgauuauccucuagaucuuucuguuuuucuucucuuucaucuggaucaucuccaucaucgucaucaucaucaucauuauauugaccaagagcauuuaccaacuccacaaaaauuucaucauuuauaaauccacauucuaaaagccaaaugucagaaacagagggaaaaagauaaugacaagauuauguauauguuuucuaaucuggaagaauagugaaggccuaucagcacuguaaccuaaggggcagguaaggauagucaagaucaauuucacagccagcaaagaaaacagcauuuaccuucaacaucuguugcuuucucaggaaucaacccucuccagcugauccaggguauauuacucccuuaauccauaaggaccuguaguuuuagcuuccucccaaucugugucacugacugaccacuucaaaccuguuuugcauuaugauaugaccacaucuccguuugcucagauaucaagagagccuccuguucagaaaccugaauccaggauucuguuaacuuaauuucacgggcucuggcugcccugaggaaggcauuguugaguagaaagccuuucugaagcacaugccccauaaacagaucuuuaaacuuaguuuuacuauugaaagcuuaccaaaaaacacacacucuauuccuauaaaaucuauguguuguuucugcuguaguuuauaaccaguuacugaugauuaccaaguggcaaauaagauccucaaauggaaaaacuaaagaaauacuaaaaauguaugccuuuaagcccagacuagcucuuaagauuuuuuaugaacucuauuaagaaacccuucuaugacagucugaaugaaaaugauguuaugggcccacagggaguggcaugauuaggaagugugguagcguugggguagguguagccuugcuaaaggaagugugucaguggaggcaggcuuugaggucuuaggugcuuaagccagacccaguggcuguugggguuagccuugugaccuguggauucagaaccugaguucuaugcccugguccagacuacaaccugaucuuggggcauugcaguaacacagguacugcaaagaauacuccccaauaauaacugauugaucaauaaauggcuggguuuaugacugggcauagaaaagguaggacuuauaaccaagaaagauuucuagagagacccggaggaagaaggaaaagaugagagagaagcugguccugaggacacacaugguacagagcaaguugaguaaaaugcaaacuaaaguacacggggccugucguuuguauauagaagagcucagaaucugccaaauauaggauuacagccuguaaauaaauaugaacuguuucugugucaauuacuugggaauuacaugaacaaaaaugaggcagaaaccuccaauagauauuaaggauuaaaggggggcacagcgacaccccagaaaauuuuuauugauuaaguguaacucucucuuccugcugucugccauccagauauagaacucuaggcuccuucuccagcaccauacuugccugcgggccaccacgcuuacugccacgaugauaauggacuaaacuuuuuugggggggguuuuuuugguuuuuuuuguuuuguuuuguuuuuguuuuuucaagacaggguuucucuguauagcccuggcuguccuggaacucacuuuguagaccaggcuggccuugaauucagaaauccgccugccucugccuccugagugcugggauuaaaggcgugcgccaacaccgcccggcuggacuaaauaaacaucucaacaguuagcaagccccaaucaaaugcuuuccuuuuuaagagcugccacugucauggcaacaagaaaacccucagacccucaacuaaagagaauauacacauagcucaccucugucaccaugcacuuuuccaucauaauuuuuuauuaguucuucaaugaaagugccauccugauccagaacuucaucccccauauaaggaauguuauguaaaacaguuucgucuuccaccugagagagagagagagagagagagagagagggcgagagagagagggagagagagagagagagagagaaagaaggaaaaagagaaaaagaaaggaagaaagaaagaaaaguuaaaaccagauguauucuaauuuuuaaacuagacuuuaagcauuuauuuaaaacuugaaggcccgagagauggcucagcagguaaagaccaugcuugacaaccagaacucaaucccugggacccaugugguaggcagagaacuaacuccccacaugcuguccucugaccccuauaauuugucaugauaaacacaaacacauacauacauacguguguguguguguguguguguguguguguguguguguguguguguguguguguguguagaguuacauaggacacauacacauaaaacuuaaaacuuaagcccucggugugagacuuaaaugugauacacuugcccagcauucuaaacacugaguuuaauuccugguaccacacaaaaaaaguuaaugagauaacuaaaaccaguauuuuccaugaguacuugucuuuauccagaucuguagagaaaacuguaacuacacuuaaucuaagaaaggaaacugcugcagguuacaugagaccucaaguguaagacauuccgauugcagauacuaaaauggaagguaccuguaauagaaccgaugauauguggcuuauccaaauaaacuacaaauacucaucaacaaagaguuuguaaaaaacuuuauuuggugaucuaacaauuaaaauauuugauacaauaagaaucuagugauacucuggagaucugaaugagaaacacccucuauaggcuuauguauuugaacaguugguuccuaguugguagcaccguuuagaagguuuagcaaguacaaccuugcuuggggaaguaugucacuggauaacauuugaagauuccauggcucacucaagucagcauccccaacuccccacucuguuuagugauucaguuacaaugggauucuuagcuucaugcuccuccagccaccacgccucuggcugccaugguaauucuuaucccccuggaaccauaagcccaaauaaacucuuccuucuauaaguugccuuggucuuggugauuuaucacaacaaggggaaaaaaaacugauacuaauauaaaagacuaucaauggucuuaucauucuaugccaaaaggauuuauacuuguaaaaucaaaauacucuacagcaacagaaacuauuucaguaauuuggugaacaagucauacaucaaagcugauuaugcuagugaacaagacaggcaaaucuacaucaaagcgugacaaccaacugggaaaagccaaucaaagaaaauguagagagacuagaauaucugagaacacaaaggacaaaaaccaaucaucuaaggaagaaaacuauacaaccaaguacaugacaguaacaauacaaaagacuagaugguccugaagcauguguccaaaaaccuaaguuagggcaggcuuaaucgaaaaagcccuugaacaaggcauugguuaaauguuuuagaaacguuuuagaacauuaacuaugaaaaacagaacauaaugacaaagacucacuggaggacaaagacaacauuucaaguauuacaagccuuggaucagacuaugauaacaaucaacaggaaaggacacacuagaaaaagccaugaaacacauagguggccaucaggcaacuaagaaauaggaagauuaaauuauuucaaaucaucacuagucagcaaauuuugaguuuguuaucaaaaauuuaaauaaagaaagaaacaaguauugagacaaaagcaaagugugaguaauaaaaggaaaauguagaguuuaacauauauauuguucagguucagaguauacauaugugacugcuauggguucaauuuauuuuguucuauuuuuauuaguuaaagaucuaacacaugucugagguguuuuugagacagccauggaggcugacauuugagagcagaacaagcaaaagcuacauuacuuacauaccauaaaauucuguuguaagggcgaccaagaguacauuauaggcaccgaggcgacugcauucagggucuuuaacgggaugacuugugcuggaaaauccaagucacuggugacugaacacuaaaacagaacacaaauaauaaaaacuuccucuuacaaaucaaaagaucaaccuuaagcuaugguuggucaucauacugugaacagaugcuguaacucuggauauaauuuuuaugaugcaaagguucauaaaauccaaaaagaauccucuuuucucuaaggugucuccuuagacauucuccaucuuuugcaagcuuuuaauccccuccagccuuucucauacuuaccaguaacaguuaaaaaucaaaaacuauauucauauuagccucagaagccugaucuguagcacguuuucucuaaacacuugaguuuauuuuuaauucugaucacucaagcacauagauuagaauauauuauauauaccaaauguguccuaagauuaugaauuacauugaucuuauuucuuuguuuguugagaugggguccuguuauugaauuuaaucuguagaccaggauguccucaaauucacaauucuccugccucagccuaaaagaugcugugaaugcuaagauuacaggcagauaucacuaugguauaucuaaaccuuaucuuuucucuugcuuuuuaaaaaugucauauuuuauauauuaucaaauaauggauuaagaguaacagaugaguuucaauugcaaaaacauuuuaaucagcuuuauagcaucuaacuguucacauguaaggcacuauauuaagcacaguaaauguuuuaucauaguuauuaugacucuaguugaaggcacuuaccccacuuugcaaugaaaaaacuacaguaaagaaaggacaaggaguuugcucaagaucauacauggaauauacacagcaagccugauucugcucacugcucugacccagugccaugauacuucaucucuauaacacaccuucuuucccuuaaaauucauuuuguauuauuuaucauaauaaugauuuaaugcuaaauuucuggggccucaaaaagagacagaauuugaccuccaccaacagacagaacuguguuaauuaaugcauauaucgaggaacagcuucucucuagaggaagaaacugcaggcucugccagggggcaaagguagcugugggcuaugaggcuugagugaggaaauugcuguagccuuggucacuccuguaaucucuccuuccugaaacuguuagcccaaggcaagacagacuacccaacuguaaucucacaggaauucugucucacaacugaggcacucuaucagacuucagggcacacuauucuuccuguaucacagaggaaaaaacugcuaauuacacugugacauaaugccuucuuaccacagugacuuaaacaaaaaaauguugguuaaaaauuguuaacauuuuugcaacuuugauucuaaugugguaaaaauucgugcccugauaaccacauugcuuucuauccugaugaggaauccagcuuuucuuaagaguucuauucucaaaugucaagccuccauggcugucucaaaaauaccucagauauguacugaugaucuuuaauaaaaauagaacaaaauaaauugaacucauggcagucacauauguacacacgauauacagagucagugucugagauuuauguaggguguuuccaagucagcaagacugggacuggaugaggugagauuacucgcacacaggccacauaagccuacauguguacucaugugucccucauguguggucacauuccacauagcagauacuauaagccuucaguucuacauagcugcucggguacucugaccaucacagugcacacugcacacaaagaugacuccuuccuaacagaagugaaagugacagacaaaguuguuccaaagaacaaagauagugaugucuacuuagguguuuuccaacaaggcaaaggaaaaauaacaauaccaaaagcucaaagucaaguaaauaaggugugaauggcuuauuaauguucucuuuccuacuaacuggcuucacucacagauccucaucccuccauuugcuaguccaauaacuacaggaaccaacauuuauugauuacaugcuguguuucaaucaccaugcuaaguaacugcuuauauucauaaucauaaguaguucuuguuaucaccuuaugacauaacuuuaacaucacaauccacaaaugggacuggaggccagaaauuaaaucuuccuaggaagauaguuaacuuagaaggcaggacuaaaaacuaagucuaauuguaacauccaagaacuuccucaguuuacugugcuuuaguucuugcucucagaagcucacagggaagagucacuauagagccuuauaguaucugcuauguggaaugugaccacacccaguaaggucacaggguuaucaccaacaacucuccucuuacucuaucccuagcacauuuuccuuuccuucaaccugacuagguaaauuuaaguaugaaaugauuuuaauuacucaauaaagcaucacauauuauccaauaaucuuaaauauaaaacaauuuucauuucuuaaaaaaguuauuaacuuuuguuuuauauuuggugggaauaaauuaauucuacauagaagcugucuuuauagcuuagagggacagacugguucuccagcccugacuuaccuguguuaguauaugaauccaaggucauguguaagucagacagaaaauauucuuuucaaccacuagcuaaggggaugacugauuugcagaaucaauauauacuaaaugaaagcuggaaacucacagaagcacagaaaacaggaagucacgggcuauagcacaaaugacacccccagucuaauaucuccaccccauuucugauauccaccacuucaaaguucugagucauccacaagucaacaagggaugaaacgcaagcucuguaaggggaagagcaucugaggugaaagguaggauuuuuaccuuucuaccucaaaacaauauucagcagugucuuaaaacauauguuuauggugucaacagacuauguuuguggcagaaaguucaguuccuuccgagcugaggacaccuauguggagaaugaagcugagcucucugcagcaccucuggauccuaccccacacagucucuagccaugcuacaaccauaccguccucacuugugaaaugauacugaaaugccacagccaaugcagguaaaacaaguugggaaugcuauguguugacuuacagaaaauuauacaaaacucccaguuacuuagcaacuuuacuuccuuugaacguguuucgcucucaacucuuuaaauacucauauugcucaaaacagugcaaaagcuguuguugaccucaccagagcauuuuugcccgcucaguuauaccucuagguggccuacuuuagcaacuuaaauuucuaauucuaauuccaauuucaggaucacagauaauuuaacagugguaaagaaaaccaaguuaccaaggacggcacacugucagagaaacacagcugacuggaaaguaacaagcuuccucugaggcuggggacucacaccacccagcugguacaacaggcgacuguguggcuggagaggaagccaagucaaaaguaguaguuguaggaguacacaaccaaacugagacucuuggcagaagacugguuccaaguaaaaacugugcuauggaaaaucguacagggagagcaggugaguggccugcagggaagggagaaaaauuaacacacccuacuaugugccaagcaccauguuagagacuuuaccaaaguugacuuuaaaauucucuacuaccuuaugagguaaauauuccccauuuuaggcaggacaucccaaaggacaauaguaacagccaccccaccucugaaugauccuuagcaugaaggcaguuaaacccagcuucaaaaaaguccacgggaguuauaucacaccagcuccuggguggugugaucauacauucuugaauacucacuggcucauucaguuaguucacacugagacaccaugaacugucauuauuuucaaacauacuccuauuuccuauuucuccauaugagaacaaagaagaaacagaaagccauagcccgggaagagacugugagugaaaggcaucagcuacugucaacucagggaagcaucagcccaggggagagugaggaggagacaucagcugucaucaaccucaaagggaagcugaagacuacuuccgagacuaccuuacuuuuuccucaggacuuaaggaaagaaagggaacaaaauccaaguuuuuaauuagcuaggccuuaugguaagggcaauauacauacuuaaauucaagaccgcuuuuuggugaagcaagaaggaaaaaaaaaggaaugaguuaagcagcauguauugaggaagcucaacagcaaacaugguuucauaaccaguuugaagggcagaggaagaagacugaaggggacacucuugagaaaaagugucucucacaagagggucagaaauaaaaacaagaaugggccuaacaucuucacgcaaguauuuaaugaaaccuagggaauaaacuaggaauaaaucuauuccagauuguaaacugcuuccauuuuugauauuacacauuuaugucaaaaaaccauuacauacuggagucucccuuguaacaaaaggcuauuaucuuggauuucacuuucaucuaauaucacuuucacacuucuuccuagcagaaauguacaagcauuucugugugugugugugugugugugugugugugugugugugugugugugugucugugucugugucugugucugugucugugucuguguaugcaugcugagggaggggaguauuuuuguuguuauuuugcuuugagguagagucucucuguguagcccuggcuggcagggaauuuucuauugagaccagacuggcuucaaucuuacaacaauccuacugccuuggcuuccugaguaaugagauuauauguagcuuuucaggaggacuagugugaugccuaaucuaaucuuaguuguaaacuucacuacauguagaauuaacuaaaacccaaagggcuagguaugccugugagagauuuuuuucuuuauuaaaucauuucaagugagaagacccacuucucacccugaccuucagggugugaagacagauacaucuuuacccaaaucuuuugagaaggaagaucuaccuuuaaucuaaauaaacaucuucugcuggaagccuauauaaaggacauggaagaagggaacuuguucucugccugcuugcccuggaucuugaguccuucacuggcauuagagcauacuucuucgggauucaggcauacacuaaugaccagcuaaaacaucaggcuucaaugacuuaacaacuucuagauucuuguaccuuccauuuguaaauagccauuguuggaauagcuggaccacagccuguaaaacauucuaauaaaucuccuggauggauggaaccauccauccauccauccauccauccauccauccauccauccaucgaguucuagagaacucugacagauuuugguacuagaagugguucuagagcaacaaaaauauaaggaugaaacuaaguaucuuucuaaaauaggcaucucacuuugucaauacuaguuacugaagccuuucauguaagcucagagaguccugaaugaugaaagcccauuauguguacuauuuuacaaauuaaggagacaaauacauuugauuauccugauucaccaaaugugagaggcaauggauuuggugacucuguauauaaaacuuuggacaauuuguggaaaaauaaggaaaaggaugacacuggucaguugaccuuagcaucacuagauaaacugacaaugggaaagaaugagcuucacgauaaaauuaaucaacuucuaucaucucagaauuuagugaacucaccaaugaacucagcaauaaaaauaaaacugaccaacuguagguuuagucuaaagcaguggcuuucaaccugugggucguaacuccuuuggggaaucacauaucagauacauaucagauauuuacauuacaauucauaacagcagcacaauuacacuuaugaaguagcaaugcaauaauuuuauaguuaugguuuagcacaacaugaggaaguauauuaagagccgcaguuuuaagaagauugagaaccacugacaacaaagguuucuaaguaugcccuggaagagaucuucucucuagcagccauagagcucaaguuacagaaaaucaaaccaaagcccccauuauaaauaagacugaauaaauuacaaauaaaauucaggucccagccucagaggguguuaaaauuaagggcauuacugguaaagaauaggauccuauacuugauaugcagauauguaggaggacccuauugaagcugagaacauugaacccucagauucucaagaguaugcuguguaagaccuaauccuccugggaagucccagaagacaugaccuucaccaguccuguaagaccaaaaauggugagggguaccagcccauuugaagagcuuuguuguuguagcccuuuuccuugugucagaccuagggucugaagcacugcuguucaguugaaugaacuuaauucagugggucuaauuggacccugaggucgcauggggcuaaguagcagcacugaaucaacaaagacaaugugacuguaguuaugguuugggcagcacagauaaaacuauguccauaaugaccuaaccuuuaauagguaacacagaaaaucugauuuuuacggugguaugacucauauggaccuuugguacugucuaaucauauuauuccaggcaugaaacauucuaggaaaccuauugcauuuuuguuugauccauauaagcagaaaaauucucaaacuaagaaagccuauaauuggaucaugggaaaagaaaucagcccauaagccaauuucuagacuugagccaguuugccaaaccaaaacgccuugaaugaggggacugccagguuccccugaagaaagaccuugauaaaauacccaaaaguuucacuguuaaccguucucaaguccuuucccagagggcccuacagccuuugacaggguuaacuguacacuggaggaaaggaaacaaucagacuucccaggaucuacuggauacugguuaugaauugucacugguuccaagagaccccaagaagcauuguagccuuccaauuaaguagggcccuaugaaggucaggugguuaauggaguuuuggcugaaguccaacucacaguagguacaguacauccccugaacucauccuuugguuauuuccccagucccagauauauaauugaaauagauauucuuagaagcuggcaggaugcccacugguucccugaccuauguagugagggcuauugugguuagaaaggguaaauggaagucuuuuauuagaguugccucugccagagagaacagcuaaucaaaaacaguaucccuggaagacugcagaaauuaguaccaccaucaaggacuugaaaagaaacagaaguagugguucccaccacaauucccuccaacuccccuaucuggccagugcagaagacagacagacaugaagaaugacaguugacuaucuaaaacuacacugguaguaacucugauugugcugcuguaccaauguccuuaucugagcagauuaacacauuuccugguauacggcauacagcuauugauccaacaauuaacuuuuucaguaccugucuguuccuaagccccagcagaagcaauaggcuuucaguuggcaagaccagcaguauaccuuuacaguuuuccuugagggaaucuaucaccucuccaacccugagucauaacuuacuucuaagggaucuugaucaucugucucuuuugcagaguaucauaugguucacuaaauuggcaacauuaugcugacuggaccaaaugagcaggaaguagcaaccacuuucaacuuguugguaacacaugugaaucaaagaaugggaaauaaauucagccaaaauucaaaggccuucuaccucaguaaaauacuuagacgcccacucuuaugggacauaaagagauauucuuucuaagauaaagaauaaguuauuguaucuggccccuuccaccaccaagaaagaagcacaauguuuagugagccuauauggauucuggagacacuuggguguguuaguccagccuauauaccaagugacucagaaaacugcuagcuuugaguggggccuggaacaggaaaaggcucuuuaacagguccaggcuguugugugcagacuacacuaccauuuggaccauaugauguagcagagcugaugauacuuugaggugucaguggcaaauagggaugcuguuuggaaaauuggggccucuauaggugaaucacagaagacacuuuggagcaagggucuaccaucaucugagagacaaguauccucccuuugagagacagcucucggacugcuuggacuuugguggaaaccgaacauuugacaaugugacaccaaguuacaagacaacccaagcugcccaucacgagcuagguauuaucuuacugaccauaccaugaaauagaacaugcacaguagcaauccauuauccaauagaaacaguauacauaugaucaggccugagcagguccugaaagcacaaacaaguuacccaagaaguuguucaaaugccuaagguuucuauuccuguuacaaugcuaccugcucccaaacauacauguguauauauaaccucauaugacuaacuaagagaagaaaagacuagggccugcuuuacugauguucugcauauuaugcaagcaccaaccagaaguggacaguugcagcaugacaacuucuuucuggaacaacccugaaagucaccagugaaaggaaaucuucacuaagggcagaacuucaggcaguacacauggcguuuugaauaggagaaugugugauuauucacugauucauguuuguagacauugaauugauugaacagucagggacuuggaaaaaccaugauuaaaagauuuuaagaaaaacaucuggggacuaaguauguagagagauuucuccaaaugggugaagaaugugaagauacuuggugucccauguaaauacucaucaaaaguugacuucagcuggaggagcucaauaaucaaguggauaaagccucuuuuccuagccaucucugucacuacccaaugggcacauaaacaaagaggccaugguggcagagauggggaugauacgugagcuugaaaacacagacugccauucaccaaucgugaacuggcuauagcugcugcuaagugccagaucugcaaccaauacugaggcccagauauggcacuguucccugagauaccaguuaacaaccugguagcagacugacuacauugaaccacaucuuccauagaaauaauaacacuuugucccuaguggaauagauacuuauacugguugugaauuuggcuuuccuguguguaaugcuucuuccaaaacuaucaucuguggacuuacagaaugccauagccaccaucuugguauuucauacaguauugaaucuggccaagggacucaugucauaccugcgaaguauaacagugagccuaagaucauagaauccacuagucuuaccauguucccuacuauccugaagcaguuggcucaaaagaaagauggaauggucuuaugaaaacacaguuacaacacuaauuaguugucagcacccuuggaaggcuggggcagguguucucuagaagaugcuauaugcuuugaaucagcauccaacauaugguacaucuucucccagagcaaggaucccugugucuagaaaccaaggaguggaaaagggaauaguuccacucacuaucaugccuagugacccacuaggaaaauguuugcuucuuguucccaugaccuuaaauucugcuggucuaggaauucugguuucagagaggggaacauucuugccaagagccacaacaaacaucccauugaucuggaagcucagacguccccuaggccucuuugagcuucugaugcccuuaaaccaacagguuaagaaaggaguaacagugucaggaggggucacugauucagacuaaaaaaaagaaauuggauugcuucuccaugacagagguaaggaagaguaugucuggagagcaggagagauccuucagggcaucucuuggagcuacuacacucucuugguguuaacacugacugugguuaagguccauggaaaaacccacuaaggugcuugcugaauauggaggaaacacagaauggguaacagagaaagguaauuauaaauaccagcuaaguggcagccugaccaguucagccaccaacuauaugcccagauccagggcuuuguguuaaccaagcccaacaucuacgccaucucugaacugccagagagaaugaagggacuggugaagugguaauuucugccuuuguuggagacucaaguguguccagugauguuuuucuaaaagcugucuuaugaggauguuuugcugaagcagacaugugagaggauguuuugcugaagcagacacgugguauuuuucuggaagcuaucugguaaaagggcaugugauguuuugcuggagugggcacuugagaggacacauguuuuagaaagaguauaaauauaacccaacagacaguggacgacacucuggcauugguucuccuugcuggucuucacugggcuucccagacacuggucuuugcugaugaugcuauugccuuggugcgccuugcuuucuuccaugaucuucgcuuguugugcuucauagagacaagugcaccaaagaacuucuggugguguucuggcugcuucuuguagcuucggcagacucaugccaauuggcagagccuggugguuucuucuggacugagccacugguugaugugcauuugauguuucucuagugaacuugucuguagacaacgaagauuggaauagucccaagaaacuguuccaaacagguccaugucccccuuguccuauuagccauuuuccuccucuaccuuuggucaguugggcuauaaauuuuuauauuuaaaaaauaaaagccugauccuauagauccaaagcuccaggaucuccaugacacaggacaaaaccaggauaucugagagagguccuaguaagaauccaguauucacaauauagcagaagccagacaccuugaaccagaccaaugacucauugcaaugaacauuugcaaguaaagauggguaggcaaaaggguguacugugggacacacuuugauacacuacaguuucccuauuuuuuuccuuuuggugaggacguuacaaagauggaggacagguauaaagggauaggaagaugggugggguugggguacaugacuugaaauuuacaaaggaucaauuaaaaauauaaacaaaugaauaaauaaaugucagcuaaggccacauaaccaguuacagagauaagaauuauaauuuacgggcuggugagauggcucaguggguaagagcacccgacugcucuuccgaaggucuggaguucaaaucccagcaaccacaugguggcucacaaccauccauaaugagaucugacuccucuucuggagugucugaagauagcuacaguguacuuacauauaaauaaauaaauuuuaaaaaauaauaauaauuauaauuuacguaaguguuucugauauauuuuuguuuagacuauaaagauauuuguguuuucuuuccucaauuuaucaugaaauguagcaucaauuaagagacuaccaguggacauuauuuuuaagugugagauccuaaaagaaugucccucaaggaacauugccaccuauucuaaguuuauaauguguuuguauagaagauaguuauaucauguuaaguguaaauaugaccugguuauuguuuucauuuggaaauuaagcaugauaucaaaagauaugauugugugccagguugauaagagauggacuuaugauuauuagucuaggcugucaaguugacuacacuugaaauuaacuaaaacccaaauggcuaggccuacccaugagaaauuuuuuuucauaaguaaauuaucugaagugggagaccugcuucuaaucuggaucuuugggguagaaagauucaucuuugaucuaggccauaccgucugcuggcuuccuauacauggaagaaggaagcuuguucucugcuugauuauucuugcucucacuggcaaguccauucuuucacuggcaugagagccuacuucuuuagcacuccagcauauacuaaagaccagauaagacagccuccuggacugaacaacuacuagauucuugggccuucuguugguggauagucauugcuguacuagcuggaccauagccuguaagucauuauaaucacucuguaccuuuacauagacaaacagacugauucauucuucaaguucuguuccucuagagaacccuaaccaauauaauuaggcuccuuaacacucuucuuugcauccucuucagaagcuugacccuaaaugauggggaucauaaacaaugauccuaauccuaugauaaaacccaagacaaucugacuaggccauaaggguaaaauauacccaaaauuacaugcuauucugcuaaaaaccaguuuuguuaaaacacuggagaucacaaagccaguacuaagacauaaacuacaaaauacucaaaaagcuaggugugauggcaggugccuauaguccuaucacuugauagacaggggaauaaggacuucaaggguucaaggugagcccagacuaugaaacccuaucucaaaacauaaaucuaaaucaugggggugggagguggggaguggggggugggaguggagaguguuaaauuaaaacacucagaagagaagaaagcaggaagggggcagaggauagacaaugggacaccaaggcauauguaugugcagucuuacguaucuacaucaauaauagugucauggaaagaaaacuaaaccguuacuacaacuaaaaggaaagacuaaaugacgaacacaauauuaugugaguucacacuaucugcaaguuacggcagcaaaucuauuucaaaaacugaaugaaacagagcaacagagacuaaacacagacaaggcugucauaaccauagagugagcuacauuuagauucuggcacaggagauccuguagugucagcagcuucugcuaauuuugccaacagauaguuaagugcucuuuacuguugacugacuagucaacauaguauugaagcaacuagacagcuaaacaaaaaaaguucacccuaccuccacacaguuuaugccaugaaaauuccuauggguuaacuaguucauagacuacaaaaccaaaaacagaaaacuaaaagauguguauuuuauaauccagaagacuuucuaagcccuugaggaacauaaaaauaaaaaauuuaaaguauaaccaaauauaucagagauaacaugaaaaugugaagaauaaaaaaaacuaaaccccaaucuaacuugggccaaaugccaaaauaaguucaaaacaaaaagaagguggaaagauggcucagugguuaagagcacuggcuacucuuuaaggauuaauuccagguuuaauucccagaaccugcaugguggucuacaacuauccaaacuccagaccaggguauccaacacccucuucugaccuccauggacaccaggcacacaagugaugaacagacauauaugcaagcaaaauacccauaaacauaaaauaaaaauuuuaaaacacccaauaguaugcauacacacacacacacacacacacacacacacacacacacacacacacacacgggagggagggagggagggagggagggagggagggagggagggagggaggaaggaaggaaggaaggaaggaaggaaggaaggaaggaaggaaggaaggaaggaaggaaauuaggaaguuuauaauggagccuaaagugaucucuagaugguuaagaucacugacuguucuugcagaagaccuuguuucagcuuucaucacccacaugguaucuuacaagucucuguaacuccaauuccauccucuucuugauuucucagguacgaggcacacauaugcaaacacacaugcagacaaaacacucaagcucacugaguuaaggcaaacugcaacacaacuuguaucuaucacucuaacaauauccuguguaaaaaggcauuuccauaaagagcuagugggagggagacagaugagagggcccguuuccccugggacagucagcaguugguaagcacugauuacacauauguuuaaaaucacuauuagugggccuguaggauuguucugaggguaaaaaucaaaccugcuaccaugccuuaguaugcaugguggaaagagcuaacgcccacauacacacacaaaaauaaaugaauaaauaaauacauaaauaaaauguaaaaaaaaucuaaggugcauucuuucaaaaaaugacauuaaguuguuuauuuccuguaagaagcagacagcuagaaauaagaaaauuugacuuccuaauucucagcuguuggacaauucuuggcugccuugacuauaaugauuuaccccuuaaugcuagcaccaggugucuacgucacaccuuggacaucuuaaaaugacugcagcaugaucauagcugacagcccucgcuucugaaggcagccagggcuguuuugagauaguaucaaacuuuuugccaucacaagccuggaugaaguccagaugacacugcaaccagcuucaccuaggccagacagggaucacuuucccaagucaucuagccaaagggacuacucugacugugacuaaauacaaggcuagauacuacugguacccuauacaaaccuccauuaacaccagucauaguuaagaggcaaggcugauugguccaaaauaaaugcaugagacugauccaaacagccuuucuucagcuaugccagcaggcuauuaaagcucagugagugggcuagaagauacucuccugcgccuucuucccuguuauugcaacauuaagcccaaugaaagcuucucucaaauggucuuuccuugcccagugguucaagcuucacuggaaacauagagaaaguaugagaccagagcagugaagcagcaggggcagggacugccucagucacguggcugagcuguagggacuguugggacuaagggcauacacuaccacacuaguuuuaaaacuuugaguucucaaaaauuacaagaaaucugcuacuauauugaacuuacggauguuucagaggacugaaauguugcuaaaugacaauguuuggggaauagaguauacugacaccuuagcuacacuaggauuuuuuuucuuuacaaauuguaaccagaacuuucucuugacacucaccuaaguaaugugcauuacaaggcaauaagccaugcaaucacguacuuauuuacauguaaaauagaccuagguuuuucuuuagcaaaaaugguuauauucuauuauuuuaauagaacuuuauuuuuuuaaucacuuguaaauaucaauaagcaaauaauuuuaaucaccucaaauauuacuaggaagagcaagccuacacauauuaaaaguuuaaaaacucuucaugaauauaaaaaucauuauauacaucuaaugcuauuucuauugcaaacaacucuacacuucaauacuuaccaaaauucucuuuucauaagacacagaugcuuacaaauacaucuuauuauacaagaaguauaccuggcauguuguuaucaugucauuuaggcauuaccugagcaaggcauucacgguauuaaaaaaaaauuuuuuuuaacauaaaaauaauucagggcaagcaugguaccaugcacuuuuaauuccagcacucaaaccucagaagcagauggaucucugaagccagucuggucaacaauagugaguuccaggccagcuagagcuacauggugagauccuaucucaaaacaagcaacaacaaauuacugaaggaaagaaaaaacaccuuauaguuuuuagugugugugugugugggggggggggauugacagauguacaagaaauacacuaagaacaucaaggguaauaccaauuucuucacuaaaccuagaaaaaaacggcuaaaaaaaaaugaagguucucaaguuuuucuaguuguuaagacaaagcaagucacuuggaaacuauauucugauaaacagccacaugauagcaauacgguauguauucuuuaguguugcuuaaugacauauugauguuggguaauucuuuaaaagauuaacugaagaccaaagaaaaugaaugcauaauauaucacugucuucaagucagaaauauuuuuuuaaacagagaaaggaauuaaagagauggcucaagcauauuaaaagccuuuaugguucuuacagaagaccuaaacucagcucccaggauccaugucagguggcucauaacagccuguaacuucaacuucaagggaucuaucugaugaccucuuguugccuccccaggcacuguacuuacaugcacagucacacacacacacacacacacacacacacacacacagagaauugaaaauaaaaaccuuuuaaaaagaaggaaauauauucugaauuaaaauucuguggccaagauugcuaagauuauuucugaaccucaauaacaaggaaguaugcuuaaaaagcuccacaaggacaaaaucugaacucuuuagucuuuaucaaaauuacuaagauaaaauauucaaaacguauacaucuacaagcaacuuaaauggacucagcaggguguguguguguguggaugggggaauaauuaaagaacuccugaauuuaagagggaauggggaggaggaauggaaaccauguaaagacaguacuccugaaugaaauacucaaaauguuuaaaaagacagcagacuaaacuuuaaaaguacuugcugcucuaauagaggaccgaguucagcuccuagcaccuacaagguagcuuauaacuaugcauaacuccaguuaugggaaaucuaauaucuucuucucaucucuuuagauacaaggcaugcacauaguccauucacauacauguagacaaauacucauauacauaaaauaaggauuuuuaaaagaucggggguuucacuauuauaaccaugaauuugaaauuacaaauauuuguaaaauuauaagucagacuuuaaagacuugucaccuaaaaacuauaaagaacuaggaacuuuuccaaaucauguauucuuaccaagaccauaucaccaugaacaucaccaaagucaccauguauauaguauuaucugugaaaaugccacugaaucaucacagaagccuuugaagccugugugucacacaaccuccacaagccucaggugacagcaaauuauggcuuguuuauuauaauacuguuauauauuaaaaugcucguugaaauaauuacuuuagaauaaaaagguuaucuccauguuuaugcauucaugaauaaucuaugauaguauaaucuuaauuccaaaucacuugcuuuuccuugaauuuacacucaacacccuuuaucauaucuuucuauauaaaaaaaggcaccuaaacagaaauguucaaaccagaauccuaauaaguagcucucuucuauuuagaucucugccauucucuaccaucuugcuggcaguauguuuugaugcgauacuuaauaauaaacucuaccauaagacuuuuguuugagaugauaauuacauuucucccuucccuuacuagaggauuuuauuuuauuuuucaccuuucuuugaaaauaaauuaucugauggugacuaagaucucccucacacagaaaauguaacuguagaaaacaccaaucuuggaacacugaauuuuuuaaaauucucagucuuuaaacaaaauggauaauaaaaaacuuucuuagaucauaaauauaaaaagaaauauuucuuaaacauggcuaauuuuuauuuaggagacagggaggaaagcaacugugaauuagaaagccuggcucuaaauaauacuaaucugagcauuuuagagauuugaucucaaaguuuguuuuaagucuaguaugccuaaauagccaaaauauacccugaaacacaccaagcuguuaaaggaauuauuguagugugguaaggcugccacugauacacacugaaacaaguagcaaugaaagagagacauccugaagucugugaauucuucucaauaagcaauaaacauuacaauaaguagaaagcaaauguguugagaauuguugcaacacuguguuaaccaaccucccuagucccgcgcaaugagcucacagaagucaugaugugcacaggcuguauccuccgcugcuuccacucuugguuuaagguuucaguucuuuccaaaauuuucugacgauuggaacuaaacauagucuuuuaaaaacaaaggagaaauuguucauuguuacaauauguagcaucuuuaaagccgguuaaaaucuagugacucaccagaaguaccaugaccauguccucaaauguacacagauucacacaagauacuacaauucuccacacucuaauaauaaauacaaaaacauuacuccuacuugcuuguaaauaaagggaaacaagaaauuauuuccauccucucuuuguuuaacuuuguauuucagaaaucacaaugacuuuagaaacacaaagccauaaaacaaaugccuuuguguuucaguccugaguuuauacaagcacugcaaagguauacugaaaagacugauuucccagcaggcugaguaauccuuaauuuaaauguuaccauuaaugagcaugauuuuuuuucauuuuuugagaaagaauccauguaucccaggaugaucuugagcuuauuuuuuauuacauuguugauucaugugccugugcauuacauacuacagcgcuucuauagcuaucugucagaggacuuguggggccugguucucuccuuccaccaugaaggucccacggaucaaaaucaggucaucagauuuaacagcaagugcuuuuaccugaugagccucucaucaguccagucuugaacuucggguccuucugcuucuaccuccccaagugcuggcauuagaggcacccagcacagcaccaaacagucaugauguaauuuuaacuaagacaaaucaagaaccaucgcuuucaggucucagucgacuuuacuguaaacaugaccuugacugaaaauguaccauuucgaaguaaaucuauuuaacuuggggguagaaggaauucguuucaauuauauaugcauuuuuaugaaauuaccuuuacuucaucagcucuucugaaccucuugagcugucucagucucauguacucugauuuuacacgcuuccgccaacaaaccggucccuucucagauuucuucccagucuggcccaugauuauucuaaaagcaaugauuucauauuauaaucacuuaucuaaccagcuugaauaugaucuuuuaaucccaagcaaacugauaucaacaaaacauuuuuacuguugauauuuguagagaaaagcccauguacucuguauaguuaaauccuggaaaugugucacugagugauuuuauuuaauuuuuguuugguugguuuuuuuguuuuucaagacagaguuucucaguguagcccuggcuguccuggaacucacuccauaacaggcuggccucaaacucaaagauccaccugccucugccucccaagugccacugugcccagcuuuuaaaacauauuuuuauuuauaaacacauacuuuuaucuguaaaucuuaaauaguagaagguuuacauauaugugaucucauuaugggaauuauguauacuauaccacaagcuaguuuuuacugcaauaagggcucacauuuuuagaguaaaaacuaaguuuuugauuauuuaaaaguuauuugaaguaaaaacuuuuaaguuuuuaauuauuaaaaagcuauaauaggggcuggagagauggcucggugauuaagagcauuggcugcucuuccagaugacccagggccaacuuccagcacccacauggcaguucaaauccuccuuuaacucaaggggauuaaacucuuuuaacucuaggggauuggacaccaccaucuggccuccauaggcaucaggcgcccaaguggugcagacauaauauguaggcaaaacacccauauauacaaaaucaaauaaaauacauagaauacauuuuuuaaaacacuguuauagaagcaauguacaacugaaugauaauacaccuuauccccauguccacagacuucacauguauggguucaaaccucuuaacaaaaauauuaagugggaaaaaacuaaaacuagaaaaaaaccaacagcaaaaccugaguuuguuucaguccuaguacuaugcucacucaauacaauaaaugaaggguaagcacacacugcuguagucccagccauuccacauauccccagccaauucccaacacuuggagcacugucuaccccacaccuccuucucacaccguaacaggacuauaacaggcaccucuacggugaauauguacaaguuuauugucauuuuuccuaaacaguauuauacaacaaacagugcagcaacuauuuacauagcaucuccauuguauuaauuaaucuaaguauaauacagauaguuggagcauaaagauguucacagguuaugucaauuaccuugccauuuuauauaaggaauccauggauuuuugguauccaaggggcuacuccaaccacucccucuaaauagcaagggaccccucuaguuguaaaagguacaagugaaaagguuccguuuacacauuaagaguagaaaguguacaguaggauaguaaggauaaaucagggaccggcaguuguggaacacaccuuugauucuagcacuuggagacaggaacagacugauccaagaguuuaaggccagccuggucuacagauuaaguuccaagacagccaagacuacacagagaaacccugcuuugaaaaacaaaacaaaggauaaaccacucuauacacacacacacacacacacacacacacacacacacacaaaggcacaccuaaucacauuucucacuucaaauacugugauggggucuuuacuucuugugccacuuuuugucacaugugggguuuuguagcaagaggaaagagaaaugcagcaaauacaaagcaaaugccuucugccuuuaguugcagacuccaugagccaauuauaagcaaauaaauaugggaacuggcuaucguucaccagacauacaacacaaacuagagccugcaccuuaagucuaaaucaguguucuuuucuuauacaaguauuagggucauauugucucuucaagagauuacaaggacauuucugucuagcuauacuaaauguuaugaauuuucauuaucucaggagcaauaggaaaccagaguguugagucaaagggaaggugaggugauuuauauucugaaaagacgaagcuggcagccagauagaaacaggagaggagauaggagaauugaaagaguaacgguguguccggguuagauggcacuacagagcagucucuaaaggagaugauacuagcuuuagaccacacuggagaccagagagaaaaguggucacuuagaucccagaaacuuaggugggauaggcuggaggaagucacuagagacaugccuuucaauguaaugcuuucuuuucaggagcucaacuguucucucagcuuccugucuaccagaaggugaacaccugacuccuucacaauucccaaaucccacuacugucauaguaaaacuuaaaaaucacaauuuucacuguacuccacccccacuguaaauucuucacuaucaagaacagguuuuacauuuuuaaaaucccagagccugccucuguguaaauaauggacuuaaaagcaaugaaagcuuauuaguaauuuaaacugagagagagagggagggagagggagagagagggacagagagagagagagaacgcaaaaccuguaucucauuaacacaucauuuguaaaguuuagcucuuccuuuuaggaagguaagaaaaagaggccauccuggacuaucucuacgcagaauccagaaagaaaaggaaaagugaaaaagggaaagggggaaggaaggaggaaggaaagggggaagagaagggaaaaaccaaagaaagaaguaugcaaacuccuaagaaaccaaccgaguaugaaucucagggacuugggauccugguugagcugucuuagucagaacacuugggcccuaccaucaagcaaauaaaaucaguuucaguaacuacuccaucauaugagcaaaaaaaagacauagaaacucuggcccaccccacccccagccuccaacacacaccauacuaguuuagauuagcuuuucuaagaaucauaggugguagaaaagacaagacacuuuaaguucucugaacuuaaagguuauuguguuaccauauagaaugucucuuucuaaagcauuucauccuucaauuuguccuaauggauaaagcuggguagggcacugucuuagucaggguggaaaggguuuauucagcuuacacuuccacacugcuguucaucaccaaaggaagucaggacuggaacugaagcaggagcugaugcagaggccauggagggauguuacucacuggcuucuuuccuggcuugcucaucuugcuuucuuacuaccagcucagagaugguaccacucacuaggggcccuccccacuuaaucacuaauugagaaaaugccccacagcuggaacucauggagacacuuccccaacugaagcuccuuucucugugauaaugcuagccuaugucaaaaugacacacaaagccagccaguacaggcacccaauaaauaauuugaaauuuucuuuucuagaauaucuauaaugcaauuuuuacuucuuuagcugauaaauuacccaaguacugaauaccacuaagcucaaacuagccaauuuauucuuuuaaauuuguguacucauuuaagguuuuguuucuugagauaggaucucacuauguagcccagguaaaccucaaacuugccacagccuugccacagucuugccacagccucaaaaaugcuggauuacagguaugaaccauaagacauagcuauaucaacuauuuucuuuuuuaauggugcuaaagauuaaagcaagaggcuucauguacacuaaguacauuacuauugaacuacacuacuaauuuugaauuguuuaaaacacuaguucaaguaccagcaagauggcucaggggguaacaguguuugcuaaugaccugacaaugaaugaaccuuaauuaaacuauugccuccaucagauugcuguaggcaaaucugugaggcauuuucuugauuaaugcuuuaagugagaguucagcacacugugggaaguaggggugaagguuuugggagggugguggggggagaccauuuaagaccuauuauguacccaaacugcuuaccugccuuuaagagaacauggaggcaacagaugaaccucaaggacauuauacuaagcaaaacaagucaaucacagaacagauacagucuaucucuagucauacaaaguaucacaaguauuagguugauacaaagguaauuucaguuuuuacauuguugaaauuugucccuuauuccuggaacacauuguuaaauaaaugugguucuguuaugcaucaauuuaauguguauuucuugcuuuaagucuuuuccuaugacuuacuacuccuugcuguuuuggauuuauucuguacuacaugaaacgauguuaggcaaaaugcauauucaagagauuuucuuauucaaguucaaaaugggucauaaaguaacaaagacagcuggaaaccucaacacacauuuaaccuaguaacugcuuaagagugaaccaggaaguggagguucaacaaguuuugcaaaggagauggaaucuggaaggaaugaaauaacuggccaugggaugcugggaaagccaaaugagaacaauuaucuaagcaccucuuacaacuaccugagaagcugccauagggacucaauguagaccuggagcauccaagucauccugcaucugagacaaguuggaaacauucauuaaugugcugaugaaaaguccaaagaccauuauuuugaacuacucuccucucuuagucuauacaacacuguuccauuucuccaccugacugugaaaugcaaaugggacuauguacaacaaccaugaugaccagcuucaugguugaacaaaaaagcuccaaaguaaugcccaaagccaagagguuaugguccauuacagcuuucugaauccuggaaaaaaauccuuacaaccgagaugugggcucaacaaaucaaugauaugcaucaaaaaauacaacacuugcagccagcauggccaacagaaaggggccauuuuuuucuucgcaguagcaccugacugcacaucgcacaaccaauacuucaaaaguucaacaaauugggcuacaaaguuuuauaugauccaccauauucaccugaucuuucauucaccaacuaucacuucuucaaguaucucaacaacuucuugcagaaaacaaacuuccacagccagcaggauacagaaaauacuuuccaaauguuugucaaaucauggaguguagcaaugcaacauucugaaaauugcucuucuaucuaagaggcaaacuuuuacucacacccagaguuaauaauacaucuugaagucacucaagacuuaagacugcuaaccuacuguguacacaaauuguuuaccugccuuuaagagaacaauguaacaaccaaccuuacuugucuuggauuucccauguaaucagcuuuuacaaccuaagcuaagguacagcuggaauaguuauguacucuucuuccaugccccugacccagaguaaugcaugucuaucacuuccugagagcagcaaauaccaaaguuaaaaacagcuuccuaaaaucuacaaaaagguugcaagcaacuuggugauaaacaaugguguuuguuaucuagaugagucgggaucuguuggagucagugacuuaauccccuguaaaacucugucaaagauuucuuaaaaauuucccauuccuuccucccucaugugaugcuuccgguacauuucaauaaauacagagcagagcucuuuguuaaggacauaugcaaaugauacaacagacacacacagcucacacaaccacacagaagaagaaaaaaacacacagaggaaagaaaaccacacacagucaugcaagagacaaacacugggacagaguccacaagauagcccuucaggcagguacagauucagacucgagaaauagaggaugcccggaagacacaggaaguaugaaguagaauaacuacccucuugguuaaacaacuccaagaggaagugcuuuuauuucuuuccuuaaugagggacacugaugaauuauuggcaacucagagcuaaucgcuaaugcauuauaauccacacaauggagcacaguguuuguuuguuuuauguacaacagaaagaaugaaacuuaucuguauuccaagcaugguggugcauaccuuuaaucucagcacucaggaggcagaggcagagagaucucugaguuucaggccacccuggucuuacauagcuagaacuaucucaaaaaagaaaaagaaaaagaaagaaagagagcgagagcgggagagagagagagagagagagagagagagagaagaaaaagagaaaaaaauguaugugcuggggaaaaaguguugauuuaaugguucuuaacuuugauuaauaaauguguuugaaccuaguuauaaugauuuaaaauucagcccaaaacacaauucuuuucacaucaaaagucaaaaccaucacagaaauaaaaaguaaaaaaguacuucccagggggcuggugaaauggcucaguggguaagagcacccgacugcucuuccgaagguccgaaguuuaaaucccagcaaccacaugguggcucacaaccaucuguaacaugaucugacucccucuucuggagugucugaagacagcuacaguguacuuacauauaauaaauaaaucuuuaaaaaaaaaaaaaaguacuucccaaagcuuguggacaacagauaaaaguucuagugaucuauuauauucaucaaugagaauacacuuaacauuacugaacaauacacuuuaaaauaguaaauacauaggcuggacagauggcucaacuguuaagaguaauuacugcuccugcaaaggacccaaguucaguuaccaacauaucagguggcucauaacugccuggaauacaaacuccuggggaaugugauguuucuggucccugcagacacaaucaagcauguauauauuccccacacagacauguacauauacuuaauuaaaaccaaucuuuuuuuuuuaaaugguaaacauagcaggauguggugggacaugucuuuaaucccagcacucaggaggcagaggcagguggaucucuaugaguucuagaccagucugaucuacaaaguuaguuccagggcuguuacacagagagagaaacccuauccaaaaaacaaaaacaaaaauaacgacgacaaaaaacaugucuauuauuccagcacucugaaggcagagaggcaggaaaaucagucuguuugaguccaccuaacauauacagugaccgcugaggauaacuugauacaguuugguuucuauguauguaugaauguuugguuucuacuuggucacuagguaaauuuacagcaucaucaguuuguuuccuuacccaugcuccccauuuuuuuucaaucaguaggauuucuaaaacuuucuggcuuuaaucaacagucaaguucuucaaggaaauucuuguaauaaccaauaaaauaaguuagcacaacucacuuugugauagaaaauagcuucaggaggaagggcacuauuuacugauuugauccuuuuugcugaggcuaccuagauccucuucuucaacacacccaaaaagaugacagacuaugccaagaaguaaggcugauuccugggcccuaacaacuuugccagccagcagcaaaagccagaagacaccaccauacccuccacugagcaggccaaacugguugacaguaugccuggcagcaggcgaugauugagccucugccagggcagaugaacauggcuagcccaacaaacccaguauaggcaggcccucaauaaaggcggauuaacuucuuauugucccuagucucaccagugcaauggugggggauaguuauucuggagaauaugggaguucaggagccuuuggacauccuggauguguaucaccuagucaucauugcucugaguuuuaaacagaggccagugacccacaagaaagcacaggccuagauugagagacuucuagccagcuguggaugcaucaugggccaaggggacuagauauuuucaguaaaguaccaugugucucaauuguuuaaaacuguuggucauagauuaaauaauuuuaaaaaugaaaauaaaauaaaaugauuucaggucaauacgaaccuguccucccauauacaaagccucuuuccaagcucuagcaaaaagauaaacuuuuuugaagaggguaaagugaaggaacuggaauugagaaaaacaacugagcaaugucucuaaacugaagagccuucuaauucaauuggaauagggaaagagguuuuggaccacaggcuaaacagacucuugacauguuaaaaugguuagauauuccagaaagagagcuaucauuaucucauggcaaucuuuuuauuccuuagguaucucauagaagcuauauuuccuguaaacaaguaauaagacagacugggugacugcgugacugacugacugauggagauaaacaaugguuauuuuguacauuacaccaaaucgagcuuuacaaauuucguaaauuguagucauggcaaaauuaagcucaacaauaguauaaccaccuacugauguaguagcuccauuacacaagagggaaaggcaauacaucuuaaaaaaaaaaaaaaaacuaaaaagucuuguggaacaaaauuagguguugcaaaagaacagacugguauuuuauagagugaaaauaguauaccaaaaucaaauacuuaaaaaggaugaaauuuaaggucaccugggcuacauaguauuucuaggccagacaauacuuuagaguaagacguuaccuuagaaaaacugcauguauuuauaugugcuaugugugugaaaugccugcagagacgaacgagggcguuggcucugcugggacuggacuuacagcuuaguucuuagcuggauauaggugcugggaauugaacacagguccucuagaagagcagcgaguguucuuaacugcugaggcaucucucuaacucagcccuaagauaaagacuaccaauaccaacgucaguguagauugggaagacuauagcuccugugcagcuuccacuggaacugaaacugucaacauaaauggcacaaccacucuugagaaagcuugacaaucucuuauaaagugaaaugaauauuuaucacaugacagagcaauucaacuuggaggcagcuauucaagaaaaacuaaaauguagguauaaaagaucuacguagacaaacaguaacugcuuuaauaaccaaaaacuaaaaacaguuccauuuauccauugacacaaauaaaggggaaaaaaaccauagaauauucauauaacagaaugcuacuuugaaauaacuaguguaaguuacaacauagauauacaucaaaaacauguuggaugaaagaagccagucacaaaagaacacuucuuuucucuucuguccauguaaauuccugagcaggagaaaucugaucaguaguugagggaugaugaugagauagaugauggcaguauuacauugugaaugaggugguuacugcagguguauacauuugccaaacuucucaagcuguaccuuucaaacccgcacauuguacauaaaccacagaucgguaaaguggaacuguuuuuuuuuuuuuuuuuuuuuuuuuuuuuuaaagauuuauuuauuuauuauauguaaguacacuguagcugucuucagacacuccagaagagggagucagaucuugauaaagaugguugugagccaccaugugguugcugggauuugaacucuggaccuucggaagagcagucgggugcucuuacccacugagccaucucaccagcccccaaaguggaacuguuaacugaaaacugaaugcuuuucuaggaagcaauguaucaauacuaaaggcuugggaauaugcaucacuuugaaaaggaaacucuccuuauagaaagcuauccugcaaaugaucaaaauacaccugggaagcagggugccaagauggcucagccagcaaggcuccugcugcacaugccuggcagccugaguccaaucaccaaaacccacagaaagguggauggaaaguacugacucuauauguuguucuuugaccuccacauacacaccaugaaacacacacacagggagagagggagagaggcagaaagggggagaagggaagagggaagagggagagaggguuuuuuuaaaaaauuaaaaacaaaggagauacaaggaugaucacuucaucuggagaccaucagagaaacagagggcaagauuaaugagccacauuuauaagcuggaauacuguccauuccucuuuacaaaggcagcaagugcuggcaagagcaacaaguuuuccugaaaaaagcuacaugguaagucuuuuauggcuggcagaggauacauaauuuuuuuucuugaagaaguagcagucuuuuacuacucucuuaaaaaauauauuaauauucuuaauuuguagacccuaaauaaaacaaccuguaggcuggggguguagcacugugggcacugugguagcaaaccgaaaguaucagauuggauucccuauguuacccuaaacaaacaagaagugggaagaaaucagaacuuuaaaaccaaaacccaacauccaaaugcccaaauucuccuuucucuaccagcuccucucuccagcccuugucauuuuuuuuuccacauuaaaaaauaaaaaaaaguagcugggcauguugggauauaacucuaauaaucucagcacuugggagaagaggcaaaagaaccaggaguucaaggcuagcuagcuagccugagcuacaugaggcccuguuucaaaaaaaugaaaacaggccagacaugguaguacaugucucuaaccccagcacucugaaagcagaagcagaaacaggcagauagaacucuguguucaaggucagccuggucaaagaguuagcuauaggauagccagggccauacaaagauacccuguuucaaaaaaagaaagaaaaagaaagaaagaaagaaagaaagaaagaaagaaagaaagaaagaaagaaagaaagaaagaaagaaagaaagaaagaaaagagaaaagaaaaacacagaagucaugagauuccaucacuagcugaggagcaauuggcaacuaaugguugcuagagaaagaagucaguuuucuucaguugcguagauacugguuaaguuuuccaugcucaguaaaucccacauccaugcccaugugaucaacucuaaucaagcucaauaagcaauaaaaggaggcagaaacauuaugagaccagccugcuugauauagcaaauuuugagccggcaagguuuauaguaugaaaucuaucucaaaaaaauaaauaaaaugcauccagacaugcauucaaccuugcagcccaccuagguccuauaacauauugcaacagggccaagcgggauaaguguagcuuucacagucauuaaggaaauuauucuuuguaacagauggagaacauuuuagaaggccacaccaggucaaaaugcagagaacaaguaagagaucauguggugcucagccccaaucgauacaucuacaauacaacuucugugccuaagguucagggaauauaucagaagagggggcagaaaaaaaauuuaagagccagaaaaugaagaaaucugcuaugaaauucugucuccuagaagugacaaggaagcuucuucacccaugaugaacucaacaauacagcugccuaaacaagacccaaagaagugcaauaccaauaaacauacuaacauugaagaagaaaaccuuauggggcccaccccuaaacaaagaacuacaggcaauuauagauugcugagagugggagaaaaagucuucccaagggacgaguacccuaacuggguauccacuaacaagugaucagcccugaaaucauguacauacaaguaacacuaaauggaccgaaugggcuguauuuauauauuucgguaaauacauacacaacaauaacaaaggaagugaccggaaacauggaggaguaaaugggagaaacuagggagagggaaggaaaaaugugauuauauuucuaugcuuaaaaauuaagaaaaaaaaauaauaaaagauaugagcuggaaauauggcuuagcaauuaagagagcuugcugcucuuccagaggaucugagcugcauucucaguaccuucauggcagcucacaaaaacagcacagcuguaaacuccaguuccaagggaucugaggaaggucuucuggcuuccaccaguuccagacagaaacauuguacauagacauacauacaagcaaagacccaaacauauaaaauaaaaauaaaugcaucuuaaaaauaaauacaaaguuguuucuggcuuaugucacuuagcacaagguccuccaaguccaugcaaguuguauagcauguaucagaauuucacuccuuuuauaucacaauaucuuacuauacauaugcuuucacugcauuuuguuuucaucugcugauaaaugaaguaaaaagugaaguaauauaucacauuuuuaaaaaauauaugucaaacaguagaugcuuuaauaucacagucagaaacugcuuaaugacaggauuacauuacaccuggaguguacuuauacaaacugagauagcaacaaugucauuuaagcaauaaucuuauaguacuucauuauacagugccugaguucacugugcagaaauuccuuaucucacuucauuucugcuauacuuuugugucacagagguauauucacaagguauauaacuaugugaccauuuuagaacucuaucagcuucaugggcugaagagauggcucaucaguuaugagugcuugguauucaaucaugagaaccuguauucugaucaaugcccagauagcagccagguaucuuggaaaucacaguaauuccagcucaaagggauuggaaacccaauucuggcuuccuguacacacgcaugcacauguacucacacaugcaagcaaauaaauauuuuuuuaaguuuuuacuauguggggguggggugaaggaguaggugggggaguagcugggggagguggucuagaaaucaaaggacaacuuacuagagucaaacaguucucucuaccuugaagguucagggugaaucaaacuuaggucaucagacuugguggcaaguacuuuuuuuugcccacugagcuaucuugacagccuaauuuuaaaaaaaaaaaaaaauuguaauagaaaaaaauguaucaggucuaacuucuauaacuuuugagauacuauuagauuugucucuacuuuugacauuaagaaagaaugaagagcccugcaugguggcgcacgccuuuaaucccaaacaggcagauuucugaguuuaagaccagccuagucuacaaagugaguuccaggacagccagggcuauacagagaaacccugucucagaaaaaaacaacaacaacaacaacaaaaaaaaaacaaaaaaaagaaugaagaucagguuacagaacugcacagcaguguacaggaccauagaagaaugaugaagaacaacccaauaagugacuuauaauuagucauugcuuccuucaauuuuagcuucaaaaccuaccugaaauuacaacaagguauccuucaguuaaaagucuugccaccuucaagccaaauauaguggcacaugccuaucaucuuagcuacucaggaggcuaagauaggaauaucaugaaaaacuaauaguuugagacaguuaugaacaacacagcaagaucuacuucaaaaaagaaaaaaagaaaagcagaaccuggugguacacauuuauaaaacuagcacucaaaagacuaaacaggaggaccucaaauccaggucagccacagcuacaaauaaagaccuagucucaaaaaaagaaaguaaguuugggcuagcauuugaaauguaaaugaagaaaauaucuaauaaaaaauugaaaagaaagaaagaaagaaagaaagaaagaaagaaagaaagaaaggaaggaaggaaggaaggaaggaaggaaggaaggaaggaaggaaggaaggaaagaaggcaggcagguauaguggccuauccuagcacucaaaagccaagugagguaggauaggacugccucaaauuuaaggccugucugggcuacauaguaaauucaagacuaaucugaguuacauagcaagugagggaggaagaccuagccugucugcuuugccaauuuucuuuauuauugaggaagaauaugugaacccaugcaugaacacauaagauagcuuuuuuggggagucgguucucucuuccccuguaccagguuccaggaaucaaacuuggguuucauaguaagcaguuuuauuuauaucucacuguuuuccaaauuucucugucaauuuauuucacuguaucuuuccaauuuccuuaaaucacuugguuauuaacuauucucuggaaacuaccaaccuaaguguuaggcaaccaaucaaaaauaggacagaaacuuugucccacaacacuuagacagugugaagcauaaacaagugaacaauuugauacaugcaauaauauaaguaugaacaaaacucugugagugucugagacuucugggacaacaucucuaaaauaaagcacauacucugauggaccuuucucugaauuuaaugaauuguuccuuucuacccauguuccaccguaaagauucuaccaaccuauaacuacuauggaauguacugaaaaauucaccaucuacacugacauaaagacuucaaagcuaaucuauaaaccauuucuauagcccauaaaucauuuuaucagcagagaaauuuuccuuuguucguuuuuuuaaggcaaaucaacuuucuucauuauuauuuaaaggcuaguaauaaaauaaaucuaaacuucuugagcauaugacuucaaaggauaaaggacaaccuaaagcaaaugaauuuuggugugauuuggaaaaucugacuaaaaccuuuacauagccaacacaaaaauaaucacauguauccaugcaaaagaauaucaguaccaaaaagaacacuucuagcuacacaugucaacaaguggcuuuuucuaucccuauuuagacuucuuaaacauuucucauuucuaccgaaacauaaggcaauauuuucaaccaauucuucagagaguuaaggaaauauauguggcaaguacaaaacagcaaaugucaacuacaggaaaaaaucacauauucaggcaaaacugaauuguuaaauucuaaacuaauuuucuaccaaaauucuauacaacuagcucaccucauaaugaaugagauuaucaauaggauuuuaauguaaacauaaaccuuaugcuacaaucucaacauuuagagcugcaccuggaaugucuauucuacgaugcuccugcaaaucagaaacaacagaaauuugacacugcauuucuuugucuccauucauaugaaaccguaaauuagcagauguacuuuaggucuucauuagaugaaacagugcaacaagagucuguucuuuugguuuuuuuuuguuuuuuuuuuuaagaaauauauucaaaacccaucaaaauuagaauauaggaugcaauuuuccuaaguuuuccuaaugcaauuuucauucucuaguacaccucuccaaagagaaaaggcaggauucuuuucguuuaagaccagaauccaauccguuuccaacuugagaauacaagaacaggaaauuaaauauaaccuaaauauuuccacauucuucuaaguaaaauugacuuuuauuccugaauaugaauucacugcuaauauucauuaauaaaaaguaauugaaaauacauuuuuaaaucgccaaaaauauaaacuacauucaacugugacagcauuaguauuuuucaaauguuuuaugugccauuaaaaacccauagaauuaaacugauaacgacuuuccugaaacugaaaaggcguuguagcguuguuguacgguauuuuaaauaucaaagacaaauuuuuacuucagaugaauuuagauucuacagauccuguuaauaagcaaaguaaguuucuuugaauugugacaagaauacacucgaauuucuuaggcaacaaaugccuuuucugacucaccaaagcuauuguucacgggaaacgugacccacuaaaaagaaacugucaauucuacagcguaaacccacauuucucguggguauuuuauuucgaucaucuagucuuuaacaaccuaccccuggagauuuggggaauaaucacugaguaaaugacaguugauuucguuagcaccugucaccauucucaaaagcacacaaguuggccaaaacagauuuuguuuuucuuucagguuuugguccuuuagaaaguagaacucacaagacauucaccaaguuuuccgaaagcccgugcuuucucaauuucucccauuuucaaaaaguagcccugaagcauacgaucuggugcgugcaaggggggcuguauaaugaagugagagaaggaaacacagcuggacucuuccaucgaacuuagcacaaagccagucgaggacacuagcagcccgaggcagugggagacucccggcucucggggaaaugucagccgcagggcuaagggaguucccacauugugcacgcagucccgccuuagcaaggcccggcguuagccggucgcccccagcagggccaggcaaggacgagcccugcccacucgcgcucgcgucgcgccuccccacgcccccacccgcgcggcgggagccccgagugucgcguccuccccuccccuuccgagacacagucuguccuuugucugagugcagacucucgacucggucccaccaacuuguguguaagucccguccuacccgggcgcucccgccucccagccacacaaagaagacuugaggcucagcgcugccggccccgaucggccacaggaacgcccccagccccggccaggcgggaccaggcuccgggacagaagcccccacucccggcccccgcccgcccgcgucugccggaauccacaguucacucgugggaccgcggggaccgccacacaccucacgaccgcucagaaagcuguccccuagcccucccuccgcgccuacaaaagcggcgcucgagugagacccgcuugggcgaugccgaagacuggccaggcacccgcgcggaggucccgcgaucgccgccgccgccgccgccgccccggggcgcguuccagaucccugacugccgaccaccggcggccgacggcgcggacuaccuucgucccgcgcgccagcccgcgccucucccgcgcgucgcccccaacccgccgccaccgccaccgccgccgccgggacuccacugccuucgaugucccacugggugucggacgcgaccggaccgag

SEQ ID NO: 12113 - RNA, 64741 nt, Mus musculus
cucgguccggucgcguccgacacccagugggacaucgaaggcaguggagucccggcggcggcgguggcgguggcggcggguugggggcgacgcgcgggagaggcgcgggcuggcgcgcgggacgaagguaguccgcgccgucggccgccgguggucggcagucagggaucuggaacgcgccccggggcggcggcggcggcggcggcgaucgcgggaccuccgcgcgggugccuggccagucuucggcaucgcccaagcgggucucacucgagcgccgcuuuuguaggcgcggagggagggcuaggggacagcuuucugagcggucgugagguguguggcgguccccgcggucccacgagugaacuguggauuccggcagacgcgggcgggcgggggccgggagugggggcuucugucccggagccuggucccgccuggccggggcugggggcguuccuguggccgaucggggccggcagcgcugagccucaagucuucuuuguguggcugggaggcgggagcgcccggguaggacgggacuuacacacaaguuggugggaccgagucgagagucugcacucagacaaaggacagacugugucucggaaggggaggggaggacgcgacacucggggcucccgccgcgcgggugggggcguggggaggcgcgacgcgagcgcgagugggcagggcucguccuugccuggcccugcugggggcgaccggcuaacgccgggccuugcuaaggcgggacugcgugcacaaugugggaacucccuuagcccugcggcugacauuuccccgagagccgggagucucccacugccucgggcugcuaguguccucgacuggcuuugugcuaaguucgauggaagaguccagcuguguuuccuucucucacuucauuauacagccccccuugcacgcaccagaucguaugcuucagggcuacuuuuugaaaaugggagaaauugagaaagcacgggcuuucggaaaacuuggugaaugucuugugaguucuacuuucuaaaggaccaaaaccugaaagaaaaacaaaaucuguuuuggccaacuugugugcuuuugagaauggugacaggugcuaacgaaaucaacugucauuuacucagugauuauuccccaaaucuccagggguagguuguuaaagacuagaugaucgaaauaaaauacccacgagaaauguggguuuacgcuguagaauugacaguuucuuuuuagugggucacguuucccgugaacaauagcuuuggugagucagaaaaggcauuuguugccuaagaaauucgaguguauucuugucacaauucaaagaaacuuacuuugcuuauuaacaggaucuguagaaucuaaauucaucugaaguaaaaauuugucuuugauauuuaaaauaccguacaacaacgcuacaacgccuuuucaguuucaggaaagucguuaucaguuuaauucuauggguuuuuaauggcacauaaaacauuugaaaaauacuaaugcugucacaguugaauguaguuuauauuuuuggcgauuuaaaaauguauuuucaauuacuuuuuauuaaugaauauuagcagugaauucauauucaggaauaaaagucaauuuuacuuagaagaauguggaaauauuuagguuauauuuaauuuccuguucuuguauucucaaguuggaaacggauuggauucuggucuuaaacgaaaagaauccugccuuuucucuuuggagagguguacuagagaaugaaaauugcauuaggaaaacuuaggaaaauugcauccuauauucuaauuuugauggguuuugaauauauuucuuaaaaaaaaaaacaaaaaaaaaccaaaagaacagacucuuguugcacuguuucaucuaaugaagaccuaaaguacaucugcuaauuuacgguuucauaugaauggagacaaagaaaugcagugucaaauuucuguuguuucugauuugcaggagcaucguagaauagacauuccaggugcagcucuaaauguugagauuguagcauaagguuuauguuuacauuaaaauccuauugauaaucucauucauuaugaggugagcuaguuguauagaauuuugguagaaaauuaguuuagaauuuaacaauucaguuuugccugaauaugugauuuuuuccuguaguugacauuugcuguuuuguacuugccacauauauuuccuuaacucucugaagaauugguugaaaauauugccuuauguuucgguagaaaugagaaauguuuaagaagucuaaauagggauagaaaaagccacuuguugacauguguagcuagaaguguucuuuuugguacugauauucuuuugcauggauacaugugauuauuuuuguguuggcuauguaaagguuuuagucagauuuuccaaaucacaccaaaauucauuugcuuuagguuguccuuuauccuuugaagucauaugcucaagaaguuuagauuuauuuuauuacuagccuuuaaauaauaaugaagaaaguugauuugccuuaaaaaaacgaacaaaggaaaauuucucugcugauaaaaugauuuaugggcuauagaaaugguuuauagauuagcuuugaagucuuuaugucaguguagauggugaauuuuucaguacauuccauaguaguuauagguugguagaaucuuuacgguggaacauggguagaaaggaacaauucauuaaauucagagaaagguccaucagaguaugugcuuuauuuuagagauguugucccagaagucucagacacucacagaguuuuguucauacuuauauuauugcauguaucaaauuguucacuuguuuaugcuucacacugucuaaguguugugggacaaaguuucuguccuauuuuugauugguugccuaacacuuagguugguaguuuccagagaauaguuaauaaccaagugauuuaaggaaauuggaaagauacagugaaauaaauugacagagaaauuuggaaaacagugagauauaaauaaaacugcuuacuaugaaacccaaguuugauuccuggaaccugguacaggggaagagagaaccgacuccccaaaaaagcuaucuuauguguucaugcauggguucacauauucuuccucaauaauaaagaaaauuggcaaagcagacaggcuaggucuuccucccucacuugcuauguaacucagauuagucuugaauuuacuauguagcccagacaggccuuaaauuugaggcaguccuauccuaccucacuuggcuuuugagugcuaggauaggccacuauaccugccugccuucuuuccuuccuuccuuccuuccuuccuuccuuccuuccuuccuuccuuccuuccuuucuuucuuucuuucuuucuuucuuucuuucuuucuuucuuuucaauuuuuuauuagauauuuucuucauuuacauuucaaaugcuagcccaaacuuacuuucuuuuuuugagacuaggucuuuauuuguagcuguggcugaccuggauuugagguccuccuguuuagucuuuugagugcuaguuuuauaaauguguaccaccagguucugcuuuucuuuuuuucuuuuuugaaguagaucuugcuguguuguucauaacugucucaaacuauuaguuuuucaugauauuccuaucuuagccuccugaguagcuaagaugauaggcaugugccacuauauuuggcuugaagguggcaagacuuuuaacugaaggauaccuuguuguaauuucagguagguuuugaagcuaaaauugaaggaagcaaugacuaauuauaagucacuuauuggguuguucuucaucauucuucuaugguccuguacacugcugugcaguucuguaaccugaucuucauucuuuuuuuuguuuuuuuuuuguuguuguuguuguuguuuuuuucugagacaggguuucucuguauagcccuggcuguccuggaacucacuuuguagacuaggcuggucuuaaacucagaaaucugccuguuugggauuaaaggcgugcgccaccaugcagggcucuucauucuuucuuaaugucaaaaguagagacaaaucuaauaguaucucaaaaguuauagaaguuagaccugauacauuuuuuucuauuacaauuuuuuuuuuuuuuuaaaauuaggcugucaagauagcucagugggcaaaaaaaaguacuugccaccaagucugaugaccuaaguuugauucacccugaaccuucaagguagagagaacuguuugacucuaguaaguuguccuuugauuucuagaccaccucccccagcuacucccccaccuacuccuucaccccacccccacauaguaaaaacuuaaaaaaauauuuauuugcuugcaugugugaguacaugugcaugcguguguacaggaagccagaauuggguuuccaaucccuuugagcuggaauuacugugauuuccaagauaccuggcugcuaucugggcauugaucagaauacagguucucaugauugaauaccaagcacucauaacugaugagccaucucuucagcccaugaagcugauagaguucuaaaauggucacauaguuauauaccuugugaauauaccucugugacacaaaaguauagcagaaaugaagugagauaaggaauuucugcacagugaacucaggcacuguauaaugaaguacuauaagauuauugcuuaaaugacauuguugcuaucucaguuuguauaaguacacuccagguguaauguaauccugucauuaagcaguuucugacugugauauuaaagcaucuacuguuugacauauauuuuuuaaaaaugugauauauuacuucacuuuuuacuucauuuaucagcagaugaaaacaaaaugcagugaaagcauauguauaguaagauauugugauauaaaaggagugaaauucugauacaugcuauacaacuugcauggacuuggaggaccuugugcuaagugacauaagccagaaacaacuuuguauuuauuuuuaagaugcauuuauuuuuauuuuauauguuugggucuuugcuuguauguaugucuauguacaauguuucugucuggaacugguggaagccagaagaccuuccucagaucccuuggaacuggaguuuacagcugugcuguuuuugugagcugccaugaagguacugagaaugcagcucagauccucuggaagagcagcaagcucucuuaauugcuaagccauauuuccagcucauaucuuuuauuauuuuuuuuucuuaauuuuuaagcauagaaauauaaucacauuuuuccuucccucucccuaguuucucccauuuacuccuccauguuuccggucacuuccuuuguuauuguuguguauguauuuaccgaaauauauaaauacagcccauucgguccauuuaguguuacuuguauguacaugauuucagggcugaucacuuguuaguggauacccaguuaggguacucgucccuugggaagacuuuuucucccacucucagcaaucuauaauugccuguaguucuuuguuuaggggugggccccauaagguuuucuucuucaauguuaguauguuuauugguauugcacuucuuugggucuuguuuaggcagcuguauuguugaguucaucaugggugaagaagcuuccuugucacuucuaggagacagaauuucauagcagauuucuucauuuucuggcucuuaaauuuuuuuucugcccccucuucugauauauucccugaaccuuaggcacagaaguuguauuguagauguaucgauuggggcugagcaccacaugaucucuuacuuguucucugcauuuugaccugguguggccuucuaaaauguucuccaucuguuacaaagaauaauuuccuuaaugacugugaaagcuacacuuaucccgcuuggcccuguugcaauauguuauaggaccuaggugggcugcaagguugaaugcaugucuggaugcauuuuauuuauuuuuuugagauagauuucauacuauaaaccuugccggcucaaaauuugcuauaucaagcaggcuggucucauaauguuucugccuccuuuuauugcuuauugagcuugauuagaguugaucacaugggcauggaugugggauuuacugagcauggaaaacuuaaccaguaucuacgcaacugaagaaaacugacuucuuucucuagcaaccauuaguugccaauugcuccucagcuagugauggaaucucaugacuucuguguuuuucuuuucucuuuucuuucuuucuuucuuucuuucuuucuuucuuucuuucuuucuuucuuucuuucuuucuuucuuucuuucuuucuuuuucuuucuuuuuuugaaacaggguaucuuuguauggcccuggcuauccuauagcuaacucuuugaccaggcugaccuugaacacagaguucuaucugccuguuucugcuucugcuuucagagugcugggguuagagacauguacuaccaugucuggccuguuuucauuuuuuugaaacagggccucauguagcucaggcuagcuagcuagccuugaacuccugguucuuuugccucuucucccaagugcugagauuauuagaguuauaucccaacaugcccagcuacuuuuuuuuauuuuuuaauguggaaaaaaaaaugacaagggcuggagagaggagcugguagagaaaggagaauuugggcauuuggauguuggguuuugguuuuaaaguucugauuucuucccacuucuuguuuguuuaggguaacauagggaauccaaucugauacuuucgguuugcuaccacagugcccacagugcuacacccccagccuacagguuguuuuauuuagggucuacaaauuaagaauauuaauauauuuuuuaagagaguaguaaaagacugcuacuucuucaagaaaaaaaauuauguauccucugccagccauaaaagacuuaccauguagcuuuuuucaggaaaacuuguugcucuugccagcacuugcugccuuuguaaagaggaauggacaguauuccagcuuauaaauguggcucauuaaucuugcccucuguuucucugauggucuccagaugaagugaucauccuuguaucuccuuuguuuuuaauuuuuuaaaaaaacccucucucccucuucccucuucccuucucccccuuucugccucucucccucucucccuguguguguguuucaugguguguauguggaggucaaagaacaacauauagagucaguacuuuccauccaccuuucuguggguuuuggugauuggacucaggcugccaggcaugugcagcaggagccuugcuggcugagccaucuuggcacccugcuucccagguguauuuugaucauuugcaggauagcuuucuauaaggagaguuuccuuuucaaagugaugcauauucccaagccuuuaguauugauacauugcuuccuagaaaagcauucaguuuucaguuaacaguuccacuuugggggcuggugagauggcucaguggguaagagcacccgacugcucuuccgaagguccagaguucaaaucccagcaaccacaugguggcucacaaccaucuuuaucaagaucugacucccucuucuggagugucugaagacagcuacaguguacuuacauauaauaaauaaauaaaucuuuaaaaaaaaaaaaaaaaaaaaaaaaaaaaaacaguuccacuuuaccgaucugugguuuauguacaaugugcggguuugaaagguacagcuugagaaguuuggcaaauguauacaccugcaguaaccaccucauucacaauguaauacugccaucaucuaucucaucaucaucccucaacuacugaucagauuucuccugcucaggaauuuacauggacagaagagaaaagaaguguucuuuugugacuggcuucuuucauccaacauguuuuugauguauaucuauguuguaacuuacacuaguuauuucaaaguagcauucuguuauaugaauauucuaugguuuuuuuccccuuuauuugugucaauggauaaauggaacuguuuuuaguuuuugguuauuaaagcaguuacuguuugucuacguagaucuuuuauaccuacauuuuaguuuuucuugaauagcugccuccaaguugaauugcucugucaugugauaaauauucauuucacuuuauaagagauugucaagcuuucucaagagugguugugccauuuauguugacaguuucaguuccaguggaagcugcacaggagcuauagucuucccaaucuacacugacguugguauugguagucuuuaucuuagggcugaguuagagagaugccucagcaguuaagaacacucgcugcucuucuagaggaccuguguucaauucccagcaccuauauccagcuaagaacuaagcuguaaguccagucccagcagagccaacgcccucguucgucucugcaggcauuucacacacauagcacauauaaauacaugcaguuuuucuaagguaacgucuuacucuaaaguauugucuggccuagaaauacuauguagcccaggugaccuuaaauuucauccuuuuuaaguauuugauuuugguauacuauuuucacucuauaaaauaccagucuguucuuuugcaacaccuaauuuuguuccacaagacuuuuuaguuuuuuuuuuuuuuuuaagauguauugccuuucccucuuguguaauggagcuacuacaucaguaggugguuauacuauuguugagcuuaauuuugccaugacuacaauuuacgaaauuuguaaagcucgauuugguguaauguacaaaauaaccauuguuuaucuccaucagucagucagucacgcagucacccagucugucuuauuacuuguuuacaggaaauauagcuucuaugagauaccuaaggaauaaaaagauugccaugagauaaugauagcucucuuucuggaauaucuaaccauuuuaacaugucaagagucuguuuagccugugguccaaaaccucuuucccuauuccaauugaauuagaaggcucuucaguuuagagacauugcucaguuguuuuucucaauuccaguuccuucacuuuacccucuucaaaaaaguuuaucuuuuugcuagagcuuggaaagaggcuuuguauaugggaggacagguucguauugaccugaaaucauuuuauuuuauuuucauuuuuaaaauuauuuaaucuaugaccaacaguuuuaaacaauugagacacaugguacuuuacugaaaauaucuaguccccuuggcccaugaugcauccacagcuggcuagaagucucucaaucuaggccugugcuuucuugugggucacuggccucuguuuaaaacucagagcaaugaugacuaggugauacacauccaggauguccaaaggcuccugaacucccauauucuccagaauaacuaucccccaccauugcacuggugagacuagggacaauaagaaguuaauccgccuuuauugagggccugccuauacuggguuuguugggcuagccauguucaucugcccuggcagaggcucaaucaucgccugcugccaggcauacugucaaccaguuuggccugcucaguggaggguaugguggugucuucuggcuuuugcugcuggcuggcaaaguuguuagggcccaggaaucagccuuacuucuuggcauagucugucaucuuuuuggguguguugaagaagaggaucuagguagccucagcaaaaaggaucaaaucaguaaauagugcccuuccuccugaagcuauuuucuaucacaaagugaguugugcuaacuuauuuuauugguuauuacaagaauuuccuugaagaacuugacuguugauuaaagccagaaaguuuuagaaauccuacugauugaaaaaaaauggggagcauggguaaggaaacaaacugaugaugcuguaaauuuaccuagugaccaaguagaaaccaaacauucauacauacauagaaaccaaacuguaucaaguuauccucagcggucacuguauauguuagguggacucaaacagacugauuuuccugccucucugccuucagagugcuggaauaauagacauguuuuuugucgucguuauuuuuguuuuuguuuuuuggauaggguuucucucucuguguaacagcccuggaacuaacuuuguagaucagacuggucuagaacucauagagauccaccugccucugccuccugagugcugggauuaaagacaugucccaccacauccugcuauguuuaccauuuaaaaaaaaaagauugguuuuaauuaaguauauguacaugucuguguggggaauauauacaugcuugauugugucugcagggaccagaaacaucacauuccccaggaguuuguauuccaggcaguuaugagccaccugauauguugguaacugaacuuggguccuuugcaggagcaguaauuacucuuaacaguugagccaucuguccagccuauguauuuacuauuuuaaaguguauuguucaguaauguuaaguguauucucauugaugaauauaauagaucacuagaacuuuuaucuguuguccacaagcuuugggaaguacuuuuuuuuuuuuuuaaagauuuauuuauuauauguaaguacacuguagcugucuucagacacuccagaagagggagucagaucauguuacagaugguugugagccaccaugugguugcugggauuuaaacuucggaccuucggaagagcagucgggugcucuuacccacugagccauuucaccagcccccugggaaguacuuuuuuacuuuuuauuucugugaugguuuugacuuuugaugugaaaagaauuguguuuugggcugaauuuuaaaucauuauaacuagguucaaacacauuuauuaaucaaaguuaagaaccauuaaaucaacacuuuuuccccagcacauacauuuuuuucucuuuuucuucucucucucucucucucucucucucucucucccgcucucgcucucuuucuuucuuuuucuuuuucuuuuuugagauaguucuagcuauguaagaccaggguggccugaaacucagagaucucucugccucugccuccugagugcugagauuaaagguaugcaccaccaugcuuggaauacagauaaguuucauucuuucuguuguacauaaaacaaacaaacacugugcuccauuguguggauuauaaugcauuagcgauuagcucugaguugccaauaauucaucagugucccucauuaaggaaagaaauaaaagcacuuccucuuggaguuguuuaaccaagaggguaguuauucuacuucauacuuccugugucuuccgggcauccucuauuucucgagucugaaucuguaccugccugaagggcuaucuuguggacucugucccaguguuugucucuugcaugacugugugugguuuucuuuccucuguguguuuuuuucuucuucugugugguugugugagcugugugugucuguuguaucauuugcauauguccuuaacaaagagcucugcucuguauuuauugaaauguaccggaagcaucacaugagggaggaaggaaugggaaauuuuuaagaaaucuuugacagaguuuuacaggggauuaagucacugacuccaacagaucccgacucaucuagauaacaaacaccauuguuuaucaccaaguugcuugcaaccuuuuuguagauuuuaggaagcuguuuuuaacuuugguauuugcugcucucaggaagugauagacaugcauuacucugggucaggggcauggaagaagaguacauaacuauuccagcuguaccuuagcuuagguuguaaaagcugauuacaugggaaauccaagacaaguaagguugguuguuacauuguucucuuaaaggcagguaaacaauuuguguacacaguagguuagcagucuuaagucuugagugacuucaagauguauuauuaacucugggugugaguaaaaguuugccucuuagauagaagagcaauuuucagaauguugcauugcuacacuccaugauuugacaaacauuuggaaaguauuuucuguauccugcuggcuguggaaguuuguuuucugcaagaaguuguugagauacuugaagaagugauaguuggugaaugaaagaucaggugaauaugguggaucauauaaaacuuuguagcccaauuuguugaacuuuugaaguauugguugugcgaugugcagucaggugcuacugcgaagaaaaaaauggccccuuucuguuggccaugcuggcugcaaguguuguauuuuuugaugcauaucauugauuuguugagcccacaucucgguuguaaggauuuuuuuccaggauucagaaagcuguaauggaccauaaccucuuggcuuugggcauuacuuuggagcuuuuuuguucaaccaugaagcuggucaucaugguuguuguacauagucccauuugcauuucacagucagguggagaaauggaacaguguuguauagacuaagagaggagaguaguucaaaauaauggucuuuggacuuuucaucagcacauuaaugaauguuuccaacuugucucagaugcaggaugacuuggaugcuccaggucuacauugagucccuauggcagcuucucagguaguuguaagaggugcuuagauaauuguucucauuuggcuuucccagcaucccauggccaguuauuucauuccuuccagauuccaucuccuuugcaaaacuuguugaaccuccacuuccugguucacucuuaagcaguuacuagguuaaauguguguugagguuuccagcugucuuuguuacuuuaugacccauuuugaacuugaauaagaaaaucucuugaauaugcauuuugccuaacaucguuucauguaguacagaauaaauccaaaacagcaaggaguaguaagucauaggaaaagacuuaaagcaagaaauacacauuaaauugaugcauaacagaaccacauuuauuuaacaauguguuccaggaauaagggacaaauuucaacaauguaaaaacugaaauuaccuuuguaucaaccuaauacuugugauacuuuguaugacuagagauagacuguaucuguucugugauugacuuguuuugcuuaguauaauguccuugagguucaucuguugccuccauguucucuuaaaggcagguaagcaguuuggguacauaauaggucuuaaauggucuccccccaccacccucccaaaaccuucaccccuacuucccacagugugcugaacucucacuuaaagcauuaaucaagaaaaugccucacagauuugccuacagcaaucugauggaggcaauaguuuaauuaagguucauucauugucaggucauuagcaaacacuguuacccccugagccaucuugcugguacuugaacuaguguuuuaaacaauucaaaauuaguaguguaguucaauaguaauguacuuaguguacaugaagccucuugcuuuaaucuuuagcaccauuaaaaaagaaaauaguugauauagcuaugucuuaugguucauaccuguaauccagcauuuuugaggcuguggcaagacuguggcaaggcuguggcaaguuugagguuuaccugggcuacauagugagauccuaucucaagaaacaaaaccuuaaaugaguacacaaauuuaaaagaauaaauuggcuaguuugagcuuagugguauucaguacuuggguaauuuaucagcuaaagaaguaaaaauugcauuauagauauucuagaaaagaaaauuucaaauuauuuauugggugccuguacuggcuggcuuugugugucauuuugacauaggcuagcauuaucacagagaaaggagcuucaguuggggaagugucuccaugaguuccagcuguggggcauuuucucaauuagugauuaaguggggagggccccuagugagugguaccaucucugagcugguaguaagaaagcaagaugagcaagccaggaaagaagccagugaguaacaucccuccauggccucugcaucagcuccugcuucaguuccaguccugacuuccuuuggugaugaacagcaguguggaaguguaagcugaauaaacccuuuccacccugacuaagacagugcccuacccagcuuuauccauuaggacaaauugaaggaugaaaugcuuuagaaagagacauucuauaugguaacacaauaaccuuuaaguucagagaacuuaaagugucuugucuuuucuaccaccuaugauucuuagaaaagcuaaucuaaacuaguaugguguguguuggaggcuggggguggggugggccagaguuucuaugucuuuuuuuugcucauaugauggaguaguuacugaaacugauuuuauuugcuugaugguagggcccaaguguucugacuaagacagcucaaccaggaucccaagucccugagauucauacucgguugguuucuuaggaguuugcauacuucuuucuuugguuuuucccuucucuucccccuuuccuuccuccuuccuucccccuuucccuuuuucacuuuuccuuuucuuucuggauucugcguagagauaguccaggauggccucuuuuucuuaccuuccuaaaaggaagagcuaaacuuuacaaaugauguguuaaugagauacagguuuugcguucucucucucucucugucccucucucucccucucccucccucucucucucaguuuaaauuacuaauaagcuuucauugcuuuuaaguccauuauuuacacagaggcaggcucugggauuuuaaaaauguaaaaccuguucuugauagugaagaauuuacaguggggguggaguacagugaaaauugugauuuuuaaguuuuacuaugacaguagugggauuugggaauugugaaggagucagguguucaccuucugguagacaggaagcugagagaacaguugagcuccugaaaagaaagcauuacauugaaaggcaugucucuagugacuuccuccagccuaucccaccuaaguuucugggaucuaagugaccacuuuucucucuggucuccaguguggucuaaagcuaguaucaucuccuuuagagacugcucuguagugccaucuaacccggacacaccguuacucuuucaauucuccuaucuccucuccuguuucuaucuggcugccagcuucgucuuuucagaauauaaaucaccucaccuucccuuugacucaacacucugguuuccuauugcuccugagauaaugaaaauucauaacauuuaguauagcuagacagaaauguccuuguaaucucuugaagagacaauaugacccuaauacuuguauaagaaaagaacacugauuuagacuuaaggugcaggcucuaguuuguguuguaugucuggugaacgauagccaguucccauauuuauuugcuuauaauuggcucauggagucugcaacuaaaggcagaaggcauuugcuuuguauuugcugcauuucucuuuccucuugcuacaaaaccccacaugugacaaaaaguggcacaagaaguaaagaccccaucacaguauuugaagugagaaaugugauuaggugugccuuuguguguguguguguguguguguguguguguguguguguauagagugguuuauccuuuguuuuguuuuucaaagcaggguuucucuguguagucuuggcugucuuggaacuuaaucuguagaccaggcuggccuuaaacucuuggaucagucuguuccugucuccaagugcuagaaucaaagguguguuccacaacugccggucccugauuuauccuuacuauccuacuguacacuuucuacucuuaauguguaaacggaaccuuuucacuuguaccuuuuacaacuagaggggucccuugcuauuuagagggagugguuggaguagccccuuggauaccaaaaauccauggauuccuuauauaaaauggcaagguaauugacauaaccugugaacaucuuuaugcuccaacuaucuguauuauacuuagauuaauuaauacaauggagaugcuauguaaauaguugcugcacuguuuguuguauaauacuguuuaggaaaaaugacaauaaacuuguacauauucaccguagaggugccuguuauaguccuguuacggugugagaaggaggugugggguagacagugcuccaaguguugggaauuggcuggggauauguggaauggcugggacuacagcagugugugcuuacccuucauuuauuguauugagugagcauaguacuaggacugaaacaaacucagguuuugcuguugguuuuuuucuaguuuuaguuuuuucccacuuaauauuuuuguuaagagguuugaacccauacaugugaagucuguggacauggggauaagguguauuaucauucaguuguacauugcuucuauaacaguguuuuaaaaaauguauucuauguauuuuauuugauuuuguauauauggguguuuugccuacauauuaugucugcaccacuugggcgccugaugccuauggaggccagauggugguguccaauccccuagaguuaaaagaguuuaauccccuugaguuaaaggaggauuugaacugccaugugggugcuggaaguuggcccugggucaucuggaagagcagccaaugcucuuaaucaccgagccaucucuccagccccuauuauagcuuuuuaauaauuaaaaacuuaaaaguuuuuacuucaaauaacuuuuaaauaaucaaaaacuuaguuuuuacucuaaaaaugugagcccuuauugcaguaaaaacuagcuugugguauaguauacauaauucccauaaugagaucacauauauguaaaccuucuacuauuuaagauuuacagauaaaaguauguguuuauaaauaaaaauauguuuuaaaagcugggcacaguggcacuugggaggcagaggcagguggaucuuugaguuugaggccagccuguuauggagugaguuccaggacagccagggcuacacugagaaacucugucuugaaaaacaaaaaaaccaaccaaacaaaaauuaaauaaaaucacucagugacacauuuccaggauuuaacuauacagaguacaugggcuuuucucuacaaauaucaacaguaaaaauguuuuguugauaucaguuugcuugggauuaaaagaucauauucaagcugguuagauaagugauuauaauaugaaaucauugcuuuuagaauaaucaugggccagacugggaagaaaucugagaagggaccgguuuguuggcggaagcguguaaaaucagaguacaugagacugagacagcucaagagguucagaagagcugaugaaguaaagguaauuucauaaaaaugcauauauaauugaaacgaauuccuucuacccccaaguuaaauagauuuacuucgaaaugguacauuuucagucaaggucauguuuacaguaaagucgacugagaccugaaagcgaugguucuugauuugucuuaguuaaaauuacaucaugacuguuuggugcugugcugggugccucuaaugccagcacuuggggagguagaagcagaaggacccgaaguucaagacuggacugaugagaggcucaucagguaaaagcacuugcuguuaaaucugaugaccugauuuugauccgugggaccuucaugguggaaggagagaaccaggccccacaaguccucugacagauagcuauagaagcgcuguaguauguaaugcacaggcacaugaaucaacaauguaauaaaaaauaagcucaagaucauccugggauacauggauucuuucucaaaaaaugaaaaaaaaucaugcucauuaaugguaacauuuaaauuaaggauuacucagccugcugggaaaucagucuuuucaguauaccuuugcagugcuuguauaaacucaggacugaaacacaaaggcauuuguuuuauggcuuuguguuucuaaagucauugugauuucugaaauacaaaguuaaacaaagagaggauggaaauaauuucuuguuucccuuuauuuacaagcaaguaggaguaauguuuuuguauuuauuauuagaguguggagaauuguaguaucuugugugaaucuguguacauuugaggacauggucaugguacuucuggugagucacuagauuuuaaccggcuuuaaagaugcuacauauuguaacaaugaacaauuucuccuuuguuuuuaaaagacuauguuuaguuccaaucgucagaaaauuuuggaaagaacugaaaccuuaaaccaagaguggaagcagcggaggauacagccugugcacaucaugacuucugugagcucauugcgcgggacuagggagguugguuaacacaguguugcaacaauucucaacacauuugcuuucuacuuauuguaauguuuauugcuuauugagaagaauucacagacuucaggaugucucucuuucauugcuacuuguuucaguguguaucaguggcagccuuaccacacuacaauaauuccuuuaacagcuugguguguuucaggguauauuuuggcuauuuaggcauacuagacuuaaaacaaacuuugagaucaaaucucuaaaaugcucagauuaguauuauuuagagccaggcuuucuaauucacaguugcuuuccucccugucuccuaaauaaaaauuagccauguuuaagaaauauuucuuuuuauauuuaugaucuaagaaaguuuuuuauuauccauuuuguuuaaagacugagaauuuuaaaaaauucaguguuccaagauugguguuuucuacaguuacauuuucugugugagggagaucuuagucaccaucagauaauuuauuuucaaagaaaggugaaaaauaaaauaaaauccucuaguaagggaagggagaaauguaauuaucaucucaaacaaaagucuuaugguagaguuuauuauuaaguaucgcaucaaaacauacugccagcaagaugguagagaauggcagagaucuaaauagaagagagcuacuuauuaggauucugguuugaacauuucuguuuaggugccuuuuuuuauauagaaagauaugauaaaggguguugaguguaaauucaaggaaaagcaagugauuuggaauuaagauuauacuaucauagauuauucaugaaugcauaaacauggagauaaccuuuuuauucuaaaguaauuauuucaacgagcauuuuaauauauaacaguauuauaauaaacaagccauaauuugcugucaccugaggcuuguggagguugugugacacacaggcuucaaaggcuucugugaugauucaguggcauuuucacagauaauacuauauacauggugacuuuggugauguucauggugauauggucuugguaagaauacaugauuuggaaaaguuccuaguucuuuauaguuuuuaggugacaagucuuuaaagucugacuuauaauuuuacaaauauuuguaauuucaaauucaugguuauaauagugaaacccccgaucuuuuaaaaauccuuauuuuauguauaugaguauuugucuacauguaugugaauggacuaugugcaugccuuguaucuaaagagaugagaagaagauauuagauuucccauaacuggaguuaugcauaguuauaagcuaccuuguaggugcuaggagcugaacucgguccucuauuagagcagcaaguacuuuuaaaguuuagucugcugucuuuuuaaacauuuugaguauuucauucaggaguacugucuuuacaugguuuccauuccuccuccccauucccucuuaaauucaggaguucuuuaauuauucccccauccacacacacacacacccugcugaguccauuuaaguugcuuguagauguauacguuuugaauauuuuaucuuaguaauuuugauaaagacuaaagaguucagauuuuguccuuguggagcuuuuuaagcauacuuccuuguuauugagguucagaaauaaucuuagcaaucuuggccacagaauuuuaauucagaauauauuuccuucuuuuuaaaagguuuuuauuuucaauucucugugugugugugugugugugugugugugugugugugacugugcauguaaguacagugccuggggaggcaacaagaggucaucagauagaucccuugaaguugaaguuacaggcuguuaugagccaccugacauggauccugggagcugaguuuaggucuucuguaagaaccauaaaggcuuuuaauaugcuugagccaucucuuuaauuccuuucucuguuuaaaaaaauauuucugacuugaagacagugauauauuaugcauucauuuucuuuggucuucaguuaaucuuuuaaagaauuacccaacaucaauaugucauuaagcaacacuaaagaauacauaccguauugcuaucauguggcuguuuaucagaauauaguuuccaagugacuugcuuugucuuaacaacuagaaaaacuugagaaccuucauuuuuuuuuagccguuuuuuucuagguuuagugaagaaauugguauuacccuugauguucuuaguguauuucuuguacaucugucaaucccccccccccacacacacacacacuaaaaacuauaagguguuuuuucuuuccuucaguaauuuguuguugcuuguuuugagauaggaucucaccauguagcucuagcuggccuggaacucacuauuguugaccagacuggcuucagagauccaucugcuucugagguuugagugcuggaauuaaaagugcaugguaccaugcuugcccugaauuauuuuuauguuaaaaaaaauuuuuuuuuaauaccgugaaugccuugcucagguaaugccuaaaugacaugauaacaacaugccagguauacuucuuguauaauaagauguauuuguaagcaucugugucuuaugaaaagagaauuuugguaaguauugaaguguagaguuguuugcaauagaaauagcauuagauguauauaaugauuuuuauauucaugaagaguuuuuaaacuuuuaauauguguaggcuugcucuuccuaguaauauuugaggugauuaaaauuauuugcuuauugauauuuacaagugauuaaaaaaauaaaguucuauuaaaauaauagaauauaaccauuuuugcuaaagaaaaaccuaggucuauuuuacauguaaauaaguacgugauugcauggcuuauugccuuguaaugcacauuacuuaggugagugucaagagaaaguucugguuacaauuuguaaagaaaaaaaauccuaguguagcuaaggugucaguauacucuauuccccaaacauugucauuuagcaacauuucaguccucugaaacauccguaaguucaauauaguagcagauuucuuguaauuuuugagaacucaaaguuuuaaaacuagugugguaguguaugcccuuagucccaacagucccuacagcucagccacgugacugaggcagucccugccccugcugcuucacugcucuggucucauacuuucucuauguuuccagugaagcuugaaccacugggcaaggaaagaccauuugagagaagcuuucauugggcuuaauguugcaauaacagggaagaaggcgcaggagaguaucuucuagcccacucacugagcuuuaauagccugcuggcauagcugaagaaaggcuguuuggaucagucucaugcauuuauuuuggaccaaucagccuugccucuuaacuaugacugguguuaauggagguuuguauaggguaccaguaguaucuagccuuguauuuagucacagucagaguagucccuuuggcuagaugacuugggaaagugaucccugucuggccuaggugaagcugguugcagugucaucuggacuucauccaggcuugugauggcaaaaaguuugauacuaucucaaaacagcccuggcugccuucagaagcgagggcugucagcuaugaucaugcugcagucauuuuaagauguccaaggugugacguagacaccuggugcuagcauuaagggguaaaucauuauagucaaggcagccaagaauuguccaacagcugagaauuaggaagucaaauuuucuuauuucuagcugucugcuucuuacaggaaauaaacaacuuaaugucauuuuuugaaagaaugcaccuuagauuuuuuuuacauuuuauuuauguauuuauuuauucauuuauuuuuguguguguaugugggcguuagcucuuuccaccaugcauacuaaggcaugguagcagguuugauuuuuacccucagaacaauccuacaggcccacuaauagugauuuuaaacauauguguaaucagugcuuaccaacugcugacugucccaggggaaacgggcccucucaucugucucccucccacuagcucuuuauggaaaugccuuuuuacacaggauauuguuagagugauagauacaaguuguguugcaguuugccuuaacucagugagcuugaguguuuugucugcauguguguuugcauaugugugccucguaccugagaaaucaagaagaggauggaauuggaguuacagagacuuguaagauaccaugugggugaugaaagcugaaacaaggucuucugcaagaacagucagugaucuuaaccaucuagagaucacuuuaggcuccauuauaaacuuccuaauuuccuuccuuccuuccuuccuuccuuccuuccuuccuuccuuccuuccuuccuuccuuccucccucccucccucccucccucccucccucccucccucccucccucccguguguguguguguguguguguguguguguguguguguguguguguguguaugcauacuauuggguguuuuaaaauuuuuauuuuauguuuauggguauuuugcuugcauauaugucuguucaucacuugugugccugguguccauggaggucagaagaggguguuggauacccuggucuggaguuuggauaguuguagaccaccaugcagguucugggaauuaaaccuggaauuaauccuuaaagaguagccagugcucuuaaccacugagccaucuuuccaccuucuuuuuguuuugaacuuauuuuggcauuuggcccaaguuagauugggguuuaguuuuuuuuauucuucacauuuucauguuaucucugauauauuugguuauacuuuaaauuuuuuauuuuuauguuccucaagggcuuagaaagucuucuggauuauaaaauacacaucuuuuaguuuucuguuuuugguuuuguagucuaugaacuaguuaacccauaggaauuuucauggcauaaacuguguggagguagggugaacuuuuuuuguuuagcugucuaguugcuucaauacuauguugacuagucagucaacaguaaagagcacuuaacuaucuguuggcaaaauuagcagaagcugcugacacuacaggaucuccugugccagaaucuaaauguagcucacucuaugguuaugacagccuugucuguguuuagucucuguugcucuguuucauucaguuuuugaaauagauuugcugccguaacuugcagauagugugaacucacauaauauuguguucgucauuuagucuuuccuuuuaguuguaguaacgguuuaguuuucuuuccaugacacuauuauugauguagauacguaagacugcacauacauaugccuuggugucccauugucuauccucugcccccuuccugcuuucuucucuucugaguguuuuaauuuaacacucuccacucccaccccccacuccccaccucccacccccaugauuuagauuuauguuuugagauaggguuucauagucugggcucaccuugaacccuugaaguccuuauuccccugucuaucaagugauaggacuauaggcaccugccaucacaccuagcuuuuugaguauuuuguaguuuaugucuuaguacuggcuuugugaucuccaguguuuuaacaaaacugguuuuuagcagaauagcauguaauuuuggguauauuuuacccuuauggccuagucagauugucuuggguuuuaucauaggauuaggaucauuguuuaugauccccaucauuuagggucaagcuucugaagaggaugcaaagaagaguguuaaggagccuaauuauauugguuaggguucucuagaggaacagaacuugaagaaugaaucagucuguuugucuauguaaagguacagagugauuauaaugacuuacaggcuaugguccagcuaguacagcaaugacuauccaccaacagaaggcccaagaaucuaguaguuguucaguccaggaggcugucuuaucuggucuuuaguauaugcuggagugcuaaagaaguaggcucucaugccagugaaagaauggacuugccagugagagcaagaauaaucaagcagagaacaagcuuccuucuuccauguauaggaagccagcagacgguauggccuagaucaaagaugaaucuuucuaccccaaagauccagauuagaagcaggucucccacuucagauaauuuacuuaugaaaaaaaauuucucauggguaggccuagccauuuggguuuuaguuaauuucaaguguagucaacuugacagccuagacuaauaaucauaaguccaucucuuaucaaccuggcacacaaucauaucuuuugauaucaugcuuaauuuccaaaugaaaacaauaaccaggucauauuuacacuuaacaugauauaacuaucuucuauacaaacacauuauaaacuuagaauagguggcaauguuccuugagggacauucuuuuaggaucucacacuuaaaaauaauguccacugguagucucuuaauugaugcuacauuucaugauaaauugaggaaagaaaacacaaauaucuuuauagucuaaacaaaaauauaucagaaacacuuacguaaauuauaauuauuauuauuuuuuaaaauuuauuuauuuauauguaaguacacuguagcuaucuucagacacuccagaagaggagucagaucucauuauggaugguugugagccaccaugugguugcugggauuugaacuccagaccuucggaagagcagucgggugcucuuacccacugagccaucucaccagcccguaaauuauaauucuuaucucuguaacugguuauguggccuuagcugacauuuauuuauucauuuguuuauauuuuuaauugauccuuuguaaauuucaagucauguaccccaaccccacccaucuuccuaucccuuuauaccuguccuccaucuuuguaacguccucaccaaaaggaaaaaaauagggaaacuguaguguaucaaagugugucccacaguacacccuuuugccuacccaucuuuacuugcaaauguucauugcaaugagucauuggucugguucaaggugucuggcuucugcuauauugugaauacuggauucuuacuaggaccucucucagauauccugguuuuguccugugucauggagauccuggagcuuuggaucuauaggaucaggcuuuuauuuuuuaaauauaaaaauuuauagcccaacugaccaaagguagaggaggaaaauggcuaauaggacaagggggacauggaccuguuuggaacaguuucuugggacuauuccaaucuucguugucuacagacaaguucacuagagaaacaucaaaugcacaucaaccaguggcucaguccagaagaaaccaccaggcucugccaauuggcaugagucugccgaagcuacaagaagcagccagaacaccaccagaaguucuuuggugcacuugucucuaugaagcacaacaagcgaagaucauggaagaaagcaaggcgcaccaaggcaauagcaucaucagcaaagaccagugucugggaagcccagugaagaccagcaaggagaaccaaugccagagugucguccacugucuguuggguuauauuuauacucuuucuaaaacauguguccucucaagugcccacuccagcaaaacaucacaugcccuuuuaccagauagcuuccagaaaaauaccacgugucugcuucagcaaaacauccucucacaugucugcuucagcaaaacauccucauaagacagcuuuuagaaaaacaucacuggacacacuugagucuccaacaaaggcagaaauuaccacuucaccagucccuucauucucucuggcaguucagagauggcguagauguugggcuugguuaacacaaagcccuggaucugggcauauaguugguggcugaacuggucaggcugccacuuagcugguauuuauaauuaccuuucucuguuacccauucuguguuuccuccauauucagcaagcaccuuaguggguuuuuccauggaccuuaaccacagucaguguuaacaccaagagaguguaguagcuccaagagaugcccugaaggaucucuccugcucuccagacauacucuuccuuaccucugucauggagaagcaauccaauuucuuuuuuuuagucugaaucagugaccccuccugacacuguuacuccuuucuuaaccuguugguuuaagggcaucagaagcucaaagaggccuaggggacgucugagcuuccagaucaaugggauguuuguuguggcucuuggcaagaauguuccccucucugaaaccagaauuccuagaccagcagaauuuaaggucaugggaacaagaagcaaacauuuuccuagugggucacuaggcaugauagugaguggaacuauucccuuuuccacuccuugguuucuagacacagggauccuugcucugggagaagauguaccauauguuggaugcugauucaaagcauauagcaucuucuagagaacaccugccccagccuuccaagggugcugacaacuaauuaguguuguaacuguguuuucauaagaccauuccaucuuucuuuugagccaacugcuucaggauaguagggaacaugguaagacuaguggauucuaugaucuuaggcucacuguuauacuucgcagguaugacaugagucccuuggccagauucaauacuguaugaaauaccaagaugguggcuauggcauucuguaaguccacagaugauaguuuuggaagaagcauuacacacaggaaagccaaauucacaaccaguauaaguaucuauuccacuagggacaaaguguuauuauuucuauggaagaugugguucaauguagucagucugcuaccagguuguuaacugguaucucagggaacagugccauaucugggccucaguauugguugcagaucuggcacuuagcagcagcuauagccaguucacgauuggugaauggcagucuguguuuucaagcucacguaucauccccaucucugccaccauggccucuuuguuuaugugcccauuggguagugacagagauggcuaggaaaagaggcuuuauccacuugauuauugagcuccuccagcugaagucaacuuuugaugaguauuuacaugggacaccaaguaucuucacauucuucacccauuuggagaaaucucucuacauacuuaguccccagauguuuuucuuaaaaucuuuuaaucaugguuuuuccaagucccugacuguucaaucaauucaaugucuacaaacaugaaucagugaauaaucacacauucuccuauucaaaacgccauguguacugccugaaguucugcccuuagugaagauuuccuuucacuggugacuuucaggguuguuccagaaagaaguugucaugcugcaacuguccacuucugguuggugcuugcauaauaugcagaacaucaguaaagcaggcccuagucuuuucuucucuuaguuagucauaugagguuauauauacacauguauguuugggagcagguagcauuguaacaggaauagaaaccuuaggcauuugaacaacuucuuggguaacuuguuugugcuuucaggaccugcucaggccugaucauauguauacuguuucuauuggauaauggauugcuacugugcauguucuauuucaugguauggucaguaagauaauaccuagcucgugaugggcagcuuggguugucuuguaacuuggugucacauugucaaauguucgguuuccaccaaaguccaagcaguccgagagcugucucucaaagggaggauacuugucucucagaugaugguagacccuugcuccaaagugucuucugugauucaccuauagaggccccaauuuuccaaacagcaucccuauuugccacugacaccucaaaguaucaucagcucugcuacaucauaugguccaaaugguaguguagucugcacacaacagccuggaccuguuaaagagccuuuuccuguuccaggccccacucaaagcuagcaguuuucugagucacuugguauauaggcuggacuaacacacccaagugucuccagaauccauauaggcucacuaaacauugugcuucuuucuuggugguggaaggggccagauacaauaacuuauucuuuaucuuagaaagaauaucucuuuaugucccauaagagugggcgucuaaguauuuuacugagguagaaggccuuugaauuuuggcugaauuuauuucccauucuuugauucacauguguuaccaacaaguugaaagugguugcuacuuccugcucauuugguccagucagcauaauguugccaauuuagugaaccauaugauacucugcaaaagagacagaugaucaagaucccuuagaaguaaguuaugacucaggguuggagaggugauagauucccucaaggaaaacuguaaagguauacugcuggucuugccaacugaaagccuauugcuucugcuggggcuuaggaacagacagguacugaaaaaguuaauuguuggaucaauagcuguaugccguauaccaggaaauguguuaaucugcucagauaaggacauugguacagcagcacaaucagaguuacuaccaguguaguuuuagauagucaacugucauucuucaugucugucugucuucugcacuggccagauaggggaguuggagggaauuguggugggaaccacuacuucuguuucuuuucaaguccuugauggugguacuaauuucugcagucuuccagggauacuguuuuugauuagcuguucucucuggcagaggcaacucuaauaaaagacuuccauuuacccuuucuaaccacaauagcccucacuacauaggucagggaaccagugggcauccugccagcuucuaagaauaucuauuucaauuauauaucugggacuggggaaauaaccaaaggaugaguucaggggauguacuguaccuacugugaguuggacuucagccaaaacuccauuaaccaccugaccuucauagggcccuacuuaauuggaaggcuacaaugcuucuuggggucucuuggaaccagugacaauucauaaccaguauccaguagauccugggaagucugauuguuuccuuuccuccaguguacaguuaacccugucaaaggcuguagggcccucugggaaaggacuugagaacgguuaacagugaaacuuuuggguauuuuaucaaggucuuucuucaggggaaccuggcaguccccucauucaaggcguuuugguuuggcaaacuggcucaagucuagaaauuggcuuaugggcugauuucuuuucccaugauccaauuauaggcuuucuuaguuugagaauuuuucugcuuauauggaucaaacaaaaaugcaauagguuuccuagaauguuucaugccuggaauaauaugauuagacaguaccaaagguccauaugagucauaccaccguaaaaaucagauuuucuguguuaccuauuaaagguuaggucauuauggacauaguuuuaucugugcugcccaaaccauaacuacagucacauugucuuuguugauucagugcugcuacuuagccccaugcgaccucaggguccaauuagacccacugaauuaaguucauucaacugaacagcagugcuucagacccuaggucugacacaaggaaaagggcuacaacaacaaagcucuucaaaugggcugguaccccucaccauuuuuggucuuacaggacuggugaaggucaugucuucugggacuucccaggaggauuaggucuuacacagcauacucuugagaaucugaggguucaauguucucagcuucaauaggguccuccuacauaucugcauaucaaguauaggauccuauucuuuaccaguaaugcccuuaauuuuaacacccucugaggcugggaccugaauuuuauuuguaauuuauucagucuuauuuauaaugggggcuuugguuugauuuucuguaacuugagcucuauggcugcuagagagaagaucucuuccagggcauacuuagaaaccuuuguugucagugguucucaaucuucuuaaaacugcggcucuuaauauacuuccucauguugugcuaaaccauaacuauaaaauuauugcauugcuacuucauaaguguaauugugcugcuguuaugaauuguaauguaaauaucugauauguaucugauaugugauuccccaaaggaguuacgacccacagguugaaagccacugcuuuagacuaaaccuacaguuggucaguuuuauuuuuauugcugaguucauuggugaguucacuaaauucugagaugauagaaguugauuaauuuuaucgugaagcucauucuuucccauugucaguuuaucuagugaugcuaaggucaacugaccagugucauccuuuuccuuauuuuuccacaaauuguccaaaguuuuauauacagagucaccaaauccauugccucucacauuuggugaaucaggauaaucaaauguauuugucuccuuaauuuguaaaauaguacacauaaugggcuuucaucauucaggacucucugagcuuacaugaaaggcuucaguaacuaguauugacaaagugagaugccuauuuuagaaagauacuuaguuucauccuuauauuuuuguugcucuagaaccacuucuaguaccaaaaucugucagaguucucuagaacucgauggauggauggauggauggauggauggauggauggauggaugguuccauccauccaggagauuuauuagaauguuuuacaggcugugguccagcuauuccaacaauggcuauuuacaaauggaagguacaagaaucuagaaguuguuaagucauugaagccugauguuuuagcuggucauuaguguaugccugaaucccgaagaaguaugcucuaaugccagugaaggacucaagauccagggcaagcaggcagagaacaaguucccuucuuccauguccuuuauauaggcuuccagcagaagauguuuauuuagauuaaagguagaucuuccuucucaaaagauuuggguaaagauguaucugucuucacacccugaaggucagggugagaagugggucuucucacuugaaaugauuuaauaaagaaaaaaaucucucacaggcauaccuagcccuuuggguuuuaguuaauucuacauguagugaaguuuacaacuaagauuagauuaggcaucacacuaguccuccugaaaagcuacauauaaucucauuacucaggaagccaaggcaguaggauuguuguaagauugaagccagucuggucucaauagaaaauucccugccagccagggcuacacagagagacucuaccucaaagcaaaauaacaacaaaaauacuccccucccucagcaugcauacacagacacagacacagacacagacacagacacagacacacacacacacacacacacacacacacacacacacacacacacacagaaaugcuuguacauuucugcuaggaagaagugugaaagugauauuagaugaaagugaaauccaagauaauagccuuuuguuacaagggagacuccaguauguaaugguuuuuugacauaaauguguaauaucaaaaauggaagcaguuuacaaucuggaauagauuuauuccuaguuuauucccuagguuucauuaaauacuugcgugaagauguuaggcccauucuuguuuuuauuucugacccucuugugagagacacuuuuucucaagaguguccccuucagucuucuuccucugcccuucaaacugguuaugaaaccauguuugcuguugagcuuccucaauacaugcugcuuaacucauuccuuuuuuuuuccuucuugcuucaccaaaaagcggucuugaauuuaaguauguauauugcccuuaccauaaggccuagcuaauuaaaaacuuggauuuuguucccuuucuuuccuuaaguccugaggaaaaaguaagguagucucggaaguagucuucagcuucccuuugagguugaugacagcugaugucuccuccucacucuccccugggcugaugcuucccugaguugacaguagcugaugccuuucacucacagucucuucccgggcuauggcuuucuguuucuucuuuguucucauauggagaaauaggaaauaggaguauguuugaaaauaaugacaguucauggugucucagugugaacuaacugaaugagccagugaguauucaagaauguaugaucacaccacccaggagcuggugugauauaacucccguggacuuuuuugaagcuggguuuaacugccuucaugcuaaggaucauucagaggugggguggcuguuacuauuguccuuugggauguccugccuaaaauggggaauauuuaccucauaagguaguagagaauuuuaaagucaacuuugguaaagucucuaacauggugcuuggcacauaguaggguguguuaauuuuucucccuucccugcaggccacucaccugcucucccuguacgauuuuccauagcacaguuuuuacuuggaaccagucuucugccaagagucucaguuugguuguguacuccuacaacuacuacuuuugacuuggcuuccucuccagccacacagucgccuguuguaccagcuggguggugugaguccccagccucagaggaagcuuguuacuuuccagucagcuguguuucucugacagugugccguccuugguaacuugguuuucuuuaccacuguuaaauuaucugugauccugaaauuggaauuagaauuagaaauuuaaguugcuaaaguaggccaccuagagguauaacugagcgggcaaaaaugcucuggugaggucaacaacagcuuuugcacuguuuugagcaauaugaguauuuaaagaguugagagcgaaacacguucaaaggaaguaaaguugcuaaguaacugggaguuuuguauaauuuucuguaagucaacacauagcauucccaacuuguuuuaccugcauuggcuguggcauuucaguaucauuucacaagugaggacgguaugguuguagcauggcuagagacugugugggguaggauccagaggugcugcagagagcucagcuucauucuccacauagguguccucagcucggaaggaacugaacuuucugccacaaacauagucuguugacaccauaaacauauguuuuaagacacugcugaauauuguuuugagguagaaagguaaaaauccuaccuuucaccucagaugcucuuccccuuacagagcuugcguuucaucccuuguugacuuguggaugacucagaacuuugaagugguggauaucagaaaugggguggagauauuagacugggggugucauuugugcuauagcccgugacuuccuguuuucugugcuucugugaguuuccagcuuucauuuaguauauauugauucugcaaaucagucauccccuuagcuagugguugaaaagaauauuuucugucugacuuacacaugaccuuggauucauauacuaacacagguaagucagggcuggagaaccagucugucccucuaagcuauaaagacagcuucuauguagaauuaauuuauucccaccaaauauaaaacaaaaguuaauaacuuuuuuaagaaaugaaaauuguuuuauauuuaagauuauuggauaauaugugaugcuuuauugaguaauuaaaaucauuucauacuuaaauuuaccuagucagguugaaggaaaggaaaaugugcuagggauagaguaagaggagaguuguuggugauaacccugugaccuuacuggguguggucacauuccacauagcagauacuauaaggcucuauagugacucuucccugugagcuucugagagcaagaacuaaagcacaguaaacugaggaaguucuuggauguuacaauuagacuuaguuuuuaguccugccuucuaaguuaacuaucuuccuaggaagauuuaauuucuggccuccagucccauuuguggauugugauguuaaaguuaugucauaaggugauaacaagaacuacuuaugauuaugaauauaagcaguuacuuagcauggugauugaaacacagcauguaaucaauaaauguugguuccuguaguuauuggacuagcaaauggagggaugaggaucugugagugaagccaguuaguaggaaagagaacauuaauaagccauucacaccuuauuuacuugacuuugagcuuuugguauuguuauuuuuccuuugccuuguuggaaaacaccuaaguagacaucacuaucuuuguucuuuggaacaacuuugucugucacuuucacuucuguuaggaaggagucaucuuugugugcagugugcacugugauggucagaguacccgagcagcuauguagaacugaaggcuuauaguaucugcuauguggaaugugaccacacaugagggacacaugaguacacauguaggcuuauguggccugugugcgaguaaucucaccucauccagucccagucuugcugacuuggaaacacccuacauaaaucucagacacugacucuguauaucguguguacauaugugacugccaugaguucaauuuauuuuguucuauuuuuauuaaagaucaucaguacauaucugagguauuuuugagacagccauggaggcuugacauuugagaauagaacucuuaagaaaagcuggauuccucaucaggauagaaagcaaugugguuaucagggcacgaauuuuuaccacauuagaaucaaaguugcaaaaauguuaacaauuuuuaaccaacauuuuuuuguuuaagucacugugguaagaaggcauuaugucacaguguaauuagcaguuuuuuccucugugauacaggaagaauagugugcccugaagucugauagagugccucaguugugagacagaauuccugugagauuacaguuggguagucugucuugccuugggcuaacaguuucaggaaggagagauuacaggagugaccaaggcuacagcaauuuccucacucaagccucauagcccacagcuaccuuugcccccuggcagagccugcaguuucuuccucuagagagaagcuguuccucgauauaugcauuaauuaacacaguucugucuguugguggaggucaaauucugucucuuuuugaggccccagaaauuuagcauuaaaucauuauuaugauaaauaauacaaaaugaauuuuaagggaaagaagguguguuauagagaugaaguaucauggcacugggucagagcagugagcagaaucaggcuugcuguguauauuccauguaugaucuugagcaaacuccuuguccuuucuuuacuguaguuuuuucauugcaaagugggguaagugccuucaacuagagucauaauaacuaugauaaaacauuuacugugcuuaauauagugccuuacaugugaacaguuagaugcuauaaagcugauuaaaauguuuuugcaauugaaacucaucuguuacucuuaauccauuauuugauaauauauaaaauaugacauuuuuaaaaagcaagagaaaagauaagguuuagauauaccauagugauaucugccuguaaucuuagcauucacagcaucuuuuaggcugaggcaggagaauugugaauuugaggacauccuggucuacagauuaaauucaauaacaggaccccaucucaacaaacaaagaaauaagaucaauguaauucauaaucuuaggacacauuugguauauauaauauauucuaaucuaugugcuugagugaucagaauuaaaaauaaacucaaguguuuagagaaaacgugcuacagaucaggcuucugaggcuaauaugaauauaguuuuugauuuuuaacuguuacugguaaguaugagaaaggcuggaggggauuaaaagcuugcaaaagauggagaaugucuaaggagacaccuuagagaaaagaggauucuuuuuggauuuuaugaaccuuugcaucauaaaaauuauauccagaguuacagcaucuguucacaguaugaugaccaaccauagcuuaagguugaucuuuugauuuguaagaggaaguuuuuauuauuuguguucuguuuuaguguucagucaccagugacuuggauuuuccagcacaagucaucccguuaaagacccugaaugcagucgccucggugccuauaauguacucuuggucgcccuuacaacagaauuuuaugguauguaaguaauguagcuuuugcuuguucugcucucaaaugucagccuccauggcugucucaaaaacaccucagacauguguuagaucuuuaacuaauaaaaauagaacaaaauaaauugaacccauagcagucacauauguauacucugaaccugaacaauauauauguuaaacucuacauuuuccuuuuauuacucacacuuugcuuuugucucaauacuuguuucuuucuuuauuuaaauuuuugauaacaaacucaaaauuugcugacuagugaugauuugaaauaauuuaaucuuccuauuucuuaguugccugauggccaccuauguguuucauggcuuuuucuaguguguccuuuccuguugauuguuaucauagucugauccaaggcuuguaauacuugaaauguugucuuuguccuccagugagucuuugucauuauguucuguuuuucauaguuaauguucuaaaacguuucuaaaacauuuaaccaaugccuuguucaagggcuuuuucgauuaagccugcccuaacuuagguuuuuggacacaugcuucaggaccaucuagucuuuuguauuguuacugucauguacuugguuguauaguuuucuuccuuagaugauugguuuuuguccuuuguguucucagauauucuagucucucuacauuuucuuugauuggcuuuucccaguugguugucacgcuuugauguagauuugccugucuuguucacuagcauaaucagcuuugauguaugacuuguucaccaaauuacugaaauaguuucuguugcuguagaguauuuugauuuuacaaguauaaauccuuuuggcauagaaugauaagaccauugauagucuuuuauauuaguaucaguuuuuuuuccccuuguugugauaaaucaccaagaccaaggcaacuuauagaaggaagaguuuauuugggcuuaugguuccagggggauaagaauuaccauggcagccagaggcgugguggcuggaggagcaugaagcuaagaaucccauuguaacugaaucacuaaacagaguggggaguuggggaugcugacuugagugagccauggaaucuucaaauguuauccagugacauacuuccccaagcaagguuguacuugcuaaaccuucuaaacggugcuaccaacuaggaaccaacuguucaaauacauaagccuauagaggguguuucucauucagaucuccagaguaucacuagauucuuauuguaucaaauauuuuaauuguuagaucaccaaauaaaguuuuuuacaaacucuuuguugaugaguauuuguaguuuauuuggauaagccacauaucaucgguucuauuacagguaccuuccauuuuaguaucugcaaucggaaugucuuacacuugaggucucauguaaccugcagcaguuuccuuucuuagauuaaguguaguuacaguuuucucuacagaucuggauaaagacaaguacucauggaaaauacugguuuuaguuaucucauuaacuuuuuuugugugguaccaggaauuaaacucaguguuuagaaugcugggcaaguguaucacauuuaagucucacaccgagggcuuaaguuuuaaguuuuauguguauguguccuauguaacucuacacacacacacacacacacacacacacacacacacacacacacacacacacacacacguauguauguauguguuuguguuuaucaugacaaauuauaggggucagaggacagcauguggggaguuaguucucugccuaccacaugggucccagggauugaguucugguugucaagcauggucuuuaccugcugagccaucucucgggccuucaaguuuuaaauaaaugcuuaaagucuaguuuaaaaauuagaauacaucugguuuuaacuuuucuuucuuucuuccuuucuuuuucucuuuuuccuucuuucucucucucucucucucucucccucucucucucgcccucucucucucucucucucucucucucucagguggaagacgaaacuguuuuacauaacauuccuuauaugggggaugaaguucuggaucaggauggcacuuucauugaagaacuaauaaaaaauuaugauggaaaagugcauggugacagaggugagcuauguguauauucucuuuaguugagggucugaggguuuucuuguugccaugacaguggcagcucuuaaaaaggaaagcauuugauuggggcuugcuaacuguugagauguuuauuuaguccagccgggcgguguuggcgcacgccuuuaaucccagcacucaggaggcagaggcaggcggauuucugaauucaaggccagccuggucuacaaagugaguuccaggacagccagggcuauacagagaaacccugucuugaaaaaacaaaaacaaaacaaaacaaaaaaaaccaaaaaaaccccccccaaaaaaguuuaguccauuaucaucguggcaguaagcgugguggcccgcaggcaaguauggugcuggagaaggagccuagaguucuauaucuggauggcagacagcaggaagagagaguuacacuuaaucaauaaaaauuuucuggggugucgcugugccccccuuuaauccuuaauaucuauuggagguuucugccucauuuuuguucauguaauucccaaguaauugacacagaaacaguucauauuuauuuacaggcuguaauccuauauuuggcagauucugagcucuucuauauacaaacgacaggccccguguacuuuaguuugcauuuuacucaacuugcucuguaccauguguguccucaggaccagcuucucucucaucuuuuccuucuuccuccgggucucucuagaaaucuuucuugguuauaaguccuaccuuuucuaugcccagucauaaacccagccauuuauugaucaaucaguuauuauuggggaguauucuuugcaguaccuguguuacugcaaugccccaagaucagguuguagucuggaccagggcauagaacucagguucugaauccacaggucacaaggcuaaccccaacagccacugggucuggcuuaagcaccuaagaccucaaagccugccuccacugacacacuuccuuuagcaaggcuacaccuaccccaacgcuaccacacuuccuaaucaugccacucccugugggcccauaacaucauuuucauucagacugucauagaaggguuucuuaauagaguucauaaaaaaucuuaagagcuagucugggcuuaaaggcauacauuuuuaguauuucuuuaguuuuuccauuugaggaucuuauuugccacuugguaaucaucaguaacugguuauaaacuacagcagaaacaacacauagauuuuauaggaauagaguguguguuuuuugguaagcuuucaauaguaaaacuaaguuuaaagaucuguuuauggggcaugugcuucagaaaggcuuucuacucaacaaugccuuccucagggcagccagagcccgugaaauuaaguuaacagaauccuggauucagguuucugaacaggaggcucucuugauaucugagcaaacggagauguggucauaucauaaugcaaaacagguuugaaguggucagucagugacacagauugggaggaagcuaaaacuacagguccuuauggauuaagggaguaauauacccuggaucagcuggagaggguugauuccugagaaagcaacagauguugaagguaaaugcuguuuucuuugcuggcugugaaauugaucuugacuauccuuaccugccccuuagguuacagugcugauaggccuucacuauucuuccagauuagaaaacauauacauaaucuugucauuaucuuuuucccucuguuucugacauuuggcuuuuagaauguggauuuauaaaugaugaaauuuuuguggaguugguaaaugcucuuggucaauauaaugaugaugaugaugacgaugauggagaugauccagaugaaagagaagaaaaacagaaagaucuagaggauaaucgagaugguauguuuaauacuaguuuuuuguuucagcuuuauauaauucuuuuaaaaaaaaccuaucaggcugguaagaugacucgguggguaaaggugcuuaccaccaagcuugauaaaucgaguuugaucccuggagcccacucuauagaagaaaagaacugacucugcugaguugccccugaucuucacaucaguacacgguggcauacauacaccaucuaauuaauacauguaaauaauguaaaagccacccauguauggguauaauuaaacuacccccuuuuuguuaaguguaugaucaaauauauuuucugcagcauuucauucuccacuagagcuucuuuguuuccuuugccuaggaaaaggacauaauccuuuuuugcacuuugcugaucaauuaucauaauuaucuuuauaauaauaucauguaucuuauauaaguuguauacuaauauacuuauauaccagcuuauccuuccacagcuuuacaauguauauauuauuaucagcuccauuauauauuggaaauggguuuagggagguuaaaggcuaagaaacuuaagauagcuauauugggaaaaaguagaaucugagccccaaguugaugaccuaggucugaccugagagcugugcuauugucucuacacuuguuaguuguugcuagaaagcagucuaccccaaauaguagagaguccauaaugcugucuuguauuuagcaagcuuacuguuaagacagcauagcagaguuugggggggggggugggaggaauugcaucaaaagacauguauucuuuauaacagaaacacaccuuaggagucaauaagugauugcuaaguucuuccaugugauggacagaucugaaaguggauuaauggucagcucugacacaaagcuauuaguuucaaauaauccaaauuugggggaucugucuuccuguacucuuaacaucucauacuugaauuuuauauuugucuuucuaguauuugacaggcuuuuccauuagaaguaaguaauacaggguuuggugacaccuguaaucucagugcuugaaagugaaagcuggagagucagaaguucaaggucauccuuagcuacauaacgaguuuuaugccaucuugggcuaaacuaggcaaaccuccccccaagccaguguuagugcgucauccuggucauacuagcacuugggagucagagacaauaagacagaaaaguuggcuaccgagauggaucaguggauaagagugcuugcugagcaagucuugaccugauuucaauuucuuaguuccaaagaggaaggagagcacugacucgcaaaaguucuuuccugacccucacacgugcacacuggugugcacaccaugugucuucacucaggugcacaugagcacacauacauguacauacaaaaauaauaauaaaguaaucaucagaggcuggaagucaagcuggucuacuuaguugcaggccaauuaagacuacgcagucucaaagauuacucccuucccaacagccccccaaaagugaaccaaaggggacaaguucuuagaaaaucagcuuuguugagaugcugugauacagagaaaaugaaauugaaacuuguuucuuccaucucuucccuuaucacaauucacuguuuagauaaagaaacuugcccaccucggaaauuuccugcugauaaaauauuugaagccauuuccucaauguuuccagauaagggcaccgcagaagaacugaaagaaaaguaagauuuuuuucuuuuuaauuugguacagucgugaaucuuaucaucuuggcuuauuauuuuaaguauucucucucucucucacacacacacacacauauacacacuuguacuguauauuaggaaauuuuuaguucauauugaguauauauaugagaauucaugcauguuauuugucuguguacaguuuauacuaguauauucuggacgcuggaagagauuuuuauaguuuauccaaacuaauguuaauagccucuucugcaguguaccucaguuguauuaaugagcuugauucuuguuuccuaugcauaauacaugauugauucuuagugucagcaaagauuauuguagguuggauauuuuucauugaguuuuagauaagauaaacuuuuaagaaaaaucaaacccuuggaaaccuuuuagaaacuuucaagaaagugauuuuucuuuguguuuuacuuauauuguuuguuuguuugucugaugucagauauaaagaacucacggagcagcagcucccaggugcucugccuccugaauguacuccaaacaucgauggaccaaaugccaaaucuguucagagggagcaaagcuugcauucauuucauacgcucuucugucgacgauguuuuaaguaugacugcuuccuacaucguaagugcaguuauuguacguuuucauuuucuaucuuuguuguugaaaucuguaguaaagcaacuugcugucaguuaccacaaccaaaauguaccggccaaucuuagagugaggauugagaaauaugucacgucccuguacugagacuuuuacauucugaggauuccucugacaucuuuuguacacauuuuauuccauucgcugcuucccauuaacuugaagcucagugacucuuuacaaggcuguuuuaugaugaaguuauuacagugaaggagcgcagagcaguauuacagauauuuaugaacaaauuuuguuaaguuaaugaauuggugaaaaggcauuuacacaaacaauuacuugccuaguguuaaaauauuuuuguuucauuuugauccuucaaauaauuguuuuauaaguacuucauauuucaaaacaagcaaacauaaaauauccuuaaugucaguaugaaaacuaauuuuuuuccuuuggcauuucuagaaaaugagguuucuugguaaaauuuccagguaacuggaauuuguuuuguguuuuuugaaauagugucucauacuccguauguagcugaggcuagccuugaacuguugauuuucaugauccuuuugauucuccugccucaacuucuugagcucuaaaauuacaggagcauaccaccauaucccacuaaaguuggaauucucuacaggcugguguguggguuuguuuguuuucuguaguguuagagauugaacccagggccuugccucugcugggcacacacuagacuauauagccacagccccaucccugcacacucucccauuaagacacacccccaucccugaacacucuaaaauacaucccauauacucccaguaagccacauccccauuccuaaaauuugcagugaauaaauaguaucagucauuccaccccccaacccuccaacccccauccccccacuccgguuucuuugucuauaaccuuggcuuuccuggaacaagcucuguagaccaauggccucaaacucugccucugccuccagagugcugggauuaaaugcaugugccgcaaacacccagcagcacgugauauagauuucccauuaggccuagacauucuucagucuccuauucucugcacguugaccaguugugggucuuuauauuaaucaccauguacugcaaauagaagcuucucuuguaacgauuaagaaaugcauuaacuuguggguauaaugguguuauuagcaauugauuuaauacuaugucuauuuagcggaauaauacuauuaggcucucuccaucccuaggguccauccaugccuugucuagcuacagauucuuggcucaacaaugaugccagauauagguaucaucuuguagagugggacuuaaauccaaucagaaagugguugucuacucucaugauguucaugguacuacugcagcagugcagaucuugccaggccaguuuuuuuuuuuacuucaucuugcaucauucacagcuaggaagguaggaaggcuaguuagugauuucuuuucucccucauuagugugcauagcaccuuucagcacuaggaaugcuagcugauagggaugaaguauucaguucagugccagccugauaccuucauguucuaugacccaaguaugugaugucuucaguaagaggucuuaucaauagcauuggcaaaagcuuauaauguuugggggccuaugggaucucacuggucaacaacuccaaaagagguaacguauucccagcacuuggcuuuugauuuguaaaccuguggguuuucuagaggcauuguugccacauuauagaguaacucuagauuaauucugugugagguguuuuuuggguguguggugggggcuuuuaugguaauagguaggcuuccauaugacauuugaaagguucuguuugucauuuauccuucucugccuuauuuguugagcuaagaucuuacagugaacugggagcucagcuuuuugcguagguugaugggacagugagcuucugggaaccuccccaucucugcuucccuucugcucuuggaugccuccuaccacacucuguuuuacagaggugugaggaucagaggucagguccuccugccuaugugaacacuuuccuuacugaaguaauuccccaccccgagauaaguucccuugaaaugaauuauuuaaaguuuguucaauaaaacguccuuaaguauaguuuaauuuuuuaaaaagaaaucacauggcuuccaccaccuuuaagacuauaaagcuccccuccccacauacacuuucuaagcuuuucuuuaauuuauuuguuuuggagguugaaggauaugcuugcuguggugcucuuguggaggucaggacaaguuuccacagucuagguauuaaacucagguggagaaacuugauggcuagcgccuuuccugguauccugggagccuccccaucacaccuacuucucgguuuuaaaaaacacauauacuuguguaucuuccuguuuagaacuuauuaugguaugaacauggaucuaacuuuuccucauucacaaaguuaucuaaaugucuuaguaucauuuauggaguucaaaucauucccugcuuugagauaucguacuucuuucauugcuuauuaucaauguauuuauuuauucacggagccagcaucccagcuccuaggucuguuucuuaguuuuagguaucuuuucucugucuuugggccuuuauuaaugacauugguugagugauugacuuugucugugggcauacauguaggcauaugugugccauggugugaauguagaagucaacuuguugaaguuggauaugugguguuacuauauauacauaauuuuacauuauuucugcagaggcaagaugauugccagucuaggcuuauguagcaaaacuuuguauguaugcaaaaacuguuggauaugguggcucacaccuuuaaucccagcauuugggaggcagaggcagguguaucucugaguugaaggccagcuaguguauagagugacuuucaggauagccaggccauacaacacagagaauuccugucucaacaaacaaacaaacaaacaaacaaacaaaacaacaacaacaaaaccuuaaaccaaaacaacaaaccccacaaccguuguuuaaaaaagguaugauuguuaaaauguuuuuuuugugaggagacagcuugggauuuuagcucagugcuugagccuuugcugagcuaggcccaggauuggaucucuuguacuuaaauggagaagauaaagaguggagccuuuaugaaaaaggccuuuuuaaaaccaccaaaacccuacauaguucugugaauaucaccuauuuuuuagccaaauuaaggucauuuucccauuguauaauuuugaauaguuagguuuuuuuguuguuguuguuugguuuuuuuggggagaggggguuugagacaggguuucucuguguaucccuggcuguccuggaacucacucuguagaccaggcuggccucgaacucggaaauccgccugccucugccucucgugcugggauuaaaggcgugcaccaccacgcccgacuugaauaguuaguuuuaagcauugacuuuuuccauugugugagaaaacaacugguuaacacacccuagaauugaguuccagauauugaagcuucuuuguucuagaaauuuuauaagcagaaccauuuucuaguucauguuuaguaaguugauccuucagcuagaaaucaaguaauuaugucagagcuggauguggugauacacaucuauaauuguaguucucagggggcaaggcuagaguauugcuaugaguuuaaagccagccugggaaagauaccacccuucuaucucaccccuccuccccacccccacccccaaaguucaaaaaccaaaaacauaaaaagccucccuagacagggaaauuguagaugccagaauauuuuuguaaaauuagaaagucuguuguguuuuuuuuuuuuccaauauuuuucacuuguuggagauacuaaagacucaaguaaaugucuauagucauacuuuauucccauagaucauacuugcauagggaaaauaagaauuaugaaucauuccagaguuuaccaugucgucaccuuucuuggagguuggaggcagaguggaggguacccugugagagaugggggaagcuguagaaaguaaacuacauaugugggagauacuggauuuuccaauggcucuggggaaaugaaaaaguaaacuuuuuauagccauauucagguacuuugugcuuauuuuacagccuuccaugcaacacccaacacauauaagaggaagaacacagaaacagcuuuggacaacaagccuuguggaccacaguguuaccagcaucuggugagauucagugcuuuguuacucuggagggcucuuaagaauuuugguggaggugguaaagccagcaguaaugcugucuggauucauauuuacauuggccauaugacaggcaguguucuuauccuuguuucuuucagagcuguguccugcacaguguagucuauuaaucuuguauuacucucuguuuaucuguguuauuucuucagcaacguuucacgguucuuaggaucaaagacucuccacaaaguuuaagagaguaugagguacagauagcccacuuaaacaccagaaacuuguagucuuaugcagacguucuuaagucuuaucauggacguaucccuucugugaaugcuuuaggccacuuauaguuuaagguguaccauagguccuaaacagguuuucuuuuuuuaagugauggugauuaggaguaagggauuaggaaaauaugaggcaggaaaguuguuuuuuuacggguacuaucuuauuuuuuaccauuuccccucuuugaaccaagccacuccuaccuaggaacuaaguggguauauauugccuguuggauuuuggacagaagauucaaugaauggcaccuacagaagguauccuauuuuuaagcaauuugguuuuuguagagugaaguauaaaacuguuggcuccuuucaaacuuugcucuuugcuccacuaaaaaaauaaaaauaaaaauaaaaauaaaggaauuccugagcacuguuuuauauucuuuauaaggcagaacuuuauuggcucaucuaaaauguuucuguggucucuuauaaaccaugcucuaaccauuguuuuauacuuucugagauuggauugugguacuuccgaaugcaaaauguaacccuaaucuuguaccucaaaguucuuucauaucuuccuguggcuuugcauccuucacaggaaaaaauaauuggauguuuuaauaguaagaucagaagugacuaagucaugcauguauauguuuuguguucuuguuuucuuuaaauaguaccuuuaaagagguauguauuauuuuaagccuugaaauaggaagucugacuuaauacacuucaauaugucuuuugauauucucuuuuaaacguacuguauguauauguagagaaaaauaccuuuauuuuuugaaauauauuuucauuuacuauauuuuaauuuaauuuuacaaacucaccauguagaacugucuugccugauuuugcaucauuggaacaaaauauugaaucuauuuuuauauuuuuggaaucuugaaaguaucaaaagcagauggaaaauagauagguguguugcuaucuaaugacugauaauggacacuguguagagucuugagcaacuuguguuaugcaaugucgucuuacucuauuccaccaaaauauuuagaacuuuacucugaugccucuauuuuucauuuuacaggagggagcuaaggaguuugcugcugcucuuacugcugagcguauaaagacaccaccuaaacgcccagggggccgcagaagaggaagacuuccgaauaacaguagcagacccagcacccccaccaucagugugcuggagucaaaggauacagacagugacagagaagcagggacugaaacugggggagagaacaaugauaaagaagaagaagagaaaaaagaugagacguccagcuccucugguaagacauaucuuacagcuggguuguuggguuauuauugcuuuguaaguuuaccuuucuaaggguuaagacuaucuaauguguguagguacagaaagcugggguuagaggcaggugugagcugccaggcacgagugcugggaaccaaucucagguucucuguaugagcagggugcuccgaguguucucuccaggacccuugccuuucuccccuuuuguggcuaagauuggagaguucucucaguaaggcauagcugaauuguuugugcugucucccaagugcaccuucuguuauucucaucugucuggguugcuggaagcucugauccaauuguucuugcuguuuguacccucuuccccuguuccaucuuucuuugauggaggaugauggaacuaagaaaguucuguuuuaaucuuaaagaccaaugaauaguuucaguuagaaagaaaacaaguacuacugcugaguuuauauuuuauugguugaauuuuaguucuuucaacucuaaacaauaccauaaaagauaauauuuguguguauuugauaagucugauaaagggagcagaacuucuggguucuuuggcaagugugauaggaucuuugugauguugauucuaaccuuacuaauucuaaaauacaauuaagugccuucugcuuuuccuuagccuaccuugaauuuuacuuguucguauugaucagucgucuuugcauaugugucaguauacacacauaugccauugguguacauaugaaugucaaagaauaacauccugaguauggguccuuaccuguccaucuuguuugagacaagaccuuuugguuauuucuccauuacauauacuagacuaguuggccugugaucuucuggagagucuccugucucugucucugauuuccuuguaggagcacugggauaacaugcuuauacuaugugucugauuuuuaugugguugagaaaaccugcccucugguccucaugcuugcaugauaagagcuuugacccagugaaccaucuccccagucccuuugucauuucuugacuaguguuaacauuugguuuucuagaagcaaauucucggugucaaacaccaauaaagaugaagccaaauauugaaccuccugagaauguggaguggaguggugcugaagccuccauguuuagaguccucauugguacuuacuacgauaacuuuugugccauugcuaggcuaauugggaccaaaacauguagacagguaagcauauguuuucagagguuuaaacacaggaauaacaugugcucauuauccagacauagagaaucuugauuucauucuguucaucuucugaaaagaauuaauuuccccuccucuuaagaaaauuaaaucaguauuauucuuuagccguguuucagaaauucuuuaguuuagaauucaauuugggugugauacauguacauagagugaacuuuggccagacuuuaaauauagcuacauucccaaugugauggaacaauagugauuucuacuguguaccuugcccuacuccauauacuggcagugugaugggagagacaaaaacauuucuccaguuugcaaaagcauggaauguuuccauuaaaccacaguguccuuauuacucugccucucauguagguguaugaguuuagagucaaggaguccaguaucauagcaccuguucccacugaggauguagacacuccuccaagaaagaagaaaaggaaacaucggugagucugcuggggagcccuuagagaagcagugaggcaggaucugcaggcagggcuuuccuaagaacaucagucaguuuucacuugaauaaugauauaaaagguucuaaacagcuguuauagauguauagaaaucucauuucucccuuauggcugcuguuaguuuuuauauacagccacuucaguauaguugacauaucaagucauagaaauuuuguuuuaccaaccacauuggauuuggauugagaaaaacauacugcaguaaagcuacagaaauguuucuuuuugguguggauauaagaugugcuucugcugugcucccugggccaguguuuagcuguggcuuuuagucuaggagucuggauuuucuaagcaugugccauuacauucugauauuugaagugagccuccuucaagucuggauauuaccucucacaaagacuuauagugaauaacuguacaggacccuccuaccucaacccacuguguuuuaaaaugagaaguguaguuaaguggguaaggaugcaguuagauuaugcuccaaaaauuuuguauaggcacauugaaugugcugaaguacuuuuuuuuuuguauuagauauuuucuuuauauacauuucaaaugcuaucccgaaaguucccuauacccucuccccacccugcuccccuacccacccacucccacuucuuggcccugguguuccccuguacuggggcauauaagguuuguaauaccaaggggccucucuucccagugauggccgacuaggccaucuuuugauacauaugcagcuagagacacgagcuccgggguacugguuaguucauaucguuguuccaccuauaggguggcagaccccuucagcuccuuggguacuuucucuagcuucuugauuuucuuguguuuugcaaauuguaucuuggguauucuauguuuuugggcuaauaucuauccacuuaucagugaguguguaucuaauaacuucuuuugugauuggguuaccuaacuaaggaugauauacuccaguuaccuccauuugucccagaauuucauaaauucauuguuuuuaauagcugaguaguacuccauuguauaaauguaccacauuuucuguauccauuccucuguugaggggcauagaaacuuaggcuuuacuauaugcuucugaguuuuugguugaacaguuucuuaccaugcaauucaacugaguaguuagugaugcugaaaauuguagaaaguauugguauccauauaauucagacgggacuaaaucaguagguaugcacaaggcuuuauagucuuaaccaggcaauauggacaagaauuuccuugccaggcuuccgggcaugacacaguauccugagugaguagguucuugagucagucugaacuggcaagcccauagagacuagggaguauaaagccagccuuggcuuuucagcacuggugcaugaauugcacagccaggcucauuuaaacaggacucagaguuguagccaguuguuguaucucacacagaacuuuuucuaucuuuuacagguugugggcugcacacugcagaaagauacaacugaaaaagggucagcauccucccaucuaaccucauuaucagcccccaaacgucuguuguccucauuuguuuuagaauagaaacuggaugaaguuuugguucuucugauuugauuuuuacuuagcaaaucaguuuaaaugaacugugucuguugaucugcagugaagugaacuggacggagcgagucagagagaagcagaaguggggcugaaauguggcaccaaguguuuaagcucuugggggugggaggugauuuuuuuuuucuccacaggaguguuguauacuucaguaaaggcagccagucaaggauguuccagagguaguggggaagaaugucuuguuaauugugaugaucauuucccaucucccuggauucauuggcugcgugcuguuaucuuuacucagacggcuccucuaaccauguuuacaacuaucaacccugugaccauccacggcagccuugugacaguucgugcccuugugugauagcacaaaauuuuugugaaaaguuuugucaauguaguucagaguguaaguauuuguugcuuuggugcaauugcaugagaacugaauaggcuuuuggucagcagcugaaaauggugguuuaaaucaagacauaaggacugggagugcucuuauugcuugcuuuaggaaagcugcuuauuuuacaaguauuucuugagcccuguacugugcuaaugucuagucagccucuugggcaaugugacuguguaugcucaugcacaaguuaggcaguuguaguaauggauuggauuuuucuguuuuuccucuuuggucauuugaaguacaguaaagaggcauagacuguaaggcgaaucuagaaguagcuacccacuccuuuugugggugucagaaauagugagaguuaaguggguuuugguuuucagaaugaagggaaguagguaagggcgcaguagguuuucauaaucacuuaagaaagcuguacagaguguggauaccaaagaauggauuagaaauaugcuuuauuauagugguucucaaccuuccuaaugcugugacccuuuaauacaguucauauuguggugacccccaucuguaaaaugauuuuuguuaaaugauuucauaauuuugcuacaguuaugaaucauaauguauaugcauuuggagggauguuuugccaacgggguuaagacccacagguugagaaccgcagguuuacuggcaugauuuagggucauggauaccauucaguccaagacuucccuuuaccugauuaauuaaccguagggcuuuaaauccaugugcuauuuaacaaauaugaaauggacagcaaaaccagcagugaucuuucucaguccuaucagcuucauguuugugguuuccugcuuccuuguuacgauggaauaguaaggaaaggugguaaggguuuaagugagugacucgugugcucagcaagaccuugacugccuuccuggaaaggauguggaugaugagggugauucuuggguaugguggugaugauacauuuaucccuaaaggucaaaaccgcuuuccuggaugucggugcaaagcacaaugcaacaccaaacaguguccaugcuaccuggcuguccgagagugugacccugaccucugucucacguguggagcugcugaccauugggacaguaaaaauguauccuguaagaacuguagcauucagcggggcucuaaaaagguaaauaacaguuauaucuggaaacuuuguugguuuuaugucacugucuuguguuaaguucugcugucuucagacuuacucuguagcugaaaacgaacuugaauuucugacccuccugccucuaccucuaccuccggagugcuggaguacagguagguacaugccugauuuuauauggugcuguggaguaaacccagggcuuggugcaugcuagguaagcacacuaccagcaacuagacuucauccucauccuccagaagauggauguuuacugauagucucagagauucucucugggaacaaauaaaagugacucuuaaaugugcgugaugaaagcaaaguagucaaucaaguauugucuggauauugcaggagugugucucucagauuuaaguucugaucauuuauuauccuuuuuuuuuuugaauuaauuuuuuuauuagguauuuuccucauuuacauuuccaaugcuauccaaaaaguccccaauacacaccccccccacuccccuacccacccacucccacuuuuuggcccuggcguuccccuguacuggggcauauaaaguuugcaaguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacauucucuagauccuccauugggggcccugugauccauccaauagcugacugugagcauccacuucuguguuugcuaggcccuggcauagucucacaagagacagcuauaucuggguccuuucagcaaaaucuugcuaguguaugcaauggugucagcauuuggaagcugauuaugugauggaucccuggauauggcagucuuuagaugguccauccuuucgucacagcuccaaacuuuaucucuuuaacucuuuccauggguguuuuguucccaauucuaagaagagacacaguguccacacuuuggucuucguucuucuugagguucauguguuuaacaaauuguaucuuauaucuuggguauccuaaguuuuugggcuaauauccacuuaucagugaguacauauugugugaguuccuuugugauuggguuaccucacucaggaugaugcccuccagguccauccauuugccuagaaauuucauaaauucauuccuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccgguugggacaucuucuggauauaugcccaggagagguauugcuggaucuuccgguaguauuauguccaauuuucugaggaaccgccaaacugauuuccagagugguuguacaagcuugcaucccaccaacaaugaaggaguguuccucuuucuccacauccucgccagcaucugcugucaccugaauuuuugaucuuagccauucugacuggugugagauagaaucucaggguuguuuugaguugcauuucccugaugauuaaggauguugaacauuuuuucaggugcuucucugccauucaguauuccucaggucagaauucuuuguucaguucugagccccauuuuuuaaugagguuauuugauuuuucugggguccacccucuugaguucuuuauauauauuggauauuaguccccuaucugauuuaggauagguaaagauccuuucccaaucuguugguggucuuuuugucuuguugacggugucuuuugccuugcagaagcuuugcaacuuuaugaggucccauuuaucgauucucaaucuuacagcacaagccauugcuguucuauucaggaauuuuuccccuguacccauaucuucgaggcuuuucccuacuuucuccucuguaaguuucagugucucugguuuuaugugaaguuccuugauccacuuagauuugaccuuaguacaaggagauaggaauggaucaauucgcauucuucuacaugauaaccgccaguugugccagcaccauuuguugaaaaugcugucuuucuuccacuggaugguuuuagcucccuugucaaagaucaagugaccauagguguguggguucaucucagggucuucaauucuguuccauuggucuacuugucugucgcuauaccaguaccaugcaguuuuuaucacaauugcucuguaguaaagcuuuaggucaggcauggugucauuuauuauucuuaaagacuuauuuuuggcuggccucagacuucuaaguaaaagcucgcagugaagauagucuaccucuuuuggcguucuguuccugccguuucucuuuggcuuccuucauucucuuggccaaauguucagcauguucuucagacuucccuuuguuuuucuuuucuuuuuaauuuuuuuuuauuacguauuuuccucaauuacauuuccaaugcuaucccaaaagucccccauacccacccccaacucuccuacccacccauucccacuuuuuggcccuggcguuccccuguacuggagcauauacaguuugcguguccaaugggccucucuuuccagugauggccgacuaggccaucuuuugauucauaugcagcuagagucaagagcuccgggguacugguuaguucauaauguuguugcaccuacaggguugcagaucccuuuagcuccuuggguacuuucucuagcuccuccauugggagcccugugauccauccaauagcugacugugagcauccacuucuguguuugcuaggcccuggcauagucucacaagagacagcuacaucuggguccuuucaacaaaaucuugcuaguguaugcaauggugucagcguuuggaggcugauuaugggauggcucccuggauauggcggucucuagaugguccauccuuuugucugagcuccaaacuuugucucuguaacuccuuccaugggugauuguuuccaauucuaagaaggcacaaaguguccacuucuucaguuucauguguuuuacaaauugucuguuauaucucggguauacuaaguuucugggcuaauaucuacuuaucagugaguacauaucauuugaguucuuuugugauuguguuaucucacucaggaugaugcccuccagguccaaccauuugccuaggaauuucauaaauucauuccuuuuaauagcugaguaguacuccauuguguaaauguaccacauuuucuguauccauuccucuguugaggggcaucuggguucuuuccagcuucuggcuauuauacauaaggcugcuaugaacauaguggagcaugugucuuucuuaccgguugggacaucuucuggauauaugcccaggaucucuuuguuuuucuuagugugcuauuucgucagagcuguauagugguguuggaauuguacaacaacacauggagugacaguaucuccaccacugauucaggcuacauaauccugcuguacacucagagcaccaacaguacuucugugguuaugaacuucugggauguauaaaguuagcauucaucaucuccuuccgugacuuucugacagcugguggcuagagagcagauauucagcuuugucuuaacacacugacacaccuaggaggugccacaaaaagaccuaaugcaaucuuaaauuuucuauaaaauaagugccguaauuacuggguaguaagauaaacccaggguucugagaaguagccauuaauguuaucagacuugaaauaggaauuauuuuaaaaguuggcucaauuuuuuguuuuuguuuuguuccacaacgagguugugucuccucaauagaaaaaaaagaugcugauuuguauucugauacgcugauacaaauguacuuucucauggugguuuuuaaaggaugcuuucuauguacaguacaagaugcaauuuccuccagcaacguucuauaggcuuuguucuuguucuuuagcgaccuuuaaaacaggccaggugugugguacaugccuguguuaccagaacucuagagacuuagugaggucggagcauauaugugaacuguaucacaagacaguucccuaccaaccucaaagccuuaaaaugaaccaccuagcaguuauguauuugaagccugcgaauugcacauaggugauuuuaaauguagcagccagggaguaaucacuaagcaaaagacaccagaugauucaguaucuuuaacuaauccuuuuaguaacaauaguuauauuauuaacugucuaauguagaaacacgguuugaaugcuuacugcauauuacaaguaaggaaacccagauucacaugacacacuaucugaugagauggcucacaugguacaaguagacaacuaacuccuuaaggugccuuccauaccuguaucauagcaugccaugaauuguuuuuaaaaagaaauugcaaguaauggagcaagaaacacaaucuggggucuugcugucccugcccuccccauacuaccacuucugcccugugggcaguguaggcacaucucaugagcuaucacauaguugauagcacccuauuauuuuuauuuuuaaagguauauuuauauguguaugaguguuuuaccuguauguaugugcacuuaauacaugucugauacccacaguuuagaagaggguauuaaauucccuggaacuagauuuacagaugguuguuagcacuguaugagaacuaaacccagguccuuuucgggaguggcuagugccuuuaaucaucucuccagccucaucacucuacuguagacccucuuugaaauucugccuuagguggaacuuucagcuucucguggcuuucuuuuuucuucccugucucuuugaaccaccacuguucauggaaaaucugaucuagauuagcugagcucucgaaucauuuuacuuuagguggcugcauauucauuuaggucaucagaccccugcuucaguuuccuuuggcauauuugcugagaccuacaucucgucuguauccugaagccauauuugccacuguaggaucuauguucccuuccuuccgcuuguucacagagugggcaggaaugcucaugcugacgugccuucucuguggcauauuuuagcucucagaaauagaacacugugcauauaguucuuagcacuugcuuguucccauuguuuagcuaauuuuguuuccgaucaggagggugauugggaaguuuacuugacaagaguggcucagaaaagcuuggaugaccuuuaaagaucacaagaauggucuugagugaagcaugauaaagauccaugaugaagaguuacuauguugccaaguaguggcggcacacaccuuuaauccuaguacucaggagucagagccaauuucugugaauuugagaccagccagugaauuccaggacagccagaacuacacagagacacucuaucacgaaagacacacagacaaaacaaaacaaaaaucuaaguaaaaaagaaaaguuaucauauuugguccuugucaucuuggccuucuguaggauugaugaaucaucauauccuucauaauaaggauguuuuuuguguuaucaugagaaguuucuagaggaaagcuguggaggaaauggcagggucuuuagaggaauaaauaccaguaaagaacuagaaugugcuaagggcucuaacaaauaaaagaauguacuuugggaaacagaaacgucgaggggagagugguugguaugcucaccuucaguugguuucaguauguugggaugcccauguuuaagggcauagugacaugggccucauagugacaggucuuaaaacuaagaguaaagaaagaucuugcugugcaagccugacauucauaugaucagcagccccauuagaaaccaaguguggucauguacuaauaaccucaguguuggaggucuggcugugggacagacugcuaggccugggacuucacugccagccagucuaacugaaacgaaacagcuccagauucagggaaggagacccugucuccaaagaaguagaguggcgagcauagaucugguaccugaaguugcugacugaccugcacaugugcucacacauguauacacuauacauacacauacaaaaaugaaauguugagaaaaacuguaaagaagauaagauuuuggcuguugguuucagcacauggucacuugcuucucuugcuccuggccuggccugugcauagugaggcagagagcauguggugggcaauaguagcucaauccacagcacacaggaggcagagggaacccaggaaggcucaagaacaagagauacauugucaggaacgacuucgucccacucccacucacugagugcaucaccucccaguaaugccaacaaauugagucugucaugagaccgcucuucaguuguucauagccucacaauucaguugccucuugggggucaguccacaagcuggggcaccugagccuuuuggagggugaugacugaaagugaguuccaggacaagauggaacagaagugagagaagcugauccacacgucucccuugcugcaguaccaugaccucagauggagaggcuugcuugucuuuccuguaagaggaucuuuaucuugaauuuuccuuagaaauauuacuuuaauaguuuuccagacacucagcaacuuuuuuuauaucugucagauacacuugggggucuagugauuccccucagguggucugagguuuaacucugcuaacuugcgaucaguucuaaugugacugcuuacucucuagcacuuacugcuggcaccgucugauguggcaggcuggggcaucuuuaucaaagauccuguacagaaaaaugaauucaucucagaauacuguggggagguaagacauacucgugcauuccaguugacuuguuuauaguagcagcuugcauuguuuuggauagauuucacuggacaaggccaaguuuagaauagauuaauaauaaaugaccuuuagccugaacuuauuuguauuagaaguuuugguuuacauaguaacuagcaagauuacuuuuaguucuagucauguuuggcuuuuauuaccuggagaacaagggguucgggaucaagaguuuugcuguguauauuugcuccuacuuacuuggccagugagcugauggggacccugagacaauauuuuuauuaguuuggcuguuuuaguuguagggcuaggaaaaaacaaagcuuuagaaagucacaguuuacauuuuuuacucagcagaaagacaauauuauugucacuuucucuagacauguugcuuaggacauagaaaucucucugauuuggaguucuuaaaaguguuauuuggacuggugugacaguucagugggugaaggcaccugcugcagaguugaugaccugaguuuaaucucaggacacacaugguggaaagagaguaauaccucccacaagguguccuugcgugcacaagcacuuucccccauaacuucuuuacuguauaucugcuaaauagagaagacaauuuagcuacucuuugauagccuugagggaccaaaauucucuuaauuggcuuuuuuguguucuaacagucuugaccacuuacuccaguacaaucuccuccugugucuuccuuauagauuauuucucaggaugaagcagacagaagaggaaaaguguaugacaaauacaugugcagcuuucuguucaacuugaacaaugguauguucugagcuguaaggcaagguuuucaaauuagaggucagcaagauuccagaaccaagggcacgugucugcaagaacagcuccugguauuuaccagcaggccuagcuucagggguguguugcucacuuguaaggagaggggaagucccagugagcagaaaggcuguguacaggaaacaaucuagagucccaaccacuugcagaugggccugccucaugcucuggcuaugaguggacauugucucccacugcuguggcuugccucauguccccuggaacuugugggcugaguaguuucuguccaccucuucagugucugaccugagagguugagcauuuugaaagcaucuuguggccugaugauguugccauauauugugagaaaagcagcagcugcugcagccugugucuguggagggcccuguguaagugggugugcucacacacauccagacaaacuuucagcuggaccaaaaaaaaaccuuuuuuuuuucuuuuuugaaaauguuccauagaaauauuauaauaucaaaugucaacaugcccaccucuugaugcccagagaaauuuggcuagauuacaucuuuuaagccauguuuugcucagcaguauauaacugaaaaaucauggcguuuaagagcuauauuuaacaaccaaggauucacuuuaaucuagaagagcauuuucuuccaaaugacauuuuuuuauauuggaugaaguugaaugcuuuauuuccuuaagucgaauccugaggaaguauauuucuaaagccauaauaaccuuggucuaugacugaaaauaagucacuggauuaucuauguuuuucacuuuagauuuugugguggaugcaacccgaaagggcaacaaaauucguuuugcuaaucauucaguaaauccaaacugcuaugcaaaagguaagcuuuuaaguuggaauugacaguuugaugcaacaguuccauuuuuccagccaagugacagcaaacuucaguaccucuggaguacuuacgugaaacaguuaguuaaccucuauggccugucuuccugcucacugcugccaauguuucucuuugcaguuaugaugguuaauggugaccacaggauaggcaucuuugcuaagagggcuauccagacuggugaagaguuguuuuuugauuacagguugguaaaauacacaaagguuuucccuucugaaacuauggggcuugggucaaaggcuguuuguaaguuuuuugacaggucugccaucauuggagggugcauucuuuuaacugaccagucacuauuugcugugggcacuaguagagaguuauauguuuccucagugaaguucucauguauuaauuauacaauguugauuugaaaaaaauuaacaaaaccuaugcagaaagcugcaucuagcacccugcuauugauauaacugacagagaccccuggggcuuaaucuaugcguacacaucuguauucuacagcaccuucucauuggugcagcauauauaucuuuauugguagaacauuuacaucuucauuguuuuaauuguuaacaucacccuguggucacuggguucuuucuaaggaagcuacucacaaccauugacuguguucaacuccauuggaaggaucaggcuggcaguguggauuuauucauagagccaccuggcucuguggaaccaaacagucauuuaaaugugauccaguaaagaguauuaguuaaagaauccuuauaguuuaauauccauucuacccagaaacuuaaguuguugaaauggggcggggggaaccucgcuauguguaaccaguuuuagcugcauagcuagagagaaccaacugaaaccuguggaacuggaauaggauccuguggcuuuaucccaugcuuguucuaaauggccaggguuagaagcaaaccuguccagcuucucuaguagugggacccucaagagccugucuugguaucuuucugagucagcacucucaaugggggguuauucuuuggcauuagcauucuuuacaagucaugguuuugcuuuuguagcauuagacccagacaugacaguguggaguugccauucagagcagcgugcugcaggggcacagggaggguguggggaaugcuucuagcacaggcuauuauaacuagcagguagguuaccagugacagaugcaugccuccccuucauguaugcagcugucuauguaaagccagucggguguguguauguuagagacauaauucacucuaucagcaggcuugguuuuccugauguuggauagguugucacuucuuguucauauuguuucagauacagccaggcugaugcccugaaguaugugggcaucgaacgagaaauggaaaucccuugacaucuacuaccucuuccccuucucucugaaacagcugccuuagcuucaggaaccuugaguacugugggcaauuuagaaaacggaaaugcaguuugaaauucugaauuugcaaaguacuguaacaguaauuuauaguaauguuuuaaaaucaacuuuuuauugccuucucaccagcugcaaaguguuuuguaccagugaguuuuugcaauaaugcaguaugguacauuuuucaaauuugaauaaagaauacuugaacuuguu

SEQ ID NO: 12114 - RNA, 1765 nt, Mus musculus
aaaugauauaaaucuggagggauuuuucacacagccuaucuuuuuaggugugccuuucccauauuuuauuaaacucgaguuguuguuuuaaaaaacagcagcauuaucaaagacacaucuguacaaacauuuuacaaaagagaacucucuaggaucagcuacaucaaggacaagcagaaaaauagaugcaguccaacaaagacauugaaaaugacuucagacguuggaaaugccuuuucuuauacaaacgauggcagaugaacacugcgcaggaucaauuagugagugaacugcucuuccuuuccugaagguugggaggcagggagcgaaugggucaccaacaacccggauagccaaaucgccgcuuucccauuucaaaccguuuaagucuuuggguagauucaagucgcugggaaacaagugggcugccuggcacuagcuucuuaaccaagcuaucuagccuuugcuuaacucucccggucagguuuccagugacuagacaaggaauuucagaaaugcguccuuaaaaaaccaagggcgagggaggugaccugagcucagcaucuagagaacuuguuuguggagagagaaggaagaggucaaagcugggaggaaaauuaccuccugacugagaauuaacaggccaacccaucuggucugaggugccgaggaagucggggcauccuacaggaaaccuacaagcuagguucgcuucucaucucccccagcuccuuaagcuccaccuuuuuguauuugcccgacuuccuccguuuggugaccaccaagaccaccacaccagccacuaccgcuaccgagacgacagcgaugacggcaaugacgccggcggugaggcgcuucauggagaacugggggggcuucucguccagguaguagaugagcguccgcuccacaugcagggguuccccacgcaccugcacguccaggccgcggcggcccaugaacagugacucgccuuuaaugucccuuucgaaguaguaggcggcaucagcgauguccacgucucucaagcccuucugcgacgcguucugccgaagcucuaucugaauggugggcuccucauaguguaccgcggauaggaagcuggggugcagcuuguagcguucuuggaagagccgccgcagcucggagucuaggucagagugguugaaggcucggucggucgggcgguggcgcaacucaaugaggaugugguggguucgcaccacuucgucgcagcgcaggcuuuggucucccuuguccgugcggcgcacgcccaccgaguuuacgcaccagcacaccgaggucugguugcacuggcgcgccuugaagcggcccuugucgucacacuccgggucguagaggccaucguuguccaguaucgcgugcucgcucggcaucaccaggcugcggccgcucuuccgggcgcucaugcgcgccuugagcagcaggcacuuggaaguuagcguggagcagucgaccaauaccugugagcccauugcccgacauuggcagaccccgccugggccauuugugucgcagaccgucaucuuguugguggggcauguacaguugcucugagccgugcaaaagcgggucgccaucgccagcaguagcaguagcagcggugcuagauccaagccccucgccauggugggguggaguagaauggaccuccaacuacagaccagaggcagggauucugaaggaucaggcuggguaggacacugcaggcgacuccugccgggcuuuucccuccagcucuuau
